US008781750B2

(12) United States Patent
Stuart et al.

(10) Patent No.: US 8,781,750 B2
(45) Date of Patent: Jul. 15, 2014

(54) CELL-TYPE-SPECIFIC PATTERNS OF GENE EXPRESSION

(75) Inventors: Robert O. Stuart, San Diego, CA (US); Elizabeth Duff Stuart, legal representative, San Diego, CA (US); William Wachsman, San Diego, CA (US); Daniel Mercola, Rancho Santa Fe, CA (US); Michael McClelland, Encinitas, CA (US); Jessica Wang-Rodriguez, San Diego, CA (US); David Tarin, San Diego, CA (US); Charles C. Berry, San Diego, CA (US); Karen Arden, San Diego, CA (US); Linda Wasserman, La Jolla, CA (US); Steven Goodison, Jacksonville, FL (US); Igor Klacansky, San Diego, CA (US)

(73) Assignees: The Regents of the University of California, Oakland, CA (US); Sidney Kimmel Cancer Center, San Diego, CA (US); Ludwig Institute for Cancer Research, New York, NY (US)

( * ) Notice: Subject to any disclaimer, the term of this patent is extended or adjusted under 35 U.S.C. 154(b) by 1747 days.

(21) Appl. No.: 11/033,056

(22) Filed: Jan. 10, 2005

(65) Prior Publication Data
US 2006/0292572 A1    Dec. 28, 2006

Related U.S. Application Data

(60) Provisional application No. 60/535,382, filed on Jan. 9, 2004, provisional application No. 60/536,163, filed on Jan. 12, 2004.

(51) Int. Cl.
*G01N 33/48* (2006.01)
*C12Q 1/00* (2006.01)

(52) U.S. Cl.
USPC ................................................. 702/19; 435/4

(58) Field of Classification Search
None
See application file for complete search history.

(56) References Cited

U.S. PATENT DOCUMENTS

2006/0172347 A1* 8/2006 Mellor et al. ................. 435/7.23

FOREIGN PATENT DOCUMENTS

| DE | 10159404 | 6/2003 |
|---|---|---|
| WO | 2005/028677 | 3/2005 |
| WO | WO 2005/068664 | 7/2005 |

OTHER PUBLICATIONS

Naughteon et al., "Scatter Factor-Hepatocyte Growth Factor Elevation in the Serum of Patients With Prostate Cancer," vol. 165, pp. 1325-1328 (2001).*
Cazares et al., "Normal, Benign, Preneoplastic, and Malignant Prostate Cells Have Distinct Protein Expression Profiles Resolved by Surface Enhanced Laser Desorption/Ionization Mass Spectrometry," (Clinical Cancer Research, vol. 8 (2002) pp. 2541-2552).*
Xu et al. "Identification of Differentially Expressed Genes in Human Prostate Cancer Using Subtraction and Microarray," (Cancer Research, vol. 60 (2000) p. 1677-1682).*
Xiao et al. teach "Qauntitation of Serum Prostate-specific Membrane Antigen by a Novel Protein Biochip Immunoassay Discriminates Benign from Malignant Prostate Disease," Cancer Res. vol. 61 (2001) 6029-6033.*
Peng Lu et al.: "Expression deconvolution: A reinterpretation of DNA microarray data reveals dynamic changes in cell populations"; Proceedings of the National academy of Sciences of the United States of America, vol. 100, No. 18; Sep. 2, 2003; pp. 10370-10375.
D. Venet et al.: "Separation of samples into their constituents using gene expression data"; Bioinformatics 2001; vol. 17, suppl. 1; 2001; pp. S279-S287.
Jennifer Tuxhorn, et al.: "Reactive stroma in human prostate cancer: induction of myofibroblast phenotype and extracellular matrix remodeling"; Clinical Cancer Research: An Official Journal of the American Association for Cancer Research Sep. 2002, vol. 8, No. 9; Sep. 2002; pp. 2912-2923.
D. Singh, et al: "Gene expression of clinical prostate concer behavious"; Cancel Cell, US, vol. 1; Mar. 2002; pp. 203-209.
S. Bhattacharya, et al.: "Overcoming confounded controls in the analysis of gene expression data from microarray experiments"; Applied Bioinformatics, Open Mind Journals, Auckland, NZ, vol. 2, No. 4; 2003; pp. 197-208.
Debashis Ghosh: "Mixture models for assessing differential expression in complex tissues using microarray data"; Bioinformatics (Ocford), vol. 20, No. 11; Jul. 22, 2004; pp. 1663-1669.
Robert O. Stuart, et al.: "In silico dissection of cell-type-associated patterns of gene expression in prostate cancer"; Proceedings of the National Academy of Sciences of the United States of America, vol. 101, No. 2; Jan. 13, 2004; pp. 615-620.
Atschul et al., "Basic Local Alignment Search Tool," *J. Molec. Biol.* 215:403-410, 1990.
Bibikova et al., Expression signatures that correlated with Gleason score and relapse in prostate cancer, *Genomics* 89(6): 666-72, 2007.
Chuang et al., "Specific and heritable genetic interference by double-stranded RNA in *Arabidopsis thaliana*," *Proc. Natl. Acad. Sci. U.S.A.* 97:4985, 2000.
Devereux et al., "A comprehensive set of sequence analysis programs for the VAX," *Nucl. Acids Res.* 12(I):387, 1984.
Efron et al., "Empirical Bayes Analysis of a Microarray Experiment," *J. Am. Stat. Assoc.* 96, 1151-1160, 2001.
Evans et al., "Design of nonpeptidal ligands for a peptide receptor: cholecystokinin antagonists," *J. Med. Chem.* 30:1229, 1987.
Fauchere, "Elements for the Rational Design of Peptide Drugs," *J. Adv. Drug Res.* 15:29, 1986.

(Continued)

*Primary Examiner* — Anna Skibinsky
(74) *Attorney, Agent, or Firm* — Fish & Richardson P.C.

(57) ABSTRACT

Among the methods, compositions, combinations and kits provided herein are those for determining gene expression levels in one or more cell types in heterogeneous cell samples, for identifying genes differentially expressed in different cell types, and for detecting a cell type in a sample from a subject. Also provided herein are methods, compositions, combinations and kits for determining gene expression levels in cells corresponding to phenotypes, and for identifying a phenotype of a subject by detecting differentially expressed genes.

4 Claims, 4 Drawing Sheets

(56) References Cited

OTHER PUBLICATIONS

Febbo and Sellers, "Use of expression analysis to predict outcome after radical prostatectomy" *J. Urol.* 170(6 Pt 2):S11-9, 2003.
Gante, "Peptidomimetics-Tailored Enzyme Inhibitors," Angew. Chem. Int. Ed. Engl., 33:1699-1720, 1994.
Goldspiel et al., "Human gene therapy," *Clin. Pharm.* 12:488-505, 1993.
Gribskov et al., "Sigma factors from *E.coli, subtilis*, phange SP01, and phage T4 are homologous proteins," *Nucl. Acids Res.* 14:6745, 1986.
Howe et al., "Annual report to the nation on the status of cancer (1973 through 1998), featuring cancers with recent increasing trends," *J. Natl. Cancer Inst.* 93, 824-842, 2001.
Ihaka and Gentleman, "R: A language for data analysis and graphics," *J. Computat. Graph. Stat.* 5:299-314, 1996.
Kononen et al., "Tissue microarrays for high-throughput molecular profiling of tumor specimens," *Nat. Med.* 4(7):844-7, 1998.
Kozak, "Structural features in Eukaryotic mRNAs that modulate the initiation of translation," *J. Biol. Chem.* 266:19867-19870, 1991.
Lander, "The new genomics: global views of biology," *Science* 274:536-539 1996.
Li and Wong, "Model-based analysis of oligonucleotide arrays: expression index computation and outlier detection," *Proc. Natl. Acad. Sci. U.S.A.* 98, 31-36, 2001.
Liang and Zeger, "Longitudinal data analysis using generalized linear models," *Biometrika* 73:13-22, 1986.
Luthman and Hacksell, "Bioactive Ether-linked Phospholipids: Platelet-activating Factor (PAF) and Analogs," Chapter 15 in *A Textbook of Drug Design and Development*, Krogsgaard-Lars, 2nd Ed., Harwood Academic Publishers (1996) pp. 386-406.
Morgan and Anderson, "Human gene therapy," *Ann. Rev. Biochem.* 62:191-217, 1993.
Mulligan, "The basic science of gene therapy," *Science* 260:926-932, 1993.
Needleman et al., "A general method applicable to the search for similarities in the amino acid sequence of two proteins," *J. Mol. Biol.* 48:443, 1970.
Pearson et al., "Improved tools for biological sequence comparison," *Proc. Natl. Acad. Sci. U.S.A.* 85:2444, 1988.
Robinson, "Gene therapy—proceeding from laboratory to clinic," *TIBECH* 11 (5):155-215, 1993.
Sagliocco et al., "Identification of proteins of the yeast protein map using genetically manipulated strains and peptide-mass fingerprinteg," *Yeast* 12:1519-1533, 1996.
Schwartz and Dayhoff, eds., *Atlas of Protein Sequence and Structure*, National Biomedical Research Foundation (1979) pp. 353-358.
Shevchenko et al., "Linking genome and proteome by mass spectrometry: Large-scale identification of yeast proteins from two dimensional gels," *Proc. Natl. Acad. Sci. U.S.A.* 93:1440-1445, 1996.
Smith and Waterman, "Comparison of biosequences," *Adv. Appl. Math.* 2:482, 1981.
Stephenson et al., "Integration of gene expression profiling and clinical variables to predict prostate carcinoma recurrence after radial prostatectomy," *Cancer* 104(2):209-8, 2005.
Stuart et al., "In silico dissection of cell-type-associated patterns of gene expression in prostate cancer" *Proc. Natl. Acad. Sci. U.S.A.* 101(2):615-20, 2004.
Tibshirani et al., "Diagnosis of multiple cancer types by shrunken centroids of gene expression," *Proc. Natl. Acad. Sci. U.S.A.* 99, 6567-6572, 2002.
Tolstoshev, "Gene therapy, concepts, current trials and future directions," *Ann. Rev. Pharmacol. Toxicol.* 32:573-596, 1993.
Tusher et al., "Significance analysis of microarrays applied to the ionizing radiation response," *Proc. Natl. Acad. Sci. U.S.A.* 98(9):5116-21, 2001.
Veber and Freidinger, "The design of metabolically-stable peptide analogs," *Trends Neurosci.* 8:392, 1985.
Warnat et al., "Cross-platform analysis of cancer microarray data improves gene expression based classification of phenotypes," *BMC Bioinformatics* 6:265, 2005.
Wu and Wu, "Delivery systems for gene therapy," *Biotherapy* 3:87-95, 1991.
Zeger and Liang, "Longitudinal data analysis for discrete and continuous outcomes," *Biometrics* 42:121-130, 1986.
International Preliminary Report on Patentability and Written Opinion dated Jan. 10, 2006, for PCT/US2005/000564, filed on Jan. 7, 2005, published as WO 2005/068664, and entitled "Cell-Type-Specific Patterns of Gene Expression" (12 pages).
Carillo and Lipman, "The Multiple Sequence Alignment Problem in Biology," *Siam J. Appl. Math.*, 48(5):1073-1082 (1988).
Nair et al., "Rival penalized competitive learning (RPCL): a topology-determining algorithm for analyzing gene expression data," *Comput. Biol. Chem.*, 27(6): 565-574 (2003).
Pavlova et al., "Evolution of gene expression patterns in a model of branching morphogenesis," *M. J. Physiol.*, 277 (Renal Physiol. 46): F650-F653 (1999).
Prakash et al., "Symptomatic and asymptomatic benign prostatic hyperplasia: Molecular differentiation by using microarrays," *Proc. Natl. Acad. Sci. U.S.A.*, 99(11):7598-7603 (2002).
Stuart et al., "Changes in gene expression patterns in the ureteric bud and metanephric mesenchyme in models of kidney development," *Kidney Int.*, 64:1997-2008 (2003).
Stuart et al., "Changes in global gene expression patterns during development and maturation of the rat kidney," *Proc. Natl. Acad. Sci. U.S.A.*, 98(10):5649-5654 (2001).
Stuart et al., "In silico dissection of cell-type associated patterns of gene expression in prostate cancer," in *Proceedings of the American Association of Cancer Research*, 2003, vol. 44, abstract No. 3210.
Stuart, "Novel Approaches to DNA Array Data Analysis: Gene Expression Profiling in the Developing Rat Kidney [P-19]," Small Talk 2001, The microfluidics, microarrays and BioMEMS Conference and Exhibition, Final Conference Progam, San Diego, California, Aug. 27-31, 2001, p. 60.

\* cited by examiner

**Agreement Analysis of Pathologists' Percent Estimates
by Calculation of Pearson Correlation Coefficients**

CELL-TYPE-SPECIFIC PATTERNS OF GENE EXPRESSION

CROSS REFERENCE TO RELATED APPLICATIONS

This application claims priority under 35 U.S.C. §119 from Provisional Application Ser. No. 60/535,382, filed Jan. 9, 2004, and Provisional Application Ser. No. 60/536,163, filed Jan. 12, 2004. The disclosures of these applications are incorporated herein by reference.

STATEMENT AS TO FEDERALLY SPONSORED RESEARCH

This invention was made with government support under CA84998 awarded by National Institute of Health. The government has certain rights in the invention.

SEQUENCE LISTING

The instant application contains a Sequence Listing, which is submitted herewith via CD-R in lieu of a printed copy, and is hereby incorporated by reference in its entirety. Said CD-R, recorded on Aug. 9, 2006, are labeled CRF, "Copy 1" and "Copy 2", respectively, and each contains only one identical 297 MB file (15677301.APP).

ELECTRONIC FILE APPENDIX

Submitted herewith in computer readable form are table appendices and a sequence listing. The table appendices are contained in a compact disc, and are listed under the filenames "Table 2.txt" "Table 8.txt" "Table 15.txt" and "Table 16.txt", which were created Jan. 10, 2005, and are 863 kb, 426 kb, 510 kb, and 1,583 kb, respectively, in size. An electronic version on compact disc (CD-R) of a computer-readable form of the Sequence Listing and Tables is filed herewith in duplicate (labeled Copy 1 and Copy 2) along with a third CD-R, labeled computer-readable form. The computer-readable files on each of the aforementioned compact discs originally created on Jan. 10, 2005, and created for resubmission on Nov. 30, 2005, are identical. The Sequence Listing is 237,457 kilobytes in size and is entitled 15670-073SEQ001.txt. Table 2 is 863 kilobytes in size and entitled Table 2.txt. Table 8 is 426 kilobytes in size and entitled Table 8.txt. Table 15 is 510 kilobytes in size and entitled Table 15.txt. Table 16 is 1,583 kilobytes in size and entitled Table 16.txt. All subject matter of the table appendix and sequence listing files on compact disk is incorporated herein by reference.

TECHNICAL FIELD

This invention relates to methods for determining gene expression in cells.

BACKGROUND

Numerous diseases and disorders are the result of specific gene expression in a tissue. For example, prostate cancer is the most common malignancy in men and is the cause of considerable morbidity and mortality (Howe et al., J. Natl. Cancer Inst. 93, 824-842, 2001). There is therefore a major incentive to try to identify genes that could be reliable early diagnostic and prognostic markers and therapeutic targets for such diseases and disorders.

SUMMARY

The methods, compositions, combinations and kits provided herein employ a regression-based approach for identification of cell-type-specific patterns of gene expression in samples containing more than one type of cell. In one example, the methods, compositions, combinations and kits provided herein employ a regression-based approach for identification of cell-type-specific patterns of gene expression in cancer. These methods, compositions, combinations and kits provided herein can be used in the identification of genes that are differentially expressed in malignant versus non-malignant cells and further identify tumor-dependent changes in gene expression of non-malignant cells associated with malignant cells relative to non-malignant cells not associated with malignant cells. The methods, compositions, combinations and kits provided herein also can be used in correlating a phenotype with gene expression in one or more cell types.

Provided herein are methods, compositions, combinations and kits for determining gene expression levels in one or more cell types in heterogeneous cell samples. For example such a method can include determining the relative content of each cell type in two or more related heterogeneous cell samples, wherein at least two of the samples do not contain the same relative content of each cell type; measuring overall levels of one or more gene expression analytes in each sample; determining the regression relationship between the relative content of each cell type and the measured overall levels; and calculating the level of each of the one or more analytes in each cell type according to the regression relationship, wherein gene expression levels correspond to the calculated levels of analytes. For example such a method can include determining the relative content of each cell type in two or more related heterogeneous cell samples, wherein at least two of the samples do not contain the same relative content of each cell type; measuring overall levels of two or more gene expression analytes in each sample; determining the regression relationship between the relative content of each cell type and the measured overall levels; and calculating the level of each of the two or more analytes in each cell type according to the regression relationship, wherein gene expression levels correspond to the calculated levels of analytes. Such methods can further include identifying genes differentially expressed in at least one cell type relative to at least one other cell type. In such methods, the analyte can be selected from a nucleic acid molecule and a protein.

In another embodiment, methods, compositions, combinations and kits are provided for identifying genes differentially expressed in malignant cells relative to non-malignant cells. Such a method can include determining the relative content of each cell type in two or more cell samples of the same tissue or organ, wherein the two or more cell samples include at least a first sample containing malignant cells and a second sample that does not contain the same relative content of each cell type as the first sample; measuring overall expression levels of one or more genes in each sample; determining the regression relationship between the relative content of each cell type and the measured overall levels; calculating the level of each of the one or more genes in each cell type according to the regression relationship; and identifying genes differentially expressed in malignant cells relative to non-malignant cells. Such a method also can include determining the relative content of each cell type in two or more cell samples of the same tissue or organ, wherein the two or more cell samples include at least a first sample containing malignant cells and a second sample that does not contain the same relative content of each cell type as the first sample; measuring overall expression levels of two or more genes in each sample; determining the regression relationship between the relative content of each cell type and the measured overall levels; calculating the level of each of the two or more genes in each cell type according to the regression relationship; and identifying genes differentially expressed in malignant cells relative to non-malignant cells.

Also provided herein are methods, compositions, combinations and kits for characterizing one or more cell types in a subject. For example, such a method can include measuring expression levels of one or more genes in a heterogeneous cell sample from a subject; comparing the measured levels to a plurality of reference expression levels of the one or more genes, wherein the plurality of reference levels are indicative of two or more cell types; and if the measured levels match reference levels indicative of a specific cell type in the sample, identifying a subject as having the specific cell type. In another example, such a method can include measuring expression levels of two or more genes in a heterogeneous cell sample from a subject; comparing the measured levels to a plurality of reference expression levels of the two or more genes, wherein the plurality of reference levels are indicative of two or more cell types; and if the measured levels match reference levels indicative of a specific cell type in the sample, identifying a subject as having the specific cell type. In another embodiment, provided herein are methods, compositions, combinations and kits for characterizing one or more cell types in a subject, by measuring expression levels of one or more genes in a cell sample from a subject; comparing the measured levels to reference expression levels of the one or more genes, wherein the reference expression levels are determined according to the methods provided herein; and if the measured levels match reference levels indicative of a specific cell type in the sample, identifying a subject as having the specific cell type. In another embodiment, provided herein are methods, compositions, combinations and kits for characterizing one or more cell types in a subject, by measuring expression levels of two or more genes in a cell sample from a subject; comparing the measured levels to reference expression levels of the two or more genes, wherein the reference expression levels are determined according to the methods provided herein; and if the measured levels match reference levels indicative of a specific cell type in the sample, identifying a subject as having the specific cell type. In such methods, the specific cell type can be selected from the group consisting of malignant cell and non-malignant cell adjacent to a malignant cell in a subject. Also provided herein are methods for identifying a subject as having malignant cells, by measuring expression levels of one or more genes in a heterogeneous cell sample from a subject; comparing the measured levels to a plurality of reference expression levels of the one or more genes, wherein the plurality of reference levels are indicative of two or more cell types; and if the measured levels match reference levels indicative of in malignant cells in the sample or of non-malignant cells in the sample that had been adjacent to malignant cells in the subject, identifying a subject as having malignant cells. Also provided herein are methods for identifying a subject as having malignant cells, by measuring expression levels of two or more genes in a heterogeneous cell sample from a subject; comparing the measured levels to a plurality of reference expression levels of the two or more genes, wherein the plurality of reference levels are indicative of two or more cell types; and if the measured levels match reference levels indicative of in malignant cells in the sample or of non-malignant cells in the sample that had been adjacent to malignant cells in the subject, identifying a subject as having malignant cells. In another embodiment, provided herein are methods of identifying a subject as having malignant cells, by measuring expression levels of one or more genes in a cell sample from a subject; comparing the measured levels to reference expression levels of the one or more genes, wherein the reference expression levels are determined according to the methods provided herein; and if the measured levels match reference levels indicative of in malignant cells in the sample or of non-malignant cells in the sample that had been adjacent to malignant cells in the subject, identifying a subject as having malignant cells. In another embodiment, provided herein are methods of identifying a subject as having malignant cells, by measuring expression levels of two or more genes in a cell sample from a subject; comparing the measured levels to reference expression levels of the two or more genes, wherein the reference expression levels are determined according to the methods provided herein; and if the measured levels match reference levels indicative of in malignant cells in the sample or of non-malignant cells in the sample that had been adjacent to malignant cells in the subject, identifying a subject as having malignant cells. In another embodiment, provided herein are methods of identifying a subject as having malignant cells, by assaying a cell sample from a subject for non-malignant cells in the sample that had been adjacent to malignant cells in the subject; and if the malignant-cell-adjacent non-malignant cells are present in the sample, identifying a subject as having malignant cells. In such methods the malignant-cell-adjacent non-malignant cells can be stromal cells.

Also provided herein are methods, compositions, combinations and kits for determining gene expression levels in one or more cell types corresponding to two or more phenotypes. For example, such a method can include determining the relative content of each cell type in two or more related heterogeneous cell samples, wherein at least two of the samples do not contain the same relative content of each cell type, and wherein at least two of the samples correspond to different phenotypes; measuring overall levels of one or more gene expression analytes in each sample; determining the regression relationship between the relative content of each cell type for each phenotype and the measured overall levels; and calculating the level of each of the one or more analytes in each cell type for each phenotype according to the regression relationship, wherein gene expression levels in each cell type for each phenotype correspond to the calculated levels of analytes. In another example, such a method can include determining the relative content of each cell type in two or more related heterogeneous cell samples, wherein at least two of the samples do not contain the same relative content of each cell type, and wherein at least two of the samples correspond to different phenotypes; measuring overall levels of two or more gene expression analytes in each sample; determining the regression relationship between the relative content of each cell type for each phenotype and the measured overall levels; and calculating the level of each of the two or more analytes in each cell type for each phenotype according to the regression relationship, wherein gene expression levels in each cell type for each phenotype correspond to the calculated levels of analytes. Also provided herein are methods, compositions, combinations and kits for identifying a phenotype of a subject. For example, such a method can include measuring expression levels of one or more genes in a cell sample from a subject; comparing the measured levels to reference expression levels of the one or more genes, wherein the reference expression levels are determined according to methods provided herein; and if the measured levels match reference levels indicative of a specific phenotype, identifying a subject as having the specific phenotype. In another example, such a method can include measuring expression levels of two or more genes in a cell sample from a subject; comparing the measured levels to reference expression levels of the two or more genes, wherein the reference expression levels are determined according to methods provided herein; and if the measured levels match reference levels indicative of a specific phenotype, identifying a subject as having the specific phenotype. Also provided are methods wherein the phenotype can be indicative of prognosis of a disease or disorder.

Also provided herein are methods, compositions, combinations and kits for determining gene expression levels in one or more cell types indicative of a disease or disorder. For example, the method can include determining the relative content of each cell type in two or more related heterogeneous cell samples, wherein at least two of the samples do not contain the same relative content of each cell type, and wherein at least one sample is from a subject with a disease or disorder and at least one sample is from a subject without a disease or disorder; measuring overall levels of one or more gene expression analytes in each sample; determining the regression relationship between the relative content of each cell type for both disease and non-disease and the measured overall levels; and calculating the level of each of the one or more analytes in each cell type for both disease and non-disease according to the regression relationship, wherein gene expression levels in each cell type for both disease and non-disease correspond to the calculated levels of analytes. In another example, the method can include determining the relative content of each cell type in two or more related heterogeneous cell samples, wherein at least two of the samples do not contain the same relative content of each cell type, and wherein at least one sample is from a subject with a disease or disorder and at least one sample is from a subject without a disease or disorder; measuring overall levels of two or more gene expression analytes in each sample; determining the regression relationship between the relative content of each cell type for both disease and non-disease and the measured overall levels; and calculating the level of each of the two or more analytes in each cell type for both disease and non-disease according to the regression relationship, wherein gene expression levels in each cell type for both disease and non-disease correspond to the calculated levels of analytes. Also provided are methods of identifying a disease or disorder in a subject by measuring expression levels of one or more genes in a cell sample from a subject; comparing the measured levels to reference expression levels of the one or more genes, wherein the reference expression levels are determined according to methods provided herein; and if the measured levels match reference levels indicative of a specific disease or disorder, identifying a subject as having the specific disease or disorder. Also provided are methods of identifying a disease or disorder in a subject by measuring expression levels of two or more genes in a cell sample from a subject; comparing the measured levels to reference expression levels of the two or more genes, wherein the reference expression levels are determined according to methods provided herein; and if the measured levels match reference levels indicative of a specific disease or disorder, identifying a subject as having the specific disease or disorder. In methods that include determining disease prognosis, the prognosis can be tumor relapse, aggressiveness of tumor, indolence of tumor, survival, or likelihood of successful treatment of tumor. In some embodiments of the methods provided herein, the sample is clinically classified as negative of a tumor, and presence in the sample of non-malignant cells adjacent to malignant cells can be indicative of tumor, tumor relapse, aggressiveness of tumor, indolence of tumor, survival, or likelihood of successful treatment of tumor.

Also provided herein are methods, compositions, combinations and kits for identifying environment-dependent changes in gene expression of a cell type. For example, such a method can include determining the relative content of each cell type in two or more related heterogeneous cell samples, wherein at least two of the samples do not contain the same relative content of each cell type, and wherein cells of the same type that are in different cell environments are separately classified; measuring overall levels of one or more gene expression analytes in each sample; determining the regression relationship between the relative content of each cell classification and the measured overall levels; calculating the level of each of the one or more analytes in each cell classification according to the regression relationship; and identifying genes differentially expressed in separately classified cells of the same type, thereby identifying environment-dependent changes in gene expression of a cell type. In another example, such a method can include determining the relative content of each cell type in two or more related heterogeneous cell samples, wherein at least two of the samples do not contain the same relative content of each cell type, and wherein cells of the same type that are in different cell environments are separately classified; measuring overall levels of two or more gene expression analytes in each sample; determining the regression relationship between the relative content of each cell classification and the measured overall levels; calculating the level of each of the two or more analytes in each cell classification according to the regression relationship; and identifying genes differentially expressed in separately classified cells of the same type, thereby identifying environment-dependent changes in gene expression of a cell type. Another method of identifying tumor-dependent changes in gene expression of a cell type includes determining the relative content of each cell type in two or more related heterogeneous cell samples, wherein at least two of the samples do not contain the same relative content of each cell type, and wherein cells associated with tumor are classified separately from cells of the same type that are not associated with tumor; measuring overall levels of one or more gene expression analytes in each sample; determining the regression relationship between the relative content of each cell classification and the measured overall levels; calculating the level of each of the one or more analytes in each cell classification according to the regression relationship; and identifying genes differentially expressed in cells associated with tumor relative to cells of the same type that are not associated with tumor. Another method of identifying tumor-dependent changes in gene expression of a cell type includes determining the relative content of each cell type in two or more related heterogeneous cell samples, wherein at least two of the samples do not contain the same relative content of each cell type, and wherein cells associated with tumor are classified separately from cells of the same type that are not associated with tumor; measuring overall levels of two or more gene expression analytes in each sample; determining the regression relationship between the relative content of each cell classification and the measured overall levels; calculating the level of each of the two or more analytes in each cell classification according to the regression relationship; and identifying genes differentially expressed in cells associated with tumor relative to cells of the same type that are not associated with tumor.

Also provided herein are methods, compositions, combinations and kits for identifying a phenotype of a subject. For example, a method can include measuring expression levels of one or more genes in a heterogeneous cell sample from a subject; comparing the measured levels to reference expression levels of the one or more genes, wherein the plurality of reference levels are indicative of two or more phenotypes; and if the measured levels match reference levels indicative of a specific phenotype, identifying a subject as having the specific phenotype. In another example, a method can include measuring expression levels of two or more genes in a heterogeneous cell sample from a subject; comparing the measured levels to reference expression levels of the two or more genes, wherein the plurality of reference levels are indicative of two or more phenotypes; and if the measured levels match reference levels indicative of a specific phenotype, identifying a subject as having the specific phenotype.

In the methods provided herein, all steps can be performed without physically separating the cells in the sample. Further in the methods provided herein, the step of determining the regression relationship can include determining the regression of overall levels of each analyte on the cell proportions.

Also provided herein are methods, compositions, combinations and kits for classifying a cell sample as indicative of prostate cancer or not indicative of prostate cancer. For example, a method can include detecting the expression levels of genes relative to a reference, the genes comprising at least 2 different indicating genes, wherein each indicating gene comprises either: (a) a nucleotide sequence at least 90% identical to a nucleotide sequence selected from SEQ ID NO:1-38,826 or a complement thereof or (b) a nucleotide sequence that hybridizes under high stringency to a nucleotide sequence selected from SEQ ID NO:1-38,826 or a complement thereof. In another embodiment, provided herein are methods, compositions, combinations and kits for classifying a cell sample as indicative of prostate cancer or not indicative of prostate cancer. In another embodiment, provided is a use of a combination for the preparation of a composition for classifying a sample as indicative of prostate cancer or not indicative of prostate cancer, wherein the combination detects the expression levels of genes relative to a reference, the genes comprising at least 2 different indicating genes, wherein each indicating gene comprises either: (a) a nucleotide sequence at least 90% identical to a nucleotide sequence selected from SEQ ID NO:1-38,826 or a complement thereof or (b) a nucleotide sequence that hybridizes under high stringency to a nucleotide sequence selected from SEQ ID NO:1-38,826 or a complement thereof. In some embodiments, the nucleotide sequences selected from SEQ ID NO:1-38,826 are selected from SEQ ID NO:35,580-38, 826.

The methods, compositions, combinations, uses and kits provided herein can be used to detect the expression levels of genes relative to a reference, the genes comprising at least 5, 10, 15, 20, 30, 40, 50, 75, 100, 150, 200, 300, 400, 500, 750, 1,000, 1,250, 1,500, 1,750, 2,000, 2,250, 2,500, or 2750 indicating genes.

Also provided herein are microarrays wherein at least 50%, 70%, 80%, 90%, 95%, 97%, 98% or 99% of the loci of the array specifically detect the expression level of the 2 or more indicating genes of the methods, compositions, combinations, uses and kits provided herein.

Also provided herein are methods, compositions, combinations, uses and kits for treating prostate cancer. For example, a method can include modulating the activity of a gene product selected from the group consisting of: (a) a product of a gene comprising a nucleotide sequence at least 90% identical to a nucleotide sequence selected from SEQ ID NO:1-38,826 or a complement thereof or (b) a gene product complementary to a nucleotide sequence that hybridizes under high stringency to a nucleotide sequence selected from SEQ ID NO:1-38,826 or a complement thereof. In some embodiments, the nucleotide sequences selected from SEQ ID NO:1-38,826 are selected from SEQ ID NO:35,580-38, 826. In the methods, compositions, combinations, uses and kits provided herein, the compound can be selected from the group consisting of an antibody, an antisense compound, a ribozyme, a DNAzyme, an RNA interference compound, a small molecule, a heterologous nucleic acid molecule encoding the gene, the gene product, and any combination thereof. For example, the modulating compound can specifically bind to mRNA encoding the gene or the protein gene product and thereby inhibit expression of the gene. In other methods, compositions, combinations, uses and kits provided herein, the modulating step can further include administering to a subject with prostate cancer a compound that increases the activity of the gene product selected from the selected from the group consisting of heterologous nucleic acid molecule encoding the gene, the gene product, and a combination thereof. For example the heterologous nucleic acid molecule can be an expression vector.

Also provided herein are methods, compositions, combinations, uses and kits for screening compounds. For example, a method can include contacting with a test compound a cell expressing a gene selected from the group consisting of: (a) a gene comprising a nucleotide sequence selected from SEQ ID NO:1-38,826 or a complement thereof; and (b) a gene comprising a nucleotide sequence that hybridizes under high stringency to a nucleotide sequence selected from SEQ ID NO:1-38,826 or a complement thereof, and measuring expression levels of the gene, wherein a change in expression levels relative to a reference identifies the compound as a compound that modulates a expression of the gene. Another screening method includes contacting with a test compound a gene product selected from the group consisting of: a product of a gene comprising a nucleotide sequence at least 90% identical to a nucleotide sequence selected from SEQ ID NO:1-38,826 or a complement thereof or (b) a gene product complementary to a nucleotide sequence that hybridizes under high stringency to a nucleotide sequence selected from SEQ ID NO:1-38,826 or a complement thereof, and either: (i) identifying a test compound that specifically binds to the gene product, or (ii) identifying a test compound that inhibits binding of a compound known to bind the gene product. In some embodiments, the nucleotide sequences selected from SEQ ID NO:1-38,826 are selected from SEQ ID NO:35,580-38, 826.

In some of the methods, compositions, combinations, uses and kits provided herein at least one of the gene products corresponds to a Probe or Identifer/LocusLink with a modified t statistic in tumor >2.5 or ←−2.5. In others, at least one of the gene products corresponds to a Probe or Identifer/LocusLink with a modified t statistic in benign prostatic hypertrophy (BPH) >2.5 or ←−2.5. In others, at least one of the gene products corresponds to a Probe or Identifer/LocusLink with a modified t statistic in stroma >2.5 or ←−2.5. In some of the methods, compositions, combinations, uses and kits provided herein the gene product can be selected from the group consisting of: (a) a product of a gene comprising a nucleotide sequence at least 90% identical to the nucleotide sequence of a Probe identified in Table 9 as having a modified t statistic in tumor >2.5 or ←−2.5; (b) a product of a gene comprising a nucleotide sequence at least 90% identical to the nucleotide sequence of a gene encoded by an Identifier and LocusLink identified in Table 9 as having a modified t statistic in tumor >2.5 or ←−2.5; (c) a product of a gene comprising a nucleotide sequence at least 90% identical to the nucleotide sequence of a Probe identified in Table 10 as having a modified t statistic in stroma >2.5 or ←−2.5; and (d) a product of a gene comprising a nucleotide sequence at least 90% identical to the nucleotide sequence of a gene encoded by an Identifier and LocusLink identified in Table 10 as having a modified t statistic in stroma >2.5 or ←−2.5. In some of the methods, compositions, combinations, uses and kits provided herein, the modified t statistic can be >3 or ←−3, >3.5 or ←−3.5, >4 or ←−4, >4.5 or ←−4.5, or >5 or ←−5.

Also provided herein are compounds that modulate the activity of a gene product selected from the group consisting of: (a) a product of a gene comprising a nucleotide sequence at least 90% identical to a nucleotide sequence selected from SEQ ID NO:1-38,826 or a complement thereof or (b) a gene product complementary to a nucleotide sequence that hybridizes under high stringency to a nucleotide sequence selected from SEQ ID NO:1-38,826 or a complement thereof. In some embodiments, the nucleotide sequences selected from SEQ ID NO:1-38,826 are selected from SEQ ID NO:35,580-38,826. In certain embodiments, such a compound can be selected from the group consisting of an antibody, an antisense compound, a ribozyme, a DNAzyme, an RNA interference compound, a small molecule, a heterologous nucleic acid molecule encoding the gene, the gene product, and any combination thereof. Some compounds provided herein are present in pharmaceutically acceptable form.

Also provided herein are compounds that indicates the presence of a gene product selected from the group consisting of: (a) a product of a gene comprising a nucleotide sequence at least 90% identical to a nucleotide sequence selected from SEQ ID NO:1-38,826 or a complement thereof or (b) a gene product complementary to a nucleotide sequence that hybridizes under high stringency to a nucleotide sequence selected from SEQ ID NO:1-38,826 or a complement thereof. In some embodiments, the nucleotide sequences selected from SEQ ID NO:1-38,826 are selected from SEQ ID NO:35,580-38, 826. In certain embodiments, such a compound can be selected from the group consisting of a nucleic acid molecule that specifically binds at least 10 nucleotides in the gene or a complement thereof or a fragment thereof, an antibody that specifically binds the gene or a complement thereof, and an antibody that specifically binds the gene product or a fragment thereof.

Also provided herein are combinations of one or more of the compounds provided herein, or combinations of at least at least 2, 3, 4, 5, 6, 7, 8, 9, 10, 15 or 20 compounds provided herein.

Also provided herein are diagnostic markers for prostate cancer as set forth in SEQ ID NO:1-38,826. Also provided herein are kits comprising nucleic acids, polypeptides and/or antibodies useful in detecting the markers set forth in SEQ ID NO:1-38,826 for detecting prostate cancer. Also provided herein are methods of treating or preventing prostate cancer comprising suppressing gene expression or inhibiting or neutralizing the gene product of the genes that are listed as tumor markers and that are differentially expressed in the Tables provided herein and SEQ ID NO:1-38,826. In some such methods antibodies, antisense, ribozyme, a DNAzyme, RNA interference, and/or small molecule therapy to neutralize the gene or gene products, can be used. Also provided herein are prognostic markers for early relapse in prostate cancer as set forth in SEQ ID NO:1-38,826, complements thereof, fragments thereof, and polypeptides encoded thereby. Also provided herein are kits comprising nucleic acids, polypeptides and/or antibodies useful in detecting the markers set forth in SEQ ID NO:1-38,826, complements thereof, fragments thereof, and polypeptides encoded thereby for detecting early relapse of prostate cancer. In some embodiments, the nucleotide sequences selected from SEQ ID NO:1-38,826 are selected from SEQ ID NO:35,580-38,826. Also provided herein are methods of treating or preventing prostate cancer comprising suppressing gene expression or inhibiting or neutralizing the gene product of genes that are up-regulated in the tumor epithelial cells of early relapsed prostate cancer samples, wherein such genes have a T>3 in Table 8, Table 9, Table 10, Table 12 or Table 13. In some such methods antibodies, antisense, ribozyme, a DNAzyme, RNA interference, and/or small molecule therapy to neutralize the gene or gene products, can be used. Also provided herein are computer implemented methods.

The details of the methods, compositions, combinations and kits provided herein, are set forth in the accompanying drawings and the description below. Other features, objects, and advantages of the invention will be apparent from the description and drawings, and from the claims.

DETAILED DESCRIPTION

Definitions

Figure 1:
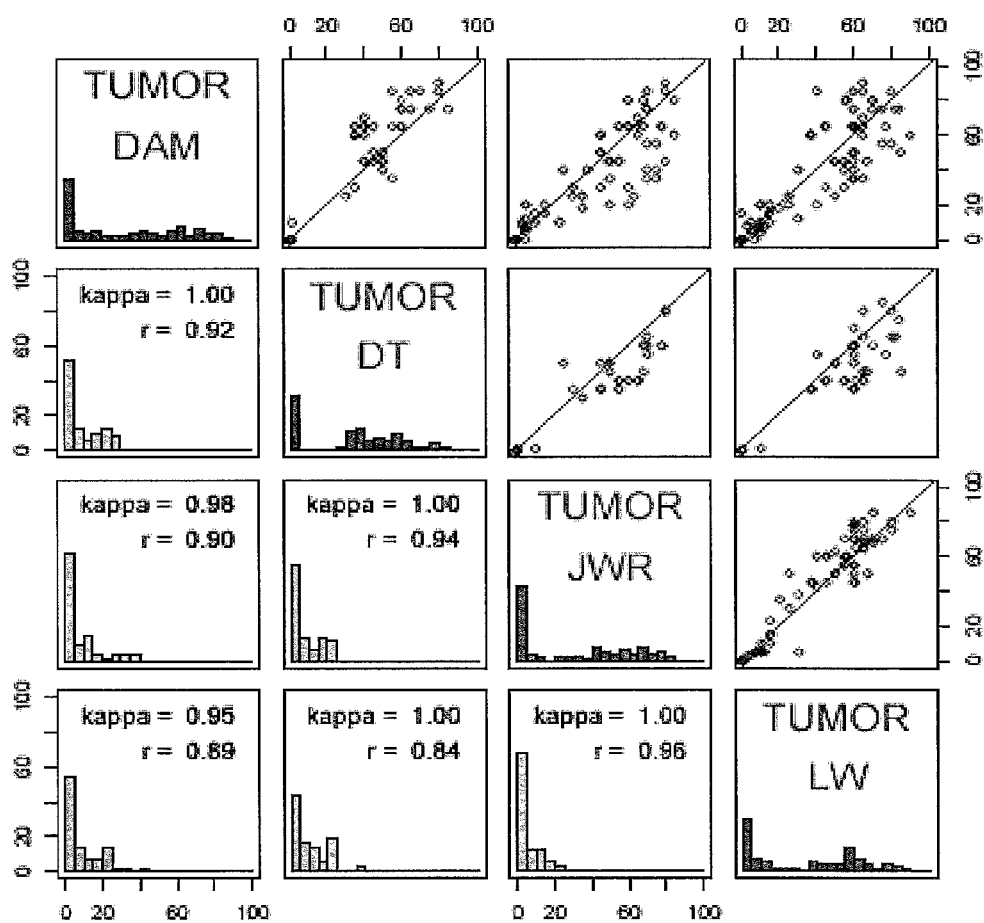
FIG. 1 depicts graphs showing agreement analysis of pathologists' percent estimates by calculation of Pearson correlation coefficients. The figure shows agreement among four pathologists, for the analysis of prostate cancer sections. A total of 363 rankings were analyzed. For any graph, the y- and x-axes give the percent of a given tissue section estimated to be tumor epithelial cells by rater whose initials occur in the diagonal panels found by moving horizontally and vertically respectively. The histograms below the diagonal show few instances in which $y_{ij1kj}$-$y_{ij2kj}$ exceeds 20%, and usually it is <5%. Further, the k statistics and the Pearson correlations coefficients are all high. Many of the ratings showed <5% tumor cells (histograms on diagonal), making this a good test for presence versus absence of tumor cells.

Unless defined otherwise, all technical and scientific terms used herein have the same meaning as is commonly understood by one of skill in the art to which the invention(s) belong. All patents, patent applications, published applications and publications, Genbank sequences, websites and other published materials referred to throughout the entire disclosure herein, unless noted otherwise, are incorporated by reference in their entirety. In the event that there is a plurality of definitions for terms herein, those in this section prevail. Where reference is made to a URL or other such identifier or address, it understood that such identifiers can change and particular information on the internet can come and go, but equivalent information can be found by searching the internet. Reference thereto evidences the availability and public dissemination of such information.

Differential expression, as used herein, refers to both quantitative as well as qualitative differences in the extend of the genes' expression depending on differential development and/or tumor growth. Differentially expressed genes can represent marker genes, and/or target genes. The expression pattern of a differentially expressed gene disclosed herein can be utilized as part of a prognostic or diagnostic evaluation of a subject. The expression pattern of a differentially expressed gene can be used to identify the presence of a particular cell type in a sample. A differentially expressed gene disclosed herein can be used in methods for identifying reagents and compounds and uses of these reagents and compounds for the treatment of a subject as well as methods of treatment.

Biological activity or bioactivity or activity or biological function, which are used interchangeably, herein mean an effector or antigenic function that is directly or indirectly performed by a polypeptide (whether in its native or denatured conformation), or by any fragment thereof in vivo or in vitro. Biological activities include but are not limited to binding to polypeptides, binding to other proteins or molecules, enzymatic activity, signal transduction, activity as a DNA binding protein, as a transcription regulator, ability to bind damaged DNA, etc. A bioactivity can be modulated by directly affecting the subject polypeptide. Alternatively, a bioactivity can be altered by modulating the level of the polypeptide, such as by modulating expression of the corresponding gene.

The term gene expression analyte refers a biological molecule, e.g., a nucleic acid, peptide, hormone, etc., whose presence or concentration can be detected and correlated with gene expression.

As used herein, gene expression levels refers to the amount of biological macromolecule produced from a gene. For example, expression levels of a particular gene can refer to the amount of protein produced from that particular gene, or can refer to the amount of mRNA produced from that particular gene. Gene expression levels can refer to an absolute (e.g., molar or gram-quantity) levels or relative (e.g., the amount relative to a standard, reference, calibration, or to another gene expression level). Typically, gene expression levels used herein are relative expression levels. As used herein in regard to determining the relationship between cell content and expression levels, gene expression levels can be considered in terms of any manner of describing gene expression known in the art. For example, regression methods that consider gene expression levels can consider the measurement of the level of a gene expression analyte, or the level calculated or estimated according to the measurement of the level of a gene expression analyte.

Marker gene, as used herein, refers to a differentially expressed gene which expression pattern can serve as part of a phenotype-indicating method, such as a predictive method, prognostic or diagnostic method, or other cell-type distinguishing evaluation, or which, alternatively, can be used in methods for identifying compounds useful for the treatment or prevention of diseases or disorders, or for identifying compounds that modulate the activity of one or more gene products.

As used herein, a phenotype indicated by methods provided herein can be a diagnostic indication, a prognostic indication, or an indication of the presence of a particular cell type in a subject. Diagnostic indications include indication of a disease or a disorder in the subject, such as presence of tumor or neoplastic disease, inflammatory disease, autoimmune disease, and any other diseases known in the art that can be identified according to the presence or absence of particular cells or by the gene expression of cells. In another embodiment, prognostic indications refers to the likely or expected outcome of a disease or disorder, including, but not limited to, the likelihood of survival of the subject, likelihood of relapse, aggressiveness of the disease or disorder, indolence of the disease or disorder, and likelihood of success of a particular treatment regimen.

As used herein, a gene expression analyte refers to a biological molecule that indicates the expression of a particular gene. For example, a gene expression analyte can be a mRNA of a particular gene, or a fragment thereof (including, e.g., by-products of mRNA splicing and nucleolytic cleavage fragments), a protein of a particular gene or a fragment thereof (including, e.g., post-translationally modified proteins or by-products therefrom, and proteolytic fragments), and other biological molecules such as a carbohydrate, lipid or small molecule, whose presence or absence corresponds to the expression of a particular gene.

As used herein, gene expression levels that correspond to levels of gene expression analytes refers to the relationship between an analyte that indicates the expression of a gene, and the actual level of expression of the gene. Typically the level of a gene expression analyte is measured in experimental methods used to determine gene expression levels. As understood by one skilled in the art, the measured gene expression levels can represent gene expression at a variety of levels of detail (e.g., the absolute amount of a gene expressed, the relative amount of gene expressed, or an indication of increased or decreased levels of expression). The level of detail at which the levels of gene expression analytes can indicate levels of gene expression can be based on a variety of factors that include the number of controls used, the number of calibration experiments or reference levels determined, and other factors known in the art. In some methods provided herein, increase in the levels of a gene expression analyte can indicate increase in the levels of the gene expressed, and a decrease in the levels of a gene expression analyte can indicate decrease in the levels of the gene expressed.

As used herein, a regression relationship between relative content of a cell type and measured overall levels of a gene expression analyte refers to a quantitative relationship between cell type and level of gene expression analyte that is determined according to the methods provided herein based on the amount of cell type present in two or more samples and experimentally measured levels of gene expression analyte. In one embodiment, the regression relationship is determined by determining the regression of overall levels of each gene expression analyte on determined cell proportions. In one embodiment, the regression relationship is determined by linear regression, where the overall expression level or the expression analyte levle is treated as directly proportional to (e.g., linear in) cell percent either for each cell type in turn or all at once and the slopes of these linear relationships can be expressed as beta values.

As used herein, a heterogeneous sample refers to a sample that contains more than one cell type. For example, a heterogeneous sample can contain stromal cells and tumor cells. Typically, as used herein, the different cell types present in a sample are present in greater than about 0.1%, 0.2%, 0.3%, 0.5%, 0.7%, 1%, 2%, 3%, 4% or 5% or greater than 0.1%, 0.2%, 0.3%, 0.5%, 0.7%, 1%, 2%, 3%, 4% or 5%. As is understood in the art, cell samples, such as tissue samples from a subject, can contain minute amounts of a variety of cell types (e.g., nerve, blood, vascular cells). However, cell types that are not present in the sample in amounts greater than about 0.1%, 0.2%, 0.3%, 0.5%, 0.7%, 1%, 2%, 3%, 4% or 5% or greater than 0.1%, 0.2%, 0.3%, 0.5%, 0.7%, 1%, 2%, 3%, 4% or 5%, are not typically considered components of the heterogeneous cell sample, as used herein.

As used herein, related cell samples refers to samples that contain one or more cell types in common. Related cell samples can be samples from the same tissue type or from the same organ. Related cell samples can be from the same or different sources (e.g., same or different individuals or cell cultures, or a combination thereof). As provided herein, in the case of three or more different cell samples, it is not required that all samples contain a common cell type, but if a first sample does not contain any cell types that are present in the other samples, the first sample is not related to the other samples.

As used herein, tumor cells refers to cells with cytological and adherence properties consisting of nuclear and cyoplasmic features and patterns of cell-to-cell association that are known to pathologists skilled in the art as sufficient for the diagnosis as cancers of various types. In some embodiments, tumor cells have abnormal growth properties, such as neoplastic growth properties.

As used herein, cells associated with tumor refers to cells that, while not necessarily malignant, are present in tumorous tissues or organs or particular locations of tissues or organs, and are not present, or are present at insignificant levels, in normal tissues or organs, or in particular locations of tissues or organs.

As used herein, benign prostatic hyperplastic (BPH) cells refers to the cells of the epithelial lining of hyperplastic prostate glands.

As used herein, dilated cystic glands cells refers to the cells of the epithelial lining of dilated (atrophic) cystic prostate glands.

As used herein, stromal cells refers to the combined connective tissue cells and smooth muscle cells forming the stroma of an organ. Exemplary stromal cells are cells of the stroma of the prostate gland.

As used herein, a reference refers to a value or set of related values for one or more variables. In one example, a reference gene expression level refers to a gene expression level in a particular cell type. Reference expression levels can be determined according to the methods provided herein, or by determining gene expression levels of a cell type in a homogenous sample. Reference levels can be in absolute or relative amounts, as is known in the art. In certain embodiments, a reference expression level can be indicative of the presence of a particular cell type. For example, in certain embodiments, only one particular cell type may have high levels of expression of a particular gene, and, thus, observation of a cell type with high measured expression levels can match expression levels of that particular cell type, and thereby indicate the presence of that particular cell type in the sample. In another embodiment, a reference expression level can be indicative of the absence of a particular cell type. As provided herein, two or more references can be considered in determining whether or not a particular cell type is present in a sample, and also can be considered in determining the relative amount of a particular cell type that is present in the sample.

As used herein, a modified t statistic is a numerical representation of the ability of a particular gene product or indicator thereof to indicate the presence or absence of a particular cell type in a sample. A modified t statistic incorporating goodness of fit and effect size can be formulated according to known methods (see, e.g., Tusher (Proc. Natl. Acad. Sci. USA 98, 5116-5121, 2001)), where $\sigma\beta$ is the standard error of the coefficient, and k is a small constant, as follows:

$$t=\beta/(k+\sigma\beta)$$

As used herein, relative content of a cell type or cell proportion refers to the amount of a cell mixture that is populated by a particular cell type. Typically, heterogeneous cell mixtures contain two or more cell types, and, therefore, no single cell type makes up 100% of the mixture. Relative content can be expressed in any of a variety of forms known in the art; For example, relative content can be expressed as a percentage of the total amount of cells in a mixture, or can be expressed relative to the amount of a particular cell type. As used herein, percent cell or percent cell composition is the percent of all cells that a particular cell type accounts for in a heterologous cell mixture, such as a microscopic section sampling a tissue.

By array or matrix is meant an arrangement of addressable locations or addresses on a device. The locations can be arranged in two dimensional arrays, three dimensional arrays, or other matrix formats. The number of locations can range from several to at least hundreds of thousands. Most importantly, each location represents a totally independent reaction site. Arrays include but are not limited to nucleic acid arrays, protein arrays and antibody arrays. A nucleic acid array refers to an array containing nucleic acid probes, such as oligonucleotides, polynucleotides or larger portions of genes. The nucleic acid on the array can be single stranded. Arrays wherein the probes are oligonucleotides are referred to as oligonucleotide arrays or oligonucleotide chips. A microarray, herein also refers to a biochip or biological chip, an array of regions having a density of discrete regions of at least about 100/cm2, and can be at least about 1000/cm2. The regions in a microarray have typical dimensions, e.g., diameters, in the range of between about 10-250 μm, and are separated from other regions in the array by about the same distance. A protein array refers to an array containing polypeptide probes or protein probes which can be in native form or denatured. An antibody array refers to an array containing antibodies which include but are not limited to monoclonal antibodies (e.g. from a mouse), chimeric antibodies, humanized antibodies or phage antibodies and single chain antibodies as well as fragments from antibodies.

The term agonist, as used herein, is meant to refer to an agent that mimics or upregulates (e.g., potentiates or supplements) the bioactivity of a protein. An agonist can be a wild-type protein or derivative thereof having at least one bioactivity of the wild-type protein. An agonist can also be a compound that upregulates expression of a gene or which increases at least one bioactivity of a protein. An agonist can also be a compound which increases the interaction of a polypeptide with another molecule, e.g., a target peptide or nucleic acid.

As used herein a polynucleotide or nucleic acid molecule is a polymeric form of nucleotides of any length, either ribonucleotides or deoxyribonucleotides. This term refers only to the primary structure of the molecule. Thus, this term includes double- and single-stranded DNA and RNA. It also includes known types of modifications, for example, labels which are known in the art, methylation, caps, substitution of one or more of the naturally occurring nucleotides with an analog, internucleotide modifications such as, for example, those with uncharged linkages (e.g., phosphorothioates, phosphorodithioates, etc.), those containing pendant moieties, such as, for example proteins (including e.g., nucleases, toxins, antibodies, signal peptides, poly-L-lysine, etc.),those with intercalators (e.g., acridine, psoralen, etc.), those containing chelators (e.g., metals, radioactive metals, etc.), those containing alkylators, those with modified linkages (e.g., alpha anomeric nucleic acids, etc.), those containing nucleotide analogs (e.g., peptide nucleic acids), as well as unmodified forms of the polynucleotide.

As used herein, a polynucleotide derived from a designated sequence refers to a polynucleotide sequence which is comprised of a sequence of approximately at least about 6 nucleotides, at least about 8 nucleotides, at least about 10-12 nucleotides, or at least about 15-20 nucleotides corresponding to a region of the designated nucleotide sequence. Corresponding polynucleotides are homologous to or complementary to a designated sequence. Typically, the sequence of the region from which the polynucleotide is derived is homologous to or complementary to a sequence that is unique to a gene provided herein.

A recombinant protein is a protein made using recombinant techniques, i.e. through the expression of a recombinant nucleic acid as depicted above. A recombinant protein is distinguished from naturally occurring protein by at least one or more characteristics. For example, the protein may be isolated or purified away from some or all of the proteins and compounds with which it is normally associated in its wild type host, and thus may be substantially pure. For example, an isolated protein is unaccompanied by at least some of the material with which it is normally associated in its natural state, constituting at least about 0.5%, or at least about 5% by weight of the total protein in a given sample. A substantially pure protein comprises at least about 50-75% by weight of the total protein, at least about 80%, or at least about 90%. The definition includes the production of a protein from one organism in a different organism or host cell. Alternatively, the protein may be made at a significantly higher concentration than is normally seen, through the use of an inducible promoter or high expression promoter, such that the protein is made at increased concentration levels. Alternatively, the protein may be in a form not normally found in nature, as in the addition of an epitope tag or amino acid substitutions, insertions and deletions, as discussed below.

As used herein, disease or disorder refers to a pathological condition in an organism resulting from, e.g., infection or genetic defect, and characterized by identifiable symptoms.

Whether any two nucleic acid molecules have nucleotide sequences that are at least, for example, 80%, 85%, 90%, 95%, 96%, 97%, 98% or 99% identical can be determined using known computer algorithms such as the FAST A program, using for example, the default parameters as in Pearson et al. (1988) Proc. Natl. Acad. Sci. USA 85:2444 (other programs include the GCG program package (Devereux, J., et al., Nucleic Acids Research 12(I):387 (1984)), BLASTP, BLASTN, FASTA (Atschul, S. F., et al., J Molec Biol 215:403 (1990); Guide to Huge Computers, Martin J. Bishop, ed., Academic Press, San Diego, 1994, and Carillo et al. (1988) SIAM J Applied Math 48:1073). For example, the BLAST function of the National Center for Biotechnology Information database can be used to determine identity. Other commercially or publicly available programs include, DNAStar MegAlign program (Madison, Wis.) and the University of Wisconsin Genetics Computer Group (UWG) Gap program (Madison Wis.)). Percent homology or identity of proteins and/or nucleic acid molecules can be determined, for example, by comparing sequence information using a GAP computer program (e.g., Needleman et al. (1970) J. Mol. Biol. 48:443, as revised by Smith and Waterman ((1981) Adv. Appl. Math. 2:482). Briefly, the GAP program defines similarity as the number of aligned symbols (i.e., nucleotides or amino acids) which are similar, divided by the total number of symbols in the shorter of the two sequences. Default parameters for the GAP program can include: (1) a unary comparison matrix (containing a value of 1 for identities and 0 for non-identities) and the weighted comparison matrix of Gribskov et al. (1986) Nucl. Acids Res. 14:6745, as described by Schwartz and Dayhoff, eds., ATLAS OF PROTEIN SEQUENCE AND STRUCTURE, National Biomedical Research Foundation, pp. 353-358 (1979); (2) a penalty of 3.0 for each gap and an additional 0.10 penalty for each symbol in each gap; and (3) no penalty for end gaps. Therefore, as used herein, the term identity represents a comparison between a test and a reference polypeptide or polynucleotide.

As used herein, the term at least 90% identical to refers to percent identities from 90 to 100 relative to the reference polypeptides. Identity at a level of 90% or more is indicative of the fact that, assuming for exemplification purposes a test and reference polynucleotide length of 100 amino acids are compared. No more than 10% (i.e., 10 out of 100) amino acids in the test polypeptide differs from that of the reference polypeptides. Similar comparisons can be made between a test and reference polynucleotides. Such differences can be represented as point mutations randomly distributed over the entire length of an amino acid sequence or they can be clustered in one or more locations of varying length up to the maximum allowable, e.g. 10/100 amino acid difference (approximately 90% identity). Differences are defined as nucleic acid or amino acid substitutions, or deletions. At the level of homologies or identities above about 85-90%, the result should be independent of the program and gap parameters set; such high levels of identity can be assessed readily, often without relying on software.

As used herein, primer refers to an oligonucleotide containing two or more deoxyribonucleotides or ribonucleotides, typically more than three, from which synthesis of a primer extension product can be initiated. Experimental conditions conducive to synthesis include the presence of nucleoside triphosphates and an agent for polymerization and extension, such as DNA polymerase, and a suitable buffer, temperature and pH.

As used herein, animals include any animal, such as, but are not limited to, goats, cows, deer, sheep, rodents, pigs and humans. Non-human animals, exclude humans as the contemplated animal. The SPs provided herein are from any source, animal, plant, prokaryotic and fungal.

As used herein, genetic therapy involves the transfer of heterologous nucleic acid, such as DNA, into certain cells, target cells, of a mammal, particularly a human, with a disorder or conditions for which such therapy is sought. The nucleic acid, such as DNA, is introduced into the selected target cells in a manner such that the heterologous nucleic acid, such as DNA, is expressed and a therapeutic product encoded thereby is produced. Alternatively, the heterologous nucleic acid, such as DNA, can in some manner mediate expression of DNA that encodes the therapeutic product, or it can encode a product, such as a peptide or RNA that in some manner mediates, directly or indirectly, expression of a therapeutic product. Genetic therapy can also be used to deliver nucleic acid encoding a gene product that replaces a defective gene or supplements a gene product produced by the mammal or the cell in which it is introduced. The introduced nucleic acid can encode a therapeutic compound, such as a growth factor inhibitor thereof, or a tumor necrosis factor or inhibitor thereof, such as a receptor therefor, that is not normally produced in the mammalian host or that is not produced in therapeutically effective amounts or at a therapeutically useful time. The heterologous nucleic acid, such as DNA, encoding the therapeutic product can be modified prior to introduction into the cells of the afflicted host in order to enhance or otherwise alter the product or expression thereof. Genetic therapy can also involve delivery of an inhibitor or repressor or other modulator of gene expression.

As used herein, heterologous nucleic acid is nucleic acid that encodes RNA or RNA and proteins that are not normally produced in vivo by the cell in which it is expressed or that mediates or encodes mediators that alter expression of endogenous nucleic acid, such as DNA, by affecting transcription, translation, or other regulatable biochemical processes. Heterologous nucleic acid, such as DNA, can also be referred to as foreign nucleic acid, such as DNA. Any nucleic acid, such as DNA, that one of skill in the art would recognize or consider as heterologous or foreign to the cell in which is expressed is herein encompassed by heterologous nucleic acid; heterologous nucleic acid includes exogenously added nucleic acid that is also expressed endogenously. Examples of heterologous nucleic acid include, but are not limited to, nucleic acid that encodes traceable marker proteins, such as a protein that confers drug resistance, nucleic acid that encodes therapeutically effective substances, such as anti-cancer agents, enzymes and hormones, and nucleic acid, such as DNA, that encodes other types of proteins, such as antibodies. Antibodies that are encoded by heterologous nucleic acid can be secreted or expressed on the surface of the cell in which the heterologous nucleic acid has been introduced. Heterologous nucleic acid is generally not endogenous to the cell into which it is introduced, but has been obtained from another cell or prepared synthetically. Generally, although not necessarily, such nucleic acid encodes RNA and proteins that are not normally produced by the cell in which it is now expressed.

As used herein, a therapeutically effective product for gene therapy is a product that is encoded by heterologous nucleic acid, typically DNA, that, upon introduction of the nucleic acid into a host, a product is expressed that ameliorates or eliminates the symptoms, manifestations of an inherited or acquired disease or that cures the disease. Also included are biologically active nucleic acid molecules, such as RNAi and antisense.

As used herein, disease or disorder treatment or compound refers to any therapeutic regimen and/or agent that, when used alone or in combination with other treatments or compounds, can alleviate, reduce, ameliorate, prevent, or place or maintain in a state of remission of clinical symptoms or diagnostic markers associated with the disease or disorder.

As used herein, nucleic acids include DNA, RNA and analogs thereof, including peptide nucleic acids (PNA) and mixtures thereof. Nucleic acids can be single or double-stranded. When referring to probes or primers, optionally labeled, with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous of sequence complementary to or identical a gene of interest. Probes and primers can be 10, 20, 30, 50, 100 or more nucleic acids long.

As used herein, operative linkage of heterologous nucleic acids to regulatory and effector sequences of nucleotides, such as promoters, enhancers, transcriptional and translational stop sites, and other signal sequences refers to the relationship between such nucleic acid, such as DNA, and such sequences of nucleotides. Thus, operatively linked or operationally associated refers to the functional relationship of nucleic acid, such as DNA, with regulatory and effector sequences of nucleotides, such as promoters, enhancers, transcriptional and translational stop sites, and other signal sequences. For example, operative linkage of DNA to a promoter refers to the physical and functional relationship between the DNA and the promoter such that the transcription of such DNA is initiated from the promoter by an RNA polymerase that specifically recognizes, binds to and transcribes the DNA. In order to optimize expression and/or in vitro transcription, it can be necessary to remove, add or alter 5' untranslated portions of the clones to eliminate extra, potential inappropriate alternative translation initiation (i.e., start) codons or other sequences that can interfere with or reduce expression, either at the level of transcription or translation. Alternatively, consensus ribosome binding sites (see, e.g., Kozak J. Biol. Chem. 266:19867-19870 (1991)) can be inserted immediately 5' of the start codon and can enhance expression. The desirability of (or need for) such modification can be empirically determined.

As used herein, a sequence complementary to at least a portion of an RNA, with reference to antisense oligonucleotides, means a sequence having sufficient complementarity to be able to hybridize with the RNA, generally under moderate or high stringency conditions, forming a stable duplex; in the case of double-stranded antisense nucleic acids, a single strand of the duplex DNA (or dsRNA) can thus be tested, or triplex formation can be assayed. The ability to hybridize depends on the degree of complementarily and the length of the antisense nucleic acid. Generally, the longer the hybridizing nucleic acid, the more base mismatches with a gene encoding RNA it can contain and still form a stable duplex (or triplex, as the case can be). One skilled in the art can ascertain a tolerable degree of mismatch by use of standard procedures to determine the melting point of the hybridized complex.

As used herein, antisense polynucleotides refer to synthetic sequences of nucleotide bases complementary to mRNA or the sense strand of double-stranded DNA. Admixture of sense and antisense polynucleotides under appropriate conditions leads to the binding of the two molecules, or hybridization. When these polynucleotides bind to (hybridize with) mRNA, inhibition of protein synthesis (translation) occurs. When these polynucleotides bind to double-stranded DNA, inhibition of RNA synthesis (transcription) occurs. The resulting inhibition of translation and/or transcription leads to an inhibition of the synthesis of the protein encoded by the sense strand. Antisense nucleic acid molecules typically contain a sufficient number of nucleotides to specifically bind to a target nucleic acid, generally at least 5 contiguous nucleotides, often at least 14 or 16 or 30 contiguous nucleotides or modified nucleotides complementary to the coding portion of a nucleic acid molecule that encodes a gene of interest.

As used herein, antibody refers to an immunoglobulin, whether natural or partially or wholly synthetically produced, including any derivative thereof that retains the specific binding ability the antibody. Hence antibody includes any protein having a binding domain that is homologous or substantially homologous to an immunoglobulin binding domain. Antibodies include members of any immunoglobulin groups, including, but not limited to, IgG, IgM, IgA, IgD, IgY and IgE.

As used herein, antibody fragment refers to any derivative of an antibody that is less than full-length, retaining at least a portion of the full-length antibody's specific binding ability. Examples of antibody fragments include, but are not limited to, Fab, Fab', F(ab)$_2$, single-chain Fvs (scFV), FV, dsFV diabody and Fd fragments. The fragment can include multiple chains linked together, such as by disulfide bridges. An antibody fragment generally contains at least about 50 amino acids and typically at least 200 amino acids.

As used herein, an Fv antibody fragment is composed of one variable heavy domain ($V_H$) and one variable light domain linked by noncovalent interactions.

As used herein, a dsFV refers to an Fv with an engineered intermolecular disulfide bond, which stabilizes the $V_H$-$V_L$ pair.

As used herein, an F(ab)$_2$ fragment is an antibody fragment that results from digestion of an immunoglobulin with pepsin at pH 4.0-4.5; it can be recombinantly expressed to produce the equivalent fragment.

As used herein, Fab fragments are antibody fragments that result from digestion of an immunoglobulin with papain; they can be recombinantly expressed to produce the equivalent fragment.

As used herein, scFVs refer to antibody fragments that contain a variable light chain ($V_L$) and variable heavy chain ($V_H$) covalently connected by a polypeptide linker in any order. The linker is of a length such that the two variable domains are bridged without substantial interference. Included linkers are (Gly-Ser)$_n$residues with some Glu or Lys residues dispersed throughout to increase solubility.

As used herein, humanized antibodies refer to antibodies that are modified to include human sequences of amino acids so that administration to a human does not provoke an immune response. Methods for preparation of such antibodies are known. For example, to produce such antibodies, the encoding nucleic acid in the hybridoma or other prokaryotic or eukaryotic cell, such as an *E. coli* or a CHO cell, that expresses the monoclonal antibody is altered by recombinant nucleic acid techniques to express an antibody in which the amino acid composition of the non-variable region is based on human antibodies. Computer programs have been designed to identify such non-variable regions.

As used herein, diabodies are dimeric scFV; diabodies typically have shorter peptide linkers than scFvs, and they generally dimerize.

As used herein, production by recombinant means by using recombinant DNA methods means the use of the well known methods of molecular biology for expressing proteins encoded by cloned DNA.

As used herein, an effective amount of a compound for treating a particular disease is an amount that is sufficient to ameliorate, or in some manner reduce the symptoms associated with the disease. Such amount can be administered as a single dosage or can be administered according to a regimen, whereby it is effective. The amount can cure the disease but, typically, is administered in order to ameliorate the symptoms of the disease. Repeated administration can be required to achieve the desired amelioration of symptoms.

As used herein, a compound that modulates the activity of a gene product either decreases or increases or otherwise alters the activity of the protein or, in some manner up- or down-regulates or otherwise alters expression of the nucleic acid in a cell.

As used herein, pharmaceutically acceptable salts, esters or other derivatives of the conjugates include any salts, esters or derivatives that can be readily prepared by those of skill in this art using known methods for such derivatization and that produce compounds that can be administered to animals or humans without substantial toxic effects and that either are pharmaceutically active or are prodrugs.

As used herein, a drug or compound identified by the screening methods provided herein refers to any compound that is a candidate for use as a therapeutic or as a lead compound for the design of a therapeutic. Such compounds can be small molecules, including small organic molecules, peptides, peptide mimetics, antisense molecules or dsRNA, such as RNAi, antibodies, fragments of antibodies, recombinant antibodies and other such compounds that can serve as drug candidates or lead compounds.

As used herein, a non-malignant cell adjacent to a malignant cell in a subject, refers to a cell that has a normal morphology (e.g., is not classified as neoplastic or malignant by a pathologist, cell sorter, or other cell classification method), but, while the cell had been present in tact in the subject, the cell had been adjacent to a malignant cell or malignant cells. As provided herein, cells of a particular type (e.g., stroma)

adjacent to a malignant cell or malignant cells can display an expression pattern that differs from cells of the same type that are not adjacent to a malignant cell or malignant cells. In accordance with the methods provided herein, cells that are adjacent to malignant cells can be distinguished from cells of the same type that are adjacent to non-malignant cells, according to their differential gene expression. As used herein regarding the location of cells, adjacent refers to a first cell and a second cell being sufficiently proximal such that the first cell influences the gene expression of the second cell. For example, adjacent cells can include cells that are in direct contact with each other, adjacent cell can include cells within 500 microns, 300 microns, 200 microns 100 microns or 50 microns, of each other.

As used herein, tumor refers to a collection of malignant cells. Malignant as applied to a cell refers to a cell that grows in an uncontrolled fashion. In some embodiments, a malignant cell can be anaplastic. In some embodiments, a malignant cell can be capable of metastasizing.

As used herein: stringency of hybridization in determining percentage mismatch is as follows:
1) high stringency: 0.1×SSPE, 0.1% SDS, 65° C.
2) medium stringency: 0.2×SSPE, 0.1% SDS, 50° C.
3) low stringency: 1.0×SSPE, 0.1% SDS, 50° C.

As used herein, vector (or plasmid) refers to discrete elements that are used to introduce heterologous nucleic acid into cells for either expression or replication thereof. The vectors typically remain episomal, but can be designed to effect integration of a gene or portion thereof into a chromosome of the genome. Also contemplated are vectors that are artificial chromosomes, such as yeast artificial chromosomes and mammalian artificial chromosomes. Selection and use of such vehicles are well known to those of skill in the art. An expression vector includes vectors capable of expressing DNA that is operatively linked with regulatory sequences, such as promoter regions, that are capable of effecting expression of such DNA fragments. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those that integrate into the host cell genome.

As used herein a disease prognosis refers to a forecast of the probable outcome of a disease or of a probable outcome resultant from a disease. Non-limiting examples of disease prognosis include likely relapse of disease, likely aggressiveness of disease, likely indolence of disease, likelihood of survival of the subject, likelihood of success in treating a disease, condition in which a particular treatment regimen is likely to be more effective than another treatment regimen, and combinations thereof.

As used herein, aggressiveness of a tumor or malignant cell refers to the capacity of one or more cells to attain a position in the body away from the tissue or organ of origin, attach to another portion of the body, and multiply. Experimentally, aggressiveness can be described in one or more manners, including, but not limited to, post-diagnosis survival of subject, relapse of tumor, and metastasis of tumor. Thus, in the disclosures provided herein, data indicative of time length of survival, relapse, non-relapse, time length for metastasis, or non-metastasis, are indicative of the aggressiveness of a tumor or a malignant cell. When survival is considered, one skilled in the art will recognize that aggressiveness is inversely related to the length of time of survival of the subject. When time length for metastasis is considered, one skilled in the art will recognize that aggressiveness is directly related to the length of time of survival of a subject. As used herein, indolence refers to non-aggressiveness of a tumor or malignant cell; thus, the more aggressive a tumor or cell, the less indolent, and vice versa. As an example of a cell attaining a position in the body away from the tissue or organ of origin, a malignant prostate cell can attain an extra-prostatic position, and thus have one characteristic of an aggressive malignant cell. Attachment of cells can be, for example, on the lymph node or bone marrow of a subject, or other sites known in the art.

As used herein, a combination refers to any association between two or among more items.

As used herein, a composition refers to any mixture. It can be a solution, a suspension, liquid, powder, a paste, aqueous, non-aqueous or any combination thereof.

As used herein, fluid refers to any composition that can flow. Fluids thus encompass compositions that are in the form of semi-solids, pastes, solutions, aqueous mixtures, gels, lotions, creams and other such compositions.

For clarity of disclosure, and not by way of limitation, the detailed description is divided into the subsections that follow.

Cell-type-associated patterns of gene expression

Primary tissues are composed of many (e.g., 2 or more) types of cells. Identification of genes expressed in a specific cell type present within a tissue in other methods can require physical separation of that cell type and the cell type's subsequent assay. Although it is possible to physically separate cells according to type, by methods such as laser capture microdissection, centrifugation, FACS, and the like, this is time consuming and costly and in certain embodiments impractical to perform. Known expression profiling assays (either RNA or protein) of primary tissues or other specimens containing multiple cell types either (1) do not take into account that multiple cell types are present or (2) physically separate the component cell types before performing the assay. Other analyses have been performed without regard to the presence of multiple cell types, thereby identifying markers indicative of a shift in the relative proportion of various cell types present in a sample, but not representative of a specific cell type. Previous analytic approaches cannot discern interactions between different types of cells.

Provided herein are methods, compositions and kits based on the development of a model, where the level of each gene product assayed can be correlated to a specific cell type. This approach for determination of cell-type-specific gene expression obviates the need for physical separation of cells from tissues or other specimens with heterogeneous cell content. Furthermore, this method permits determination of the interaction between the different types of cells contained in such heterogeneous mixtures, which would otherwise have been difficult or impossible had the cells been first physically separated and then assayed. Using the approaches provided herein, a number of biomarkers can be identified related to various diseases and disorders. Exemplified herein is the identification of biomarkers for prostate cancer and benign prostatic hypertopy. Such biomarkers can be used in diagnosis and prognosis and treatment decisions.

The methods, compositions, combinations and kits provided herein employ a regression-based approach for identification of cell-type-specific patterns of gene expression in samples containing more than one type of cell. In one example, the methods, compositions, combinations and kits provided herein employ a regression-based approach for identification of cell-type-specific patterns of gene expression in cancer. These methods, compositions, combinations and kits provided herein can be used in the identification of genes that are differentially expressed in malignant versus non-malignant cells and further identify tumor-dependent changes in gene expression of non-malignant cells associated with malignant cells relative to non-malignant cells not associated with malignant cells. The methods, compositions, combinations and kits provided herein also can be used in correlating a phenotype with gene expression in one or more cell types. For example such a method can include determining the relative content of each cell type in two or more related heterogeneous cell samples, wherein at least two of the samples do not contain the same relative content of each cell type, measuring overall levels of one or more gene expression analytes in each sample, determining the regression relationship between the relative content of each cell type and the measured overall levels, and calculating the level of each of the one or more analytes in each cell type according to the regression relationship, where gene expression levels correspond to the calculated levels of analytes. In another example such a method can include determining the relative content of each cell type in two or more related heterogeneous cell samples, wherein at least two of the samples do not contain the same relative content of each cell type, measuring overall levels of two or more gene expression analytes in each sample, determining the regression relationship between the relative content of each cell type and the measured overall levels, and calculating the level of each of the two or more analytes in each cell type according to the regression relationship, where gene expression levels correspond to the calculated levels of analytes. Such methods can further include identifying genes differentially expressed in at least one cell type relative to at least one other cell type. In such methods, the analyte can be a nucleic acid molecule and a protein.

The methods provided herein can be used for determining cell-type-specific gene expression in any heterogeneous cell population. The methods provided herein can find application in samples known to contain a variety of cell types, such as brain tissue samples and muscle tissue samples. The methods provided herein also can find application in samples in which separation of cell type can represent a tedious or time consuming operation, which is no longer required under the methods provided herein. Samples used in the present methods can be any of a variety of samples, including, but not limited to, blood, cells from blood (including, but not limited to, non-blood cells such as epithelial cells in blood), plasma, serum, spinal fluid, lymph fluid, skin, sputum, alimentary and genitourinary samples (including, but not limited to, urine, semen, seminal fluid, prostate aspirate, prostatic fluid, and fluid from the seminal vesicles), saliva, milk, tissue specimens (including, but not limited to, prostate tissue specimens), tumors, organs, and also samples of in vitro cell culture constituents.

In certain embodiments, the methods provided herein can be used to differentiate true markers of tumor cells, hyperplastic cells, and stromal cells of cancer. As exemplified herein, least squares regression using individual cell-type proportions can be used to produce clear predictions of cell-specific expression for a large number of genes. In an example provided herein applied to prostate cancer, many of these predictions are accepted on the basis of prior knowledge of prostate gene expression and biology, which provide confidence in the method. These are illustrated by numerous genes predicted to be preferentially expressed by stromal cells that are characteristic of connective tissue and only poorly expressed or absent in epithelial cells.

In some embodiments, the methods provided herein allow segregation of molecular tumor and nontumor markers into more discrete and informative groups. Thus, genes identified as tumor-associated can be further categorized into tumor versus stroma (epithelial versus mesenchymal) and tumor versus hyperplastic (perhaps reflecting true differences between the malignant cell and its hyperplastic counterpart). The methods provided herein can be used to distinguish tumor and non-tumor markers in a variety of cancers, including, but not limited to cancers classified by site such as cancer of the oral cavity and pharynx (lip, tongue, salivary gland, floor of mouth, gum and other mouth, nasopharynx, tonsil, oropharynx, hypopharynx, other oral/pharynx); cancers of the digestive system (esophagus; stomach; small intestine; colon and rectum; anus, anal canal, and anorectum; liver; intrahepatic bile duct; gallbladder; other biliary; pancreas; retroperitoneum; peritoneum, omentum, and mesentery; other digestive); cancers of the respiratory system (nasal cavity, middle ear, and sinuses; larynx; lung and bronchus; pleura; trachea, mediastinum, and other respiratory); cancers of the mesothelioma; bones and joints; and soft tissue, including heart; skin cancers, including melanomas and other non-epithelial skin cancers; Kaposi's sarcoma and breast cancer; cancer of the female genital system (cervix.uteri; corpus uteri; uterus, nos; ovary; vagina; vulva; and other female genital); cancers of the male genital system (prostate gland; testis; penis; and other male genital); cancers of the urinary system (urinary bladder; kidney and renal pelvis; ureter; and other urinary); cancers of the eye and orbit; cancers of the brain and nervous system (brain; and other nervous system); cancers of the endocrine system (thyroid gland and other endocrine, including thymus); lymphomas (Hodgkin's disease and non-Hodgkin's lymphoma), multiple myeloma, and leukemias (lymphocytic leukemia; myeloid leukemia; monocytic leukemia; and other leukemias); and cancers classified by histological type, such as Neoplasm, malignant; Carcinoma, NOS; Carcinoma, undifferentiated, NOS; Giant and spindle cell carcinoma; Small cell carcinoma, NOS; Papillary carcinoma, NOS; Squamous cell carcinoma, NOS; Lymphoepithelial carcinoma; Basal cell carcinoma, NOS; Pilomatrix carcinoma; Transitional cell carcinoma, NOS; Papillary transitional cell carcinoma; Adenocarcinoma, NOS; Gastrinoma, malignant; Cholangiocarcinoma; Hepatocellular carcinoma, NOS; Combined hepatocellular carcinoma and cholangiocarcinoma; Trabecular adenocarcinoma; Adenoid cystic carcinoma; Adenocarcinoma in adenomatous polyp; Adenocarcinoma, familial polyposis coli; Solid carcinoma, NOS; Carcinoid tumor, malignant; Bronchiolo-alveolar adenocarcinoma; Papillary adenocarcinoma, NOS; Chromophobe carcinoma; Acidophil carcinoma; oxyphilic adenocarcinoma; Basophil carcinoma; Clear cell adenocarcinoma, NOS; Granular cell carcinoma; Follicular adenocarcinoma, NOS; Papillary and follicular adenocarcinoma; Non-encapsulating sclerosing carcinoma; Adrenal cortical carcinoma; Endometroid carcinoma; Skin appendage carcinoma; Apocrine adenocarcinoma; Sebaceous adenocarcinoma; Ceruminous adenocarcinoma; Mucoepidermoid carcinoma; Cystadenocarcinoma, NOS; Papillary cystadenocarcinoma, NOS; Papillary serous cystadenocarcinoma; Mucinous cystadenocarcinoma, NOS; Mucinous adenocarcinoma; Signet ring cell carcinoma; Infiltrating duct carcinoma; Medullary carcinoma, NOS; Lobular carcinoma; Inflammatory carcinoma; Paget's disease, mammary; Acinar cell carcinoma; Adenosquamous carcinoma; Adenocarcinoma w/squamous metaplasia; Thymoma, malignant; Ovarian stromal tumor, malignant; Thecoma, malignant; Granulosa cell tumor, malignant; Androblastoma, malignant;

Sertoli cell carcinoma; Leydig cell tumor, malignant; Lipid cell tumor, malignant; Paraganglioma, malignant; Extramammary paraganglioma, malignant; Pheochromocytoma; Glomangiosarcoma; Malignant melanoma, NOS; Amelanotic melanoma; Superficial spreading melanoma; Malig melanoma in giant pigmented nevus; Epithelioid cell melanoma; Blue nevus, malignant; Sarcoma, NOS; Fibrosarcoma, NOS; Fibrous histiocytoma, malignant; Myxosarcoma; Liposarcoma, NOS; Leiomyosarcoma, NOS; Rhabdomyosarcoma, NOS; Embryonal rhabdomyosarcoma; Alveolar rhabdomyosarcoma; Stromal sarcoma, NOS; Mixed tumor, malignant, NOS; Mullerian mixed tumor; Nephroblastoma; Hepatoblastoma; Carcinosarcoma, NOS; Mesenchymoma, malignant; Brenner tumor, malignant; Phyllodes tumor, malignant; Synovial sarcoma, NOS; Mesothelioma, malignant; Dysgerminoma; Embryonal carcinoma, NOS; Teratoma, malignant, NOS; Struma ovarii, malignant; Choriocarcinoma; Mesonephroma, malignant; Hemangiosarcoma; Hemangioendothelioma, malignant; Kaposi's sarcoma; Hemangiopericytoma, malignant; Lymphangiosarcoma; Osteosarcoma, NOS; Juxtacortical osteosarcoma; Chondrosarcoma, NOS; Chondroblastoma, malignant; Mesenchymal chondrosarcoma; Giant cell tumor of bone; Ewing's sarcoma; Odontogenic tumor, malignant; Ameloblastic odontosarcoma; Ameloblastoma, malignant; Ameloblastic fibrosarcoma; Pinealoma, malignant; Chordoma; Glioma, malignant; Ependymoma, NOS; Astrocytoma, NOS; Protoplasmic astrocytoma; Fibrillary astrocytoma; Astroblastoma; Glioblastoma, NOS; Oligodendroglioma, NOS; Oligodendroblastoma; Primitive neuroectodermal; Cerebellar sarcoma, NOS; Ganglioneuroblastoma; Neuroblastoma, NOS; Retinoblastoma, NOS; Olfactory neurogenic tumor; Meningioma, malignant; Neurofibrosarcoma; Neurilemmoma, malignant; Granular cell tumor, malignant; Malignant lymphoma, NOS; Hodgkin's disease, NOS; Hodgkin's; paragranuloma, NOS; Malignant lymphoma, small lymphocytic; Malignant lymphoma, large cell, diffuse; Malignant lymphoma, follicular, NOS; Mycosis fungoides; Other specified non-Hodgkin's lymphomas; Malignant histiocytosis; Multiple myeloma; Mast cell sarcoma; Immunoproliferative small intestinal disease; Leukemia, NOS; Lymphoid leukemia, NOS; Plasma cell leukemia; Erythroleukemia; Lymphosarcoma cell leukemia; Myeloid leukemia, NOS; Basophilic leukemia; Eosinophilic leukemia; Monocytic leukemia, NOS; Mast cell leukemia; Megakaryoblastic leukemia; Myeloid sarcoma; and Hairy cell leukemia.

In an example comparing the results of a prostate tissue analysis using the methods provided herein to the results of previous methods, the vast majority of markers associated with normal prostate tissues in previous microarray-based studies relate to cells of the stroma. This result is not surprising given that normal samples can be composed of a relatively greater proportion of stromal cells.

In the example of prostate analysis, the strongest single discriminator between benign prostate hyperplasia (BPH) cells and tumor cells was CK15, a result confirmed by immunohistochemistry. CK15 has previously received little attention in this context, but BPH markers play an important role in the diagnosis of ambiguous clinical cases.

Transcripts whose expression levels have high covariance with cross-products of tissue proportions suggest that expression in one cell type depends on the proportion of another tissue, as would be expected in a paracrine mechanism. The stroma transcript with the highest dependence on tumor percentage was TGF-β2. Another such stroma cell gene for which immunohistochemistry was practical was desmin, which showed altered staining in the tumor-associated stroma. In fact, a large number of typical stroma cell genes displayed dependence on the proportion of tumor, adding evidence to the speculation that tumor-associated stroma differs from non-associated stroma. Tumor-stroma paracrine signaling can be reflected in peritumor halos of altered gene expression that can present a much bigger target for detection than the tumor cells alone.

The methods provided herein provide a straightforward approach using simple and multiple linear regression to identify genes whose expression in tissue is specifically correlated with a specific cell type (e.g., in prostate tissue with either tumor cells, BPH epithelial cells or stromal cells). Context-dependent expression that is not readily attributable to single cell types is also recognized. The investigative approach described here is also applicable to a wide variety of tumor marker discovery investigations in a variety of tissues and organs. The exemplary prostate analysis results presented herein demonstrate the ability to identify a large number of gene candidates as specific products of various cells involved in prostate cancer pathogenesis.

A model for cell-specific gene expression is established by both (1) determination of the proportion of each constituent cell type (e.g., epithelium, stroma, tumor, or other discriminating entity) within a given type of tissue or specimen (e.g., prostate, breast, colon, marrow, and the like) and (2) assay of the expression profile (e.g., RNA or protein) of that same tissue or specimen. In some embodiments, cell type specific expression of a gene can be determined by fitting this model to data from a collection of tissue samples.

The methods provided herein can include a step of determining the relative content of each cell type in a heterogeneous sample. Identification of a cell type in a sample can include identifying cell types that are present in a sample in amounts greater than about 1%, 2%, 3%, 4% or 5% or greater than 1%, 2%, 3%, 4% or 5%.

Any of a variety of known methods for cell type identification can be used herein. For example, cell type can be determined by an individual skilled in the ability to identify cell types, such as a pathologist or a histologist. In another example, cell types can be determined by cell sorting and/or flow cytometry methods known in the art.

The methods provided herein can be used to determine that the nucleotide or proteins are differentially expressed in at least one cell type relative to at least one other cell type. Such genes include those that are up-regulated (i.e. expressed at a higher level), as well as those that are down-regulated (i.e. expressed at a lower level). Such genes also include sequences that have been altered (i.e., truncated sequences or sequences with substitutions, deletions or insertions, including point mutations) and show either the same expression profile or an altered profile. In certain embodiments, the genes can be from humans; however, as will be appreciated by those in the art, genes from other organisms can be useful in animal models of disease and drug evaluation; thus, other genes are provided, from vertebrates, including mammals, including rodents (rats, mice, hamsters, guinea pigs, etc.), primates, and farm animals (including sheep, goats, pigs, cows, horses, etc). In some cases, prokaryotic genes can be useful. Gene expression in any of a variety of organisms can be determined by methods provided herein or otherwise known in the art.

Gene products measured according to the methods provided herein can be nucleic acid molecules, including, but not limited to mRNA or an amplicate or complement thereof, polypeptides, or fragments thereof. Methods and compositions for the detection of nucleic acid molecules and proteins are known in the art. For example, oligonucleotide probes and primers can be used in the detection of nucleic acid molecules, and antibodies can be used in the detection of polypeptides.

In the methods provided herein, one or more gene products can be detected. In some embodiments, two or more gene products are detected. In other embodiments, 3 or more, 4 or more, 5 or more, 7 or more, 10 or more 15 or more, 20 or more 25, or more, 35 or more, 50 or more, 75 or more, or 100 or more gene products can be detected in the methods provided herein.

The expression levels of the marker genes in a sample can be determined by any method or composition known in the art. The expression level can be determined by isolating and determining the level (i.e., amount) of nucleic acid transcribed from each marker gene. Alternatively, or additionally, the level of specific proteins translated from mRNA transcribed from a marker gene can be determined.

Determining the level of expression of specific marker genes can be accomplished by determining the amount of mRNA, or polynucleotides derived therefrom, or protein present in a sample. Any method for determining protein or RNA levels can be used. For example, protein or RNA is isolated from a sample and separated by gel electrophoresis. The separated protein or RNA is then transferred to a solid support, such as a filter. Nucleic acid or protein (e.g., antibody) probes representing one or more markers are then hybridized to the filter by hybridization, and the amount of marker-derived protein or RNA is determined. Such determination can be visual, or machine-aided, for example, by use of a densitometer. Another method of determining protein or RNA levels is by use of a dot-blot or a slot-blot. In this method, protein, RNA, or nucleic acid derived therefrom, from a sample is labeled. The protein, RNA or nucleic acid derived therefrom is then hybridized to a filter containing oligonucleotides or antibodies derived from one or more marker genes, wherein the oligonucleotides or antibodies are placed upon the filter at discrete, easily-identifiable locations. Binding, or lack thereof, of the labeled protein or RNA to the filter is determined visually or by densitometer. Proteins or polynucleotides can be labeled using a radiolabel or a fluorescent (i.e., visible) label.

Methods provided herein can be used to detect mRNA or amplicates thereof, and any fragment thereof. In one example, introns of mRNA or amplicate or fragment thereof can be detected. Processing of mRNA can include splicing, in which introns are removed from the transcript. Detection of introns can be used to detect the presence of the entire mRNA, and also can be used to detect processing of the mRNA, for example, when the intron region alone (e.g., intron not attached to any exons) is detected.

In another embodiment, methods provided herein can be used to detect polypeptides and modifications thereof, where a modification of a polypeptide can be a post-translation modification such as lipidylation, glycosylation, activating proteolysis, and others known in the art, or can include degradational modification such as proteolytic fragments and ubiquitinated polypeptides.

These examples are not intended to be limiting; other methods of determining protein or RNA abundance are known in the art.

Alternatively, proteins can be separated by two-dimensional gel electrophoresis systems. Two-dimensional gel electrophoresis is well-known in the art and can involve isoelectric focusing along a first dimension followed by SDS-PAGE electrophoresis along a second dimension. See, e.g., Hames et al, 1990, GEL ELECTROPHORESIS OF PROTEINS: A PRACTICAL APPROACH, IRL Press, New York; Shevchenko et al., Proc. Nat'l Acad. Sci. USA 93:1440-1445 (1996); Sagliocco et al., Yeast 12:1519-1533 (1996); Lander, Science 274:536-539 (1996). The resulting electropherograms can be analyzed by numerous techniques, including mass spectrometric techniques, western blotting and immunoblot analysis using polyclonal and monoclonal antibodies.

Alternatively, marker-derived protein levels can be determined by constructing an antibody microarray in which binding sites comprise immobilized antibodies, such as monoclonal antibodies, specific to a plurality of protein species encoded by the cell genome. Antibodies can be present for a substantial fraction of the marker-derived proteins of interest. Methods for making monoclonal antibodies are well known (see, e.g., Harlow and Lane, 1988, ANTIBODIES: A LABORATORY MANUAL, Cold Spring Harbor, N.Y., which is incorporated in its entirety for all purposes). In one embodiment, monoclonal antibodies are raised against synthetic peptide fragments designed based on genomic sequence of the cell. With such an antibody array, proteins from the cell are contacted to the array, and their binding is assayed with assays known in the art. The expression, and the level of expression, of proteins of diagnostic or prognostic interest can be detected through immunohistochemical staining of tissue slices or sections.

In another embodiment, expression of marker genes in a number of tissue specimens can be characterized using a tissue array (Kononen et al., Nat. Med 4(7):844-7 (1998)). In a tissue array, multiple tissue samples are assessed on the same microarray. The arrays allow in situ detection of RNA and protein levels; consecutive sections allow the analysis of multiple samples simultaneously.

In some embodiments, polynucleotide microarrays are used to measure expression so that the expression status of each of the markers above is assessed simultaneously. In one embodiment, the microarrays provided herein are oligonucleotide or cDNA arrays comprising probes hybridizable to the genes corresponding to the marker genes described herein.

The microarrays provided herein can comprise probes hybridizable to the genes corresponding to markers able to distinguish cells, identify phenotypes, identify a disease or disorder, or provide a prognosis of a disease or disorder. In particular, provided herein are polynucleotide arrays comprising probes to a subset or subsets of at least 2, 5, 10, 15, 20, 30, 40, 50, 75, 100, 150, 200, 300, 400, 500, 750, 1,000, 1,250, 1,500, 1,750, 2,000, 2,250, 2,500, 2750, 3000, 3500, 4000, 4500, 5000, or more, genetic markers, up to the full set of markers listed in SEQ ID NO:1-38,826. In some embodiments, the nucleotide sequences selected from SEQ ID NO:1-38,826 are selected from SEQ ID NO:35,580-38,826. Also provided herein are probes to markers with a modified t statistic greater than or equal to 2.5, 3, 3.5, 4, 4.5 or 5. Also provided herein are probes to markers with a modified t statistic less than or equal to −2.5, −3, −3.5, −4, −4.5 or −5. In specific embodiments, the invention provides combinations such as arrays in which the markers described herein comprise at least 50%, 60%, 70%, 80%, 85%, 90%, 95% or 98% of the probes on the combination or array.

General methods pertaining to the construction of microarrays comprising the marker sets and/or subsets above are known in the art as described herein.

Microarrays can be prepared by selecting probes that comprise a polypeptide or polynucleotide sequence, and then immobilizing such probes to a solid support or surface. For example, the probes can comprise DNA sequences, RNA sequences, or antibodies. The probes can also comprise amino acid, DNA and/or RNA analogues, or combinations thereof. The probes can be prepared by any method known in the art.

The probe or probes used in the methods of the invention can be immobilized to a solid support which can be either porous or non-porous. For example, the probes of the can be attached to a nitrocellulose or nylon membrane or filter. Alternatively, the solid support or surface can be a glass or plastic surface. In another embodiment, hybridization levels are measured to microarrays of probes consisting of a solid phase on the surface of which are immobilized a population of probes. The solid phase can be a nonporous or, optionally, a porous material such as a gel.

In another embodiment, the microarrays are addressable arrays, such as positionally addressable arrays. More specifically, each probe of the array can be located at a known, predetermined position on the solid support such that the identity (i.e., the sequence) of each probe can be determined from its position in the array (i.e., on the support or surface).

A skilled artisan will appreciate that positive control probes, e.g., probes known to be complementary and hybridizable to sequences in target polynucleotide molecules, and negative control probes, e.g., probes known to not be complementary and hybridizable to sequences in target polynucleotide molecules, can be included on the array. In one embodiment, positive controls can be synthesized along the perimeter of the array. In another embodiment, positive controls can be synthesized in diagonal stripes across the array. Other variations are known in the art. Probes can be immobilized on the to solid surface by any of a variety of methods known in the art.

In certain embodiments, this model can be further extended to include sample characteristics, such as cell or organism phenotypes, allowing cell type specific expression to be linked to observable indicia such as clinical indicators and prognosis (e.g., clinical disease progression, response to therapy, and the like). In one embodiment, a model for prostate tissue is provided, resulting in identification of cell-type-specific markers of cancer, epithelial hypertrophy, and disease progression. In another embodiment, a method for studying differential gene expression between subjects with cancers that relapse and those with cancers that do not relapse, is disclosed. Also provided is the framework for studying mixed cell type samples and more flexible models allowing for cross-talk among genes in a sample. Also provided are extensions to defining differences in expression between samples with different characteristics, such as samples from subjects who subsequently relapse versus those who do not.

Statistical Treatment

The methods provided herein include determining the regression relationship between relative cell content and measured expression levels. For example, the regression relationship can be determined by determining the regression of measured expression levels on cell proportions. Statistical methods for determining regression relationships between variables are known in the art. Such general statistical methods can be used in accordance with the teachings provided herein regarding regression of measured expression levels on cell proportions.

The methods provided herein also include calculating the level of analytes in each cell type based on the regression relationship between relative cell content and expression levels. The regression relationship can be determined according to methods provided herein, and, based on the regression relationship, the level of a particular analyte can be calculated for a particular cell type. The methods provided herein can permit the calculation of any of a variety of analyte for particular cell types. For example, the methods provided herein can permit calculation of a single analyte for a single cell type, or can permit calculation of a plurality of analytes for a single cell type, or can permit calculation of a single analyte for a plurality of cell types, or can permit calculation of a plurality of analytes for a plurality of cell types. Thus, the number of analytes whose level can be calculated for a particular cell type can range from a single analyte to the total number of analytes measured (e.g., the total number of analytes measured using a microarray). In another embodiment, the total number of cell types for which analyte levels can be calculated can range from a single cell type, to all cell types present in a sample at sufficient levels. The levels of analyte for a particular cell type can be used to estimate expression levels of the corresponding gene, as provided elsewhere herein.

The methods provided herein also can include identifying genes differentially expressed in a first cell type relative to a second cell type. Expression levels of one or more genes in a particular cell type can be compared to one or more additional cell types. Differences in expression levels can be represented in any of a variety of manners known in the art, including mathematical or statistical representations, as provided herein. For example, differences in expression level can be represented as a modified t statistic, as described elsewhere herein.

The methods provided herein also can serve as the basis for methods of indicating the presence of a particular cell type in a subject. The methods provided herein can be used for identifying the expression levels in particular cell types. Using any of a variety of classifier methods known in the art, such as a naive Bayes classifier, gene expression levels in cells of a sample from a subject can be compared to reference expression levels to determine the presence of absence, and, optionally, the relative amount, of a particular cell type in the sample. For example, the markers provided herein as associated with prostate tumor, stroma or BPH can be selected in a prostate tumor classifier in accordance with the modified t statistic associated with each marker provided in the Tables herein. Methods for using a modified-t statistic in classifier methods are provided herein and also are known in the art. In another embodiment, the methods provided herein can be used in phenotype-indicating methods such as diagnostic or prognostic methods, in which the gene expression levels in a sample from a subject can be compared to references indicative of one or more particular phenotypes.

For purposes of exemplification, and not for purposes of limitation, an exemplary method of determining gene expression levels in one or more cell types in a heterogeneous cell sample is provided as follows. Suppose that there are four cell types: BPH, Tumor, Stroma, and Cystic Atrophy. Supposing that each cell type has a (possibly) different distribution for y, the expression level for a gene j, denoted by:

$f_{ij}(y), i \in \{BPH, \text{Tumor}, \text{Stromia}, \text{Cystic Atrophy}\}$ and that sample k has proportions $X_k = (x_{k,BPH}, x_{k,Tumor}, x_{k,Cystic\ Atrophy})$ of each cell type is studied. The distribution of the expression level for gene j is then $$g_j(y|X_k) = \sum_i x_{ki} f_{ij}(y)$$

if the expression levels are additive in the cell proportions as they would be if each cell's expression level depends only on the type of cell (and not, say, on what other types of cells can be present in the sample). In a later section this formulation is extended to cases in which the expression of a given cell type depends on what other types of cells are present.

The average expression level in a sample is then the weighted average of the expectations with weights corresponding to the cell proportions:

$$E_{g_j}(y|X_k) = \sum_i x_{ki} E_{f_{ij}}(y)$$

or $$y_{jk} = \sum_i x_{ki} \beta_{ij} + \epsilon_{jk}$$

where $$E_{f_{ij}}(y) = \beta_{ij} \text{ and } \epsilon_{jk} = y_{jk} - E_{g_j}(y|X_k)$$

This is the known form for a multiple linear regression equation (without specifying an intercept), and when multiple samples are available one can estimate the $\beta_{ij}$. Once these estimates are in hand, estimates for the differences in gene expression of two cell types are of the form:

$$\hat{\beta}_{i_1 j} - \hat{\beta}_{i_2 j}$$

and standard methods for testing linear hypotheses about the coefficients $\beta_{ij}$ can be applied to test whether the average expression levels of cell types $i_1$ and $i_2$ are different. The term 'expression levels' as used in this exemplification of the method is used in a generic sense: 'expression levels' could be readings of mRNA levels, cRNA levels, protein levels, fluorescent intensity from a feature on an array, the logarithm of that reading, some highly post-processed reading, and the like. Thus, differences in the coefficients can correspond to differences, log ratios, or some other functions of the underlying transcript abundance.

For computational convenience, one may in certain embodiments use $Z=XT$ and $\gamma=T^{-1}\beta$ setting up $T$ so that one column of $T$ has all zeroes but for a one in position $i_1$ and a minus one in position $i_2$ such as $$T = \begin{pmatrix} 1 & 1 & -1 & 0 \\ 1 & 1 & 1 & 0 \\ 1 & 0 & 0 & 1 \\ 1 & 0 & 0 & 0 \end{pmatrix}$$

The columns of Z that result are the unit vector (all ones), $X_{k,BPH}+X_{k,Tumor}$, $X_{k,BPH}-X_{k,Tumor}$, and $X_{k,Stroma}$. With this setup, twice the coefficient of $X_{k,BPH}-X_{k,Tumor}$ estimates the average difference in expression level of a tumor cell versus a BPH cell. With this parametrization, standard software can be used to provide an estimate and a tesmodified t statistic for the average difference of tumor and BPH cells. Further, this can simplify the specification of restricted models in which two or more of the tissue components have the same average expression level.

The data for a study can contain a large number of samples from a smaller number of different men. It is plausible that the samples from one man may tend to share a common level of expression for a given gene, differences among his cells according to their type notwithstanding. This will tend to lead to positive covariance among the measurements of expression level within men. Ordinary least squares (OLS) estimates are less than fully efficient in such circumstances. One alternative to OLS is to use a weighted least squares approach that treats a collection of samples from a single subject as having a common (non-negative) covariance and identical variances.

The estimating equation for this setup can be solved via iterative methods using software such as the gee library from R (Ross Ihaka and Robert Gentleman. R: A language for data analysis and graphics. Journal of Computational and Graphical Statistics, 5:299-314, 1996)). When the estimated covariance is negative—as sometimes happens when there is an extreme outlier in the dataset—it can be fixed at zero. Also the sandwich estimate (Kung-Yee Liang and Scott L. Zeger. Longitudinal data analysis using generalized linear models. Biometrika, 73:13-22, 1986.) of the covariance structure can be used.

The estimating equation approach will provide a tesmodified t statistic for a single transcript. Assessment of differential expression among a group of 12625 transcripts is handled by permutation methods that honor a suitable null model. That null model is obtained by regressing the expression level on all design terms except for the 'BPH-tumor' term using the exchangeable, non-negative correlation structure just mentioned. For performing permutation tests, the correlation structure in the residuals can be accounted for. Let $k_1$ be the set of $n_1$ indexes of samples for subject 1. First, we find $y_{jk} - \hat{y}_{jk} = e_{jk}$, $k \in k_1$, as the residuals from that fitted null model for subject 1. The inverse square root of the correlation matrix of these residuals is used to transform them, i.e. $\tilde{e}_j = \phi^{-1/2} e_j$, where $\phi$ is the (block diagonal) correlation matrix obtained by substituting the estimate of $r$ from gee as the off-diagonal elements of blocks corresponding to measurements for each subject and $e_j$ and $\tilde{e}_j$ are the vector of residuals and transformed residuals for all subjects for gene j. Asymptotically, the $\tilde{e}_{jk}$ have means and covariances equal to zero. Random permutations of these, $\tilde{e}_{j.}^{(i)}$, $i=1, \ldots, M$, are obtained and used to form pseudo-observations:

$$\tilde{y}_{j.}^{(i)} = \hat{y}_{j.} + \phi^{1/2} \tilde{e}_{j.}^{(i)}$$

This permutation scheme preserves the null model and enforces its correlation structure asymptotically.

In certain embodiments, the contribution of each type of cell does not depend on what other cell types are present in the sample. However, there can be instances in which contribution of each type of cell does depend on other cell types present in the sample. It may happen that putatively 'normal' cells exhibit genomic features that influence both their expression profiles and their potential to become malignant. Such cells would exhibit the same expression pattern when located in normal tissue, but are more likely to be found in samples that also have tumor cells in them. Another possible effect is that signals generated by tumor cells trigger expression changes in nearby cells that would not be seen if those same cells were located in wholly normal tissue. In either case, the contribution of a cell may be more or less than in another tissue environment leading to a setup in which the contributions of individual cell types to the overall profile depend on the proportions of all types present, viz.

$$g_j(y|X_k) = \sum_i x_{ki} f_{ij}(y|X_k)$$

as do the expected proportions $$E_{g_j}(y|X_k) = \sum_i x_{ki} E_{f_{ij}}(y|X_k)$$

or $$y_{jk} = \sum_i x_{ki}\beta_{ij} + (X_k) + \epsilon_{jk}$$

The methods used herein above can still be applied in the context provided some calculable form is given for $\beta_{ij}(X_k)$. One choice is given by $$\beta_{ij}(X_k)=(\phi_j R(X_k))_i$$

where $\Phi_j$ is a 4×m matrix of unknown coefficients and $R(X_k)$ is a column vector of m elements. This reduces to the case in which each cell's expression level depends only on the type of cell when $\Phi_j$ is 4×1 matrix and $R(X_k)$ is just '1'.

Consider the case:

$$\phi_j(X_k)R(X_k) = \begin{pmatrix} v_{Bj} & v_{Bj} & v_{Bj} & v_{Bj} \\ v_{Tj} & v_{Tj} & v_{Tj} & v_{Tj} \\ v_{Sj} & v_{Sj}+\delta_j & v_{Sj} & v_{Sj} \\ v_{Cj} & v_{Cj} & v_{Cj} & v_{Cj} \end{pmatrix} \begin{pmatrix} x_{k,B} \\ x_{k,T} \\ x_{k,S} \\ x_{k,C} \end{pmatrix} = \begin{pmatrix} v_{Bj} \\ v_{Tj} \\ v_{Sj}+\delta_j x_{k,T} \\ v_{Cj} \end{pmatrix}$$

$$\phi_j(X_k)R(X_k) = \begin{pmatrix} v_{Bj} & v_{Bj} & v_{Bj} & v_{Bj} \\ v_{Tj} & v_{Tj} & v_{Tj} & v_{Tj} \\ v_{Sj} & v_{Sj}+\delta_j & v_{Sj} & v_{Sj} \\ v_{Cj} & v_{Cj} & v_{Cj} & v_{Cj} \end{pmatrix} \begin{pmatrix} x_{k,B} \\ x_{k,T} \\ x_{k,S} \\ x_{k,C} \end{pmatrix} = \begin{pmatrix} v_{Bj} \\ v_{Tj} \\ v_{Sj}+\delta_j x_{k,T} \\ v_{Cj} \end{pmatrix}$$

(and recall that $\Sigma_j X_{k,j}=1$) Here the subscript for Tumor has been abbreviated T etc., for brevety. This setup provides that BPH (B), tumor, and cystic atrophy (C) cells have expression profiles that do not depend on the other cell types in the sample. However, the expression levels of stromal cells (S) depend on the proportion of tumor cells as reflected by the coefficient $\delta_j$. Notice that is linear in $X_{k,B}$, $X_{k,T}$, $X_{k,S}$, $X_{k,C}$, and $X_{k,S}X_{k,T}$ with the unknown $$X_k \phi_j R(X_k) = x_{k,B} v_{Bj} + x_{k,T} v_{Tj} + x_{k,S} v_{Sj} + x_{k,S} x_{k,T} \delta_j + x_{k,C} v_{Cj}$$

coefficients being multipliers of those terms. So, the unknowns in this case are linear functions of the gene expression levels and can be determined using standard linear models as was done earlier. The only change here is the addition of the product of $X_{k,s}$ and $X_{k,T}$. Such a product, when significant, is termed an "interaction" and refers to the product archiving a significance level owing to a correlation of $X_{k,S}$ with $X_{k,T}$. Thus, it is possible to accommodate variations in gene expression that occur when the level of a transcript in one cell type is influenced by the amount of another cell type in the sample. In one aspect, a setup involving a dependency of tumor on the amount of stroma $$\phi_j(X_k)R(X_k) = \begin{pmatrix} v_{Bj} & v_{Bj} & v_{Bj} & v_{Bj} \\ v_{Tj} & v_{Tj} & v_{Tj}+\delta_j & v_{Tj} \\ v_{Sj} & v_{Sj} & v_{Sj} & v_{Sj} \\ v_{Cj} & v_{Cj} & v_{Cj} & v_{Cj} \end{pmatrix} \begin{pmatrix} x_{k,B} \\ x_{k,T} \\ x_{k,S} \\ x_{k,C} \end{pmatrix} = \begin{pmatrix} v_{Bj} \\ v_{Tj}+\delta_j x_{k,T} \\ v_{Sj} \\ v_{Cj} \end{pmatrix}$$

the expression for $X_k \Phi_j R(X_k)$ is precisely as it was just above.

Accordingly, one can screen for dependencies by including as regressors products of the proportions of cell types. In certain embodiments, it may not be possible to detect interactions if two different cell types experience equal and opposite changes—one type expressing more with increases in the other and the other expressing less with increases in the first. In one embodiment, dependence of gene expression refers to the dependence of gene expression in one cell type on the level of gene expression in another cell type. In another embodiment, dependence of gene expression refers to the dependence of gene expression in one cell type on the amount of another cell type.

The contribution of each type of cell can depend on what other cell types are present in the sample, but also can depend on other characteristics of the sample, such as clinical characteristics of the subject who contributed it. For example, clinical characteristics such as disease symptoms, disease prognosis such as relapse and/or aggressiveness of disease, likelihood of success in treating a disease, likelihood of survival, condition in which a particular treatment regimen is likely to be more effective than another treatment regimen, can be correlated with cell expression. For example, cell type specific gene expression can differ between a subject with a cancer that does not relapse after treatment and a subject with a cancer that does relapse after treatment. In this case, the contribution of a cell type may be more or less than in another subject leading to an instance in which the contributions of individual cell types to the overall profile depend on the characteristics of the subject or sample. Here, the model used earlier is extended to allow for dependence on a vector of sample specific covariates, $Z_k$:

$$g_j(y|X_k, Z_k) = \sum_i x_{ki} f_{ij}(y|X_k, Z_k)$$

as do the expected proportions:

$$E_{g_j}(y|X_k, Z_k) = \sum_i x_{ki} E_{f_{ij}}(y|X_k, Z_k)$$

or $$y_{jk} = \sum_i x_{ki}\beta_{ij} + (X_k, Z_k) + \epsilon_{jk}$$

where $$E_{f_{ij}}(y|X_k, Z_k) = \beta_{ij}(X_k, Z_k)$$

and $$\epsilon_{jk} = y_{jk} - E_{g_j}(y|X_k, Z_k).$$

The methods used herein above can still be applied in this context provided some reasonable form is given for $\beta_{ij}(X_k, Z_k)$. One useful choice is given by:

$$\beta_{ij}(X_k, Z_k)=(\phi_j R(Z_k))_i$$

Where $\Phi_j$ is a 4×m matrix of unknown coefficients and $R(Z_k)$ is a column vector of m elements.

Consider how this would be used to study differences in gene expression among subjects who relapse and those who do not. In this case, $Z_k$ is an indicator variable taking the value zero for samples of subjects who do not relapse and one for those who do. Then $$R(Z_k) = \begin{pmatrix} 1 \\ Z_k \end{pmatrix}$$

and $\Phi_j$ is a four by two matrix of coefficients:

$$\phi_j = \begin{pmatrix} v_{Bj} & \delta_{Bj} \\ v_{Tj} & \delta_{Tj} \\ v_{Sj} & \delta_{Sj} \\ v_{Cj} & \delta_{Cj} \end{pmatrix}$$

Notice that this leads to $$X_k\phi_j R(Z_k) = x_{k,B}v_{Bj} + x_{k,T}v_{Tj} + x_{k,S}v_{Sj} + x_{k,C}v_{Cj} + x_{k,B}Z_k\delta_{Bj} + x_{k,T}Z_k\delta_{Tj} + x_{k,S}Z_k\delta_{Sj} + x_{k,C}Z_k\delta_{Cj}$$

The v coefficients give the average expression of the different cell types in subjects who do not relapse, while the δ coefficients give the difference between the average expression of the different cell types in subjects who do relapse and those who do not. Thus, a non-zero value of $\delta_T$ would indicate that in tumor cells, the average expression level differs for subjects who relapse and those who do not. The above equation is linear in its coefficients, so standard statistical methods can be applied to estimation and inference on the coefficients. Extensions that allow β to depend on both cell proportions and on sample covariates can be determined according to the teachings provided herein or other methods known in the art.

Nucleic Acids

Provided herein are nucleic acid molecules that contain one or more nucleotide sequences provided in SEQ ID NO:1-38,826 or a complement thereof. For purposes of brevity and clarity, reference to one or more nucleotide sequences in SEQ ID NO: 1-38,826 also is intended to refer to the nucleotide sequence complementary thereto, as will be understood by one skilled in the art. In some embodiments, a nucleic acid molecule that contains one or more nucleotide sequences provided in SEQ ID NO:1-38,826 is a gene that encodes RNA and/or a polypeptide. Also provided herein are splice variants of the nucleotide sequences listed in SEQ ID NO:35,580-38,826. Such splice variants also can encode a polypeptide. In particular, nucleic acid molecules encoding genes containing the nucleotide sequences listed in SEQ ID NO:35,580-38,826 from animals, including splice variants thereof are provided. The encoded proteins are also provided. Also provided are functional domains thereof. For each of the nucleic acid molecules provided, the nucleic acid can be DNA or RNA or PNA or other nucleic acid analogs or can include non-natural nucleotide bases. Also provided are isolated nucleic acid molecules that include a sequence of nucleotides complementary to a nucleotide sequence provided in SEQ ID NO:1-38,826. In some embodiments, the nucleotide sequences selected from SEQ ID NO:1-38,826 are selected from SEQ ID NO:35,580-38,826.

Provided herein are tables listing probe sets; nucleotide sequences of the probes in the probe sets; genes associated with the probe set, including, for some tables, genbank accession number, locus ID, nucleotide sequence of the genes, splice regions for the genes, start and stop translation sites for the genes; modified t statistics for each probe set, and additional information described with reference to the individual table. One skilled in the art will recognize the relationship between the tables, such that nucleotide sequence information associated with particular probe sets in a first table can thereby be associated with other features such as modified t statistics by virtue of one or more additional tables that associate probe sets with those features such as modified t statistics. For example, Table 15 lists Probe ID, Probe SEQ ID NOs and Gene SEQ ID NOs to identify the nucleotide sequences of the enclosed sequence listing correspond to each Probe set (Probe ID); subsequent tables (e.g., Table 2 or Table 8) that describe information (e.g., modified t statistics) relating to a particular Probe ID, are therefore contemplated herein to also describe information relating to each nucleotide sequence identified with that Probe ID.

Table 2 provides modified t statistics for an Affymetrix U95Av2 microarray, including Bstat (modified t statistic for BPH), Sstat (modified t statistic for stroma), Tstat (modified t statistic for tumor). The Probe IDs for the U95Av2 microarray that map to a Probe ID for the U133a microarray, and the mapping itself, is provided in Table 17, where the mapping represents Probe IDs of microarrays that can hybridize to the same gene. Probe IDs with identical names for the two arrays are identical. Accordingly, by virtue of the mapping of Table 17, Table 2 Probe IDs can be associated with nucleotide sequences via Table 15. Table 8 provides Probe IDs for Affymetrix U133a microarray, and associated t statistics for BPH, tumor, stroma and cystic atrophy. Table 8 also identifies cell type for which the modified t statistic is greater than 2.5. Table 8 also identifies cell type for which the calculated expression for the associated gene is greater than two-fold more than in other cell types; such information can be used in selection of probes for a classifier, as described elsewhere herein. Table 9 provides the top genes identified as up- and down-regulated in prostate tumor cells of relapse patients, calculated by linear regression including all samples with prostate cancer; in Table 9, "1" is the top up-regulated gene, and "−1" is the top down-regulated gene. The gene(s) referred to in Table 9 (which lists Probe ID) can be determined by way of Table 15. Other tables describing genes in terms of Probe ID also can be interpreted according to Table 15. Tables 9-13 also contains a column that indicates with a "D" those genes that have a greater than 1.5 fold ratio of predicted expression between relapse and non-relapse tissue, as well as an absolute difference in expression that exceeds the expression level reported for most genes queried by the array.

Table 10 provides top genes identified as up- and down-regulated in prostate stroma of relapse patients, calculated by linear regression including all samples with prostate cancer, with numbering as in Table 9. Table 11 identifies exemplary genes whose expression can be examined in methods for identifying or characterizing a sample; and also identifies Probe IDs that can be used for such gene expression identification.

Table 12 provides top 144 genes identified as down-regulated in prostate stroma cells of relapse patients, calculated by linear regression including only samples that did not have detectable tumor cells, with ranking as with Table 9. In some embodiments, Table 13 provides top 100 genes identified as up-regulated in prostate stroma of relapse patients when only samples free of tumor were examined from cases of prostate cancer. Thus, Tables 12 and 13 demonstrate that genes in stroma can be used to determine a prognosis such as relapse, aggressiveness, and indolence of prostate tumor.

Table 15 provides splice variants of the genes provided herein. Each row identifies one or more pairs of numbers that identify the first and last residues of an exon in the gene, where the numbers in the pair are separated by a comma, and different pairs are separated by semicolons. Table 15 also provides the start and stop site of translation of the gene into a polypeptide. As will be understood in the art, multiple splicing combinations are provided for some genes. One skilled in the art can apply the splicing taught in Table 15 and nucleotide sequences listed herein to generate the nucleotide sequence of a spliced mRNA transcript. One skilled in the art also can apply the splicing taught in Table 15 and nucleotide sequences listed herein to generate the amino acid sequence of a polypeptide translated from the spliced transcript. Reference herein to one or more genes (including reference to products of genes) by referring to the SEQ ID NO of the gene or the SEQ ID NO of a nucleotide contained in the gene also contemplates reference to spliced gene sequences for the corresponding SEQ ID NO in accordance with Table 15. Similarly, reference herein to one or more protein gene products also contemplates proteins translated from the splice variants identified in Table 15.

Table 14 provides a list of 35 (nonunique) genes that have been associated with differential expression in aggressive prostate cancer. Among the cell-specific genes identified here (see, e.g., Tables 8-10), those not previously known to be indicator of aggressive prostate cancer are contemplated herein. For example, Table 14 lists genes associated with aggressive prostate cancer that are also found among the genes identified here (see, e.g., Table 9-10). Thus, contemplated herein all genes of Tables 1-13 and 15-17 that are not present in Table 14 represent genes identified herein as genes whose differential expression can be indicative of prostate cancer (in accordance with the corresponding table). For example, cell-specific genes statistically significantly differentially expressed in early relapse prostate cancer by tumor cells (Table 9) or stroma cells (Table 10) of early relapse prostate cancer are biomarkers when used individually or in combination to form panels or profiles of genes for use in the examination of gene expression of prostate tissue by the methods described herein in order to determine whether the examined prostate tissue is similar in gene expression to the pattern of, for example, early relapsed or aggressive disease or indolent disease. When used alone as markers, the methods, compositions and kits provided herein exclude those genes identified in Table 14. When used in combination, genes identified in Table 14 also can be used in the methods, combinations, compositions and kits provided herein, with the exception of use of PSA and PMSA in a combination of only those two genes.

Exemplary, non-limiting examples of genes whose products can be detected in the methods provided herein include, IGF-1, microsimino protein, and MTA-1. In one embodiment detection of the expression of one or more of these genes can be performed in combination with detection of expression of one or more additional genes containing a sequence provided in SEQ ID NO:1-38,826.

Uses of Probes and detection of genes identified in the tables are described herein and exemplified below. It is contemplated herein that uses and methods similar to those exemplified below can be applied to the probe and gene nucleotide sequences in accordance with the teachings provided herein.

Also provided are nucleic acid molecules that have at least 60%, 70%, 75%, 80%, 81%, 82%, 83%, 84%, 85%, 86%, 87%, 88%, 89%, 90%, 91%, 92%, 93%, 94%, 95%, 96%, 97%, 98% or 99% sequence identity with a nucleotide of SEQ ID NO:1-38,826, or that hybridizes along their full-length or along at least about 70%, 80% or 90% of the full-length nucleic acid to a nucleic acids under conditions of moderate, or high, stringency. In some embodiments, the nucleotide sequences selected from SEQ ID NO:1-38,826 are selected from SEQ ID NO:35,580-38,826.

The isolated nucleic acids can contain least 10 nucleotides, 25 nucleotides, 50 nucleotides, 100 nucleotides, 150 nucleotides, or 200 nucleotides or more, contiguous nucleotides of a sequence provided in SEQ ID NO:1-38,826. In another embodiment, the nucleic acids are smaller than 35, 200 or 500 nucleotides in length. In some embodiments, the nucleotide sequences selected from SEQ ID NO:1-38,826 are selected from SEQ ID NO:35,580-38,826.

Also provided are fragments of the above nucleic acids that can be used as probes or primers and that contain at least about 10 nucleotides, at least about 14 nucleotides, at least about 16 nucleotides, or at least about 30 nucleotides. The length of the probe or primer is a function of the size of the genome probed; the larger the genome, the longer the probe or primer required for specific hybridization to a single site. Those of skill in the art can select appropriately sized probes and primers. Probes and primers as described can be single-stranded. Double stranded probes and primers also can be used, if they are denatured when used. Probes and primers derived from the nucleic acid molecules are provided. Such probes and primers contain at least 8, 14, 16, 30, 100 or more contiguous nucleotides. The probes and primers are optionally labeled with a detectable label, such as a radiolabel or a fluorescent tag, or can be mass differentiated for detection by mass spectrometry or other means. Also provided is an isolated nucleic acid molecule that includes the sequence of molecules that is complementary to the nucleotides provided in SEQ ID NO:1-38,826. Double-stranded RNA (dsRNA), such as RNAi is also provided. In some embodiments, the nucleotide sequences selected from SEQ ID NO:1-38,826 are selected from SEQ ID NO:35,580-38,826.

Plasmids and vectors containing the nucleic acid molecules are also provided. Cells containing the vectors, including cells that express the encoded proteins are provided. The cell can be a bacterial cell, a yeast cell, a fungal cell, a plant cell, an insect cell or an animal cell.

For recombinant expression of one or more of the genes containing a nucleotide sequence provided in SEQ ID NO:1-38,826, the nucleic acid containing all or a portion of the nucleotide sequence encoding the genes can be inserted into an appropriate expression vector, i.e., a vector that contains the elements for the transcription and translation of the inserted protein coding sequence. In some embodiments, the nucleotide sequences selected from SEQ ID NO:1-38,826 are selected from SEQ ID NO:35,580-38,826. The transcriptional and translational signals can also be supplied by the native promoter for the genes, and/or their flanking regions.

Also provided are vectors that contain nucleic acid encoding a gene containing a sequence provided in SEQ ID NO:1-38,826 In some embodiments, the nucleotide sequences selected from SEQ ID NO:1-38,826 are selected from SEQ ID NO:35,580-38,826. Cells containing the vectors are also provided. The cells include eukaryotic and prokaryotic cells, and the vectors are any suitable for use therein.

Prokaryotic and eukaryotic cells containing the vectors are provided. Such cells include bacterial cells, yeast cells, fungal cells, plant cells, insect cells and animal cells. The cells can be used to produce an oligonucleotide or polypeptide gene products by (a) growing the above-described cells under conditions whereby the encoded gene is expressed by the cell, and then (b) recovering the expressed compound.

A variety of host-vector systems can be used to express the protein coding sequence. These include but are not limited to mammalian cell systems infected with virus (e.g. vaccinia virus, adenovirus, etc.); insect cell systems infected with virus (e.g. baculovirus); microorganisms such as yeast containing yeast vectors; or bacteria transformed with bacteriophage, DNA, plasmid DNA, or cosmid DNA. The expression elements of vectors vary in their strengths and specificities. Depending on the host-vector system used, any one of a number of suitable transcription and translation elements can be used.

Any methods known to those of skill in the art for the insertion of nucleic acid fragments into a vector can be used to construct expression vectors containing a chimeric gene containing appropriate transcriptional/translational control signals and protein coding sequences. These methods can include in vitro recombinant DNA and synthetic techniques and in vivo recombinants (genetic recombination). Expression of nucleic acid sequences encoding polypeptide can be regulated by a second nucleic acid sequence so that the genes or fragments thereof are expressed in a host transformed with the recombinant DNA molecule(s). For example, expression of the proteins can be controlled by any promoter/enhancer known in the art.

Proteins

Protein products of the genes provided in SEQ ID NO:35, 580-38,826, derivatives and analogs can be produced by various methods known in the art. For example, once a recombinant cell expressing such a polypeptide, or a domain, fragment or derivative thereof, is identified, the individual gene product can be isolated and analyzed. This is achieved by assays based on the physical and/or functional properties of the protein, including, but not limited to, radioactive labeling of the product followed by analysis by gel electrophoresis, immunoassay, cross-linking to marker-labeled product, and assays of protein activity or antibody binding.

The polypeptides can be isolated and purified by standard methods known in the art (either from natural sources or recombinant host cells expressing the complexes or proteins), including but not restricted to column chromatography (e.g., ion exchange, affinity, gel exclusion, reversed-phase high pressure and fast protein liquid), differential centrifugation, differential solubility, or by any other standard technique used for the purification of proteins. Functional properties can be evaluated using any suitable assay known in the art.

Manipulations of polypeptide sequences can be made at the protein level. Also contemplated herein are polypeptide proteins, domains thereof, derivatives or analogs or fragments thereof, which are differentially modified during or after translation, e.g., by glycosylation, acetylation, phosphorylation, amidation, derivatization by known protecting/blocking groups, proteolytic cleavage, linkage to an antibody molecule or other cellular ligand. Any of numerous chemical modifications can be carried out by known techniques, including but not limited to specific chemical cleavage by cyanogen bromide, trypsin, chymotrypsin, papain, V8 protease, NaBH4, acetylation, formulation, oxidation, reduction, metabolic synthesis in the presence of tunicamycin and other such agents.

In addition, domains, analogs and derivatives of a polypeptide provided herein can be chemically synthesized. For example, a peptide corresponding to a portion of a polypeptide provided herein, which includes the desired domain or which mediates the desired activity in vitro can be synthesized by use of a peptide synthesizer. Furthermore, if desired, nonclassical amino acids or chemical amino acid analogs can be introduced as a substitution or addition into the polypeptide sequence. Non-classical amino acids include but are not limited to the D-isomers of the common amino acids, a-amino isobutyric acid, 4-aminobutyric acid, Abu, 2-aminobutyric acid, .epsilon.-Abu, e-Ahx, 6-amino hexanoic acid, Aib, 2-amino isobutyric acid, 3-amino propionoic acid, ornithine, norleucine, norvaline, hydroxyproline, sarcosine, citrulline, cysteic acid, t-butylglycine, t-butylalanine, phenylglycine, cyclohexylalanine, .beta.-alanine, fluoro-amino acids, designer amino acids such as .beta.-methyl amino acids, Ca-methyl amino acids, Na-methyl amino acids, and amino acid analogs in general. Furthermore, the amino acid can be D (dextrorotary) or L (levorotary).

Screening Methods

The oligonucleotide or polypeptide gene products provided herein can be used in a variety of methods to identify compounds that modulate the activity thereof. As provided herein, the nucleotide sequences and genes identified in SEQ ID NO:35,580-38,826 can be identified in different cell types and in the same cell type in which subject have different phenotypes. Methods are provided herein for screening compounds can include contacting cells with a compound and measuring gene expression levels, wherein a change in expression levels relative to a reference identifies the compound as a compound that modulates a gene expression.

Also provided herein are methods for identification and isolation of agents, such as compounds that bind to products of genes identified in SEQ ID NO:35,580-38,826. The assays are designed to identify agents that bind to the RNA or polypeptide gene product. The identified compounds are candidates or leads for identification of compounds for treatments of tumors and other disorders and diseases.

A variety of methods can be used, as known in the art. These methods can be performed in solution or in solid phase reactions.

Methods for identifying an agent, such as a compound, that specifically binds to an oligonucleotide or polypeptide encoded by a gene identified in SEQ ID NO:35,580-38,826 are provided herein. The method can be practiced by (a) contacting the gene product with one or a plurality of test agents under conditions conducive to binding between the gene product and an agent; and (b) identifying one or more agents within the one or plurality that specifically binds to the gene product. Compounds or agents to be identified can originate from biological samples or from libraries, including, but are not limited to, combinatorial libraries. Exemplary libraries can be fusion-protein-displayed peptide libraries in which random peptides or proteins are presented on the surface of phage particles or proteins expressed from plasmids; support-bound synthetic chemical libraries in which individual compounds or mixtures of compounds are presented on insoluble matrices, such as resin beads, or other libraries known in the art.

Modulators of the Activity of Gene products

Provided herein are compounds that modulate the activity of a gene product from SEQ ID NO:35,580-38,826. These compounds act by directly interacting with the polypeptide or by altering transcription or translation thereof. Such molecules include, but are not limited to, antibodies that specifically bind the polypeptide, antisense nucleic acids or double-stranded RNA (dsRNA) such as RNAi, that alter expression of the polypeptide, antibodies, peptide mimetics and other such compounds.

Antibodies, including polyclonal and monoclonal antibodies, that specifically bind to a polypeptide gene product provided herein are provided. The antibody can be a monoclonal antibody, and the antibody can specifically bind to the polypeptide. The polypeptide and domains, fragments, homologs and derivatives thereof can be used as immunogens to generate antibodies that specifically bind such immunogens. Such antibodies include but are not limited to polyclonal, monoclonal, chimeric, single chain, Fab fragments, and an Fab expression library. In a specific embodiment, antibodies to human polypeptides are produced. Methods for monoclonal and polyclonal antibody production are known in the art. Antibody fragments that specifically bind to the polypeptide or epitopes thereof can be generated by techniques known in the art. For example, such fragments include but are not limited to: the F(ab')2 fragment, which can be produced by pepsin digestion of the antibody molecule; the Fab' fragments that can be generated by reducing the disulfide bridges of the F(ab')2 fragment, the Fab fragments that can be generated by treating the antibody molecular with papain and a reducing agent, and Fv fragments.

Peptide analogs are commonly used in the pharmaceutical industry as non-peptide drugs with properties analogous to those of the template peptide. These types of non-peptide compounds are termed peptide mimetics or peptidomimetics (Luthman et al., A Textbook of Drug Design and Development, 14:386-406, 2nd Ed., Harwood Academic Publishers (1996); Joachim Grante (1994) Angew. Chem. Int. Ed. Engl., 33:1699-1720; Fauchere (1986) J. Adv. Drug Res., 15:29; Veber and Freidinger (1985) TINS, p. 392; and Evans et al. (1987) J. Med. Chem. 30:1229). Peptide mimetics that are structurally similar to therapeutically useful peptides can be used to produce an equivalent or enhanced therapeutic or prophylactic effect. Preparation of peptidomimetics and structures thereof are known to those of skill in this art.

Prognosis and Diagnosis

Products of genes in SEQ ID NO:35,580-38,826 can be detected in diagnostic methods, such as diagnosis of tumors and other diseases or disorders. Such methods can be used to detect, prognose, diagnose, or monitor various conditions, diseases, and disorders. Exemplary compounds that can be used in such detection methods include polypeptides such as antibodies or fragments thereof that specifically bind polypeptides encoded by the genes of SEQ ID NO:35,580-38,826, and oligonucleotides such as DNA probes or primers that specifically bind oligonucleotides such as RNA encoded by the genes of SEQ ID NO:35,580-38,826.

A set of one or more, or two or more compounds for detection of markers containing a nucleotide sequence provided in SEQ ID NO:1-38,826, complements thereof, fragments thereof, or polypeptides encoded thereby, can be selected for any of a variety of assay methods provided herein. For example, one or more, or two or more such compounds can be selected as diagnostic or prognostic indicators. Methods for selecting such compounds and using such compounds in assay methods such as diagnostic and prognostic indicator applications are known in the art. For example, the Tables provided herein list a modified t statistic associated with each marker, where the modified t statistic indicate the ability of the associated marker to indicate (by presence or absence of the marker, according to the modified t statistic) the presence or absence of a particular cell type in a prostate sample.

In another embodiment, marker selection can be performed by considering both modified t statistics and expected intensity of the signal for a particular marker. For example, markers can be selected that have a strong signal in a cell type whose presence or absence is to be determined, and also have a sufficiently large modified t statistic for gene expression in that cell type. Also, markers can be selected that have little or no signal in a cell type whose presence or absence is to be determined, and also have a sufficiently large negative modified t statistic for gene expression in that cell type.

Exemplary assays include immunoassays such as competitive and non-competitive assay systems using techniques such as western blots, radioimmunoassays, ELISA (enzyme linked immunosorbent assay), sandwich immunoassays, immunoprecipitation assays, precipitin reactions, gel diffusion precipitin reactions, immunodiffusion assays, agglutination assays, complement-fixation assays, immunoradiometric assays, fluorescent immunoassays and protein A immunoassays. Other exemplary assays include hybridization assays which can be carried out by a method by contacting a sample containing nucleic acid with a nucleic acid probe, under conditions such that specific hybridization can occur, and detecting or measuring any resulting hybridization.

Kits for diagnostic use are also provided, that contain in one or more containers an anti-polypeptide antibody, and, optionally, a labeled binding partner to the antibody. A kit is also provided that includes in one or more containers a nucleic acid probe capable of hybridizing to the gene-encoding nucleic acid. In a specific embodiment, a kit can include in one or more containers a pair of primers (e.g., each in the size range of 6-30 nucleotides) that are capable of priming amplification. A kit can optionally further include in a container a predetermined amount of a purified control polypeptide or nucleic acid.

The kits can contain packaging material that is one or more physical structures used to house the contents of the kit, such as invention nucleic acid probes or primers, and the like. The packaging material is constructed by well known methods, and can provide a sterile, contaminant-free environment. The packaging material has a label which indicates that the compounds can be used for detecting a particular oligonucleotide or polypeptide. The packaging materials employed herein in relation to diagnostic systems are those customarily utilized in nucleic acid or protein-based diagnostic systems. A package is to a solid matrix or material such as glass, plastic, paper, foil, and the like, capable of holding within fixed limits an isolated nucleic acid, oligonucleotide, or primer of the present invention. Thus, for example, a package can be a glass vial used to contain milligram quantities of a contemplated nucleic acid, oligonucleotide or primer, or it can be a microtiter plate well to which microgram quantities of a contemplated nucleic acid probe have been operatively affixed. The kits also can include instructions for use, which can include a tangible expression describing the reagent concentration or at least one assay method parameter, such as the relative amounts of reagent and sample to be admixed, maintenance time periods for reagent/sample admixtures, temperature, buffer conditions, and the like.

Pharmaceutical Compositions and Modes of Administration

Pharmaceutical compositions containing the identified compounds that modulate expression of a gene in SEQ ID NO:35,580-38,826 or bind to a gene product are provided herein. Also provided are combinations of such a compound and another treatment or compound for treatment of a disease or disorder, such as a chemotherapeutic compound.

Expression modulator or binding compound and other compounds can be packaged as separate compositions for administration together or sequentially or intermittently. Alternatively, they can provided as a single composition for administration or as two compositions for administration as a single composition. The combinations can be packaged as kits.

Compounds and compositions provided herein can be formulated as pharmaceutical compositions, for example, for single dosage administration. The concentrations of the compounds in the formulations are effective for delivery of an amount, upon administration, that is effective for the intended treatment. In certain embodiments, the compositions are formulated for single dosage administration. To formulate a composition, the weight fraction of a compound or mixture thereof is dissolved, suspended, dispersed or otherwise mixed in a selected vehicle at an effective concentration such that the treated condition is relieved or ameliorated. Pharmaceutical carriers or vehicles suitable for administration of the compounds provided herein include any such carriers known to those skilled in the art to be suitable for the particular mode of administration.

In addition, the compounds can be formulated as the sole pharmaceutically active ingredient in the composition or can be combined with other active ingredients. The active compound is included in the pharmaceutically acceptable carrier in an amount sufficient to exert a therapeutically useful effect in the absence of undesirable side effects on the subject treated. The therapeutically effective concentration can be determined empirically by testing the compounds in known in vitro and in vivo systems. The concentration of active compound in the drug composition depends on absorption, inactivation and excretion rates of the active compound, the physicochemical characteristics of the compound, the dosage schedule, and amount administered as well as other factors known to those of skill in the art. Pharmaceutically acceptable derivatives include acids, salts, esters, hydrates, solvates and prodrug forms. The derivative can be selected such that its pharmacokinetic properties are superior to the corresponding neutral compound. Compounds are included in an amount effective for ameliorating or treating the disorder for which treatment is contemplated.

Formulations suitable for a variety of administrations such as perenteral, intramuscular, subcutaneous, alimentary, transdermal, inhaling and other known methods of administration, are known in the art. The pharmaceutical compositions can also be administered by controlled release means and/or delivery devices as known in the art. Kits containing the compositions and/or the combinations with instructions for administration thereof are provided. The kit can further include a needle or syringe, which can be packaged in sterile form, for injecting the complex, and/or a packaged alcohol pad. Instructions are optionally included for administration of the active agent by a clinician or by the patient.

The compounds can be packaged as articles of manufacture containing packaging material, a compound or suitable derivative thereof provided herein, which is effective for treatment of a diseases or disorders contemplated herein, within the packaging material, and a label that indicates that the compound or a suitable derivative thereof is for treating the diseases or disorders contemplated herein. The label can optionally include the disorders for which the therapy is warranted.

Methods of Treatment

The compounds provided herein can be used for treating or preventing diseases or disorders in an animal, such as a mammal, including a human. In one embodiment, the method includes administering to a mammal an effective amount of a compound that modulates the expression of a gene provided in SEQ ID NO:35,580-38,826 or a compound that binds to a product of a gene provided in SEQ ID NO:35,580-38,826, whereby the disease or disorder is treated or prevented. Exemplary inhibitors provided herein are those identified by the screening assays. In addition, antibodies and antisense nucleic acids or double-stranded RNA (dsRNA), such as RNAi, are contemplated.

In a specific embodiment, as described hereinabove, gene expression can be inhibited by antisense nucleic acids. The therapeutic or prophylactic use of nucleic acids of at least six nucleotides, up to about 150 nucleotides, that are antisense to a gene or cDNA is provided. The antisense molecule can be complementary to all or a portion of the gene. For example, the oligonucleotide is at least 10 nucleotides, at least 15 nucleotides, at least 100 nucleotides, or at least 125 nucleotides. The oligonucleotides can be DNA or RNA or chimeric mixtures or derivatives or modified versions thereof, single-stranded or double-stranded. The oligonucleotide can be modified at the base moiety, sugar moiety, or phosphate backbone. The oligonucleotide can include other appending groups such as peptides, or agents facilitating transport across the cell membrane, hybridization-triggered cleavage agents or intercalating agents.

RNA interference (RNAi) (see, e.g. Chuang et al. (2000) Proc. Natl. Acad. Sci. U.S.A. 97:4985) can be employed to inhibit the expression of a gene provided in SEQ ID NO:35, 580-38,826. Interfering RNA (RNAi) fragments, such as double-stranded (ds) RNAi, can be used to generate loss-of-gene function. Methods relating to the use of RNAi to silence genes in organisms including, mammals, C. elegans, Drosophila and plants, and humans are known. Double-stranded RNA (dsRNA)-expressing constructs are introduced into a host, such as an animal or plant using, a replicable vector that remains episomal or integrates into the genome. By selecting appropriate sequences, expression of dsRNA can interfere with accumulation of endogenous mRNA. RNAi also can be used to inhibit expression in vitro. Regions include at least about 21 (or 21) nucleotides that are selective (i.e. unique) for the selected gene are used to prepare the RNAi. Smaller fragments of about 21 nucleotides can be transformed directly (i.e., in vitro or in vivo) into cells; larger RNAi dsRNA molecules can be introduced using vectors that encode them. dsRNA molecules are at least about 21 bp long or longer, such as 50, 100, 150, 200 and longer. Methods, reagents and protocols for introducing nucleic acid molecules in to cells in vitro and in vivo are known to those of skill in the art.

In an exemplary embodiment, nucleic acids that include a sequence of nucleotides encoding a polypeptide of a gene provided in SEQ ID NO:35,580-38,826, are administered to promote polypeptide function, by way of gene therapy. Gene therapy refers to therapy performed by the administration of a nucleic acid to a subject. In this embodiment, the nucleic acid produces its encoded protein that mediates a therapeutic effect by promoting polypeptide function. Any of the methods for gene therapy available in the art can be used (see, Goldspiel et al., Clinical Pharmacy 12:488-505 (1993); Wu and Wu, Biotherapy 3:87-95 (1991); Tolstoshev, An. Rev. Pharmacol. Toxicol. 32:573-596 (1993); Mulligan, Science 260:926-932 (1993); and Morgan and Anderson, An. Rev. Biochem. 62:191-217 (1993); TIBTECH 11 (5):155-215 (1993).

In one embodiment, vaccines based on the genes and polypeptides provided herein can be developed. For example genes can be administered as DNA vaccines, either single genes or combinations of genes. Naked DNA vaccines are generally known in the art. Methods for the use of genes as DNA vaccines are well known to one of ordinary skill in the art, and include placing a gene or portion of a gene under the control of a promoter for expression in a patient with cancer. The gene used for DNA vaccines can encode full-length proteins, but can encode portions of the proteins including peptides derived from the protein. For example, a patient can be immunized with a DNA vaccine comprising a plurality of nucleotide sequences derived from a particular gene. In another embodiment, it is possible to immunize a patient with a plurality of genes or portions thereof. Without being bound by theory, expression of the polypeptide encoded by the DNA vaccine, cytotoxic T-cells, helper T-cells and antibodies are induced that recognize and destroy or eliminate cells expressing the proteins provided herein.

DNA vaccines include a gene encoding an adjuvant molecule with the DNA vaccine. Such adjuvant molecules include cytokines that increase the immunogenic response to the polypeptide encoded by the DNA vaccine. Additional or alternative adjuvants are known to those of ordinary skill in the art and find use in the invention.

Animal Models and Transgenics

Also provided herein, the nucleotide the genes, nucleotide molecules and polypeptides disclosed herein find use in generating animal models of cancers, such as lymphomas and carcinomas. As is appreciated by one of ordinary skill in the art, when one of the genes provided herein is repressed or diminished, gene therapy technology wherein antisense RNA directed to the gene will also diminish or repress expression of the gene. An animal generated as such serves as an animal model that finds use in screening bioactive drug candidates. In another embodiment, gene knockout technology, for example as a result of homologous recombination with an appropriate gene targeting vector, will result in the absence of the protein. When desired, tissue-specific expression or knockout of the protein can be accomplished using known methods.

It is also possible that the protein is overexpressed in cancer. As such, transgenic animals can be generated that overexpress the protein. Depending on the desired expression level, promoters of various strengths can be employed to express the transgene. Also, the number of copies of the integrated transgene can be determined and compared for a determination of the expression level of the transgene. Animals generated by such methods find use as animal models and are additionally useful in screening for bioactive molecules to treat cancer.

Computer Programs and Methods

The various techniques, methods, and aspects of the methods provided herein can be implemented in part or in whole using computer-based systems and methods. In another embodiment, computer-based systems and methods can be used to augment or enhance the functionality described above, increase the speed at which the functions can be performed, and provide additional features and aspects as a part of or in addition to those of the invention described elsewhere in this document. Various computer-based systems, methods and implementations in accordance with the above-described technology are presented below.

A processor-based system can include a main memory, such as random access memory (RAM), and can also include a secondary memory. The secondary memory can include, for example, a hard disk drive and/or a removable storage drive, representing a floppy disk drive, a magnetic tape drive, an optical disk drive, etc. The removable storage drive reads from and/or writes to a removable storage medium. Removable storage medium refers to a floppy disk, magnetic tape, optical disk, and the like, which is read by and written to by a removable storage drive. As will be appreciated, the removable storage medium can comprise computer software and/or data.

In alternative embodiments, the secondary memory may include other similar means for allowing computer programs or other instructions to be loaded into a computer system. Such means can include, for example, a removable storage unit and an interface. Examples of such can include a program cartridge and cartridge interface (such as the found in video game devices), a movable memory chip (such as an EPROM or PROM) and associated socket, and other removable storage units and interfaces, which allow software and data to be transferred from the removable storage unit to the computer system.

The computer system can also include a communications interface. Communications interfaces allow software and data to be transferred between computer system and external devices. Examples of communications interfaces can include a modem, a network interface (such as, for example, an Ethernet card), a communications port, a PCMCIA slot and card, and the like. Software and data transferred via a communications interface are in the form of signals, which can be electronic, electromagnetic, optical or other signals capable of being received by a communications interface. These signals are provided to communications interface via a channel capable of carrying signals and can be implemented using a wireless medium, wire or cable, fiber optics or other communications medium. Some examples of a channel can include a phone line, a cellular phone link, an RF link, a network interface, and other communications channels.

In this document, the terms computer program medium and computer usable medium are used to refer generally to media such as a removable storage device, a disk capable of installation in a disk drive, and signals on a channel. These computer program products are means for providing software or program instructions to a computer system.

Computer programs (also called computer control logic) are stored in main memory and/or secondary memory. Computer programs can also be received via a communications interface. Such computer programs, when executed, permit the computer system to perform the features of the invention as discussed herein. In particular, the computer programs, when executed, permit the processor to perform the features of the invention. Accordingly, such computer programs represent controllers of the computer system.

In an embodiment where the elements are implemented using software, the software may be stored in, or transmitted via, a computer program product and loaded into a computer system using a removable storage drive, hard drive or communications interface. The control logic (software), when executed by the processor, causes the processor to perform the functions of the invention as described herein.

In another embodiment, the elements are implemented in hardware using, for example, hardware components such as PALs, application specific integrated circuits (ASICs) or other hardware components. Implementation of a hardware state machine so as to perform the functions described herein will be apparent to person skilled in the relevant art(s). In yet another embodiment, elements are implanted using a combination of both hardware and software.

In another embodiment, the computer-based methods can be accessed or implemented over the World Wide Web by providing access via a Web Page to the methods of the invention. Accordingly, the Web Page is identified by a Universal Resource Locator (URL). The URL denotes both the server machine and the particular file or page on that machine. In this embodiment, it is envisioned that a consumer or client computer system interacts with a browser to select a particular URL, which in turn causes the browser to send a request for that URL or page to the server identified in the URL. The server can respond to the request by retrieving the requested page and transmitting the data for that page back to the requesting client computer system (the client/server interaction can be performed in accordance with the hypertext transport protocol (HTTP)). The selected page is then displayed to the user on the client's display screen. The client may then cause the server containing a computer program of the invention to launch an application to, for example, perform an analysis according to the methods provided herein.

Prostate-Associated Genes

Provided herein are probe and gene sequences that can be indicative of the presence and/or absence of prostate cancer in a subject. Also provided herein are probe and gene sequences that can be indicative of presence and/or absence of benign prostatic hyperplasia (BPH) in a subject. Also provided herein are probe and gene sequences that can be indicative of a prognosis of prostate cancer, where such a prognosis can include likely relapse of prostate cancer, likely aggressiveness of prostate cancer, likely indolence of prostate cancer, likelihood of survival of the subject, likelihood of success in treating prostate cancer, condition in which a particular treatment regimen is likely to be more effective than another treatment regimen, and combinations thereof. In one embodiment, the probe and gene sequences can be indicative of the likely aggressiveness or indolence of prostate cancer.

As provided in the methods and Tables herein, probes have been identified that hybridize to one or more nucleic acids of a prostate sample at different levels according to the presence or absence of prostate tumor, BPH and stroma in the sample. The probes provided herein are listed in conjunction with modified t statistics that represent the ability of that particular probe to indicate the presence or absence of a particular cell type in a prostate sample. Use of modified t statistics for such a determination is described elsewhere herein, and general use of modified t statistics is known in the art. Accordingly, provided herein are nucleotide sequences of probes that can be indicative of the presence or absence of prostate tumor and/or BPH cells, and also can be indicative of the likelihood of prostate tumor relapse in a subject.

Also provided in the methods and Tables herein are nucleotide and predicted amino acid sequences of genes and gene products associated with the probes provided herein. Accordingly, as provided herein, detection of gene products (e.g., mRNA or protein) or other indicators of gene expression, can be indicative of the presence or absence of prostate tumor and/or BPH cells, and also can be indicative of the likelihood of prostate tumor relapse in a subject. As with the probe sequences, the nucleotide and amino acid sequences of these gene products are listed in conjunction with modified t statistics that represent the ability of that particular gene product or indicator thereof to indicate the presence or absence of a particular cell type in a prostate sample.

Methods for determining the presence of prostate tumor and/or BPH cells, the likelihood of prostate tumor relapse in a subject, the likelihood of survival of prostate cancer, the aggressiveness of prostate tumor, the indolence of prostate tumor, survival, and other prognoses of prostate tumor, can be performed in accordance with the teachings and examples provided herein. Also provided herein, a set of probes or gene products can be selected according to their modified t statistic for use in combination (e.g., for use in a microarray) in methods of determining the presence of prostate tumor and/or BPH cells, and/or the likelihood of prostate tumor relapse in a subject.

Also provided herein, the gene products identified as present at increased levels in prostate cancer or in subjects with likely relapse of cancer, can serve as targets for therapeutic compounds and methods. For example an antibody or siRNA targeted to a gene product present at increased levels in prostate cancer can be administered to a subject to decrease the levels of that gene product and to thereby decrease the malignancy of tumor cells, the aggressiveness of a tumor, indolence of a tumor, survival, or the likelihood of tumor relapse. Methods for providing molecules such as antibodies or siRNA to a subject to decrease the level of gene product in a subject are provided herein or are otherwise known in the art.

In another embodiment, the gene products identified as present at decreased levels in prostate cancer or in subjects with likely relapse of cancer, can serve as subjects for therapeutic compounds and methods. For example a nucleic acid molecule, such as a gene expression vector encoding a particular gene, can be administered to a individual with decreased levels of the particular gene product to increase the levels of that gene product and to thereby decrease the malignancy of tumor cells, the aggressiveness of a tumor, indolence of a tumor, likelihood of survival, or the likelihood of tumor relapse. Methods for providing gene expression vectors to a subject to increase the level of gene product in a subject are provided herein or are otherwise known in the art.

The following examples are included for illustrative purposes only and are not intended to limit the scope of the invention.

EXAMPLES

Example 1

Tissue Samples. Prostate samples were obtained from patients that were preoperatively staged as having organ-confined prostate cancer. Institutional Review Board-approved informed consent for participation in this project was obtained from all patients. Tissue samples were collected in the operating room, and specimens were immediately transported to institutional pathologists who provided fresh portions of grossly identifiable or suspected tumor tissue and separate portions of uninvolved tissues. All tissue was snap frozen upon receipt and maintained in liquid nitrogen until used for frozen section preparation at −22° C. Thirty-eight of the contributed cases contained carcinomas. An additional 50 additional samples, consisting of paired adjacent nontumor tissue and separate nontumor bearing cases, also were used, making a total of 88 specimens for analysis. Tissue for expression analysis was provided as 20-µm-thick serial cryosections sections.

Tissue samples for expression analysis were prepared as 10- to 400-mm$^3$ pieces, an amount that was found to be sufficient to yield 10 µg or more of total RNA. Before RNA preparation, 5-µm frozen sections were prepared at −22° C. The first section and a section every 200 µm thereafter were stained with hematoxylin and eosin for histopathological assessment, and all other intervening sections were prepared at 20-µm thickness for RNA extraction. Typically four to eight thin sections were examined per specimen by four pathologists. Preparative (20-µm) sections were lysed in RNA extraction buffer (RNeasy, Qiagen, Valencia, Calif.) and stored at −80° C. Thin sections were examined by four pathologists in a single session using a multihead microscope. Each pathologist assessed each specimen and completed a standardized form indicating the fraction of total area of the section occupied by the aggregate of all prostate carcinoma cells, benign prostatic hypertrophy (BPH) epithelial cells, dilated gland (dilated cystic atrophy) epithelial cells, and stromal cells. Clear spaces of glandular lumina, edema, defects, etc., were not considered, and minor proportions of neural, vascular, or other components were marked as other (median value, 3.1%). Average percentages of estimates from the four pathologists were calculated for epithelial cells of tumor, BPH, and cystic glands and total stromal cells for each sample.

Data Collection. Preoperative and follow-up demographic and clinical variables, histologic scoring, and DNA array data were collected into an internet accessible, secure Oracle database. Each physical object in the study was issued a unique identifier, and relationships between samples, subsamples, patients, and data were maintained.

Amplification and GeneChip Hybridization. Total cellular RNA was isolated by using RNeasy kits (Qiagen) and quantified by RiboGreen fluorescent assay (Molecular Probes, Eugene, Oreg.), and the quality of preparation was examined by using a BioAnalyzer 2100 (Agilent Technologies, Palo Alto, Calif.). Generation of cRNA was performed according to the known Affymetrix protocol. Briefly, double stranded cDNA was synthesized from total RNA by using a reverse transcriptase with a purified oligo(dT) primer containing a RNA polymerase promoter sequence at it's 5'-end. The second cDNA strand was synthesized using DNA polymerase I, RNase H and DNA ligase. The double-stranded cDNA was placed in RNase-free buffer. Labeled cRNA was generated from cDNA by in vitro transcription and incorporating biotinylated nucleotides. Fifteen micrograms of the resulting biotinylated cRNA was fragmented and hybridized to U95Av2 GeneChip® arrays Affymetrix according to the manufacturer's instructions.

Data Analysis. Array images (.dat files) were digitized by using MAS version 5 (Affymetrix). Gene expression values were generated from the resulting raw numerical data (.cel files) by the dCHIP program of Li and Wong (Li and Wong, Proc. Natl. Acad. Sci. USA 98, 31-36, 2001). Most subsequent analyses were carried out by using the R environment and language including the gee-library for generalized estimated equations (Iheka and Gentleman, J. Comput. Graph. Stat. 5, 299-314, 1996; Zeger and Liang, Biometrics 42, 121-130, 1986). Differential expression between dichotomous variables (tumor/no tumor) was detected by a modification of the permutation method in Efron et al. (J. Am. Stat. Assoc. 96, 1151-1160, 2001). Class predictive genes were identified via the nearest shrunken centroids method by using the PAM package of R software (Tibshirani et al. Proc. Natl. Acad. Sci. USA 99, 6567-6572, 2002).

Immunohistochemistry. Selected gene expression results were validated by the direct examination of the distribution of the protein in paraffin sections of five or more of the cases. Indirect immunohistochemistry was performed. The antibodies were obtained and used as follows: directed against desmin and prostate-specific membrane antigen (PSMA) (DAKO, Carpinteria, Calif.), keratin 15 and tubulin β4 (Neo-Markers, Lab Vision Corporation, Fremont, Calif.), prostaglandin-D2 synthase (Cayman Chemical, Ann Arbor, Mich.), and prostate-specific antigen (PSA) (Biodesign International, Saco, Me.).

Laser Capture Microdissection (LCM). Microdissection of freshly prepared frozen sections was performed by using an Arcturus (Mountain View, Calif.) Mark PixCell II LCM apparatus to isolate prostate cancer epithelium, stroma, and hypertrophic benign epithelial prostate cells. Total RNA was prepared from these samples and used in quantitative RT-PCR (qPCR) to validate cell-specific expression analysis as described in detail together with the gene list, primers, graphical relationships of Affymetrix (modified t statistic) to LCM (LCM/qPCR endpoint). From each flash-frozen tissue, 5-μm-thick frozen sections were prepared. Sections were subsequently dehydrated in graded ethanol solutions (70% once, 5-second rinse, 95% twice, 5-second rinse each, 100% two times, 5-second rinse each) and cleared in xylene (two times, 5 min each). After air-drying for 10 min, the PixCell II LCM System from Acturus Engineering (Mountain View, Calif.) was used for laser capture following the manufacturer's protocol. Total RNA was extracted using resin spin-column system (PicoPure RNA isolation kit, Arcturus Engineering).

Figure 2:
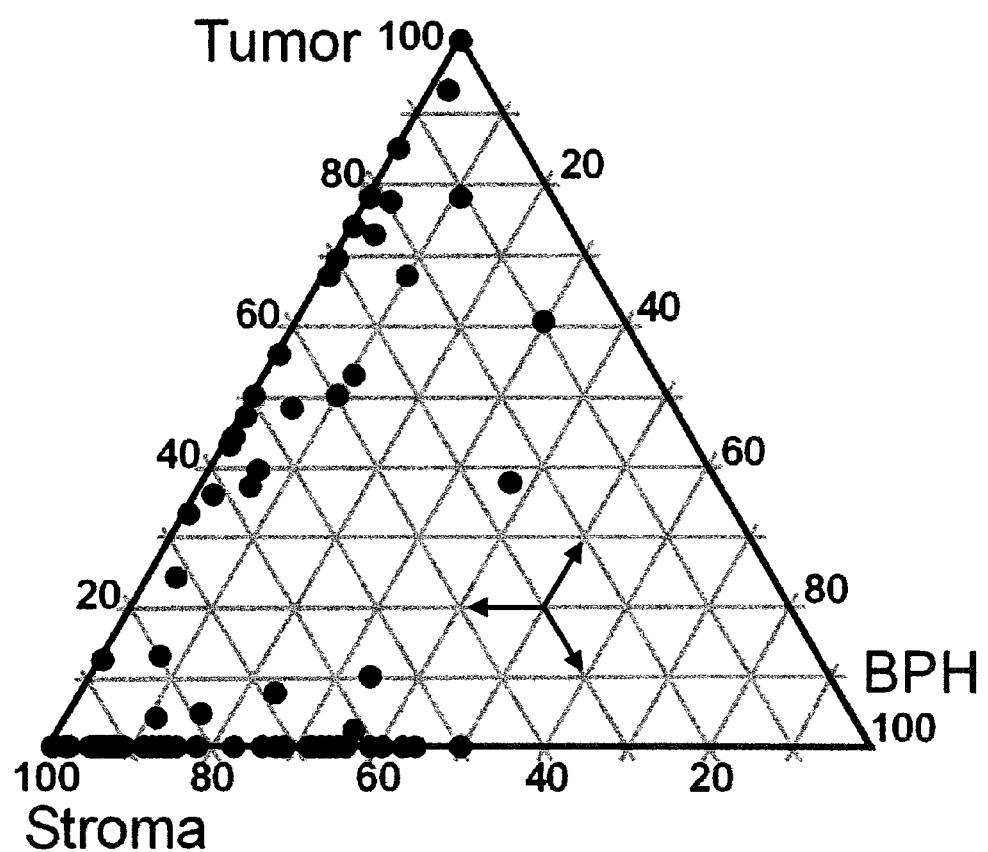
FIG. 2 shows a ternary graph of sample characteristics. Eighty-eight prostatectomy samples from 41 individuals comprising 50 nontumor and 38 tumor-containing specimens were scored for proportional content of tumor, BPH, stroma, and dilated cystic glands. Vertices represent pure tissue types. Epithelia of dilated cystic glands, nerves, and vessels are small components. Note the wide range of proportions of tumor and stromal cells. Estimated tumor percentages ranged from 0.3% through 100%. The proportions were used in the linear models ($x_{kj}$ in Equation 1) for cell-associated gene expression.

The 88 tissue samples from 41 subjects undergoing prostatectomy for clinically early stage localized prostate carcinoma were independently scored by a panel of four pathologists for fractional composition of the four cell types. Agreement analysis on the continuous measures of fractional cell type as estimated by four pathologists were assessed as interobserver Pearson correlation coefficients. The average coefficients for tumor, stroma, BPH, and dilated gland cells were 0.92, 0.77, 0.73, and 0.49, respectively, indicating reproducibility of scoring for the predominant cell types. The lesser reproducibility for the dilated gland category was due to the relative paucity of this cell type in the samples (median proportion=5%). The samples were found to contain a wide range of relative tumor cell numbers ranging, in the case of tumor cells, from a low of 0.3% to a high of 100% tumor cells (FIG. 2).

Despite inclusion of samples with very low tumor content, some 1,197 genes were identified as differentially expressed between tumor and nontumor samples (posterior probability >0.95, see supporting information) according to empirical Bayes estimates. Because tumor samples contained, on average, 53.4% cells of epithelial origin (tumor, BPH, dilated glands), and nontumor samples had an average epithelial composition of 24.7% (P=3.5×10-11), differences in gene expression reflected stromal content were suspected. An illustrative subset of transcripts differentially expressed according to class was identified through nearest shrunken centroids discriminant analysis. Of 37 highly discriminant genes, 23 were predictive of nontumor and were mostly archetypal smooth muscle transcripts such as myosin, tropomyosin, actin, and others. Thus, a corollary notion is that tumor markers identified through standard microarray studies may have little significance with respect to tumor-cell biology, being more reflective of fundamental differences between cells of epithelial versus mesenchymal lineage.

To assign gene expression to particular cell types within tumor specimens, a linear model was constructed in which it was assumed that the contribution to gene expression of any one cell type depends only on the proportion of that cell type and its corresponding characteristic cell-type expression level, $\beta_{ij}$, but not on the proportions of other cell types present. In Equation 1, the average expression level $G_{jk}$ of gene j in a sample k is the average of cell type expectations, $\beta_{ij}$, weighted by cell type fractions $x_{ki}$.

$$G_{jk} = \sum_i x_{ki} \beta_{ij} + \varepsilon_{jk} \qquad \text{(Equation 1)}$$

Comparing tumor versus no tumor expression levels amounts to using two cell types whose proportions are taken as either 1 and 0 (all tumor) or 0 and 1 (no tumor) in model (Equation 1) and taking the difference of the coefficients. Another procedure uses the proportions assessed by pathologists in a two-cell-type model. Coefficients, standard errors, and intercepts were calculated according to a two-cell type model (e.g., tumor vs. nontumor via simple linear regression of expression level on proportion of tumor cells) for each gene expression vector in 88 microarrays as a function of fractional content of tumor, then of stroma, and then of BPH. Thus, the expected cell type expression level is given as the regression coefficient, β, in the linear model (Equation 1). Modified t statistics incorporating goodness of fit and effect size were calculated according to Tusher (Proc. Natl. Acad. Sci. USA 98, 5116-5121, 2001), where ρβ is the standard error of the coefficient, and k is a small constant.

$$t = \beta/(k+\sigma_\beta) \qquad \text{(Equation 2)}$$

Figure 3:
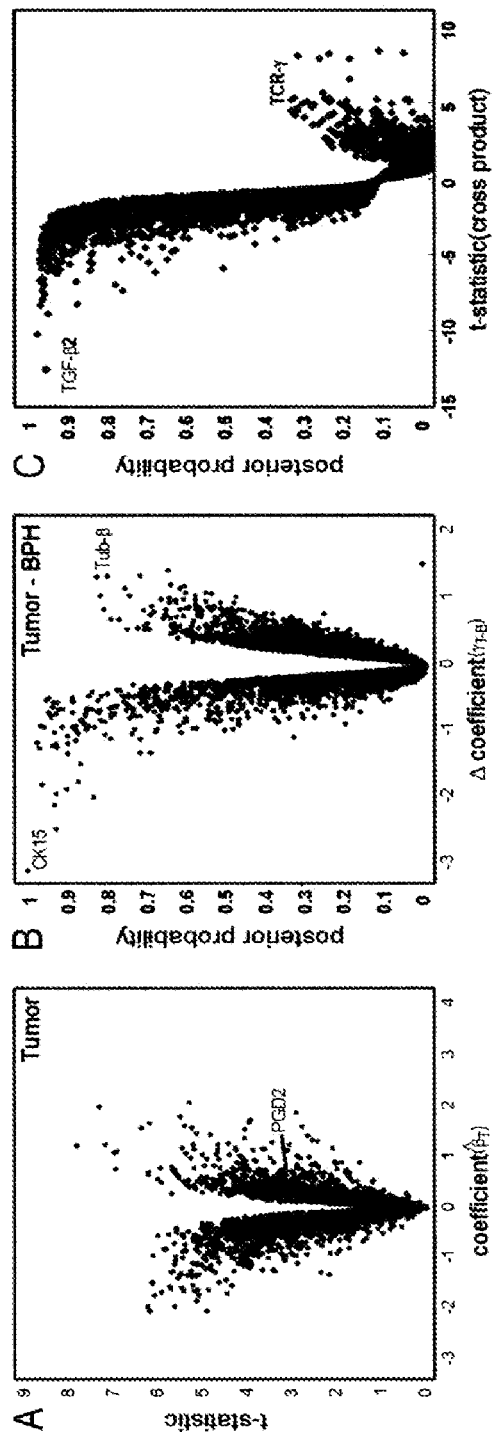
FIG. 3A-C shows statistical modeling. (A) Regression on cell type. The expected cell type expression levels are the coefficients β in models of gene expression as a linear function of fractional cell type (Equation 1) and were calculated by using the lsfit function in R. Modified t statistics were calculated as $t=\beta/(0.0029+\beta_{se})$, where se is the standard error of the coefficient. Volcano plot representations of the data reveal genes associated with the tumor cell type with high confidence in the upper right portion of the graph. (B) Multiple regression on percentage stroma, BPH, and tumor allows direct identification of tumor-BPH differences beyond the effect of stroma. Posterior probabilities akin to those in Efron et al. (J. Am. Stat. Assoc. 96, 1151-1160, 2001) used an estimating equations approach (gee library for R) (R Development Core Team (2004). R: A language and environment for statistical computing. R Foundation for Statistical Computing, Vienna, Austria. ISBN 3-900051-07-0, URL http://www.R-project.org.). BPH-specific gene expression is in the upper left (note CK15), and tumor-specific gene expression is in the upper right (tubulin-β) of the graph. (C) Tumor-stroma interaction model. Inclusion of cross-product terms in the linear model identifies genes in which the contribution of a cell may be more or less than in another tissue environment; i.e., the contributions of individual cell types to the overall profile depend on the proportions of other types present. Data show tumor-stroma cross-product modified t statistics versus probabilities (y axis), which were calculated as in B by comparing actual with permuted modified t statistics. The upper left portion of graph represents a large number of stroma-associated genes with a high likelihood deviation from a strictly linear model. The right portion of the graph reveals a number of tumor-associated genes that deviate from linearity. Among these is TCRγ, which is among the most discriminant tumor/no tumor genes even at low proportions of tumor; i.e., the expression of TCRγ is greater than that predicted by proportion of tumor cells alone. The stromal gene with the greatest deviation was TGF-β2, a candidate paracrine signaling molecule in prostate cancer.
Figure 4:
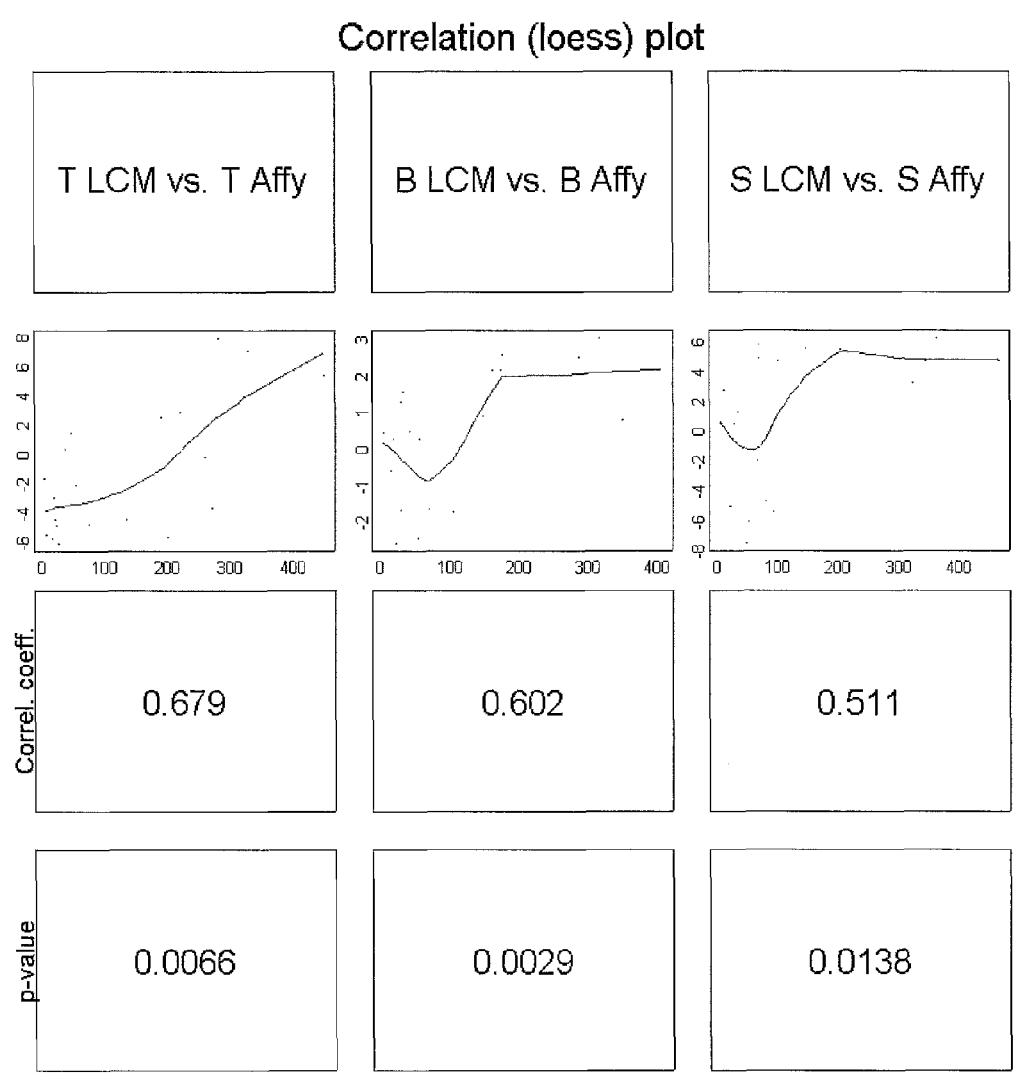
FIG. 4. Validation the GeneChip analysis with LCM/qPCR. Six prostate specimens were used for isolation of each cell type by laser capture microdissection (LCM). Primer sets for 31 selected genes including house keeping genes, including several genes validated by IHC (e.g. Tubulin-β, PSA, Desmin, and Cytokeratin-15), were used for assay of target gene expression by quantitative RT-PCR (qPCR). The qPCR data were subjected to quantile normalization. To assess the independence between modified t-statistics from Table 2 and the specific expression levels obtained by qPCR, Spearman Rank-Order correlation coefficients were evaluated for 20 genes with modified t-statistic >2.4 for at least one cell type (i.e. genes included on Table 2). The levels of significance (the p-values) of these correlation coefficients were estimated by test for association/correlation between paired samples from R (ref. 11). This analysis yielded coefficients of 0.679 ($p=0.0066$), 0.602 ($p=0.0029$), and 0.511 ($p=0.0138$) for the tumor, BPH, and stroma cell types, respectively. Thus, the qRT-PCR specific expression levels correlated with low probability to the cell-type modified t-statistic, determined for the same genes, as generated from the analysis of the GeneChip data. The graphs plot modified t-statistic along the ordinate against qPCR endpoint value (abscissa).

For n 88, a modified t statistic of 2.4 sets thresholds corresponding >4-fold expected differences in expression between the respective cell types (P<0.02). By these criteria, many transcripts were found to have strong association with a particular cell type (FIG. 3). A global view of predicted cell-specific gene expression was obtained by hierarchical clustering of the modified t statistics from the linear model. A total of 3,384 transcripts displayed cell-type-associated gene expression patterns according to the criteria. The procedure revealed that tumor- and nontumor-associated transcripts could be interpreted in terms of cell type specificity. Thus, 1,096 genes have strong tumor association, yet the majority (683) of these represent primarily differences in tumor-stroma gene expression (tumor>stroma). Conversely, a large number of transcripts are predicted to be stroma associated (stroma and stroma>tumor). Interestingly, a number of genes are strongly associated with BPH cell content (492). A subset of these (196) also showed a strong negative association with tumor cell content, indicating potential clinically useful markers of BPH. In addition, this analysis predicts 413 genes to be tumor specific, being strongly associated with tumor and displaying negative associations with both BPH and stroma.

The transcript groups were characterized by distinct personalities in terms of gene function. The BPH cell-associated groups (B>S, B>T) included a number of previously identified nonmalignant prostate epithelial markers including 15-lipoxygenase-II, CD38, and p63. This group contained a number of neuroendocrine markers such as cystatin-A, chromogranin-A, cholecystokinin, and cholecystokinin receptor. Notably, the BPH group of genes included IL-1 convertase. IL-1 is a putative neuroendocrine morphogen in prostate. The stroma cell compartment was dominated by archetypal smooth muscle and connective tissue-associated genes: vimentin, myosins, actin, and dystrophin. Other strong stroma associations included participants in transforming growth factor (TGF)-β and fibroblast growth factor signaling pathways.

Transcripts with strong tumor associations that were also anticorrelated with other cell types included hepsin, macmarcks, LIM protein, and α-methyl CoA racemase, as noted. A number of enzymes involved in O— and N-linked glycosylation were strongly tumor-specific, including UDP N-acetylglucosamine pyrophosphorylase-1, which in this study carried the third highest cell-type-associated modified t statistic of 7.2. Also noted were several genes participating in small GTP protein signaling pathways. The set of transcripts that were associated with both tumor and BPH cell content included, not surprisingly, PSA. In fact, six separate GeneChip probe sets for this gene present on the Affymetrix arrays segregated into this group.

Specific differences between BPH and tumor cell expression are of interest diagnostically and may shed light on pathogenesis. A four-cell-type model (via multiple regression of expression level on the tissue proportions using no intercept) allows direct and unbiased estimates of differences in expression between two cell types. Simultaneous regression holding the effect of stroma constant accounts for the fact that in the prostate, cell-type-associated differences in gene expression were dominated by the inverse relationship between fractional content of tumor cells and stromal cells. Because multiple samples are used from some subjects, the estimating equations approach implemented in the gee library for R was used. The procedure identified a number of transcripts predicted to be specific for either BPH or tumor cells (FIG. 3B). Cytokeratin-15 (CK15) expression was predicted with high confidence to be associated with the BPH cell type. Other putative BPH epithelial cell markers included the intermediate filament protein NF-H, histone H2A1B, CD38, and 15-lipoxygenase. Transcripts predicted to be specifically expressed in tumor as opposed to BPH cells included β-tubulin, UDP N-acetyl glucosamine pyrophosphorylase 1, and SGP-28, among others.

Including a term dependent on both the tumor cell proportion and the stroma cell proportion (i.e., the cross-product $x_{kT}x_{kS}$) in Equation 1 for the four-cell-type multiple regression model, the gene expression in stroma (or tumor) cells which is not independent but, rather, dependent on the proportion of tumor (or stroma) was calculated (FIG. 3C). Many genes displayed expression profiles with high tumor-stroma cross product terms including TGF-β2, which in the linear model is predicted to be in stroma. Also among stroma-associated genes with high cross products was desmin. Immunohistochemical staining (see below) supports this finding. High cross-product tumor-associated genes were also identified and included the T cell receptor γ (TCRγ) transcript (Affymetrix probe set 41468_at). In this instance, the high cross-product is the result of TCRγ transcript being a very highly discriminant tumor marker. That is, even relatively low percentage tumor samples display high expression, an exception to the linear model consistent with stromal modulation of tumor TCR expression.

Immunohistochemical Validation. Selected predicted cell-type-specific gene expression patterns were tested by examining the distribution of gene expression on the protein level by using immunohistochemistry. At least five cases of tumor-bearing tissue with adjacent BPH, stroma, and dilated glands were examined with each antibody. β-Tubulin is predicted to be a strongly tumor-associated gene. Immunohistochemical staining revealed uniform expression in tumor cells of crowded gland-like structures of the tumor but negative in stroma or epithelial cells of adjacent BPH and dilated glands. Prostaglandin-D2 synthase (PD2S) is predicted to be a moderately tumor-associated gene. Apical surfaces of the epithelial cells of tumor-gland structures were highly immunoreactive, whereas BPH glands displayed little or no immunoreactivity. Prostate-specific membrane antigen (PSMA) is predicted to be strongly tumor associated. Staining revealed strong immunoreactivity that was strictly confined to the apical membranes of tumor gland cells, but only weak reactivity was observed in adjacent BPH cells. Desmin is predicted to be a stromal gene with high likelihood of tumor-stroma cell interaction. Numerous desmin-positive spindle shaped cells forming files and parallel clusters fill the stroma tissue component, whereas all epithelial cells are negative. The stroma within zones of tumor is distinct from adjacent normal stroma in that the desmin-positive spindle cell population is sparse, suggesting a distinct remodeling of cells in the tumor-associated stroma. CK15 is predicted to be strongly associated with BPH. Uniform labeling of most cells of myoepithelial of hyperplastic epithelium was apparent, whereas no expression could be detected in adjacent tumor cells of the same cases. PSA is predicted to be present in BPH and tumor cells. Strong immunoreactivity was noted in both tumor and BPH glands. These observations provide direct confirmation of the cell-type-specific expression of proteins as predicted on the basis of the dissection of transcript expression described here.

LCM-qPCR Validation. Five independent specimens and one specimen used for expression analysis were used for isolation of tumor, BPH, and stromal cells by LCM. Primer sets for 28 genes, including several genes validated by immunohistochemistry, were examined by qPCR, such as PSA, β-tubulin, desmin, and Cytokeratin-15, 504 PCR runs in all. The overall pattern of qPCR results exhibited a clear correlation with the expression level based on cell type. To quantitatively examine the relationship, the Pearson correlation coefficient and associated probability for each cell type was calculated between qPCR end points from the LCM samples, and the corresponding modified t statistics derived from the in silico dissection for the same cell type across the 20 genes with complete data. This analysis yielded correlation coefficients of 0.689 (P=0.004), 0.609 (P=0.0042), and 0.524 (P=0.0144) for the tumor, BPH, and stroma cell types, respectively. Thus, all correlation coefficients are statistically significant. It is apparent, therefore, that for all three cell types there is a significant correlation between these two independent and multistep methods of cell-type-specific analysis for the genes examined.

The analysis was conducted in order to discriminate true markers of tumor cells, BPH cells, and stromal cells of Prostate Cancer. Conventional least squares regression using individual cell-type proportions produces clear predictions of cell specific expression for a large number of genes. Many predictions are readily accepted on the basis of prior knowledge of prostate gene expression and biology, which provides confidence in the method. These are strikingly illustrated by numerous genes predicted to be preferentially expressed by stromal cells that are characteristic of connective tissue and only poorly expressed or absent in epithelial cells.

This analysis allows segregation of molecular tumor and non-tumor markers into more discrete and informative groups. Thus, genes identified as tumor-associated may be further categorized into tumor versus stroma (epithelial versus mesenchymal) and tumor versus BPH (perhaps reflecting true differences between the malignant cell and its hyperplastic counterpart). A recent meta-analysis produced a list of 500 genes up-regulated in prostate cancer. Of these 338 (unique Unigene identifiers) were identified in the analysis provided herein as tightly correlated with the presence of tumor. The method presented here indicates that 157 of these tumor-associated transcripts represent a tumor-stroma dichotomy. Another 26 are associated with BPH cells and tumor cells, and 89 are relatively unique to tumor cells. Notably, only 2 transcripts associated by the herein disclosed method with stroma were classified as tumor-associated in the meta-analysis. Conversely, 296 of 500 genes identified in the meta-analysis as indicative of normal prostate can be divided into 271 stromal genes and only 15 genes associated with BPH cells and not malignant cells. Thus, the vast majority of markers associated with normal prostate tissues in recent microarray-based studies are related to cells of the stroma. This result is not surprising given that, at least here, normal samples are composed of a relatively greater proportion of stromal cells.

The strongest single discriminator between BPH cells and tumor cells in this study was cytokeratin-15 (CK15), a result confirmed by immunohistochemistry. CK15 has previously received little attention in this context, but BPH markers play an important role in the diagnosis of ambiguous clinical cases. The clinical utility of CK15 and other predicted BPH markers will require further study.

It was expected that not all genes would be expressed as a linear function of cell-type. Transcripts with high cross-products in the covariance matrix suggest that expression in one cell type was not independent of the proportion of another tissue as would be expected in a paracrine mechanism. The stroma transcript with the highest dependence on tumor percentage was TGF-b2, a cytokine previously identified as important in prostate cell proliferation. Another such stroma cell gene for which immunohistochemistry was practical was desmin which showed considerably altered staining in the tumor associated stroma. In fact, a large number of typical stroma cell genes displayed dependence on the proportion of tumor adding evidence to the speculation that tumor-associated stroma differs fundamentally from non-associated stroma. Tumor-stroma paracrine signaling may be reflected in peri-tumor halos of altered gene expression that may be present a much bigger target for detection than the tumor cells alone.

Recently, a group of genes was identified that correlated with Gleason score and clinical outcome. These studies were restricted to specimens with very high proportions of tumor cells. Therefore, in contrast to the study provided herein, the previous study could not assess the role of cells neighboring the cancer, which may participate in the gene expression signature of tumor and, possibly, its biology.

The experiments have employed a straightforward bioinformatics approach using simple and multiple linear regression to identify genes whose expression is specifically correlated with either tumor cells, BPH epithelial cells or stromal cells. These results confirm a variety of previous observations and importantly identify a large number of gene candidates as specific products of various cells involved in prostate cancer pathogenesis. Context-dependent expression that is not readily attributable to single cell types is also recognized. The investigative approach described here is applicable to a wide variety of tumor marker discovery investigations in other organs.

Laser Capture Microdissection and Extraction. From each flash-frozen tissue, 5μ thick frozen sections were prepared. Sections were subsequently dehydrated in graded ethanol solutions (70% once, 5 second rinse, 95% twice, 5 second rinse each, 100% two times, 5 second rinse each) and cleared in xylene (two times, 5 min each). After air-drying for 10 min, we used the PixCell II LCM System from Acturus Engineering (Mountain View, Calif.) for laser capture and followed the manufacturer's protocol. Total RNA was extracted using resin spin-column system (PicoPure RNA isolation Kit, Arcturus Engineering).

Analysis of Gene Expression by Real-Time Quantitative (qPCR). First strand cDNA synthesis was performed using all extracted total RNA from each sample (preheated at 65° C., 5 min with oligo-dT(15) and dNTPs) in 0.5 μg oligo-dT(15), 50 mM Tris-HCl (pH 8.3 at room temperature), 75 mM KCl, 3 mM $MgCl_2$, 10 mM dithiothereitol, 0.5 mM dNTPs, 2 units/ul of RNase Inhibitor (Roche) and 10 units/ul SuperScript II RNase H-Reverse Transcriptase (Invitrogen Corporation). Reverse Transcriptase was added after two minutes of incubation at 42° C., then incubate for 50 minutes at 42° C. The reaction was inactivated at 70° C. for 15 min. 20 μl cDNA reaction was diluted to 400 μl and 6 μl was used for analysis of each gene. Real-time quantitative PCR (ABI Prism 7900 Sequence Detection System, Applied Biosystems, Foster City, Calif.) was carried out for the analysis of gene expression by the use of SybrGreen. Real-time PCR reaction contained 1× HotStartTaq PCR Buffer (with 1.5 mM MgCl2), 1:25,000 dilution of SybrGreen I (Molecular Probes), 0.35 μM 6-ROX (Molecular Probes), 0.2 mM dNTPs, 4 mM MgCl2, 0.025 unit/μl HotStartTaq DNA polymerase (Qiagen) and 0.8 μM each primer. Real-time PCR was done in 95° C. for 15 minutes; 50 cycles of 95° C. for 15 seconds, 60° C. for 15 seconds and 72° C. for 30 seconds; followed by a dissociation stage (95° C. 15 seconds, 60° C. 15 seconds, 95° C. 15 seconds, 2% ramping rate from 60° C. to 95° C.). Relative standard curves representing decreasing dilutions of stock cDNA were used for monitoring efficiency of target amplification of each gene. Thirty-one genes were amplified. The primer pair sequences for each of the specific RNA transcripts assayed are listed in Table 1.

Quantile normalization. The intensity values of each LCM sample were quantile normalized; the kth ranked intensity among the K=24 genes for each LCM sample was replaced by the average of the kth ranked values across all samples. For a few LCM samples readings were not been obtained for some genes. These samples were not included in the averaging, but normalized values for the non-missing genes were obtained by replacing the rank, j, among the J valid values for a sample with (j−1)*(K−1)/(J−1)+1 and using this to interpolate among the K averages.

Table 8. Selected Cell-type specific Expressed Genes. The table provides a modified t-statistic calculated as described herein (Equation 2) for each cell type (tumor (T), BPH, (B), and stroma (S)) defined and selected differences (T-B) for each gene with t>2.4. The modified t-statistics $t_{ij}$ incorporates goodness of fit and effect size for every gene j and every tissue type i, where $\sigma_\beta$ the standard error of the coefficient, $\beta_{ij}$, and k is a small constant: $t_{ij}=\beta_{ij}(k+\sigma_\beta)$. The $\beta_{ij}$ are determined according to equation (1) as described. For N=88, a modified t-statistic of 2.4 sets thresholds-corresponding greater than four-fold expected differences in expression between the respective cell types (p<0.02). 3384 transcripts displayed cell-type associated gene expression patterns according to the threshold and are listed here. 1096 genes have strong tumor association, yet the majority (683) of these represent primarily differences in tumor-stroma gene expression (tumor>stroma). Conversely, a large number of transcripts are predicted to be stroma associated (groups stroma and stroma>tumor). 492 are strongly associated with BPH cell content. A subset of these (196) also showed a strong negative association with tumor cell content indicating potential clinically useful markers of BPH. 413 are predicted to be tumor specific, being strongly associated with tumor and displaying negative associations with both BPH and stroma (tumor). Columns B, C, and D labeled BSTAT, SSTAT, and TSTAT respectively are the corresponding modified t-statistic values for simple regression using percent composition for each tissue type alone (cf. equation 1), i.e. BPH epithelial cells content, stroma cell content, or tumor epithelial cell content respectively. The modified t-statistic value are color coded Red for modified t-statistic >2.0; Tan for 2.0>modified t-statistic >1.0, Green for t-static ←2.0, and Blue for −2.0<modified t-statistic ←1.0.

The modified t statistics calculated from two-cell-type linear models embody the direction and magnitude as well as goodness of fit of the coefficients. The modified t statistics were filtered to include genes with >4-fold predicted changes in between pure and 0% specific cell type sample composition and an absolute correlation coefficient of >0.25. By these criteria, 3,387 transcripts displayed cell-type-associated gene expression, and the modified t statistics are visualized here by hierarchical clustering. Red corresponds to a positive correlation, and green corresponds to a negative correlation between cell type (B, BPH; S, stroma; T, tumor) and gene expression. Representative genes from each group are at right. Previously available tumor/no tumor distinction is represented by middle labels. The analysis provides for further classification of no tumor markers into stromal (the vast majority) and BPH-associated genes. Likewise, tumor markers can be subdivided. Markers of the tumor-stroma difference may reflect epithelial mesenchymal differences in gene expression. Genes that differ according to the tumor-BPH distinction may reflect changes between malignant and non-malignant states of prostate epithelium.

Example 2

Identification of Differences in Expression Between Cell-Types and Between Relapse and Non-Relapse Patients Methods have been developed which have promise to distinguish cell-specific and relapse-specific differential gene expression which will be assessed on available clinical cases in a prospective observational trial design.

1. Sample Evaluation. Percent sample composition determination. All samples used in microarray analysis were evaluated by four pathologists, who independently estimated percentage of tumor-, stroma-, BPH- and Cystic-Atrophy-cells in every sample using serial frozen sections as described in Example 1. Tissue between these analytical sections was utilized for RNA preparation and expression analysis. The reliability of tissue composition estimates by this method has been checked by carrying out a variety of agreement analyses among the four pathologists such as calculation of agreement of presence or absence of tissue types (kappa) and Pearson correlation coefficient calculations for percent assignments. An example of such an analysis in the case of estimating tumor cell content is shown in FIG. 1 and a summary for the four cells types estimated is shown in Table 3. The percent estimates averaged over the four contributing pathologists for each sample were used to derive cell-specific gene expression estimates as described below and summarized in Example 1; averaged values were used in the analysis.

2. Gene Expression Data Processing.

Total RNA was prepared from samples of known cellular composition and analyzed on Affymetrix GeneChip platforms as described by the manufacturer. The data of the hybridized microarrays were processed by Affymetrix Microarray Suite 5.0. (Affymetrix (2000). Microarray Suite 5.0—User Guide. Affymetrix, Inc. (www.affymetrix.com)). The background estimation and gene expression evaluation was carried out using BioConductor's Affymetrix package (Rafael A. Irizarry, Laurent Gautier, Benjamin Milo Bolstad, Crispin Miller, with contributions from Magnus Astr, Leslie M. Cope, Robert Gentleman Jeff Gentry Wolfgang Huber James MacDonald Benjamin I. P. Rubinstein Christopher Workman and John Zhang (2004). Affymetrix: Methods for Affymetrix oligonucleotide Arrays. R package version 1.5.8.).

3. Two GeneChip data sets. Samples from 55 patients were hybridized to 118 U95Av2 GeneChips and samples from 91 patients were hybridized to 146 U133A GeneChips. Samples from 34 patients were hybridized to both chip types. 54 samples were hybridized to both chip types. These data sets and the distribution among relapse and nonrelapse samples are summarized in Tables 4 & 5.

4. Determination of Cell-Specific Gene Expression by Regression analysis for Four Cell-types. In accord with the common histology of prostate, we assume (1) that the vast majority of cell types of tumor-bearing prostate tissue is accounted for by four cell types: Tumor epithelial cells, BPH epithelial cells, stromal cells (combined smooth muscle and connective tissue cells, and the flattened epithelial lining of dilated cystic glands). We assume (2) that the amount of mRNA of a given gene in extracted prostate tissue is derived from these four cell types in proportion to the amount of that cell type observed in a given case. That is, we postulate that a linear model accounts for the Affymetrix GeneChip Intensity:

$$y_{ij}=\beta_{BPH,j}x_{BPH,i}+\beta_{T,j}x_{T,j}+\beta_{S,j}x_{S,j}+\beta_{G,j}x_{G,j}+\epsilon_{i,j}, \quad (3)$$

where $y_{ij}$ is the observed gene expression intensity of a gene j in a sample i, $x_{xi}$ is a percentage of cell-type X in sample i and $\beta_{xj}$ is a regression coefficient for gene j and cell-type X, defining the contribution of the proportion of the cell-type X to the overall gene expression intensity of the gene j, obtained fitting the model.

The β coefficients are the change in gene expression per unit cell (i.e. the slope of plots of gene intensity vs. percent composition) and therefore are cell specific gene intensity coefficients. For the model of equation 3, no distinction has been made in the gene expression properties of tumor cells from different samples which may have different Gleason scores or varying phenotypes such as aggressive growth (Example 1). These β coefficients are, therefore, average characteristic gene expression properties of a given cell type. Aggressive versus indolent disease is treated below in section 6 below.

The coefficients of the model, equation 3, may be obtained by regression analysis (Draper N and Smith H. Applied Regression Analysis. John Wiley and Sons, New York 1981). Because there are multiple samples for some patients and samples for one patient generally have a different correlation structure then other patients, we fitted the model with Generalized Estimation Equation (GEE) by means of the package gee in R (Diggle, P. J., P. Heagerty, et al. (2002). Analysis of Longitudinal Data. Oxford University Press 2nd edition, Oxford, England). The procedure minimizes the residual by an iterative process.

To determine significant $\beta_{xj}$ values, i.e. significant correlation of gene expression with the amount of a given cell type, we test the null-hypothesis, that correlation coefficient $\beta_{xj}=0$. $\beta_{xj}$ may be significant for only some genes, the significant genes. The tuned modified t-statistic after Tusher (Tusher, V. G., R. Tibshirani, et al. (2001). Significance analysis of microarrays applied to the ionizing radiation response. Proc Natl Acad Sci USA 98(9): 5116-21) was computed. It evaluates the correlation of gene j with the proportion of the cell-type X:

$$t_{j,X} = \frac{\beta_{X,j}}{(\sigma_j + k)}, \quad (4)$$

where $\sigma_j$ is a standard error of the coefficient $\beta_{xj}$ and k is a small constant penalizing the weakly expressed genes (Tusher and Tibshirani 2001).

Cell-specific expression lists have been derived herein. For N=88 GeneChips, a modified t-statistic of 2.4 sets thresholds corresponding to greater than four-fold expected differences in expression between the respective cell types (p<0.02). 3384 transcripts displayed cell-type associated gene expression patterns according to the threshold and are listed here. 1096 genes have strong tumor association, yet the majority (683) of these represent primarily differences in tumor-stroma gene expression (tumor>stroma). Conversely, a large number of transcripts are predicted to be stroma associated (groups stroma and stroma>tumor). 492 are strongly associated with BPH cell content. A subset of these (196) also showed a strong negative association with tumor cell content indicating potential clinically useful markers of BPH. 413 are predicted to be tumor specific, being strongly associated with tumor and displaying negative associations with both BPH and stroma.

5. Independent Replication of Cell-Specific Gene Expression. The analysis of 53 samples on U95Av2 in Example 1 indicated that cell-specific gene expression could be deduced from a knowledge of cell composition. A test was undertaken to determine whether the cell-specific results of multiple regression analysis of sample of known cellular composition was reproducible and general. The multiple linear regression results were quantitatively compared for the samples analyzed by the U95Av2 GeneChips with independent samples analyzed on U133A GeneChips with independent probe sets. First, a mapping between common samples genes of each platform was created.

Mapping between U95Av2 and U133A: replication of Example 1. The mapping of the probe sets from U95Av2 to probe sets of U133A was based on Affymetrix Best Mapping (Affymetrix, Palo Alto, Calif.). 10,507 probe sets of the U95Av2 GeneChip were mapped to 9530 probe sets on the U133A GeneChip. There are approximately 22,000 probe sets on the U133A GeneChip. Thus, the mapped probe sets represents most of the U95Av2 probe sets and over 40% of the U133A probe sets. The 9530 probe sets correspond to approximately 6235 human genes.

Comparison of 4 cell-type regression analysis results for U95 and U133. Regression analysis for 4 cell-types was performed for both the U95Av2 and U133a data sets using the intensities of the mapped probe sets. The respective modified t-statistics for four cell types of both GeneChips were determined. The comparison is for 110 samples measured on the U95Av2 and 93 different samples measured by U133A. The results may be assessed by correlating modified t-statistics for these probe sets for each cell type (Table 5).

For modified t-statistics >2.4, i.e. uniformly cell-specifically expressed genes across all samples, the comparison yielded positive Pearson correlation coefficients between modified t-statistics for a given gene are in the range of 0.72 to 0.94 for the four cell types indicating excellent agreement for the determination of the same genes as cell specific in both analyses. Indeed, when all genes represented by the mapped probe sets were considered, significant positive correlations were still observed (Table 5). Since the results represent independent samples and independent gene expression analyses, these observations argue that the method of cell specific gene expression determination is reproducible and robust. Genes that are tissue specific in the U133A set are presented in Table 8.

6. Regression analysis for four cell-types and the categorical variable 'relapse case', rs: identification of differentially expressed genes in early relapse Prostate Carcinoma.

During the course of this study a number of patients exhibited postoperative PSA values greater than the test threshold. For the purposes of an interim calculation, all such patients were taken as having exhibited chemical relapse. Relapse in turn is taken as a surrogate marker of Aggressive prostate cancer. To obtain the molecular signature of 'being a relapse sample', an extended linear model was built to determine the cell-specific significant genes correlated with the categorical variable rs ('being a relapse case'):

$$y_{ij} = \beta'_{BPH,j} x_{BPH,i} + \beta'_{T,j} x_{T,i} + \beta'_{S,j} x_{S,i} + \beta'_{G,j} x_{G,i} + rs(\gamma_{BPH,j} x_{BPH,i} + \gamma_{T,j} x_{T,i} + \gamma_{S,j} x_{S,i} + \gamma_{G,j} x_{G,i}) + \epsilon_{ij}, \quad (5)$$

where $\beta'_{x,j}$ values define the contribution of the nonrelapsed cell-type expression for gene j and cell-type X; and the $\gamma_{xj}$ are the regression coefficients, defining the contribution of the relapsed cell-type X to the overall gene expression intensity of gene j. There are two-way interactions of type rs*$x_{xj}$ in the model.

Further, the False Discovery Rate (FDR) was estimated by means of a permutation schema (Good, Phillip: Permutation Tests, A Practical Guide to Resampling Methods for Testing Hypotheses, 1993, Springer Verlag, New York). FDR is a proportion of false positives in a set of significant genes, discovered by some rule. The null-hypothesis was, $\beta_{xj}=0$—'being a relapse case' has no influence on the overall gene expression. The permutation schema honored the null model and enforced its correlation structure as provided herein. This process was repeated 20-times. The distribution of the modified t-statistic considering the 20 repetitions for every cell-type gave the null-distribution of the modified t-statistics, which was compared to the actual data. The resulting FDR values are in parentheses in Table 6. ~1100 probe sets of the ~22,000 probe sets on the Affymetrix U133A GeneChip are significantly differentially expressed between nonrelapsed and early relapse Prostate Cancer. Of these, approximately 13% are false positives. Table 9 contains a list of the most significantly different genes discovered tumor that are changed in patient that have a higher risk of relapse. Table 10 contains genes that are different in stroma in relapse versus non-relapse patients.

Several particular observations are noted. First, although cell specific expression by BPH epithelium is readily apparent (Example 1), no significant gene expression changes in BPH were resolved when comparing relapsed status. This is consistent with the general observation that BPH is not a precursor lesion or factor in progression (Chung, L., Isaacs, W., and Simons, J. Prostate Cancer, Biology, Genetics, and the New Therapeutics. 2001, Human Press, New York). Second, most changes are associated with a negative γ indicating decreased gene expression with aggression, which correlates with dedifferentiation with progression (Chung et al. 2001). Third, many of the most significant gene expression changes are associated with stromal cells. The large number of differential changes in stroma may correlate with growing indications that stroma is an integral part of Prostate Cancer Progression through paracrine interactions.

The identification of genes specific to stroma and early relapse predicts that analysis of stroma alone as in negative clinical prostate biopsies may be predictive of the presence of cancer and whether indolent or aggressive disease is present. This hypothesis is readily testable both experimentally by validation studies and analytically by, for example, application of classifiers to independent data sets. A stroma classifier is developed in section 7.

When the original distribution of modified t-statistics for a particular cell-type X (e.g. stroma cell) is compared with the appropriate null-distribution, an increased frequency of modified t-statistics is apparent for (modified t-statistic)/(standard deviation) <~–1. FDR is determined as the as the ratio of areas of interest of the null distribution to the original distribution of modified t-statistics.

7. Development of Candidate Classifier of Aggressive Prostate Cancer by use of genes differentially expressed in early relapse Prostate Cancer: the 43-gene classifier.

We sought to develop a classification rule based on known samples that could be applied to the classification of unknown samples. The modified t-statistics calculated in Section 5 (U133A samples) were used as the basis for building the classifying rule. We selected 1024 genes contributing the best 1024 modified t-statistics for all cell types. Some genes contributed more that one modified t-statistic owing to the presence of multiple probe sets for that gene on the U133A GeneChip. We built a restricted model of the type of Eqn (5) by setting a gamma=0 except for the 1024 genes with the best modified t-statistics. The model was fitted by employing a version of diagonal linear discriminant analysis. The generalization error and standard deviation was estimated by repeated 10-fold cross validation by serially leaving out the gene with the lowest modified t-statistic. A set of 43 genes was selected that had generalization errors less than one standard deviation from the minimum generalization error, as provided in Table 11.

The results of the classifier when applied to various data sets are in Table 7.

These results are likely underestimates since the nonrelapse data of this interim analysis necessarily contains gene signatures of cases that will relapse within 5 years (~20% of all radical prostatectomy patients relapse; ~40% relapse within 2 years of surgery, ~49% relapse within 3 years; Chung et al 2001).

It should be noted that the classifier does not directly account for cell-specific gene expression.

8. Development of a nontumor-based Stromal classifier for aggressive Prostate Cancer.

Samples from tumor-bearing prostate glands that were confirmed by serial frozen sections to be free of tumor cells were used to predict genes associated with relapse in stroma, and BPH. The top 144 down-regulated genes in the permutation analysis are listed in Table 12. In addition, the top 100 up-regulated genes are also listed in Table 13.

The 144 genes were all tested as the starting set for a Support Vector Machine (SVM) application. This method seeks a subset of genes that discriminate two or more data sets in a manner that is independent of cell composition. Thus, a classifier derived in this was may be applied to independent data sets of unknown cell composition.

The result for the application of the 144 gene classifier to our nontumor samples was the correct classification of relapse status in 79.1% of the samples. The classifier has been tested on an entirely independent data set composed of known relapsed and nonrelapsed cases of Febbo et al. (Febbo P G, Sellers W R. Use of expression analysis to predict outcome after radical prostatectomy. J Urol. December 2003; 170(6 Pt 2):S11-9; discussion S19-20) with a result of 76%. However, the Febbo at al. 2003 are tumor samples only, with high percentage of tumor. These results far exceed random expectation. As before, these performance results are likely underestimates owing to the use of nonrelapse data in this interim analysis, which almost certainly contains late relapsing cases.

A number of embodiments are been described herein. Nevertheless, it will be understood that various modifications may be made without departing from the spirit and scope of the methods, compositions and kits. Accordingly, since modifications will be apparent to those of skill in this art, it is intended that this invention be limited only by the scope of the appended claims.

TABLE 1

Genes and Sequences of real-time quantitative RT-PCR primers of measured gene transcripts
(Fwd Primer column discloses SEQ ID NO: 38,827-38,857, respectively, in order of appearance.
Rev Primer column discloses SEQ ID NOS: 38,858-38,888, respectively, in order of appearance.)

| HUGO Name | Accession No. | UniGene | Fwd Primer (5'-3') | Rev Primer (5'-3') | Llength (bp) |
|---|---|---|---|---|---|
| | | | G | | |
| glyceraldehyde-3-phosphate dehydrogenase | NM_002046 | Hs.169476 | GAAGGTGAAGGTCGGAGTC | GAAGATGGTGATGGGATTTC | 226 |

TABLE 1-continued

Genes and Sequences of real-time quantitative RT-PCR primers of measured gene transcripts
(Fwd Primer column discloses SEQ ID NO: 38,827-38,857, respectively, in order of appearance.
Rev Primer column discloses SEQ ID NOS: 38,858-38,888, respectively, in order of appearance.)

| HUGO Name | Accession No. | UniGene | Fwd Primer (5'-3') | Rev Primer (5'-3') | Length (bp) |
|---|---|---|---|---|---|
| kallikrein 3, (prostate specific antigen) | NM_001648 | Hs.171995 | TGGTGCTGCACCCCTCAT | CCAGGGTTGGGAATGCTTCT | 70 |
| tropomyosin 1 (alpha) | NM_000366 | Hs.77899 | GAAGATGCCGACCGCAAAT | CGTTCCAGGTCGCTCTCAAT | 68 |
| actin, alpha 2, smooth muscle, aorta | NM_001613 | Hs.195851 | TGGTCATCCTCCCTTGAGAAGA | CGTTCATTTCCGATGGTGATC | 68 |
| collagen, type I, alpha 1 | NM_000088 | Hs.172928 | GGCTTCCCTGGTCCTCTTG | GGGACCACGTTCACCACTTG | 78 |
| hepsin (transmembrane protease, serine 1) | NM_002151 | Hs.823 | TTTGTGTGTGAGGACAGCATCTC | GCCCCAACTCACAATGCC | 66 |
| MARCKS-like protein | NM_023009 | Hs.75061 | GCGCTGAGCAGAATGAGTAGCT | ACCTCACAAGGACAGCACAGTTT | 79 |
| LIM | NM_006457 | Hs.154103 | CCTGGAAGCTCTGGGCTACAC | TTCCAAACTTTCACAACACACTGA | 70 |
| thymosin, beta 4, Y chromosome | NM_004202 | Hs.159201 | GCGACCTGGGCTCCATTT | AGCCACTTCCGCGTTCAAG | 63 |
| kallikrein 2, prostatic | NM_005551 | Hs.181350 | CGTGCCCCTCATCCAGTCT | GCCAGGGTTGGGAATGCT | 65 |
| acid phosphatase, prostate | NM_001099 | Hs.1852 | TTTCTCAGGGCAGATGATGCT | AAGCCCATTTTCCTCAAAGCT | 71 |
| keratin 15 | NM_002275 | Hs.80342 | CTCCAGTCCCTGCCTTCAGA | GCATGCAAAGCCCTGAAATAA | 66 |
| keratin 5 (epidermolysis bullosa simplex, Dowling-Meara/Kobner/Weber-Cockayne types) | NM_000424 | Hs.433845 | CACAGAGATGAACCGGATGATC | TTGGCGCACTGTTTCTTGAC | 69 |
| prostaglandin D2 synthase (21 kD, brain) | NM_000954 | Hs.8272 | GGGCTTCACAGAGGATACCATT | AGTCCTATTGTTCCGTCATGCA | 68 |
| CD44 antigen (homing function and Indian blood group system) | NM_000610 | Hs.169610 | CCTCTGCAAGGCTTTCAATAGC | CGATGCTCAGAGCTTTCTCCAT | 65 |
| tropomyosin 2 (beta) | NM_003289 | Hs.300772 | CGAGAGCCGAGCCAGACA | CTCTGAGGCCATCAGGGACTT | 76 |
| Desmin | NM_001927 | Hs.279604 | CCAGTCCTACACCTGCGAGATT | CCTCCAATTCCCGCATCTG | 77 |
| Transforming growth factor, beta 1 (Camurati-Engelmann disease) | NM_000660 | Hs.1103 | CTCTCCGACCTGCCACAGA | AACCTAGATGGGCGCGATCT | 72 |
| filamin A, alpha (actin binding protein 280) | NM_001456 | Hs.195464 | CAGGCTTGGTGTCTGCTTACG | TCCCGCATTGCTCGTGTT | 89 |
| myosin, light polypeptide 9, regulatory | NM_006097 | Hs.9615 | TTAAGGAGGCTTTCAACATGATTG | GTCGTGCAGGTCCTCCTTGT | 68 |
| myosin, heavy polypeptide 11, smooth muscle | NM_002474 | Hs.78344 | ACGGGAGAGCTGGAAAAGC | TTTTGGCGTTGCCGAAAG | 67 |
| Synaptogyrin 1 | NM_004711 | Hs.6139 | CCAAAGGACAGCAGTGATGGA | CCGGATTGGAAAATGAAGTCA | 79 |
| eukaryotic translation elongation factor 1 alpha 1 | NM_001402 | Hs.181165 | CTGAACCATCCAGGCCAAAT | GCCGTGTGGCAATCCAAT | 59 |

TABLE 1-continued

Genes and Sequences of real-time quantitative RT-PCR primers of measured gene transcripts
(Fwd Primer column discloses SEQ ID NO: 38,827-38,857, respectively, in order of appearance.
Rev Primer column discloses SEQ ID NOS: 38,858-38,888, respectively, in order of appearance.)

| HUGO Name | Accession No. | UniGene | Fwd Primer (5'-3') | Rev Primer (5'-3') | Llength (bp) |
|---|---|---|---|---|---|
| single-minded homolog 2 (Drosophila) | NM_005069.2 | Hs.27311 | TTTAGGACCGTGGGTCATGC | ATAGCTGAGTGCGTGGAGAGG | 77 |
| alpha-methylacyl-CoA racemase | NM_014324.2 | Hs.128749 | GTGAAACAGAGTGATTGGTTGCA | GAATGTGCTTAGAGGGAGATCATGA | 70 |
| UDP-N-acteylglucosamine pyrophosphorylase 1 | NM_003115.2 | Hs.21293 | CTCTCCTCTTATCTCCTATGCTGGA | CGATGATTAGAGGTGCATGGAA | 80 |
| RAB4A, member RAS oncogene family | NM_004578.2 | Hs.119007 | GAGACAGCTGAGGTCACCGC | ATTGTGTCCCAAATGCCACTG | 104 |
| CD38 antigen (p45) | NM_001775.1 | Hs.66052 | CACCATAAAAGAGCTGGAATCGAGTAGTGGAATATGTCTTCTGTATAA | GTGCAAGATGAATCCTCAGGATTT | 120 |
| homeo box A9 | NM_002142.3 | | CTAGGCT | CATCCCCGAGAACACTTAAAATTT | 108 |
| tubulin, alpha 1 (testis specific) | NM_006000.1 | Hs.75318 | TCTGTTTGCTGTTCATGACCCT | AAGAACCCCTTTGCAGGTCTC | 65 |
| Arachidonate 15-lipoxygenase, second type | NM_001141.1 | Hs.111256 | CATGCGAGGGCTTCATAGC | GATGCCCCTCGAGATCTGG | 197 |

TABLE 3

Summary of Agreement Analysis Among Four
Pathologists
126 Sample Slides
363 Ratings
Average Pearson Correlation Coefficients:

| Tumor epithelial cells | 0.92 |
|---|---|
| BPH epithelial cells | 0.73 |
| Stroma-all cells | 0.77 |
| Dilated Cystic Glands epithelial cells | 0.49 |

TABLE 4

Summary of Prostate Carcinoma Cases with known Cell Composition and Clinical Follow-up Analyzed by Affymetrix GeneChips.

| Set | Patients | Micro Chips | Tumor-Bearing Samples | Non Tumor-Bearing Samples | Relapse Tumor Samples | Non relapse Tumor Samples | Patients Analyzed on both U95/U133 | RNA Extracts Analyzed on both U95/U133 |
|---|---|---|---|---|---|---|---|---|
| U95Av2 | | 88 | 38 | 50 | | | 34 | 54 |
| Example 1 | | 30 | | | | | | |
| Recent | | 64 | | | | | | |
| Unique to | | 110 | | | | | | |
| U95Av2 Also run on U133A[2] | | 118 | 50 | 68 | 13 | 35 | | |
| TOTAL | | | | | | | | |
| U133A | 57 | 146 | 74 | 52 | 28 | 46 | | |
| Also run on U95[2] | | 93 | | | | | | |
| TOTAL | 91 | 146 | | | | | | |

[1]As of July 2004; refers to relapse tumor samples and nonrelapse tumor samples.

[2]For the comparison of cell-specific genes derived following the methods of Example 1 using U95Av2 GeneChips, 110 patients analyzed on the U95Av2 platform were compared to 93 independent patients analyzed on the U133A platform. T-statistics for the four cell types were determined and compared as described in Section 5.

TABLE 5

Agreement Analysis of Cell-type Specific Gene Expression as determined using U95A GeneChip expression data (Example 1) and additional samples and by U113A GeneChip Expression data

| Cell Type | Pearson Correlation Coefficient for U95 vs. U133 with probability | |
|---|---|---|
| | t-statistic >2.4 | No t-statistic cutoff |
| TUMOR EPITHELIAL CELLS | 0.827 | 0.51 |
| | p < 2.23e**−16 | p < 2.2e**−16 |
| BPH EPITHELIAL CELLS | 0.723 | 0.366 |
| | p < 2.2e**−16 | p < 2.2e**−16 |
| STROMA CELLS | 0.937 | 0.734 |
| | p < 2.2e**−16 | p < 2.2e**−16 |
| DILATED CYSTIC GLAND EIPTHELIAL CELLS | 0.750 | 0.323 |
| | p < 7.4e**−13 | p < 2.2e**−16 |

TABLE 6

Identification of 1098 probe sets that are significantly differentially expressed in early relapse Prostate Cancer by Cell-type based on analysis of 146 U133A GeneChips. False discovery rates are in parentheses.

SAMPLES

| | |
|---|---|
| Relapsed within 2 years | 28 |
| NonRelapsed tumors (2-3 years) | 46 |
| Control: tissue from relapsed cases | 46 |
| Control: tissue from nonrelapsed cases | 26 |
| TOTAL | 146 |

RESULTS

Tumor cells of relapse tumor vs. nonrelapsed tumor

| | |
|---|---|
| 394 | significant differences in gene expression |
| 110 (0.22) | increased in expression |
| 284 (0.19) | decreased in expression |

Stromal cells of relapse tumor vs. nonrelapsed tumor

| | |
|---|---|
| 704 | significant differences |
| 78 (0.22) | increased in expression |
| 626 (0.06) | decreased in expression |

BPH cells - no significant differences

TABLE 7

| Data Set | Classification success % |
|---|---|
| 146 U133A Arrays | 67.75% of relapse and nonrelapse cases correct |
| | 80% of relapse cases correct |
| Probe Sets Common to U133A & U95 | 69.89% |

TABLE 9

Top genes identified as up- and down-regulated in prostate tumor cells of relapse patients, calculated by linear regression, including all samples with prostate cancer. (negative numbers for down-regulated. −1 is best)

| Affymetrix ProbeID | T statistic | Rank | Large differences |
|---|---|---|---|
| 218509_at | 5.44 | 1 | D |
| 220587_s_at | 5.22 | 2 | |
| 208579_x_at | 4.83 | 3 | |
| 208490_x_at | 4.56 | 4 | |
| 209806_at | 4.55 | 5 | |
| 208527_x_at | 4.55 | 6 | |
| 208676_s_at | 4.51 | 7 | D |
| 218186_at | 4.26 | 8 | |
| 209873_s_at | 4.23 | 9 | |
| 202148_s_at | 4.23 | 10 | D |
| 201618_x_at | 4.13 | 11 | |
| 209391_at | 4.07 | 12 | |
| 200003_s_at | 3.95 | 13 | |
| 212445_s_at | 3.94 | 14 | |
| 64899_at | 3.91 | 15 | |
| 220584_at | 3.87 | 16 | |
| 202041_s_at | 3.86 | 17 | |
| 211982_x_at | 3.86 | 18 | D |
| 215690_x_at | 3.86 | 19 | |
| 218275_at | 3.84 | 20 | |
| 202871_at | 3.8 | 21 | |
| 222067_x_at | 3.79 | 22 | |
| 210243_s_at | 3.71 | 23 | |
| 32837_at | 3.62 | 24 | |
| 211716_x_at | 3.61 | 25 | D |
| 208629_s_at | 3.6 | 26 | |
| 213843_x_at | 3.6 | 27 | |
| 211899_s_at | 3.59 | 28 | |
| 203103_s_at | 3.56 | 29 | |
| 219798_s_at | 3.55 | 30 | |
| 215812_s_at | 3.54 | 31 | |
| 211060_x_at | 3.52 | 32 | |
| 208684_at | 3.51 | 33 | D |
| 206491_s_at | 3.5 | 34 | |
| 218261_at | 3.5 | 35 | |
| 203720_s_at | 3.46 | 36 | |
| 201115_at | 3.45 | 37 | |
| 201388_at | 3.45 | 38 | |
| 220189_s_at | 3.44 | 39 | |
| 208308_s_at | 3.44 | 40 | D |
| 210983_s_at | 3.43 | 41 | D |
| 219360_s_at | 3.41 | 42 | |
| 201378_s_at | 3.37 | 43 | D |
| 202779_s_at | 3.37 | 44 | D |
| 203287_at | 3.36 | 45 | |
| 201168_x_at | 3.35 | 46 | |
| 202525_at | 3.35 | 47 | |
| 210854_x_at | 3.35 | 48 | |
| 208613_s_at | 3.34 | 49 | |
| 209696_at | 3.31 | 50 | |
| 217294_s_at | 3.31 | 51 | D |
| 214784_x_at | 3.31 | 52 | |
| 219223_at | 3.31 | 53 | |
| 200852_x_at | 3.31 | 54 | |
| 209844_at | 3.3 | 55 | |
| 208546_x_at | 3.29 | 56 | |
| 204934_s_at | 3.27 | 57 | |
| 202676_x_at | 3.25 | 58 | |
| 212125_at | 3.25 | 59 | |
| 201771_at | 3.24 | 60 | |
| 202247_s_at | 3.21 | 61 | D |
| 200997_at | 3.21 | 62 | |
| 207722_s_at | 3.21 | 63 | |
| 201709_s_at | 3.2 | 64 | |
| 203228_at | 3.19 | 65 | |
| 204109_s_at | 3.19 | 66 | |
| M33197_5_at | 3.19 | 67 | |
| 208824_x_at | 3.17 | 68 | |
| 212282_at | 3.17 | 69 | |
| 209878_s_at | 3.15 | 70 | |
| 210761_s_at | 3.15 | 71 | |
| 208751_at | 3.15 | 72 | |
| 202758_s_at | 3.14 | 73 | |
| 218164_at | 3.14 | 74 | |

TABLE 9-continued

Top genes identified as up- and down-regulated in prostate
tumor cells of relapse patients, calculated by linear
regression, including all samples with prostate cancer.
(negative numbers for down-regulated. −1 is best)

| Affymetrix ProbeID | T statistic | Rank | Large differences |
|---|---|---|---|
| 201548_s_at | 3.14 | 75 | |
| 209231_s_at | 3.14 | 76 | |
| 214501_s_at | 3.13 | 77 | |
| 58696_at | 3.13 | 78 | |
| 212081_x_at | 3.12 | 79 | |
| 210470_x_at | 3.11 | 80 | D |
| 212563_at | 3.1 | 81 | |
| 202790_at | 3.1 | 82 | |
| 214336_s_at | 3.09 | 83 | |
| 65517_at | 3.09 | 84 | |
| 208523_x_at | 3.09 | 85 | D |
| 208856_x_at | 3.09 | 86 | |
| 200895_s_at | 3.09 | 87 | |
| 208698_s_at | 3.08 | 88 | |
| 208621_s_at | 3.08 | 89 | |
| 202545_at | 3.07 | 90 | |
| 203952_at | 3.06 | 91 | |
| 201946_s_at | 3.06 | 92 | |
| 212772_s_at | 3.05 | 93 | |
| 217791_s_at | 3.05 | 94 | |
| 217784_at | 3.05 | 95 | |
| 201526_at | 3.04 | 96 | |
| 220707_s_at | 3.04 | 97 | |
| 200950_at | 3.03 | 98 | D |
| 212002_at | 3.03 | 99 | |
| 218893_at | 3.03 | 100 | |
| 201587_s_at | 3.03 | 101 | |
| 208693_s_at | 3.03 | 102 | |
| 209516_at | 3.03 | 103 | |
| 217754_at | 3.02 | 104 | |
| 209592_s_at | 3.02 | 105 | |
| 202290_at | 3.02 | 106 | |
| 218695_at | 3.01 | 107 | |
| 220964_s_at | 3.01 | 108 | |
| 213059_at | 3 | 109 | |
| 204480_s_at | 3 | 110 | |
| 212845_at | −3 | −284 | |
| 212535_at | −3.01 | −283 | |
| 212150_at | −3.01 | −282 | |
| 202000_at | −3.01 | −281 | |
| 202133_at | −3.01 | −280 | |
| 201153_s_at | −3.01 | −279 | |
| 200673_at | −3.02 | −278 | |
| 204655_at | −3.02 | −277 | |
| 209658_at | −3.02 | −276 | |
| 213044_at | −3.02 | −275 | |
| 209656_s_at | −3.03 | −274 | |
| 221788_at | −3.03 | −273 | D |
| 209465_x_at | −3.03 | −272 | |
| 212956_at | −3.04 | −271 | |
| 220617_s_at | −3.04 | −270 | D |
| 204345_at | −3.04 | −269 | |
| 203017_s_at | −3.05 | −268 | |
| 203636_at | −3.06 | −267 | |
| 201865_x_at | −3.06 | −266 | |
| 202269_x_at | −3.07 | −265 | |
| 213338_at | −3.07 | −264 | |
| 200762_at | −3.07 | −263 | D |
| 208131_at | −3.08 | −262 | |
| 204753_s_at | −3.09 | −261 | |
| 213158_at | −3.1 | −260 | |
| 211577_s_at | −3.1 | −259 | |
| 211562_s_at | −3.1 | −258 | D |
| 212226_s_at | −3.1 | −257 | |
| 213005_s_at | −3.1 | −256 | |
| 205348_s_at | −3.11 | −255 | |
| 823_at | −3.11 | −254 | |
| 212713_at | −3.11 | −253 | D |
| 200696_s_at | −3.11 | −252 | |
| 204359_at | −3.11 | −251 | |
| 209747_at | −3.11 | −250 | |
| 207876_s_at | −3.11 | −249 | |
| 213878_at | −3.12 | −248 | |
| 211126_s_at | −3.12 | −247 | |
| 211813_x_at | −3.12 | −246 | D |
| 208030_s_at | −3.13 | −245 | |
| 218082_at | −3.13 | −244 | |
| 210764_s_at | −3.13 | −243 | D |
| 200985_s_at | −3.14 | −242 | |
| 209075_s_at | −3.14 | −241 | |
| 209473_at | −3.14 | −240 | |
| 212557_at | −3.14 | −239 | D |
| 212149_at | −3.14 | −238 | |
| 206070_s_at | −3.15 | −237 | |
| 221523_s_at | −3.15 | −236 | D |
| 209297_at | −3.15 | −235 | |
| 212288_at | −3.15 | −234 | |
| 213306_at | −3.15 | −233 | |
| 202074_at | −3.16 | −232 | |
| 203156_at | −3.16 | −231 | |
| 215016_x_at | −3.16 | −230 | |
| 201200_at | −3.17 | −229 | |
| 207738_s_at | −3.17 | −228 | |
| 202037_s_at | −3.17 | −227 | D |
| 209129_at | −3.18 | −226 | |
| 217437_s_at | −3.18 | −225 | |
| 202026_at | −3.18 | −224 | |
| 217362_x_at | −3.18 | −223 | |
| 219747_at | −3.18 | −222 | |
| 209466_x_at | −3.19 | −221 | |
| 200791_s_at | −3.19 | −220 | |
| 202522_at | −3.19 | −219 | |
| 213110_s_at | −3.2 | −218 | |
| 202266_at | −3.2 | −217 | D |
| 209542_x_at | −3.2 | −216 | |
| 201603_at | −3.21 | −215 | |
| 202440_s_at | −3.21 | −214 | |
| 212423_at | −3.22 | −213 | |
| 204963_at | −3.22 | −212 | |
| 209568_s_at | −3.22 | −211 | |
| 211984_at | −3.22 | −210 | |
| 213411_at | −3.23 | −209 | |
| 201150_s_at | −3.23 | −208 | |
| 201336_at | −3.23 | −207 | |
| 201021_s_at | −3.23 | −206 | |
| 214752_x_at | −3.23 | −205 | |
| 209550_at | −3.23 | −204 | |
| 221760_at | −3.24 | −203 | |
| 200899_s_at | −3.24 | −202 | |
| 206332_s_at | −3.24 | −201 | |
| 211737_x_at | −3.24 | −200 | |
| 208747_s_at | −3.24 | −199 | |
| 204412_s_at | −3.24 | −198 | |
| 209770_at | −3.25 | −197 | |
| 206481_s_at | −3.25 | −196 | |
| 212549_at | −3.25 | −195 | |
| 211986_at | −3.26 | −194 | |
| 203687_at | −3.26 | −193 | |
| 212551_at | −3.26 | −192 | |
| 201152_s_at | −3.26 | −191 | |
| 211962_s_at | −3.26 | −190 | |
| 203632_s_at | −3.27 | −189 | |
| 208944_at | −3.27 | −188 | |
| 212558_at | −3.27 | −187 | |
| 201185_at | −3.27 | −186 | |
| 219055_at | −3.27 | −185 | |
| 219647_at | −3.28 | −184 | |
| 203705_s_at | −3.28 | −183 | |
| 205383_s_at | −3.28 | −182 | |
| 204462_s_at | −3.29 | −181 | |
| 213203_at | −3.29 | −180 | |
| 219685_at | −3.3 | −179 | |
| 202646_s_at | −3.3 | −178 | |
| 205564_at | −3.3 | −177 | |

TABLE 9-continued

Top genes identified as up- and down-regulated in prostate tumor cells of relapse patients, calculated by linear regression, including all samples with prostate cancer. (negative numbers for down-regulated. −1 is best)

| Affymetrix ProbeID | T statistic | Rank | Large differences |
|---|---|---|---|
| 203339_at | −3.31 | −176 | |
| 204939_s_at | −3.31 | −175 | |
| 202506_at | −3.31 | −174 | |
| 218718_at | −3.32 | −173 | D |
| 203065_s_at | −3.33 | −172 | |
| 206938_at | −3.33 | −171 | |
| 205051_s_at | −3.33 | −170 | |
| 212063_at | −3.34 | −169 | |
| 216215_s_at | −3.34 | −168 | |
| 213675_at | −3.34 | −167 | |
| 35776_at | −3.36 | −166 | |
| 212690_at | −3.38 | −165 | |
| 204400_at | −3.38 | −164 | |
| 202157_s_at | −3.39 | −163 | |
| 209090_s_at | −3.39 | −162 | |
| 204135_at | −3.39 | −161 | |
| 201409_s_at | −3.4 | −160 | |
| 208158_s_at | −3.4 | −159 | |
| 220911_s_at | −3.42 | −158 | |
| 201957_at | −3.42 | −157 | |
| 209616_s_at | −3.42 | −156 | D |
| 220751_s_at | −3.42 | −155 | |
| 209291_at | −3.42 | −154 | |
| 200986_at | −3.44 | −153 | |
| 206874_s_at | −3.45 | −152 | |
| 209210_s_at | −3.45 | −151 | |
| 204069_at | −3.46 | −150 | |
| 214937_x_at | −3.46 | −149 | |
| 201667_at | −3.46 | −148 | |
| 202362_at | −3.46 | −147 | |
| 201368_at | −3.47 | −146 | |
| 207977_s_at | −3.48 | −145 | |
| 201536_at | −3.48 | −144 | |
| 212829_at | −3.48 | −143 | |
| 210299_s_at | −3.49 | −142 | D |
| 212230_at | −3.49 | −141 | |
| 219167_at | −3.49 | −140 | |
| 209379_s_at | −3.49 | −139 | |
| 208791_at | −3.49 | −138 | D |
| 212233_at | −3.5 | −137 | D |
| 204820_s_at | −3.51 | −136 | |
| 202995_s_at | −3.51 | −135 | |
| 200931_s_at | −3.51 | −134 | |
| 203566_s_at | −3.52 | −133 | D |
| 221816_s_at | −3.53 | −132 | |
| 203680_at | −3.53 | −131 | |
| 212865_s_at | −3.54 | −130 | |
| 218217_at | −3.55 | −129 | |
| 218824_at | −3.56 | −128 | |
| 212111_at | −3.56 | −127 | |
| 212148_at | −3.57 | −126 | |
| 217766_s_at | −3.57 | −125 | |
| 203903_s_at | −3.58 | −124 | |
| 215000_s_at | −3.59 | −123 | |
| 208792_s_at | −3.59 | −122 | |
| 206580_s_at | −3.59 | −121 | |
| 213068_at | −3.6 | −120 | |
| 209337_at | −3.61 | −119 | |
| 208667_s_at | −3.61 | −118 | |
| 213924_at | −3.61 | −117 | |
| 204931_at | −3.62 | −116 | |
| 217792_at | −3.62 | −115 | |
| 202501_at | −3.63 | −114 | |
| 201300_s_at | −3.63 | −113 | |
| 204570_at | −3.65 | −112 | |
| 202946_s_at | −3.65 | −111 | |
| 212097_at | −3.66 | −110 | |
| 200953_s_at | −3.68 | −109 | D |
| 209540_at | −3.7 | −108 | |
| 204754_at | −3.71 | −107 | D |
| 203420_at | −3.72 | −106 | |
| 200816_s_at | −3.72 | −105 | |
| 202172_at | −3.74 | −104 | |
| 212120_at | −3.74 | −103 | |
| 205480_s_at | −3.75 | −102 | |
| 204083_s_at | −3.75 | −101 | |
| 204464_s_at | −3.77 | −100 | |
| 221748_s_at | −3.77 | −99 | |
| 212419_at | −3.79 | −98 | |
| 203037_s_at | −3.79 | −97 | |
| 203640_at | −3.79 | −96 | |
| 212586_at | −3.79 | −95 | |
| 202073_at | −3.8 | −94 | |
| 209496_at | −3.82 | −93 | |
| 212764_at | −3.82 | −92 | D |
| 212043_at | −3.82 | −91 | D |
| 201289_at | −3.83 | −90 | |
| 200621_at | −3.83 | −89 | D |
| 207016_s_at | −3.83 | −88 | |
| 205624_at | −3.84 | −87 | |
| 207547_s_at | −3.84 | −86 | |
| 201893_x_at | −3.85 | −85 | |
| 201787_at | −3.86 | −84 | |
| 211323_s_at | −3.87 | −83 | D |
| 202401_s_at | −3.88 | −82 | |
| 207761_s_at | −3.88 | −81 | |
| 201121_s_at | −3.89 | −80 | D |
| 207071_s_at | −3.89 | −79 | |
| 204793_at | −3.9 | −78 | |
| 218162_at | −3.9 | −77 | |
| 212914_at | −3.9 | −76 | |
| 218730_s_at | −3.91 | −75 | D |
| 201012_at | −3.91 | −74 | D |
| 209541_at | −3.91 | −73 | |
| 200911_s_at | −3.91 | −72 | |
| 201560_at | −3.93 | −71 | |
| 204041_at | −3.93 | −70 | |
| 218698_at | −3.94 | −69 | |
| 201272_at | −3.95 | −68 | |
| 210297_s_at | −3.95 | −67 | |
| 204393_s_at | −3.96 | −66 | D |
| 207961_x_at | −3.98 | −65 | |
| 221584_s_at | −3.99 | −64 | |
| 212509_s_at | −4.02 | −63 | |
| 212730_at | −4.02 | −62 | |
| 218421_at | −4.03 | −61 | |
| 209487_at | −4.03 | −60 | |
| 213071_at | −4.03 | −59 | D |
| 209118_s_at | −4.04 | −58 | |
| 218298_s_at | −4.05 | −57 | |
| 203404_at | −4.06 | −56 | D |
| 203706_s_at | −4.06 | −55 | |
| 213093_at | −4.06 | −54 | |
| 202992_at | −4.09 | −53 | D |
| 201408_at | −4.09 | −52 | |
| 217922_at | −4.1 | −51 | |
| 218087_s_at | −4.1 | −50 | D |
| 218047_at | −4.14 | −49 | |
| 200982_s_at | −4.14 | −48 | |
| 200907_s_at | −4.15 | −47 | |
| 202594_at | −4.15 | −46 | |
| 205364_at | −4.16 | −45 | |
| 212724_at | −4.18 | −44 | |
| 208848_at | −4.2 | −43 | |
| 202565_s_at | −4.25 | −42 | |
| 212757_s_at | −4.25 | −41 | |
| 208789_at | −4.28 | −40 | D |
| 203710_at | −4.31 | −39 | |
| 212195_at | −4.35 | −38 | |
| 203766_s_at | −4.35 | −37 | |
| 201061_s_at | −4.36 | −36 | |
| 213293_s_at | −4.36 | −35 | |
| 209651_at | −4.38 | −34 | |
| 212813_at | −4.41 | −33 | |

TABLE 9-continued

Top genes identified as up- and down-regulated in prostate tumor cells of relapse patients, calculated by linear regression, including all samples with prostate cancer. (negative numbers for down-regulated. −1 is best)

| Affymetrix ProbeID | T statistic | Rank | Large differences |
|---|---|---|---|
| 209687_at | −4.43 | −32 | |
| 202350_s_at | −4.44 | −31 | |
| 210987_x_at | −4.49 | −30 | |
| 202555_s_at | −4.55 | −29 | |
| 209286_at | −4.58 | −28 | |
| 205011_at | −4.58 | −27 | |
| 212077_at | −4.6 | −26 | |
| 218418_s_at | −4.64 | −25 | |
| 209948_at | −4.64 | −24 | D |
| 202228_s_at | −4.66 | −23 | |
| 217897_at | −4.66 | −22 | D |
| 209763_at | −4.67 | −21 | |
| 202994_s_at | −4.67 | −20 | |
| 207480_s_at | −4.67 | −19 | |
| 207430_s_at | −4.67 | −18 | D |
| 201540_at | −4.72 | −17 | |
| 216231_s_at | −4.72 | −16 | |
| 203951_at | −4.72 | −15 | |
| 209288_s_at | −4.75 | −14 | |
| 221958_s_at | −4.76 | −13 | |
| 201431_s_at | −4.8 | −12 | |
| 200974_at | −4.82 | −11 | |
| 221667_s_at | −4.99 | −10 | |
| 202432_at | −5.02 | −9 | |
| 200897_s_at | −5.15 | −8 | |
| 209074_s_at | −5.16 | −7 | D |
| 201891_s_at | −5.19 | −6 | |
| 201497_x_at | −5.23 | −5 | |
| 202274_at | −5.72 | −4 | |
| 200795_at | −5.89 | −3 | |
| 201022_s_at | −5.93 | −2 | |
| 210986_s_at | −6.14 | −1 | |

TABLE 10

Top genes identified as up- and down-regulated in prostate stroma of relapse patients, calculated by linear regression, including all samples with prostate cancer. (negative numbers for down-regulated. −1 is best)

| Affymetrix number Probe Set Name | T statistic | Rank | Probe Set Name |
|---|---|---|---|
| | | | D |
| 204436_at | 4.19 | 1 | |
| 212076_at | 3.94 | 2 | |
| 202401_s_at | 3.93 | 3 | |
| 211323_s_at | 3.85 | 4 | D |
| 211991_s_at | 3.81 | 5 | |
| 212713_at | 3.77 | 6 | D |
| 207547_s_at | 3.73 | 7 | |
| 209473_at | 3.68 | 8 | |
| 200953_s_at | 3.61 | 9 | D |
| 202501_at | 3.61 | 10 | |
| 205988_at | 3.59 | 11 | |
| 212151_at | 3.57 | 12 | |
| 203735_x_at | 3.55 | 13 | |
| 205456_at | 3.51 | 14 | |
| 218525_s_at | 3.5 | 15 | |
| 208789_at | 3.49 | 16 | D |
| 204882_at | 3.48 | 17 | |
| 201148_s_at | 3.47 | 18 | |
| 207691_x_at | 3.47 | 19 | |
| 200610_s_at | 3.46 | 20 | |
| 215826_x_at | 3.46 | 21 | |
| 209582_s_at | 3.45 | 22 | D |

TABLE 10-continued

Top genes identified as up- and down-regulated in prostate stroma of relapse patients, calculated by linear regression, including all samples with prostate cancer. (negative numbers for down-regulated. −1 is best)

| Affymetrix number | T statistic | Rank | |
|---|---|---|---|
| 209071_s_at | 3.4 | 23 | 0 |
| 201080_at | 3.39 | 24 | |
| 210105_s_at | 3.39 | 25 | |
| 200621_at | 3.38 | 26 | D |
| 218581_at | 3.37 | 27 | |
| 209070_s_at | 3.35 | 28 | |
| 221958_s_at | 3.35 | 29 | |
| 211203_s_at | 3.35 | 30 | |
| 201893_x_at | 3.34 | 31 | |
| 205011_at | 3.34 | 32 | |
| 203853_s_at | 3.34 | 33 | |
| 221447_s_at | 3.34 | 34 | |
| 212972_x_at | 3.33 | 35 | |
| 214760_at | 3.3 | 36 | |
| 202048_s_at | 3.28 | 37 | |
| 217187_at | 3.27 | 38 | |
| 204754_at | 3.26 | 39 | D |
| 217362_x_at | 3.25 | 40 | |
| 210976_s_at | 3.25 | 41 | |
| 209057_x_at | 3.2 | 42 | D |
| 205405_at | 3.19 | 43 | |
| 200974_at | 3.19 | 44 | |
| 213958_at | 3.18 | 45 | |
| 204795_at | 3.17 | 46 | |
| 219035_s_at | 3.16 | 47 | |
| 217580_x_at | 3.16 | 48 | D |
| 209947_at | 3.15 | 49 | |
| 212822_at | 3.15 | 50 | |
| 217925_s_at | 3.15 | 51 | |
| 211697_x_at | 3.15 | 52 | D |
| 38521_at | 3.14 | 53 | |
| 204341_at | 3.14 | 54 | D |
| 216033_s_at | 3.14 | 55 | |
| 209646_x_at | 3.14 | 56 | |
| 208306_x_at | 3.13 | 57 | |
| 210444_at | 3.13 | 58 | |
| 209297_at | 3.13 | 59 | |
| 214738_s_at | 3.1 | 60 | |
| 202074_s_at | 3.1 | 61 | |
| 205482_x_at | 3.09 | 62 | |
| 201320_at | 3.09 | 63 | |
| 214694_at | 3.08 | 64 | |
| 212344_at | 3.08 | 65 | |
| 206868_at | 3.08 | 66 | |
| 211504_x_at | 3.08 | 67 | |
| 206057_x_at | 3.07 | 68 | |
| 219093_at | 3.07 | 69 | |
| 203950_s_at | 3.06 | 70 | |
| 200795_at | 3.06 | 71 | |
| 212239_at | 3.05 | 72 | |
| 211296_x_at | 3.05 | 73 | |
| 210288_at | 3.04 | 74 | |
| 205151_s_at | 3.03 | 75 | |
| 38149_at | 3.02 | 76 | |
| 211123_at | 3.02 | 77 | |
| 218338_at | 3.01 | 78 | |
| 217782_s_at | −2.5 | −626 | |
| 211972_x_at | −2.5 | −625 | |
| 220477_s_at | −2.5 | −624 | |
| 201485_s_at | −2.5 | −623 | |
| 203201_at | −2.51 | −622 | |
| 217950_at | −2.51 | −621 | |
| 209917_at | −2.51 | −620 | |
| 203164_at | −2.51 | −619 | |
| 218186_at | −2.51 | −618 | |
| 218617_at | −2.51 | −617 | |
| 203573_at | −2.51 | −616 | |
| 203721_s_at | −2.51 | −615 | |
| 201568_at | −2.51 | −614 | |
| 209110_s_at | −2.51 | −613 | |
| 209471_s_at | −2.51 | −612 | |
| 208721_s_at | −2.51 | −611 | |

TABLE 10-continued

Top genes identified as up- and down-regulated in prostate stroma of relapse patients, calculated by linear regression, including all samples with prostate cancer.
(negative numbers for down-regulated. −1 is best)

| Affymetrix number | T statistic | Rank | |
|---|---|---|---|
| 208649_s_at | −2.52 | −610 | |
| 212168_at | −2.52 | −609 | |
| 209377_s_at | −2.52 | −608 | |
| 217870_s_at | −2.52 | −607 | |
| 218557_at | −2.52 | −606 | |
| 209177_at | −2.52 | −605 | |
| 202868_s_at | −2.52 | −604 | |
| 209472_at | −2.52 | −603 | |
| 214243_s_at | −2.52 | −602 | |
| 218681_s_at | −2.52 | −601 | |
| 217755_at | −2.53 | −600 | |
| 221587_s_at | −2.53 | −599 | |
| 220945_x_at | −2.53 | −598 | |
| 211070_x_at | −2.53 | −597 | |
| 216958_s_at | −2.53 | −596 | |
| 213399_x_at | −2.53 | −595 | |
| 209228_x_at | −2.53 | −594 | |
| 201077_s_at | −2.53 | −593 | |
| 218434_s_at | −2.53 | −592 | |
| 218795_at | −2.54 | −591 | |
| 202769_at | −2.54 | −590 | |
| 201219_at | −2.54 | −589 | |
| 200925_at | −2.54 | −588 | |
| 211596_s_at | −2.54 | −587 | |
| 208650_s_at | −2.54 | −586 | |
| 221570_s_at | −2.54 | −585 | |
| 202343_x_at | −2.54 | −584 | |
| 202758_s_at | −2.54 | −583 | |
| 212508_at | −2.54 | −582 | |
| 204246_s_at | −2.54 | −581 | |
| 217973_at | −2.55 | −580 | |
| 216532_x_at | −2.55 | −579 | |
| 201705_at | −2.55 | −578 | |
| 221939_at | −2.55 | −577 | |
| 222075_s_at | −2.55 | −576 | |
| 219203_at | −2.55 | −575 | |
| 215091_s_at | −2.56 | −574 | |
| 209696_at | −2.56 | −573 | |
| 217875_s_at | −2.56 | −572 | |
| 217976_s_at | −2.56 | −571 | |
| 212449_s_at | −2.56 | −570 | |
| 201003_x_at | −2.56 | −569 | |
| 200078_s_at | −2.57 | −568 | |
| 202166_s_at | −2.57 | −567 | |
| 203007_x_at | −2.57 | −566 | |
| 202697_at | −2.57 | −565 | |
| 221434_s_at | −2.57 | −564 | |
| 215947_s_at | −2.57 | −563 | |
| 200819_s_at | −2.57 | −562 | |
| 209364_at | −2.57 | −561 | |
| 218685_s_at | −2.57 | −560 | |
| 204168_at | −2.58 | −559 | |
| 203041_s_at | −2.58 | −558 | |
| 209389_x_at | −2.58 | −557 | |
| 208930_s_at | −2.58 | −556 | |
| 203351_s_at | −2.58 | −555 | |
| 209171_at | −2.58 | −554 | |
| 201698_s_at | −2.58 | −553 | |
| 206066_s_at | −2.58 | −552 | |
| 213828_x_at | −2.59 | −551 | |
| 214522_x_at | −2.59 | −550 | |
| 203360_s_at | −2.59 | −549 | |
| 206491_s_at | −2.59 | −548 | |
| 219176_at | −2.59 | −547 | |
| 212833_at | −2.59 | −546 | |
| 201625_s_at | −2.59 | −545 | |
| 204922_at | −2.59 | −544 | |
| 207088_s_at | −2.59 | −543 | |
| 207707_s_at | −2.59 | −542 | |
| 209625_at | −2.59 | −541 | |
| 202121_s_at | −2.59 | −540 | |
| 221041_s_at | −2.6 | −539 | |
| 210387_at | −2.6 | −538 | |
| 218095_s_at | −2.6 | −537 | D |
| 215726_s_at | −2.6 | −536 | |
| 204170_s_at | −2.6 | −535 | |
| 201624_at | −2.6 | −534 | |
| 213716_s_at | −2.6 | −533 | |
| 206469_x_at | −2.6 | −532 | |
| 205542_at | −2.6 | −531 | |
| 217800_s_at | −2.6 | −530 | |
| 208932_at | −2.6 | −529 | |
| 200777_s_at | −2.6 | −528 | |
| 201273_s_at | −2.61 | −527 | |
| 203646_at | −2.61 | −526 | |
| 208788_at | −2.61 | −525 | |
| 41047_at | −2.61 | −524 | |
| 220547_s_at | −2.61 | −523 | |
| 201900_s_at | −2.61 | −522 | |
| 212204_at | −2.61 | −521 | |
| 212006_at | −2.61 | −520 | |
| 217752_s_at | −2.61 | −519 | |
| 221637_s_at | −2.61 | −518 | |
| 210927_x_at | −2.61 | −517 | |
| 209014_at | −2.61 | −516 | |
| 217850_at | −2.61 | −515 | |
| 202545_at | −2.61 | −514 | |
| 209407_s_at | −2.61 | −513 | |
| 203030_s_at | −2.61 | −512 | |
| 214765_s_at | −2.62 | −511 | |
| 204427_s_at | −2.62 | −510 | |
| 204050_s_at | −2.62 | −509 | |
| 214542_x_at | −2.62 | −508 | |
| 203511_s_at | −2.63 | −507 | |
| 209694_at | −2.63 | −506 | |
| 209482_at | −2.63 | −505 | |
| 217770_at | −2.63 | −504 | |
| 205597_at | −2.63 | −503 | |
| 200790_at | −2.63 | −502 | |
| 220334_at | −2.63 | −501 | |
| 201095_at | −2.64 | −500 | |
| 208651_x_at | −2.64 | −499 | D |
| 205449_at | −2.64 | −498 | |
| 209100_at | −2.64 | −497 | |
| 216088_s_at | −2.64 | −496 | |
| 201114_x_at | −2.64 | −495 | |
| 210541_s_at | −2.65 | −494 | |
| 213892_s_at | −2.65 | −493 | |
| 202737_s_at | −2.65 | −492 | |
| 218341_at | −2.65 | −491 | D |
| 210024_s_at | −2.65 | −490 | |
| 201177_s_at | −2.65 | −489 | |
| 220587_s_at | −2.65 | −488 | |
| 213971_s_at | −2.65 | −487 | |
| 213738_s_at | −2.66 | −486 | |
| 212246_at | −2.66 | −485 | |
| 216230_x_at | −2.66 | −484 | |
| 203857_s_at | −2.66 | −483 | |
| 212191_x_at | −2.66 | −482 | |
| 202890_at | −2.66 | −481 | |
| 209217_s_at | −2.66 | −480 | |
| 202433_at | −2.66 | −479 | |
| 201600_at | −2.66 | −478 | |
| 209340_at | −2.67 | −477 | |
| 208024_s_at | −2.67 | −476 | |
| 202993_at | −2.67 | −475 | |
| 200852_x_at | −2.67 | −474 | |
| 204212_at | −2.67 | −473 | |
| 203667_at | −2.67 | −472 | |
| 213175_s_at | −2.68 | −471 | |
| 211423_s_at | −2.68 | −470 | |
| 213735_s_at | −2.68 | −469 | |
| 209808_x_at | −2.68 | −468 | |
| 218283_at | −2.68 | −467 | |

TABLE 10-continued

Top genes identified as up- and down-regulated in prostate stroma of relapse patients, calculated by linear regression, including all samples with prostate cancer. (negative numbers for down-regulated. −1 is best)

| Affymetrix number | T statistic | Rank | |
|---|---|---|---|
| 203272_s_at | −2.68 | −466 | |
| 202139_at | −2.69 | −465 | |
| 220192_x_at | −2.69 | −464 | |
| 217861_s_at | −2.69 | −463 | |
| 217868_s_at | −2.69 | −462 | |
| 200960_x_at | −2.69 | −461 | |
| 202927_at | −2.69 | −460 | |
| 219075_at | −2.69 | −459 | |
| 203791_at | −2.69 | −458 | |
| 218074_at | −2.69 | −457 | |
| 218320_s_at | −2.69 | −456 | |
| 200903_s_at | −2.7 | −455 | |
| 222256_s_at | −2.7 | −454 | |
| 200710_at | −2.7 | −453 | |
| 201019_s_at | −2.71 | −452 | |
| 218548_x_at | −2.71 | −451 | |
| 217942_at | −2.71 | −450 | |
| 209911_x_at | −2.71 | −449 | |
| 1729_at | −2.71 | −448 | |
| 213726_x_at | −2.71 | −447 | |
| 203478_at | −2.71 | −446 | |
| 212767_at | −2.72 | −445 | |
| 217898_at | −2.72 | −444 | |
| 213133_s_at | −2.72 | −443 | |
| 218789_s_at | −2.72 | −442 | |
| 221566_s_at | −2.72 | −441 | |
| 202122_s_at | −2.72 | −440 | |
| 207063_at | −2.72 | −439 | |
| 203954_x_at | −2.72 | −438 | |
| 209080_x_at | −2.72 | −437 | |
| 202942_at | −2.72 | −436 | |
| 209797_at | −2.73 | −435 | |
| 212255_s_at | −2.73 | −434 | |
| 213581_at | −2.73 | −433 | |
| 212680_x_at | −2.73 | −432 | |
| 216905_s_at | −2.73 | −431 | |
| 218732_at | −2.73 | −430 | |
| 209478_at | −2.73 | −429 | |
| 218216_x_at | −2.74 | −428 | |
| 202457_s_at | −2.74 | −427 | |
| 205780_at | −2.74 | −426 | |
| 203034_s_at | −2.74 | −425 | |
| 209063_x_at | −2.74 | −424 | |
| 217761_at | −2.74 | −423 | D |
| 208864_s_at | −2.74 | −422 | |
| 201963_at | −2.75 | −421 | |
| 201543_s_at | −2.75 | −420 | |
| 201619_at | −2.75 | −419 | |
| 209076_s_at | −2.75 | −418 | |
| 202308_at | −2.75 | −417 | |
| 211404_s_at | −2.75 | −416 | |
| 204340_at | −2.75 | −415 | |
| 220980_s_at | −2.76 | −414 | |
| 215952_s_at | −2.76 | −413 | |
| 201791_s_at | −2.76 | −412 | |
| 216308_x_at | −2.76 | −411 | |
| 204231_s_at | −2.76 | −410 | |
| 213061_s_at | −2.76 | −409 | |
| 218652_s_at | −2.76 | −408 | |
| 206656_s_at | −2.76 | −407 | |
| 213190_at | −2.76 | −406 | |
| 201923_at | −2.76 | −405 | |
| 209605_at | −2.76 | −404 | |
| 218192_at | −2.76 | −403 | |
| 218872_at | −2.76 | −402 | |
| 209114_at | −2.76 | −401 | D |
| 218447_at | −2.77 | −400 | |
| 202839_s_at | −2.77 | −399 | |
| 207431_s_at | −2.77 | −398 | |
| 214274_s_at | −2.77 | −397 | |
| 215631_s_at | −2.77 | −396 | |
| 204608_at | −2.77 | −395 | |
| 216483_s_at | −2.77 | −394 | |
| 218533_s_at | −2.77 | −393 | |
| 221437_s_at | −2.77 | −392 | |
| 208653_s_at | −2.78 | −391 | |
| 217956_s_at | −2.78 | −390 | |
| 211558_s_at | −2.78 | −389 | |
| 204084_s_at | −2.78 | −388 | D |
| 209825_s_at | −2.78 | −387 | |
| 209130_at | −2.78 | −386 | |
| 204160_s_at | −2.78 | −385 | |
| 204017_at | −2.78 | −384 | |
| 217930_s_at | −2.78 | −383 | |
| 207168_s_at | −2.78 | −382 | |
| 202525_at | −2.78 | −381 | |
| 204985_s_at | −2.78 | −380 | |
| 214112_s_at | −2.79 | −379 | |
| 215779_s_at | −2.79 | −378 | D |
| 218086_at | −2.79 | −377 | |
| 214882_s_at | −2.79 | −376 | |
| 214092_x_at | −2.79 | −375 | |
| 219117_s_at | −2.79 | −374 | |
| 202406_s_at | −2.79 | −373 | |
| 203373_at | −2.79 | −372 | |
| 217720_at | −2.79 | −371 | |
| 210825_s_at | −2.79 | −370 | |
| 218203_at | −2.79 | −369 | D |
| 202477_s_at | −2.8 | −368 | |
| 221512_at | −2.8 | −367 | |
| 201338_x_at | −2.8 | −366 | |
| 212116_at | −2.8 | −365 | |
| 206352_s_at | −2.8 | −364 | |
| 201066_at | −2.8 | −363 | |
| 206302_s_at | −2.81 | −362 | |
| 201740_at | −2.81 | −361 | |
| 201284_s_at | −2.81 | −360 | |
| 200805_at | −2.81 | −359 | |
| 204387_x_at | −2.81 | −358 | |
| 202130_at | −2.81 | −357 | |
| 204295_at | −2.82 | −356 | |
| 202708_s_at | −2.82 | −355 | |
| 202428_x_at | −2.82 | −354 | |
| 214107_x_at | −2.82 | −353 | |
| 217803_at | −2.82 | −352 | |
| 205329_s_at | −2.82 | −351 | |
| 204616_at | −2.82 | −350 | |
| 207721_x_at | −2.83 | −349 | |
| 200598_s_at | −2.83 | −348 | |
| 202429_s_at | −2.83 | −347 | |
| 211052_s_at | −2.83 | −346 | |
| 214214_s_at | −2.83 | −345 | D |
| 209132_s_at | −2.83 | −344 | |
| 213246_at | −2.84 | −343 | |
| 219920_s_at | −2.84 | −342 | |
| 203931_s_at | −2.84 | −341 | |
| 204934_s_at | −2.84 | −340 | |
| 209213_at | −2.84 | −339 | D |
| 221567_at | −2.84 | −338 | |
| 200620_at | −2.85 | −337 | |
| 201033_s_at | −2.85 | −336 | |
| 208826_x_at | −2.85 | −335 | |
| 204386_s_at | −2.85 | −334 | |
| 219061_s_at | −2.85 | −333 | |
| 203042_at | −2.85 | −332 | |
| 214455_at | −2.85 | −331 | D |
| 201745_at | −2.85 | −330 | |
| 212032_s_at | −2.85 | −329 | |
| 74694_s_at | −2.85 | −328 | |
| 201411_s_at | −2.86 | −327 | |
| 213152_s_at | −2.86 | −326 | |
| 209222_s_at | −2.86 | −325 | |
| 205353_s_at | −2.86 | −324 | |
| 213026_at | −2.86 | −323 | |

TABLE 10-continued

Top genes identified as up- and down-regulated in prostate stroma of relapse patients, calculated by linear regression, including all samples with prostate cancer. (negative numbers for down-regulated. −1 is best)

| Affymetrix number | T statistic | Rank | |
|---|---|---|---|
| 205164_at | −2.87 | −322 | |
| 212773_s_at | −2.87 | −321 | |
| 214875_x_at | −2.87 | −320 | |
| 204078_at | −2.87 | −319 | |
| 203192_at | −2.87 | −318 | |
| 210638_s_at | −2.87 | −317 | |
| 214257_s_at | −2.87 | −316 | |
| 211177_s_at | −2.87 | −315 | |
| 200969_at | −2.87 | −314 | |
| 222191_s_at | −2.88 | −313 | |
| 201612_at | −2.88 | −312 | |
| 218897_at | −2.88 | −311 | |
| 210059_s_at | −2.88 | −310 | |
| 210187_at | −2.88 | −309 | |
| 208405_s_at | −2.89 | −308 | |
| 218132_s_at | −2.89 | −307 | |
| 202138_x_at | −2.89 | −306 | |
| 207508_at | −2.9 | −305 | |
| 219929_s_at | −2.9 | −304 | |
| 218671_s_at | −2.9 | −303 | |
| 207275_s_at | −2.9 | −302 | |
| 220607_x_at | −2.9 | −301 | |
| 202836_s_at | −2.9 | −300 | |
| 205498_at | −2.9 | −299 | D |
| 213379_at | −2.91 | −298 | |
| 201714_at | −2.91 | −297 | |
| 218555_at | −2.91 | −296 | |
| 218327_s_at | −2.91 | −295 | |
| 203031_s_at | −2.92 | −294 | |
| 203892_at | −2.92 | −293 | |
| 221972_s_at | −2.92 | −292 | |
| 218101_s_at | −2.92 | −291 | |
| 221582_at | −2.92 | −290 | |
| 208918_s_at | −2.92 | −289 | |
| 209113_s_at | −2.92 | −288 | |
| 200740_s_at | −2.92 | −287 | |
| 211475_s_at | −2.93 | −286 | |
| 208941_s_at | −2.93 | −285 | |
| 205241_at | −2.93 | −284 | |
| 210633_x_at | −2.93 | −283 | |
| 218636_s_at | −2.93 | −282 | |
| 212790_x_at | −2.93 | −281 | |
| 59625_at | −2.93 | −280 | |
| 218996_at | −2.93 | −279 | |
| 218150_at | −2.93 | −278 | |
| 200863_s_at | −2.93 | −277 | |
| 205133_s_at | −2.93 | −276 | |
| 203437_at | −2.94 | −275 | |
| 209844_at | −2.94 | −274 | |
| 210041_s_at | −2.94 | −273 | |
| 219575_s_at | −2.94 | −272 | |
| 203524_s_at | −2.94 | −271 | |
| 213129_s_at | −2.94 | −270 | |
| 203219_s_at | −2.94 | −269 | |
| 215090_x_at | −2.94 | −268 | |
| 208817_at | −2.95 | −267 | |
| 217835_x_at | −2.95 | −266 | |
| 218220_at | −2.95 | −265 | |
| 202550_s_at | −2.95 | −264 | |
| 210097_s_at | −2.96 | −263 | |
| 201135_at | −2.96 | −262 | |
| 219807_x_at | −2.96 | −261 | |
| 213287_s_at | −2.96 | −260 | |
| 218046_s_at | −2.96 | −259 | |
| 58696_at | −2.96 | −258 | |
| 219119_at | −2.96 | −257 | |
| 40225_at | −2.96 | −256 | |
| 217824_at | −2.96 | −255 | |
| 221610_s_at | −2.96 | −254 | |
| 211730_s_at | −2.96 | −253 | |
| 222138_s_at | −2.96 | −252 | |
| 219806_s_at | −2.96 | −251 | |
| 201913_s_at | −2.97 | −250 | |
| 208818_s_at | −2.97 | −249 | |
| 217080_s_at | −2.97 | −248 | |
| 209759_s_at | −2.97 | −247 | |
| 49679_s_at | −2.97 | −246 | |
| 202632_at | −2.97 | −245 | |
| 219065_s_at | −2.97 | −244 | |
| 213423_x_at | −2.97 | −243 | |
| 219283_at | −2.97 | −242 | |
| 36936_at | −2.98 | −241 | |
| 203686_at | −2.98 | −240 | |
| 221847_at | −2.98 | −239 | D |
| 205489_at | −2.98 | −238 | |
| 202857_at | −2.98 | −237 | |
| 201955_at | −2.98 | −236 | |
| 218272_at | −2.98 | −235 | |
| 65884_at | −2.99 | −234 | |
| 204599_s_at | −2.99 | −233 | |
| 220597_s_at | −3 | −232 | |
| 202424_at | −3 | −231 | |
| 221688_s_at | −3 | −230 | |
| 202077_at | −3.01 | −229 | |
| 208658_at | −3.01 | −228 | |
| 218328_at | −3.01 | −227 | |
| 205110_s_at | −3.02 | −226 | |
| 219862_s_at | −3.02 | −225 | |
| 222125_s_at | −3.02 | −224 | |
| 218647_s_at | −3.02 | −223 | |
| 203594_at | −3.02 | −222 | |
| 206055_s_at | −3.02 | −221 | |
| 201903_at | −3.02 | −220 | |
| 218582_at | −3.02 | −219 | |
| 208722_s_at | −3.03 | −218 | |
| 201128_s_at | −3.03 | −217 | |
| 217772_s_at | −3.04 | −216 | |
| 204238_s_at | −3.04 | −215 | |
| 211940_x_at | −3.04 | −214 | |
| 209796_s_at | −3.04 | −213 | |
| 218206_x_at | −3.04 | −212 | |
| 220526_s_at | −3.04 | −211 | |
| 201588_at | −3.05 | −210 | |
| 218436_at | −3.05 | −209 | |
| 220161_s_at | −3.05 | −208 | |
| 203397_s_at | −3.05 | −207 | |
| 203228_at | −3.05 | −206 | |
| 201490_s_at | −3.05 | −205 | |
| 219015_s_at | −3.06 | −204 | |
| 202838_at | −3.06 | −203 | |
| 51200_at | −3.06 | −202 | |
| 202718_at | −3.07 | −201 | |
| 215111_s_at | −3.07 | −200 | |
| 203606_at | −3.07 | −199 | |
| 209309_at | −3.08 | −198 | |
| 203189_s_at | −3.08 | −197 | |
| 217014_s_at | −3.08 | −196 | |
| 202154_x_at | −3.09 | −195 | |
| 201016_at | −3.09 | −194 | |
| 203190_at | −3.09 | −193 | |
| 218123_at | −3.09 | −192 | |
| 220966_x_at | −3.09 | −191 | |
| 209398_at | −3.1 | −190 | |
| 212411_at | −3.1 | −189 | |
| 202096_s_at | −3.1 | −188 | |
| 209104_s_at | −3.1 | −187 | |
| 212085_at | −3.1 | −186 | |
| 208837_at | −3.1 | −185 | |
| 217812_at | −3.1 | −184 | |
| 208929_x_at | −3.1 | −183 | |
| 204360_s_at | −3.11 | −182 | |
| 208856_x_at | −3.11 | −181 | |
| 213902_at | −3.11 | −180 | |
| 208654_s_at | −3.11 | −179 | |

TABLE 10-continued

Top genes identified as up- and down-regulated in prostate stroma of relapse patients, calculated by linear regression, including all samples with prostate cancer. (negative numbers for down-regulated. −1 is best)

| Affymetrix number | T statistic | Rank | |
|---|---|---|---|
| 211936_at | −3.12 | −178 | |
| 221255_s_at | −3.12 | −177 | |
| 212347_x_at | −3.12 | −176 | |
| 209391_at | −3.13 | −175 | |
| 203136_at | −3.13 | −174 | |
| 208821_at | −3.13 | −173 | |
| 216338_s_at | −3.13 | −172 | |
| 218188_s_at | −3.13 | −171 | |
| 221844_x_at | −3.14 | −170 | |
| 201192_s_at | −3.14 | −169 | |
| 208910_s_at | −3.14 | −168 | |
| 206303_s_at | −3.14 | −167 | |
| 213062_at | −3.14 | −166 | |
| 200970_s_at | −3.15 | −165 | |
| 216449_x_at | −3.15 | −164 | |
| 208783_s_at | −3.15 | −163 | |
| 202655_at | −3.15 | −162 | |
| 218358_at | −3.16 | −161 | |
| 221827_at | −3.16 | −160 | |
| 200700_s_at | −3.17 | −159 | |
| 210312_s_at | −3.17 | −158 | |
| 213041_s_at | −3.17 | −157 | |
| 218531_at | −3.18 | −156 | |
| 213285_at | −3.18 | −155 | |
| 215071_s_at | −3.19 | −154 | |
| 202286_s_at | −3.19 | −153 | |
| 214469_at | −3.2 | −152 | |
| 220757_s_at | −3.2 | −151 | |
| 218258_at | −3.2 | −150 | |
| 220934_s_at | −3.2 | −149 | |
| 218961_s_at | −3.21 | −148 | |
| 209161_at | −3.22 | −147 | |
| 202168_at | −3.22 | −146 | |
| 208546_x_at | −3.22 | −145 | |
| 208415_x_at | −3.22 | −144 | |
| 208977_x_at | −3.22 | −143 | |
| 201825_s_at | −3.22 | −142 | |
| 218194_at | −3.22 | −141 | |
| 201358_s_at | −3.23 | −140 | |
| 210010_s_at | −3.23 | −139 | |
| 200098_s_at | −3.23 | −138 | |
| 217927_at | −3.24 | −137 | |
| 220741_s_at | −3.24 | −136 | |
| 201119_s_at | −3.24 | −135 | |
| 218552_at | −3.24 | −134 | |
| 208750_at | −3.24 | −133 | |
| 208583_x_at | −3.24 | −132 | |
| 218112_at | −3.25 | −131 | |
| 219762_s_at | −3.25 | −130 | |
| 218962_s_at | −3.25 | −129 | |
| 210719_s_at | −3.25 | −128 | |
| 219118_at | −3.25 | −127 | |
| 203133_at | −3.26 | −126 | |
| 202812_at | −3.26 | −125 | |
| 209302_at | −3.26 | −124 | |
| 202740_at | −3.26 | −123 | |
| 214531_s_at | −3.27 | −122 | |
| 205470_s_at | −3.28 | −121 | D |
| 212685_s_at | −3.28 | −120 | |
| 200654_at | −3.28 | −119 | |
| 219049_at | −3.28 | −118 | |
| 221732_at | −3.29 | −117 | |
| 203517_at | −3.29 | −116 | |
| 201096_s_at | −3.29 | −115 | |
| 213931_at | −3.29 | −114 | D |
| 208751_at | −3.3 | −113 | |
| 203647_at | −3.3 | −112 | |
| 202788_at | −3.31 | −111 | |
| 208923_at | −3.31 | −110 | |
| 218921_at | −3.33 | −109 | |
| 218580_x_at | −3.33 | −108 | |
| 209665_at | −3.34 | −107 | |
| 205347_s_at | −3.34 | −106 | |
| 200022_at | −3.34 | −105 | |
| 217979_at | −3.35 | −104 | |
| 202109_at | −3.36 | −103 | |
| 218313_s_at | −3.37 | −102 | |
| 208909_at | −3.37 | −101 | |
| 201268_at | −3.38 | −100 | |
| 213988_s_at | −3.38 | −99 | D |
| 207157_s_at | −3.38 | −98 | |
| 204331_s_at | −3.39 | −97 | |
| 209404_s_at | −3.39 | −96 | |
| 209806_at | −3.39 | −95 | |
| 204175_at | −3.4 | −94 | |
| 201359_at | −3.4 | −93 | |
| 220094_s_at | −3.41 | −92 | |
| 213315_x_at | −3.41 | −91 | |
| 218070_s_at | −3.41 | −90 | |
| 210386_s_at | −3.42 | −89 | |
| 208726_s_at | −3.43 | −88 | |
| 202941_at | −3.43 | −87 | |
| 213897_s_at | −3.45 | −86 | |
| 204862_s_at | −3.45 | −85 | |
| 200093_s_at | −3.45 | −84 | D |
| 209123_at | −3.45 | −83 | |
| 202427_s_at | −3.46 | −82 | D |
| 203582_s_at | −3.46 | −81 | |
| 204088_at | −3.46 | −80 | |
| 220495_s_at | −3.46 | −79 | |
| 210592_s_at | −3.48 | −78 | |
| 208734_x_at | −3.49 | −77 | |
| 46323_at | −3.49 | −76 | D |
| 211574_s_at | −3.49 | −75 | |
| 210667_s_at | −3.49 | −74 | |
| 217940_s_at | −3.49 | −73 | |
| 200044_at | −3.5 | −72 | |
| 201704_at | −3.5 | −71 | |
| 204034_at | −3.51 | −70 | |
| 212527_at | −3.51 | −69 | |
| 208490_x_at | −3.51 | −68 | |
| 203415_at | −3.51 | −67 | |
| 202297_s_at | −3.52 | −66 | |
| 200820_at | −3.52 | −65 | |
| 52940_at | −3.52 | −64 | |
| 201758_at | −3.53 | −63 | |
| 209420_s_at | −3.53 | −62 | |
| 201944_at | −3.53 | −61 | |
| 212739_s_at | −3.53 | −60 | |
| 201489_at | −3.53 | −59 | |
| 218387_s_at | −3.54 | −58 | |
| 222209_s_at | −3.55 | −57 | |
| 200670_at | −3.56 | −56 | |
| 203372_s_at | −3.57 | −55 | |
| 202418_at | −3.59 | −54 | |
| 36554_at | −3.59 | −53 | |
| 210434_x_at | −3.59 | −52 | |
| 202996_at | −3.6 | −51 | |
| 212961_x_at | −3.66 | −50 | |
| 218898_at | −3.66 | −49 | |
| 218388_at | −3.68 | −48 | |
| 207805_s_at | −3.68 | −47 | |
| 202120_x_at | −3.69 | −46 | |
| 217995_at | −3.7 | −45 | D |
| 208579_x_at | −3.7 | −44 | |
| 208074_s_at | −3.7 | −43 | |
| 200681_at | −3.73 | −42 | |
| 201849_at | −3.73 | −41 | D |
| 200656_at | −3.73 | −40 | D |
| 209149_s_at | −3.74 | −39 | |
| 202475_at | −3.76 | −38 | |
| 208527_x_at | −3.77 | −37 | |
| 204319_s_at | −3.78 | −36 | D |
| 205593_s_at | −3.78 | −35 | |

TABLE 10-continued

Top genes identified as up- and down-regulated in prostate stroma of relapse patients, calculated by linear regression, including all samples with prostate cancer. (negative numbers for down-regulated. −1 is best)

| Affymetrix number | T statistic | Rank | |
|---|---|---|---|
| 219188_s_at | −3.78 | −34 | |
| 203430_at | −3.78 | −33 | |
| 200075_s_at | −3.78 | −32 | D |
| 207023_x_at | −3.79 | −31 | |
| 216295_s_at | −3.81 | −30 | |
| 204392_at | −3.82 | −29 | |
| 222067_x_at | −3.82 | −28 | |
| 200048_s_at | −3.84 | −27 | D |
| 200971_s_at | −3.87 | −26 | |
| 217744_s_at | −3.89 | −25 | |
| 200065_s_at | −3.9 | −24 | |
| 211047_x_at | −3.92 | −23 | |
| 201410_at | −3.93 | −22 | |
| 201201_at | −3.95 | −21 | |
| 218280_x_at | −3.95 | −20 | |
| 214290_s_at | −3.97 | −19 | D |
| 201848_s_at | −4 | −18 | |
| 207549_x_at | −4.02 | −17 | D |
| 201264_at | −4.05 | −16 | D |
| 202929_s_at | −4.07 | −15 | D |
| 200846_s_at | −4.09 | −14 | D |
| 201953_at | −4.09 | −13 | |
| 212280_x_at | −4.09 | −12 | |
| 202041_s_at | −4.1 | −11 | |
| 218592_s_at | −4.2 | −10 | |
| 201079_at | 4.24 | −9 | D |
| 213166_x_at | −4.25 | −8 | |
| 202671_s_at | −4.28 | −7 | |
| 204903_x_at | −4.43 | −6 | |
| 203663_s_at | −4.49 | −5 | D |
| 212995_x_at | −4.67 | −4 | D |
| 217871_s_at | −4.97 | −3 | D |
| 201106_at | −5.02 | −2 | |
| 202296_s_at | −5.11 | −1 | D |

TABLE 11

43 gene classifier for relapse of prostate cancer

| Affymetrix number | |
|---|---|
| 210986_s_at | |
| 201022_s_at | |
| 200795_at | |
| 202274_at | |
| 218509_at | D |
| 201497_x_at | |
| 220587_s_at | |
| 201891_s_at | |
| 209074_s_at | D |
| 200897_s_at | |
| 202296_s_at | D |
| 202432_at | |
| 201106_at | |
| 221667_s_at | |
| 217871_s_at | D |
| 208579_x_at | |
| 200974_at | |
| 201431_s_at | |
| 221958_s_at | |
| 209288_s_at | |
| 203951_at | |
| 216231_s_at | |
| 201540_at | |
| 207430_s_at | D |
| 207480_s_at | |
| 202994_s_at | |

TABLE 11-continued 43 gene classifier for relapse of prostate cancer

| Affymetrix number | |
|---|---|
| 212995_x_at | D |
| 209763_at | |
| 217897_at | D |
| 202228_s_at | |
| 209948_at | D |
| 218418_s_at | |
| 212077_at | |
| 205011_at | |
| 209286_at | |
| 208490_x_at | |
| 209806_at | |
| 208527_x_at | |
| 202555_s_at | |
| 208676_s_at | D |
| 210987_x_at | |
| 203663_s_at | D |
| 202350_s_at | |

TABLE 12

Top 144 genes identified as down-regulated in prostate stroma cells of relapse patients, calculated by linear regression, including only samples from regions of the prostate that did not have detectable tumor cells

| Affymetrix number | T statistic | Rank | |
|---|---|---|---|
| 211047_x_at | −5.79 | 1 | |
| 201106_at | −5.18 | 2 | |
| 208074_s_at | −5.05 | 3 | |
| 202120_x_at | −4.82 | 4 | |
| 212280_x_at | −4.68 | 5 | |
| 202296_s_at | −4.45 | 6 | D |
| 211404_s_at | −4.37 | 7 | |
| 201201_at | −4.34 | 8 | |
| 208923_at | −4.26 | 9 | |
| 204903_x_at | −4.21 | 10 | |
| 210010_s_at | −4.08 | 11 | |
| 208929_x_at | −3.96 | 12 | |
| 52940_at | −3.93 | 13 | |
| 202041_s_at | −3.9 | 14 | |
| 210719_s_at | −3.89 | 15 | |
| 212995_x_at | −3.87 | 16 | D |
| 202671_s_at | −3.85 | 17 | |
| 218552_at | −3.83 | 18 | |
| 217930_s_at | −3.8 | 19 | |
| 203663_s_at | −3.79 | 20 | D |
| 200075_s_at | −3.76 | 21 | D |
| 217744_s_at | −3.73 | 22 | |
| 207023_x_at | −3.72 | 23 | |
| 201848_s_at | −3.69 | 24 | |
| 208726_s_at | −3.69 | 25 | |
| 218388_at | −3.68 | 26 | |
| 212961_x_at | −3.67 | 27 | |
| 200656_s_at | −3.66 | 28 | D |
| 217871_s_at | −3.66 | 29 | D |
| 220757_s_at | −3.63 | 30 | |
| 213624_at | −3.61 | 31 | |
| 202096_s_at | −3.6 | 32 | |
| 209113_s_at | −3.6 | 33 | |
| 221972_s_at | −3.59 | 34 | |
| 221566_s_at | −3.59 | 35 | |
| 202929_s_at | −3.59 | 36 | D |
| 208702_x_at | −3.59 | 37 | |
| 201953_at | −3.57 | 38 | |
| 201119_s_at | −3.57 | 39 | |
| 202996_at | −3.57 | 40 | |
| 201520_s_at | −3.57 | 41 | |
| 219929_s_at | −3.54 | 42 | |

TABLE 12-continued

Top 144 genes identified as down-regulated in prostate stroma cells of relapse patients, calculated by linear regression, including only samples from regions of the prostate that did not have detectable tumor cells

| Affymetrix number | T statistic | Rank | |
|---|---|---|---|
| 214875_x_at | −3.54 | 43 | |
| 209420_s_at | −3.53 | 44 | |
| 201587_s_at | −3.5 | 45 | |
| 201489_at | −3.49 | 46 | |
| 213897_s_at | −3.47 | 47 | |
| 208751_at | −3.45 | 48 | |
| 203517_at | −3.45 | 49 | |
| 204360_s_at | −3.43 | 50 | |
| 201490_s_at | −3.42 | 51 | |
| 201264_at | −3.42 | 52 | D |
| 214882_s_at | −3.41 | 53 | |
| 208669_s_at | −3.4 | 54 | |
| 213931_at | −3.39 | 55 | D |
| 219119_at | −3.37 | 56 | |
| 36554_at | −3.37 | 57 | |
| 202424_at | −3.36 | 58 | |
| 218387_s_at | −3.36 | 59 | |
| 217716_s_at | −3.35 | 60 | |
| 221567_at | −3.35 | 61 | |
| 210097_s_at | −3.33 | 62 | |
| 59625_at | −3.33 | 63 | |
| 207805_s_at | −3.33 | 64 | |
| 213166_x_at | −3.31 | 65 | |
| 212085_at | −3.3 | 66 | |
| 215952_s_at | −3.3 | 67 | |
| 218592_s_at | −3.3 | 68 | |
| 216308_x_at | −3.29 | 69 | |
| 213061_s_at | −3.29 | 70 | |
| 209472_at | −3.28 | 71 | |
| 202308_at | −3.28 | 72 | |
| 208909_at | −3.27 | 73 | |
| 208787_at | −3.27 | 74 | |
| 204238_s_at | −3.27 | 75 | |
| 207157_s_at | −3.27 | 76 | |
| 204981_at | −3.26 | 77 | |
| 209407_s_at | −3.26 | 78 | |
| 218921_at | −3.25 | 79 | |
| 208734_x_at | −3.25 | 80 | |
| 208928_at | −3.25 | 81 | |
| 40225_at | −3.24 | 82 | |
| 210386_s_at | −3.24 | 83 | |
| 220607_x_at | −3.23 | 84 | |
| 212347_x_at | −3.23 | 85 | |
| 217940_s_at | −3.23 | 86 | |
| 210667_s_at | −3.22 | 87 | |
| 200637_s_at | −3.22 | 88 | |
| 41047_at | −3.22 | 89 | |
| 201705_at | −3.21 | 90 | |
| 200022_at | −3.2 | 91 | |
| 209222_s_at | −3.2 | 92 | |
| 218070_s_at | −3.19 | 93 | |
| 212191_x_at | −3.19 | 94 | |
| 222191_s_at | −3.18 | 95 | |
| 203647_s_at | −3.18 | 96 | |
| 203571_s_at | −3.18 | 97 | |
| 200065_s_at | −3.17 | 98 | |
| 208750_s_at | −3.16 | 99 | |
| 201192_s_at | −3.16 | 100 | |
| 208024_s_at | −3.15 | 101 | |
| 204608_at | −3.15 | 102 | |
| 204034_at | −3.15 | 103 | |
| 209149_s_at | −3.14 | 104 | |
| 218150_at | −3.13 | 105 | |
| 201849_at | −3.13 | 106 | D |
| 218132_s_at | −3.13 | 107 | |
| 1729_at | −3.13 | 108 | |
| 203372_s_at | −3.11 | 109 | |
| 220597_s_at | −3.1 | 110 | |
| 209217_s_at | −3.1 | 111 | |
| 214274_s_at | −3.09 | 112 | |
| 218289_s_at | −3.09 | 113 | |
| 210130_s_at | −3.09 | 114 | |
| 209076_s_at | −3.09 | 115 | |
| 202812_at | −3.08 | 116 | |
| 202736_s_at | −3.08 | 117 | |
| 204392_at | −3.08 | 118 | |
| 203582_s_at | −3.07 | 119 | |
| 217912_at | −3.07 | 120 | |
| 201079_at | −3.07 | 121 | D |
| 201095_at | −3.07 | 122 | |
| 218652_s_at | −3.07 | 123 | |
| 208918_s_at | −3.06 | 124 | |
| 219188_s_at | −3.06 | 125 | |
| 51200_at | −3.06 | 126 | |
| 200710_at | −3.05 | 127 | |
| 213062_at | −3.05 | 128 | |
| 200846_s_at | −3.04 | 129 | D |
| 218188_s_at | −3.04 | 130 | |
| 213287_s_at | −3.04 | 131 | |
| 202737_s_at | −3.03 | 132 | |
| 212782_x_at | −3.03 | 133 | |
| 214494_s_at | −3.03 | 134 | |
| 221850_x_at | −3.03 | 135 | |
| 203430_at | −3.02 | 136 | |
| 204862_s_at | −3.02 | 137 | |
| 200654_at | −3.02 | 138 | |
| 200852_x_at | −3.02 | 139 | |
| 201704_at | −3.02 | 140 | |
| 217014_s_at | −3.01 | 141 | |
| 206469_x_at | −3 | 142 | |
| 202139_at | −3 | 143 | |
| 216862_s_at | −3 | 144 | |

TABLE 13

Top 100 genes identified as up-regulated in prostate stroma from patients that had relapsed, including only samples from regions of the prostate that did not have detectable tumor cells

| Affymetrix number | T statistic | Rank | |
|---|---|---|---|
| 204951_at | 4.73 | 1 | |
| 204795_at | 4.64 | 2 | |
| 51774_s_at | 4.54 | 3 | |
| 205456_at | 4.52 | 4 | |
| 211323_s_at | 4.51 | 5 | D |
| 201320_at | 4.28 | 6 | |
| 204436_at | 4.05 | 7 | |
| 205988_at | 3.98 | 8 | |
| 212076_at | 3.97 | 9 | |
| 218525_s_at | 3.94 | 10 | |
| 209671_x_at | 3.89 | 11 | |
| 211991_s_at | 3.73 | 12 | |
| 205405_at | 3.69 | 13 | |
| 58900_at | 3.66 | 14 | |
| 210038_at | 3.65 | 15 | |
| 211599_x_at | 3.59 | 16 | |
| 207834_at | 3.55 | 17 | |
| 204901_at | 3.53 | 18 | |
| 209616_s_at | 3.49 | 19 | D |
| 217187_at | 3.48 | 20 | |
| 219812_at | 3.47 | 21 | |
| 211123_at | 3.44 | 22 | |
| 209582_s_at | 3.42 | 23 | D |
| 211902_x_at | 3.42 | 24 | |
| 221486_at | 3.41 | 25 | |

TABLE 13-continued

Top 100 genes identified as up-regulated in prostate stroma from patients that had relapsed, including only samples from regions of the prostate that did not have detectable tumor cells

| Affymetrix number | T statistic | Rank | |
|---|---|---|---|
| 219035_s_at | 3.39 | 26 | |
| 210972_x_at | 3.38 | 27 | |
| 201080_at | 3.38 | 28 | |
| 219877_at | 3.37 | 29 | |
| 208598_s_at | 3.35 | 30 | |
| 209670_at | 3.35 | 31 | |
| 218581_at | 3.34 | 32 | |
| 210072_at | 3.33 | 33 | D |
| 215826_x_at | 3.33 | 34 | |
| 213193_x_at | 3.3 | 35 | |
| 202501_at | 3.3 | 36 | |
| 207648_at | 3.29 | 37 | |
| 204562_at | 3.29 | 38 | |
| 207691_x_at | 3.24 | 39 | |
| 64064_at | 3.23 | 40 | |
| 211203_at | 3.23 | 41 | |
| 214760_at | 3.22 | 42 | |
| 204341_at | 3.21 | 43 | D |
| 206053_at | 3.21 | 44 | |
| 202401_s_at | 3.21 | 45 | |
| 204852_s_at | 3.21 | 46 | |
| 200610_s_at | 3.21 | 47 | |
| 202964_s_at | 3.2 | 48 | |
| 205011_at | 3.19 | 49 | |
| 202809_s_at | 3.18 | 50 | |
| 38521_at | 3.18 | 51 | |
| 209062_x_at | 3.16 | 52 | |
| 211504_x_at | 3.16 | 53 | |
| 208306_x_at | 3.15 | 54 | |
| 217362_x_at | 3.15 | 55 | |
| 212151_at | 3.15 | 56 | |
| 212100_s_at | 3.14 | 57 | |
| 214738_s_at | 3.14 | 58 | |
| 202578_s_at | 3.14 | 59 | |
| 204882_at | 3.14 | 60 | |
| 204563_at | 3.13 | 61 | D |
| 213386_at | 3.13 | 62 | |
| 206105_at | 3.13 | 63 | |
| 211796_s_at | 3.13 | 64 | |
| 212713_at | 3.13 | 65 | D |
| 217418_x_at | 3.12 | 66 | |
| 204116_at | 3.11 | 67 | |
| 211710_x_at | 3.1 | 68 | |
| 204640_s_at | 3.1 | 69 | |
| 213370_s_at | 3.09 | 70 | |
| 214694_at | 3.08 | 71 | |
| 210444_at | 3.08 | 72 | |
| 218338_at | 3.08 | 73 | |
| 206767_at | 3.08 | 74 | |
| 209473_at | 3.08 | 75 | |
| 203157_s_at | 3.07 | 76 | |
| 200064_at | 3.07 | 77 | |
| 212972_x_at | 3.07 | 78 | |
| 215592_at | 3.06 | 79 | |
| 210915_x_at | 3.06 | 80 | |
| 205821_at | 3.05 | 81 | |
| 213831_at | 3.04 | 82 | |
| 214928_at | 3.04 | 83 | |
| 209057_x_at | 3.03 | 84 | D |
| 208459_s_at | 3.03 | 85 | |
| 213958_at | 3.02 | 86 | |
| 207547_s_at | 3 | 87 | |
| 215946_x_at | 2.99 | 88 | |
| 210356_x_at | 2.99 | 89 | |
| 214450_at | 2.99 | 90 | |
| 204229_at | 2.98 | 91 | |
| 200621_at | 2.98 | 92 | D |
| 208227_x_at | 2.97 | 93 | |
| 215762_at | 2.96 | 94 | |
| 38149_at | 2.96 | 95 | |
| 217925_s_at | 2.95 | 96 | |
| 215379_x_at | 2.95 | 97 | |
| 71933_at | 2.94 | 98 | |
| 211269_s_at | 2.93 | 99 | |
| 206180_x_at | 2.91 | 100 | |

TABLE 14

List of 35 (nonunique) genes associated with differential expression in aggressive prostate cancer found among the statistically differentially expressed genes of early relapse prostate cancer (cf. Tables 9 and 10).

| Set Name | 148_rs_btsg_regcoeff_tstats_nam_Name |
|---|---|
| 211323_s_at | inositol 1,4,5-triphosphate receptor, type 1 |
| 208579_x_at | histone 1, H2bk |
| 208490_x_at | histone 1, H2bf |
| 209806_at | histone 1, H2bk |
| 209844_at | homeo box B13 |
| 222067_x_at | histone 1, H2bd |
| 201893_x_at | decorin |
| 202401_s_at | serum response factor (c-fos serum response element-binding transcription factor) |
| 202525_at | protease, serine, 8 (prostasin) |
| 204934_s_at | hepsin (transmembrane protease, serine 1) |
| 207547_s_at | TU3A protein |
| 208527_x_at | histone 1, H2be |
| 218186_at | RAB25, member RAS oncogene family |
| 200621_at | cysteine and glycine-rich protein 1 |
| 208789_at | polymerase I and transcript release factor |
| 212713_at | microfibrillar-associated protein 4 |
| 205011_at | loss of heterozygosity, 11, chromosomal region 2, gene A |
| 208546_x_at | histone 1, H2bh |
| 209473_at | ectonucleoside triphosphate diphosphohydrolase 1 |
| 209696_at | fructose-1,6-bisphosphatase 1 |
| 221958_s_at | hypothetical protein FLJ23091 |
| 200953_s_at | cyclin D2 |
| 200852_x_at | guanine nucleotide binding protein (G protein), beta polypeptide 2 |
| 202074_s_at | optineurin |
| 206491_s_at | N-ethylmaleimide-sensitive factor attachment protein, alpha |
| 208751_at | N-ethylmaleimide-sensitive factor attachment protein, alpha |
| 204754_at | hepatic leukemia factor |
| 200795_at | SPARC-like 1 (mast9, hevin) |
| 200974_at | actin, alpha 2, smooth muscle, aorta |
| 202041_s_at | fibroblast growth factor (acidic) intracellular binding protein |
| 202501_at | microtubule-associated protein, RP/EB family, member 2 |
| 202545_at | protein kinase C, delta |
| 209297_at | intersectin 1 (SH3 domain protein) |
| 202758_s_at | regulatory factor X-associated ankyrin-containing protein |

TABLE 17

| probeID U133 | probeID U95A |
|---|---|
| AFFX-HUMGAPDH/M33197_M_at | 35905_s_at |
| AFFX-HUMGAPDH/M33197_5_at | 35905_s_at |
| AFFX-HUMGAPDH/M33197_3_at | 35905_s_at |
| AFFX-HSAC07/X00351_M_at | 32318_s_at |
| AFFX-HSAC07/X00351_M_at | AFFX-HSAC07/X00351_3_at |
| AFFX-HSAC07/X00351_M_at | AFFX-HSAC07/X00351_3_st |
| AFFX-HSAC07/X00351_M_at | AFFX-HSAC07/X00351_5_at |
| AFFX-HSAC07/X00351_M_at | AFFX-HSAC07/X00351_5_st |

TABLE 17-continued

| probeID U133 | probeID U95A |
|---|---|
| AFFX-HSAC07/X00351_M_at | AFFX-HSAC07/X00351_M_at |
| AFFX-HSAC07/X00351_5_at | 32318_s_at |
| AFFX-HSAC07/X00351_5_at | AFFX-HSAC07/X00351_3_at |
| AFFX-HSAC07/X00351_5_at | AFFX-HSAC07/X00351_3_st |
| AFFX-HSAC07/X00351_5_at | AFFX-HSAC07/X00351_5_at |
| AFFX-HSAC07/X00351_5_at | AFFX-HSAC07/X00351_5_st |
| AFFX-HSAC07/X00351_5_at | AFFX-HSAC07/X00351_M_at |
| AFFX-HSAC07/X00351_3_at | 32318_s_at |
| AFFX-HSAC07/X00351_3_at | AFFX-HSAC07/X00351_3_at |
| AFFX-HSAC07/X00351_3_at | AFFX-HSAC07/X00351_3_st |
| AFFX-HSAC07/X00351_3_at | AFFX-HSAC07/X00351_5_at |
| AFFX-HSAC07/X00351_3_at | AFFX-HSAC07/X00351_5_st |
| AFFX-HSAC07/X00351_3_at | AFFX-HSAC07/X00351_M_at |
| 39817_s_at | 39817_s_at |
| 39817_s_at | 39818_at |
| 38671_at | 38671_at |
| 37996_s_at | 37996_s_at |
| 37950_at | 37950_at |
| 37408_at | 37408_at |
| 37384_at | 37384_at |
| 37117_at | 37117_at |
| 37022_at | 37022_at |
| 37005_at | 37005_at |
| 35846_at | 35846_at |
| 33850_at | 242_at |
| 33850_at | 243_g_at |
| 33850_at | 32226_at |
| 33767_at | 33767_at |
| 33323_r_at | 33322_i_at |
| 33323_r_at | 33323_r_at |
| 33322_i_at | 33322_i_at |
| 33322_i_at | 33323_r_at |
| 32094_at | 32094_at |
| 243_g_at | 242_at |
| 243_g_at | 243_g_at |
| 243_g_at | 32226_at |
| 222221_x_at | 40098_at |
| 222067_x_at | 38576_at |
| 222043_at | 36780_at |
| 221922_at | 33185_at |
| 221881_s_at | 33891_at |
| 221872_at | 1042_at |
| 221730_at | 38420_at |
| 221729_at | 38420_at |
| 221586_s_at | 1044_s_at |
| 221586_s_at | 1639_s_at |
| 221584_s_at | 40737_at |
| 221564_at | 39348_at |
| 221475_s_at | 32432_f_at |
| 219514_at | 37573_at |
| 219140_s_at | 32552_at |
| 218924_s_at | 37855_at |
| 218831_s_at | 31431_at |
| 218831_s_at | 31432_g_at |
| 218820_at | 41837_at |
| 218215_s_at | 518_at |
| 217871_s_at | 895_at |
| 217826_s_at | 39039_s_at |
| 217826_s_at | 39040_at |
| 217764_s_at | 33371_s_at |
| 217764_s_at | 33372_at |
| 217763_s_at | 33371_s_at |
| 217763_s_at | 33372_at |
| 217762_s_at | 33371_s_at |
| 217762_s_at | 33372_at |
| 217741_s_at | 41542_at |
| 217691_x_at | 33143_s_at |
| 217487_x_at | 1739_at |
| 217487_x_at | 1740_g_at |
| 217437_s_at | 40841_at |
| 217398_x_at | 35905_s_at |
| 217066_s_at | 37996_s_at |
| 217014_s_at | 35834_at |
| 216944_s_at | 32778_at |
| 216944_s_at | 32779_s_at |
| 216944_s_at | 755_at |
| 216905_s_at | 35309_at |
| 216899_s_at | 36091_at |
| 216887_s_at | 34870_at |
| 216866_s_at | 34388_at |
| 216840_s_at | 36917_at |
| 216733_s_at | 36595_s_at |
| 216733_s_at | 36596_r_at |
| 216689_x_at | 39700_at |
| 216689_x_at | 552_at |
| 216689_x_at | 553_g_at |
| 216623_x_at | 37426_at |
| 216602_s_at | 34291_at |
| 216594_x_at | 32805_at |
| 216483_s_at | 38969_at |
| 216474_x_at | 32905_s_at |
| 216442_x_at | 311_s_at |
| 216442_x_at | 31719_at |
| 216442_x_at | 31720_s_at |
| 216438_s_at | 33421_s_at |
| 216397_s_at | 35615_at |
| 216331_at | 36892_at |
| 216251_s_at | 37648_at |
| 216236_s_at | 36979_at |
| 216235_s_at | 1507_s_at |
| 216230_x_at | 32574_at |
| 216230_x_at | 37371_at |
| 216215_s_at | 40260_g_at |
| 216205_s_at | 34369_at |
| 216111_x_at | 41258_at |
| 216100_s_at | 40832_s_at |
| 216100_s_at | 40833_r_at |
| 216074_x_at | 34213_at |
| 216033_s_at | 2039_s_at |
| 216033_s_at | 40480_s_at |
| 215990_s_at | 40091_at |
| 215779_s_at | 32819_at |
| 215711_s_at | 36909_at |
| 215707_s_at | 36159_s_at |
| 215706_x_at | 36958_at |
| 215606_s_at | 37869_at |
| 215537_x_at | 36131_at |
| 215537_x_at | 38621_at |
| 215493_x_at | 32673_at |
| 215485_s_at | 32640_at |
| 215471_s_at | 39732_at |
| 215464_s_at | 39416_at |
| 215438_x_at | 33932_at |
| 215382_x_at | 32905_s_at |
| 215333_x_at | 39054_at |
| 215300_s_at | 37874_at |
| 215222_x_at | 38704_at |
| 215193_x_at | 41723_s_at |
| 215108_x_at | 37426_at |
| 215051_x_at | 33641_g_at |
| 215016_x_at | 40304_at |
| 215000_s_at | 38651_at |
| 214909_s_at | 36131_at |
| 214909_s_at | 38621_at |
| 214894_x_at | 38704_at |
| 214889_at | 34423_at |
| 214875_x_at | 33944_at |
| 214789_x_at | 32038_s_at |
| 214774_x_at | 37426_at |
| 214771_x_at | 38730_at |
| 214761_at | 34950_at |
| 214752_x_at | 32749_s_at |
| 214752_x_at | 32750_r_at |
| 214726_x_at | 32145_at |
| 214643_x_at | 459_s_at |
| 214598_at | 33611_g_at |
| 214582_at | 35872_at |
| 214582_at | 746_at |
| 214577_at | 41373_s_at |
| 214543_x_at | 39759_at |
| 214543_x_at | 39760_at |
| 214508_x_at | 32065_at |
| 214508_x_at | 32066_g_at |
| 214508_x_at | 32067_at |
| 214505_s_at | 32542_at |
| 214501_s_at | 36576_at |

TABLE 17-continued

| probeID U133 | probeID U95A |
|---|---|
| 214500_at | 36576_at |
| 214463_x_at | 34027_f_at |
| 214455_at | 32980_f_at |
| 214449_s_at | 1818_at |
| 214449_s_at | 40555_at |
| 214439_x_at | 459_s_at |
| 214308_s_at | 31844_at |
| 214307_at | 31844_at |
| 214271_x_at | 33668_at |
| 214266_s_at | 39530_at |
| 214265_at | 41005_at |
| 214212_x_at | 36577_at |
| 214170_x_at | 32546_at |
| 214167_s_at | 31538_at |
| 214117_s_at | 37274_at |
| 214077_x_at | 37486_f_at |
| 214040_s_at | 32612_at |
| 214039_s_at | 41188_at |
| 214027_x_at | 40776_at |
| 213994_s_at | 35277_at |
| 213993_at | 35277_at |
| 213992_at | 39939_at |
| 213982_s_at | 34445_at |
| 213982_s_at | 34446_at |
| 213974_at | 38856_at |
| 213947_s_at | 41812_s_at |
| 213901_x_at | 40260_g_at |
| 213892_s_at | 34310_at |
| 213867_x_at | 32318_s_at |
| 213867_x_at | AFFX-HSAC07/X00351_3_at |
| 213867_x_at | AFFX-HSAC07/X00351_3_st |
| 213867_x_at | AFFX-HSAC07/X00351_5_at |
| 213867_x_at | AFFX-HSAC07/X00351_5_st |
| 213867_x_at | AFFX-HSAC07/X00351_M_at |
| 213804_at | 33290_at |
| 213800_at | 32250_at |
| 213798_s_at | 935_at |
| 213791_at | 38291_at |
| 213787_s_at | 32536_at |
| 213746_s_at | 32749_s_at |
| 213746_s_at | 32750_r_at |
| 213702_x_at | 36938_at |
| 213702_x_at | 461_at |
| 213688_at | 41143_at |
| 213688_at | 41144_g_at |
| 213675_at | 39750_at |
| 213620_s_at | 38454_g_at |
| 213600_at | 37831_at |
| 213572_s_at | 33305_at |
| 213541_s_at | 36383_at |
| 213541_s_at | 914_g_at |
| 213524_s_at | 38326_at |
| 213519_s_at | 36917_at |
| 213506_at | 36345_g_at |
| 213506_at | 38247_at |
| 213492_at | 37605_at |
| 213492_at | 598_at |
| 213485_s_at | 36732_at |
| 213476_x_at | 471_f_at |
| 213455_at | 38643_at |
| 213453_x_at | 35905_s_at |
| 213446_s_at | 1825_at |
| 213428_s_at | 38722_at |
| 213422_s_at | 35219_at |
| 213400_s_at | 32554_s_at |
| 213400_s_at | 32555_at |
| 213395_at | 36897_at |
| 213371_at | 34870_at |
| 213338_at | 35692_at |
| 213325_at | 34202_at |
| 213307_at | 37806_at |
| 213293_s_at | 36825_at |
| 213275_x_at | 32372_at |
| 213189_at | 34662_at |
| 213176_s_at | 33137_at |
| 213154_s_at | 40879_at |
| 213152_s_at | 32038_s_at |
| 213151_s_at | 32175_at |
| 213138_at | 38278_at |
| 213134_x_at | 37218_at |
| 213107_at | 32680_at |
| 213102_at | 35271_at |
| 213071_at | 38059_g_at |
| 213068_at | 38059_g_at |
| 213041_s_at | 37992_s_at |
| 213041_s_at | 37993_at |
| 213005_s_at | 37225_at |
| 213004_at | 37573_at |
| 213001_at | 37573_at |
| 212998_x_at | 36773_f_at |
| 212977_at | 34288_at |
| 212937_s_at | 38722_at |
| 212914_at | 39788_at |
| 212886_at | 34183_at |
| 212878_s_at | 39057_at |
| 212865_s_at | 34388_at |
| 212845_at | 40855_at |
| 212843_at | 1566_at |
| 212843_at | 41289_at |
| 212838_at | 34712_at |
| 212826_s_at | 40435_at |
| 212826_s_at | 40436_g_at |
| 212817_at | 38632_at |
| 212793_at | 41098_at |
| 212792_at | 39021_at |
| 212765_at | 34688_at |
| 212764_at | 33440_at |
| 212758_s_at | 33440_at |
| 212757_s_at | 32104_i_at |
| 212757_s_at | 32105_f_at |
| 212747_at | 40971_at |
| 212744_at | 33175_at |
| 212730_at | 39544_at |
| 212724_at | 35803_at |
| 212713_at | 39066_at |
| 212694_s_at | 36561_at |
| 212670_at | 31621_s_at |
| 212670_at | 39098_at |
| 212669_at | 32104_i_at |
| 212669_at | 32105_f_at |
| 212667_at | 671_at |
| 212658_at | 37542_at |
| 212652_s_at | 40605_at |
| 212651_at | 39771_at |
| 212647_at | 1879_at |
| 212647_at | 38338_at |
| 212646_at | 32593_at |
| 212624_s_at | 40512_at |
| 212610_at | 38443_at |
| 212609_s_at | 40781_at |
| 212590_at | 32827_at |
| 212581_x_at | 35905_s_at |
| 212573_at | 40455_at |
| 212572_at | 32182_at |
| 212567_s_at | 242_at |
| 212567_s_at | 243_g_at |
| 212567_s_at | 32226_at |
| 212566_at | 242_at |
| 212566_at | 243_g_at |
| 212566_at | 32226_at |
| 212565_at | 32182_at |
| 212563_at | 35615_at |
| 212561_at | 33924_at |
| 212554_at | 33404_at |
| 212554_at | 33405_at |
| 212554_at | 693_g_at |
| 212551_at | 33404_at |
| 212551_at | 33405_at |
| 212551_at | 693_g_at |
| 212535_at | 41747_s_at |
| 212526_at | 39852_at |
| 212510_at | 38394_at |
| 212504_at | 33407_at |
| 212504_at | 33408_at |
| 212503_s_at | 33407_at |
| 212503_s_at | 33408_at |

TABLE 17-continued

| probeID U133 | probeID U95A |
| --- | --- |
| 212494_at | 35358_at |
| 212470_at | 39419_at |
| 212457_at | 34669_at |
| 212449_s_at | 39396_at |
| 212445_s_at | 39356_at |
| 212430_at | 38661_at |
| 212409_s_at | 40832_s_at |
| 212409_s_at | 40833_r_at |
| 212408_at | 40832_s_at |
| 212408_at | 40833_r_at |
| 212358_at | 36095_at |
| 212354_at | 35832_at |
| 212344_at | 35832_at |
| 212330_at | 37758_s_at |
| 212325_at | 32812_at |
| 212316_at | 41812_s_at |
| 212314_at | 41585_at |
| 212280_x_at | 37041_at |
| 212276_at | 38098_at |
| 212274_at | 38098_at |
| 212272_at | 38098_at |
| 212254_s_at | 40304_at |
| 212253_x_at | 40304_at |
| 212252_at | 38716_at |
| 212240_s_at | 1269_at |
| 212236_x_at | 34301_r_at |
| 212235_at | 38671_at |
| 212230_at | 33862_at |
| 212227_x_at | 33850_at |
| 212203_x_at | 41745_at |
| 212197_x_at | 38730_at |
| 212169_at | 38761_s_at |
| 212157_at | 39757_at |
| 212154_at | 39757_at |
| 212130_x_at | 33850_at |
| 212127_at | 32151_at |
| 212120_at | 1818_at |
| 212120_at | 40555_at |
| 212119_at | 1818_at |
| 212119_at | 40555_at |
| 212118_at | 40176_at |
| 212117_at | 1818_at |
| 212117_at | 40555_at |
| 212116_at | 40176_at |
| 212104_s_at | 40260_g_at |
| 212097_at | 36119_at |
| 212091_s_at | 38722_at |
| 212088_at | 36602_at |
| 212085_at | 40435_at |
| 212085_at | 40436_g_at |
| 212082_s_at | 33994_g_at |
| 212071_s_at | 39556_at |
| 212067_s_at | 39409_at |
| 212041_at | 38686_at |
| 212008_at | 37336_at |
| 211991_s_at | 38833_at |
| 211990_at | 38833_at |
| 211981_at | 39333_at |
| 211980_at | 39333_at |
| 211978_x_at | 33667_at |
| 211966_at | 36659_at |
| 211964_at | 36659_at |
| 211954_s_at | 39028_at |
| 211949_s_at | 36597_at |
| 211945_s_at | 32808_at |
| 211892_s_at | 36533_at |
| 211871_x_at | 38176_at |
| 211864_s_at | 34678_at |
| 211778_at | 36761_at |
| 211765_x_at | 33667_at |
| 211762_s_at | 40407_at |
| 211749_s_at | 35783_at |
| 211719_x_at | 311_s_at |
| 211719_x_at | 31719_at |
| 211719_x_at | 31720_s_at |
| 211678_s_at | 38670_at |
| 211678_s_at | 41698_at |
| 211658_at | 39729_at |
| 211654_x_at | 36773_f_at |
| 211651_s_at | 581_at |
| 211596_s_at | 34800_at |
| 211576_s_at | 33135_at |
| 211574_s_at | 38441_s_at |
| 211573_x_at | 231_at |
| 211573_x_at | 38404_at |
| 211562_s_at | 37765_at |
| 211559_s_at | 1913_at |
| 211559_s_at | 37723_at |
| 211558_s_at | 37722_s_at |
| 211538_s_at | 36925_at |
| 211538_s_at | 645_at |
| 211537_x_at | 36905_at |
| 211536_x_at | 36905_at |
| 211535_s_at | 2056_at |
| 211535_s_at | 2057_g_at |
| 211535_s_at | 424_s_at |
| 211473_s_at | 39939_at |
| 211423_s_at | 33421_s_at |
| 211404_s_at | 33944_at |
| 211378_x_at | 33667_at |
| 211323_s_at | 32778_at |
| 211323_s_at | 32779_s_at |
| 211323_s_at | 755_at |
| 211296_x_at | 1366_i_at |
| 211296_x_at | 32335_r_at |
| 211256_x_at | 32673_at |
| 211203_s_at | 31809_at |
| 211203_s_at | 31810_g_at |
| 211160_x_at | 39329_at |
| 211160_x_at | 39330_s_at |
| 211144_x_at | 41468_at |
| 211126_s_at | 41401_at |
| 211071_s_at | 36941_at |
| 211070_x_at | 37692_at |
| 211043_s_at | 32522_f_at |
| 211031_s_at | 41396_at |
| 211026_s_at | 35792_at |
| 211003_x_at | 231_at |
| 211003_x_at | 38404_at |
| 210990_s_at | 37671_at |
| 210986_s_at | 36790_at |
| 210986_s_at | 36791_g_at |
| 210986_s_at | 36792_at |
| 210982_s_at | 37039_at |
| 210976_s_at | 36196_at |
| 210973_s_at | 2056_at |
| 210973_s_at | 2057_g_at |
| 210973_s_at | 424_s_at |
| 210935_s_at | 38736_at |
| 210907_s_at | 35218_at |
| 210840_s_at | 1825_at |
| 210829_s_at | 32668_at |
| 210794_s_at | 39026_r_at |
| 210787_s_at | 38716_at |
| 210764_s_at | 38772_at |
| 210762_s_at | 37951_at |
| 210738_s_at | 35285_at |
| 210738_s_at | 35871_s_at |
| 210736_x_at | 36467_g_at |
| 210736_x_at | 36469_at |
| 210736_x_at | 36470_s_at |
| 210702_s_at | 36533_at |
| 210648_x_at | 39360_at |
| 210628_x_at | 33137_at |
| 210627_s_at | 38464_at |
| 210592_s_at | 1173_g_at |
| 210592_s_at | 34304_s_at |
| 210588_x_at | 40836_s_at |
| 210582_s_at | 38618_at |
| 210570_x_at | 1238_at |
| 210570_x_at | 38431_at |
| 210547_x_at | 32634_s_at |
| 210544_s_at | 40409_at |
| 210541_s_at | 40176_at |
| 210517_s_at | 37680_at |
| 210495_x_at | 311_s_at |

TABLE 17-continued

| probeID U133 | probeID U95A |
|---|---|
| 210495_x_at | 31719_at |
| 210495_x_at | 31720_s_at |
| 210471_s_at | 32709_at |
| 210470_x_at | 38527_at |
| 210338_s_at | 1180_g_at |
| 210337_s_at | 40881_at |
| 210317_s_at | 1011_s_at |
| 210299_s_at | 32542_at |
| 210298_x_at | 32542_at |
| 210243_s_at | 39445_at |
| 210237_at | 35899_at |
| 210202_s_at | 459_s_at |
| 210201_x_at | 459_s_at |
| 210186_s_at | 151_s_at |
| 210156_s_at | 37737_at |
| 210139_s_at | 38653_at |
| 210110_x_at | 40836_s_at |
| 210105_s_at | 2039_s_at |
| 210105_s_at | 40480_s_at |
| 210101_x_at | 39691_at |
| 210089_s_at | 37671_at |
| 210084_x_at | 32905_s_at |
| 210079_x_at | 32709_at |
| 210036_s_at | 38225_at |
| 210036_s_at | 38858_at |
| 210027_s_at | 2025_s_at |
| 210026_s_at | 41817_g_at |
| 210026_s_at | 41818_at |
| 210024_s_at | 34850_at |
| 209967_s_at | 32065_at |
| 209967_s_at | 32066_g_at |
| 209967_s_at | 32067_at |
| 209948_at | 38298_at |
| 209897_s_at | 39634_at |
| 209896_s_at | 38443_at |
| 209895_at | 38443_at |
| 209872_s_at | 41359_at |
| 209868_s_at | 31671_at |
| 209868_s_at | 31672_g_at |
| 209868_s_at | 333_s_at |
| 209868_s_at | 33867_s_at |
| 209863_s_at | 31791_at |
| 209834_at | 32094_at |
| 209823_x_at | 36773_f_at |
| 209818_s_at | 32970_f_at |
| 209786_at | 35737_at |
| 209786_at | 35738_at |
| 209772_s_at | 266_s_at |
| 209747_at | 1767_s_at |
| 209708_at | 36834_at |
| 209702_at | 37242_at |
| 209696_at | 36495_at |
| 209695_at | 36008_at |
| 209687_at | 32666_at |
| 209687_at | 33834_at |
| 209685_s_at | 1217_g_at |
| 209685_s_at | 1336_s_at |
| 209685_s_at | 160029_at |
| 209665_at | 39752_at |
| 209663_s_at | 36892_at |
| 209656_s_at | 37958_at |
| 209655_s_at | 37958_at |
| 209651_at | 35146_at |
| 209646_x_at | 38503_at |
| 209645_s_at | 38503_at |
| 209625_at | 40629_at |
| 209624_s_at | 36432_at |
| 209623_at | 36432_at |
| 209621_s_at | 39690_at |
| 209608_s_at | 34790_at |
| 209583_s_at | 37716_at |
| 209582_s_at | 37716_at |
| 209576_at | 33809_at |
| 209568_s_at | 37539_at |
| 209563_x_at | 41143_at |
| 209563_x_at | 41144_g_at |
| 209550_at | 36073_at |
| 209539_at | 37543_at |
| 209516_at | 36462_at |
| 209505_at | 1147_at |
| 209496_at | 34407_at |
| 209488_s_at | 1276_g_at |
| 209488_s_at | 34162_at |
| 209488_s_at | 34163_g_at |
| 209488_s_at | 38047_at |
| 209488_s_at | 38049_g_at |
| 209487_at | 1276_g_at |
| 209487_at | 34162_at |
| 209487_at | 34163_g_at |
| 209487_at | 38047_at |
| 209487_at | 38049_g_at |
| 209482_at | 32213_at |
| 209470_s_at | 36939_at |
| 209469_at | 36939_at |
| 209440_at | 36489_at |
| 209437_s_at | 35277_at |
| 209436_at | 35277_at |
| 209433_s_at | 34341_at |
| 209427_at | 31830_s_at |
| 209427_at | 31831_at |
| 209426_s_at | 41706_at |
| 209425_at | 41706_at |
| 209424_s_at | 41706_at |
| 209406_at | 35291_at |
| 209402_s_at | 38625_g_at |
| 209402_s_at | 39521_at |
| 209401_s_at | 38625_g_at |
| 209401_s_at | 39521_at |
| 209398_at | 37018_at |
| 209391_at | 38726_at |
| 209389_x_at | 37692_at |
| 209379_s_at | 37617_at |
| 209368_at | 41473_at |
| 209367_at | 38259_at |
| 209366_x_at | 38458_at |
| 209366_x_at | 38459_g_at |
| 209363_s_at | 34356_at |
| 209363_s_at | 34357_g_at |
| 209360_s_at | 1882_g_at |
| 209360_s_at | 2026_at |
| 209356_x_at | 35347_at |
| 209355_s_at | 33862_at |
| 209340_at | 41242_at |
| 209337_at | 39243_s_at |
| 209323_at | 41141_at |
| 209318_x_at | 36943_r_at |
| 209312_x_at | 41723_s_at |
| 209309_at | 35834_at |
| 209302_at | 35631_at |
| 209292_at | 41536_at |
| 209291_at | 41536_at |
| 209288_s_at | 33362_at |
| 209287_s_at | 33362_at |
| 209265_s_at | 32245_at |
| 209265_s_at | 32246_g_at |
| 209242_at | 39701_at |
| 209210_s_at | 36577_at |
| 209209_s_at | 36577_at |
| 209203_s_at | 40879_at |
| 209200_at | 37710_at |
| 209199_s_at | 37710_at |
| 209198_s_at | 36144_at |
| 209197_at | 36144_at |
| 209194_at | 38410_at |
| 209170_s_at | 37251_s_at |
| 209167_at | 37251_s_at |
| 209154_at | 39416_at |
| 209147_s_at | 34797_at |
| 209142_s_at | 1423_at |
| 209129_at | 39341_at |
| 209118_s_at | 40567_at |
| 209114_at | 34775_at |
| 209113_s_at | 41526_at |
| 209104_s_at | 41322_s_at |
| 209101_at | 36638_at |
| 209091_s_at | 39691_at |

TABLE 17-continued

| probeID U133 | probeID U95A |
|---|---|
| 209090_s_at | 39691_at |
| 209074_s_at | 38044_at |
| 209047_at | 36156_at |
| 209039_x_at | 40098_at |
| 209009_at | 38375_at |
| 208985_s_at | 40616_at |
| 208980_s_at | 1366_i_at |
| 208980_s_at | 32335_r_at |
| 208978_at | 35828_at |
| 208966_x_at | 1456_s_at |
| 208964_s_at | 39372_at |
| 208964_s_at | 39373_at |
| 208964_s_at | 41719_i_at |
| 208964_s_at | 41720_r_at |
| 208962_s_at | 39372_at |
| 208962_s_at | 39373_at |
| 208962_s_at | 41719_i_at |
| 208962_s_at | 41720_r_at |
| 208944_at | 1814_at |
| 208944_at | 1815_g_at |
| 208941_s_at | 39387_at |
| 208910_s_at | 37668_at |
| 208905_at | 35818_at |
| 208904_s_at | 39798_at |
| 208899_x_at | 33854_at |
| 208894_at | 37039_at |
| 208881_x_at | 36985_at |
| 208868_s_at | 35785_at |
| 208853_s_at | 40125_at |
| 208852_s_at | 40125_at |
| 208848_at | 37707_i_at |
| 208848_at | 37708_r_at |
| 208843_s_at | 35806_at |
| 208842_s_at | 35806_at |
| 208837_at | 41163_at |
| 208801_at | 33837_at |
| 208800_at | 33837_at |
| 208792_s_at | 36780_at |
| 208791_at | 36780_at |
| 208787_at | 37726_at |
| 208786_s_at | 39370_at |
| 208781_x_at | 39360_at |
| 208778_s_at | 34791_at |
| 208770_s_at | 35263_at |
| 208767_s_at | 41188_at |
| 208763_s_at | 36629_at |
| 208763_s_at | 36630_at |
| 208756_s_at | 1644_at |
| 208756_at | 32230_at |
| 208747_s_at | 40496_at |
| 208737_at | 38814_at |
| 208702_x_at | 33944_at |
| 208700_s_at | 38789_at |
| 208699_x_at | 38789_at |
| 208698_s_at | 38527_at |
| 208687_x_at | 1180_g_at |
| 208682_s_at | 34859_at |
| 208679_s_at | 1718_at |
| 208675_s_at | 38791_at |
| 208650_s_at | 266_s_at |
| 208637_x_at | 39329_at |
| 208637_x_at | 39330_s_at |
| 208636_at | 39329_at |
| 208636_at | 39330_s_at |
| 208633_s_at | 38704_at |
| 208632_at | 34883_at |
| 208628_s_at | 36140_at |
| 208627_s_at | 36140_at |
| 208591_s_at | 35872_at |
| 208591_s_at | 746_at |
| 208527_x_at | 31523_f_at |
| 208523_x_at | 31524_f_at |
| 208490_x_at | 31522_f_at |
| 208456_s_at | 32827_at |
| 208454_s_at | 32765_f_at |
| 208447_s_at | 36489_at |
| 208430_s_at | 36467_g_at |
| 208430_s_at | 36469_at |
| 208430_s_at | 36470_s_at |
| 208370_s_at | 32168_s_at |
| 208308_s_at | 39122_at |
| 208306_x_at | 32035_at |
| 208264_s_at | 40616_at |
| 208146_s_at | 38323_at |
| 208131_s_at | 36533_at |
| 208112_x_at | 40098_at |
| 208029_s_at | 41188_at |
| 207984_s_at | 34656_at |
| 207977_s_at | 38059_g_at |
| 207961_x_at | 32582_at |
| 207961_x_at | 37407_s_at |
| 207961_x_at | 767_at |
| 207961_x_at | 773_at |
| 207961_x_at | 774_g_at |
| 207957_s_at | 1217_g_at |
| 207957_s_at | 1336_s_at |
| 207957_s_at | 160029_at |
| 207949_s_at | 32634_s_at |
| 207936_x_at | 31941_s_at |
| 207876_s_at | 35330_at |
| 207843_x_at | 38458_at |
| 207843_x_at | 38459_g_at |
| 207842_s_at | 38437_at |
| 207836_s_at | 1276_g_at |
| 207836_s_at | 34162_at |
| 207836_s_at | 34163_g_at |
| 207836_s_at | 38047_at |
| 207836_s_at | 38049_g_at |
| 207824_s_at | 32553_at |
| 207821_s_at | 36117_at |
| 207802_at | 36464_at |
| 207761_s_at | 38717_at |
| 207741_x_at | 32905_s_at |
| 207714_s_at | 39167_r_at |
| 207630_s_at | 32065_at |
| 207630_s_at | 32066_g_at |
| 207630_s_at | 32067_at |
| 207629_s_at | 40099_at |
| 207563_s_at | 38614_s_at |
| 207549_x_at | 38441_s_at |
| 207547_s_at | 38044_at |
| 207542_s_at | 36156_at |
| 207507_s_at | 34811_at |
| 207453_s_at | 38632_at |
| 207390_s_at | 31830_s_at |
| 207390_s_at | 31831_at |
| 207348_s_at | 1188_g_at |
| 207317_s_at | 36505_at |
| 207266_x_at | 31671_at |
| 207266_x_at | 31672_g_at |
| 207266_x_at | 333_s_at |
| 207266_x_at | 33867_s_at |
| 207260_at | 31685_at |
| 207172_s_at | 2087_s_at |
| 207172_s_at | 36976_at |
| 207124_s_at | 38176_at |
| 207121_s_at | 36926_at |
| 207071_s_at | 40077_at |
| 207001_x_at | 36629_at |
| 207001_x_at | 36630_at |
| 206938_at | 565_at |
| 206932_at | 32363_at |
| 206868_at | 34034_at |
| 206858_s_at | 40674_s_at |
| 206842_at | 40021_at |
| 206813_at | 36252_at |
| 206701_x_at | 1198_at |
| 206666_at | 36280_at |
| 206649_s_at | 34669_at |
| 206631_at | 828_at |
| 206580_s_at | 35347_at |
| 206558_at | 39608_at |
| 206558_at | 39609_at |
| 206459_s_at | 33684_at |
| 206458_s_at | 33684_at |
| 206434_at | 33596_at |

TABLE 17-continued

| probeID U133 | probeID U95A |
|---|---|
| 206433_s_at | 33596_at |
| 206429_at | 36345_g_at |
| 206429_at | 38247_at |
| 206385_s_at | 36965_at |
| 206382_s_at | 1088_at |
| 206382_s_at | 40023_at |
| 206377_at | 36319_at |
| 206375_s_at | 528_at |
| 206352_s_at | 41281_s_at |
| 206352_s_at | 41282_s_at |
| 206351_s_at | 41281_s_at |
| 206351_s_at | 41282_s_at |
| 206332_s_at | 1456_s_at |
| 206284_x_at | 32522_f_at |
| 206117_at | 36790_at |
| 206117_at | 36791_g_at |
| 206117_at | 36792_at |
| 206116_s_at | 36790_at |
| 206116_s_at | 36791_g_at |
| 206116_s_at | 36792_at |
| 206106_at | 983_at |
| 206076_at | 39447_f_at |
| 206070_s_at | 1234_at |
| 206065_s_at | 41422_at |
| 206030_at | 39654_at |
| 206009_at | 1508_at |
| 205980_s_at | 37117_at |
| 205963_s_at | 36541_at |
| 205961_s_at | 39243_s_at |
| 205942_s_at | 33278_at |
| 205942_s_at | 41149_at |
| 205942_s_at | 33279_s_at |
| 205937_at | 470_at |
| 205935_at | 38183_at |
| 205934_at | 1182_at |
| 205895_s_at | 36597_at |
| 205882_x_at | 33102_at |
| 205882_x_at | 33103_s_at |
| 205827_at | 37572_at |
| 205805_at | 213_at |
| 205803_s_at | 39123_s_at |
| 205803_s_at | 39125_at |
| 205782_at | 1380_at |
| 205782_at | 1466_s_at |
| 205780_at | 2011_s_at |
| 205780_at | 36891_at |
| 205776_at | 37874_at |
| 205743_at | 40024_at |
| 205741_s_at | 36467_g_at |
| 205741_s_at | 36469_at |
| 205741_s_at | 36470_s_at |
| 205730_s_at | 39597_at |
| 205709_s_at | 40217_s_at |
| 205709_s_at | 40218_at |
| 205683_x_at | 33321_r_at |
| 205645_at | 40663_at |
| 205620_at | 39979_at |
| 205611_at | 39588_at |
| 205608_s_at | 1929_at |
| 205608_s_at | 39315_at |
| 205575_at | 39920_r_at |
| 205573_s_at | 37808_at |
| 205548_s_at | 37218_at |
| 205547_s_at | 36931_at |
| 205505_at | 38218_at |
| 205480_s_at | 37373_at |
| 205475_at | 35837_at |
| 205438_at | 40524_at |
| 205433_at | 37841_at |
| 205431_s_at | 1831_at |
| 205430_at | 1831_at |
| 205407_at | 35234_at |
| 205404_at | 35702_at |
| 205384_at | 32109_at |
| 205382_s_at | 40282_s_at |
| 205348_s_at | 40318_at |
| 205329_s_at | 40605_at |
| 205325_at | 37191_at |
| 205304_s_at | 34428_at |
| 205303_at | 34428_at |
| 205294_at | 37760_at |
| 205294_at | 37761_at |
| 205262_at | 38225_at |
| 205262_at | 38858_at |
| 205249_at | 37863_at |
| 205225_at | 1681_at |
| 205221_at | 31844_at |
| 205219_s_at | 37825_at |
| 205200_at | 36569_at |
| 205168_at | 1319_at |
| 205160_at | 39648_at |
| 205158_at | 32664_at |
| 205157_s_at | 34301_r_at |
| 205155_s_at | 33630_s_at |
| 205132_at | 39063_at |
| 205120_s_at | 37223_at |
| 205116_at | 36917_at |
| 205110_s_at | 36232_at |
| 205110_s_at | 468_at |
| 205047_s_at | 36671_at |
| 205018_s_at | 33318_at |
| 205011_at | 38151_at |
| 205001_s_at | 38355_at |
| 204993_at | 38279_at |
| 204979_s_at | 36040_at |
| 204964_s_at | 33302_at |
| 204964_s_at | 33303_at |
| 204963_at | 33302_at |
| 204963_at | 33303_at |
| 204939_s_at | 38734_at |
| 204938_s_at | 38734_at |
| 204934_s_at | 37639_at |
| 204931_at | 37247_at |
| 204929_s_at | 32533_s_at |
| 204929_s_at | 32534_f_at |
| 204903_x_at | 37041_at |
| 204894_s_at | 33756_at |
| 204875_s_at | 35071_s_at |
| 204872_at | 38364_at |
| 204834_at | 39591_s_at |
| 204834_at | 39592_r_at |
| 204803_s_at | 1776_at |
| 204802_at | 1776_at |
| 204790_at | 1857_at |
| 204780_s_at | 37643_at |
| 204777_s_at | 38051_at |
| 204755_x_at | 401_s_at |
| 204754_at | 401_s_at |
| 204753_s_at | 401_s_at |
| 204751_x_at | 39302_at |
| 204749_at | 743_at |
| 204744_s_at | 40827_at |
| 204734_at | 37582_at |
| 204731_at | 1897_at |
| 204730_at | 37265_at |
| 204714_s_at | 35245_at |
| 204713_s_at | 35245_at |
| 204688_at | 41449_at |
| 204615_x_at | 36985_at |
| 204610_s_at | 41851_at |
| 204608_at | 36528_at |
| 204607_at | 35345_at |
| 204595_s_at | 41354_at |
| 204570_at | 39031_at |
| 204556_s_at | 36521_at |
| 204518_s_at | 37422_at |
| 204517_at | 37422_at |
| 204491_at | 38526_at |
| 204484_at | 41715_at |
| 204472_at | 37279_at |
| 204464_s_at | 1507_s_at |
| 204463_s_at | 1507_s_at |
| 204442_x_at | 33137_at |
| 204436_at | 36856_at |
| 204430_s_at | 34362_at |
| 204429_s_at | 34362_at |

TABLE 17-continued

| probeID U133 | probeID U95A |
|---|---|
| 204427_s_at | 36972_at |
| 204426_at | 36972_at |
| 204424_s_at | 38028_at |
| 204422_s_at | 1593_at |
| 204422_s_at | 41806_at |
| 204421_s_at | 1593_at |
| 204421_s_at | 41806_at |
| 204412_s_at | 33767_at |
| 204396_s_at | 1135_at |
| 204395_s_at | 1135_at |
| 204394_at | 33708_at |
| 204393_s_at | 32200_at |
| 204392_at | 251_at |
| 204352_at | 35238_at |
| 204345_at | 35168_f_at |
| 204345_at | 35169_at |
| 204344_s_at | 39099_at |
| 204341_at | 38881_i_at |
| 204341_at | 38882_r_at |
| 204331_s_at | 33214_at |
| 204319_s_at | 33121_g_at |
| 204312_x_at | 877_at |
| 204273_at | 1198_at |
| 204271_s_at | 1198_at |
| 204223_at | 37022_at |
| 204163_at | 35740_at |
| 204151_x_at | 32805_at |
| 204147_s_at | 37758_s_at |
| 204141_at | 296_at |
| 204141_at | 39331_at |
| 204141_at | 297_g_at |
| 204140_at | 32718_at |
| 204135_at | 31897_at |
| 204134_at | 31904_at |
| 204133_at | 31882_at |
| 204123_at | 1188_g_at |
| 204122_at | 38363_at |
| 204117_at | 37950_at |
| 204114_at | 753_at |
| 204100_at | 35846_at |
| 204099_at | 32565_at |
| 204083_s_at | 32312_at |
| 204083_s_at | 32313_at |
| 204083_s_at | 32314_g_at |
| 204069_at | 40763_at |
| 204059_s_at | 33644_at |
| 204059_s_at | 837_s_at |
| 204058_at | 33644_at |
| 204058_at | 837_s_at |
| 204045_at | 38317_at |
| 204042_at | 1058_at |
| 204038_s_at | 40387_at |
| 204037_at | 40387_at |
| 204031_s_at | 35745_f_at |
| 204031_s_at | 35746_r_at |
| 204030_s_at | 36536_at |
| 204005_s_at | 40621_at |
| 204000_at | 38176_at |
| 203973_s_at | 1052_s_at |
| 203966_s_at | 36501_at |
| 203966_s_at | 857_at |
| 203953_s_at | 33904_at |
| 203951_at | 34203_at |
| 203944_x_at | 32673_at |
| 203931_s_at | 39812_at |
| 203926_x_at | 37992_s_at |
| 203926_x_at | 37993_at |
| 203911_at | 1251_g_at |
| 203909_at | 36542_at |
| 203908_at | 35285_at |
| 203908_at | 35871_s_at |
| 203903_s_at | 35644_at |
| 203886_s_at | 32783_at |
| 203851_at | 1736_at |
| 203811_s_at | 158_at |
| 203811_s_at | 33533_at |
| 203810_at | 158_at |
| 203810_at | 33533_at |
| 203787_at | 32668_at |
| 203766_s_at | 37765_at |
| 203752_s_at | 1612_s_at |
| 203752_s_at | 41483_s_at |
| 203748_x_at | 31671_at |
| 203748_x_at | 31672_g_at |
| 203748_x_at | 333_s_at |
| 203748_x_at | 33867_s_at |
| 203739_at | 32034_at |
| 203733_at | 41637_at |
| 203729_at | 39182_at |
| 203725_at | 1911_s_at |
| 203722_at | 37331_g_at |
| 203710_at | 32778_at |
| 203710_at | 32779_s_at |
| 203710_at | 755_at |
| 203698_s_at | 40230_at |
| 203688_at | 38120_at |
| 203680_at | 37221_at |
| 203666_at | 32666_at |
| 203666_at | 33834_at |
| 203663_s_at | 41223_at |
| 203649_s_at | 37017_at |
| 203649_s_at | 614_at |
| 203641_s_at | 41755_at |
| 203638_s_at | 1143_s_at |
| 203638_s_at | 1363_at |
| 203638_s_at | 1145_g_at |
| 203620_s_at | 32224_at |
| 203592_s_at | 33900_at |
| 203586_s_at | 41774_at |
| 203585_at | 32139_at |
| 203582_s_at | 39244_at |
| 203582_s_at | 621_at |
| 203576_at | 41111_at |
| 203562_at | 37743_at |
| 203557_s_at | 34352_at |
| 203542_s_at | 40202_at |
| 203524_s_at | 36124_at |
| 203498_at | 32076_at |
| 203456_at | 34318_at |
| 203455_s_at | 1173_g_at |
| 203455_s_at | 34304_s_at |
| 203453_at | 35207_at |
| 203449_s_at | 1329_s_at |
| 203449_s_at | 32255_i_at |
| 203449_s_at | 32256_r_at |
| 203435_s_at | 1389_at |
| 203434_s_at | 1389_at |
| 203430_at | 41454_at |
| 203423_at | 38634_at |
| 203415_at | 37569_at |
| 203414_at | 37565_at |
| 203413_at | 32598_at |
| 203411_s_at | 37378_r_at |
| 203397_s_at | 36483_at |
| 203397_s_at | 36484_at |
| 203370_s_at | 39530_at |
| 203369_x_at | 39530_at |
| 203324_s_at | 339_at |
| 203324_s_at | 40168_at |
| 203320_at | 39428_at |
| 203311_s_at | 33152_at |
| 203304_at | 37678_at |
| 203303_at | 36921_at |
| 203300_x_at | 41549_s_at |
| 203296_s_at | 34377_at |
| 203243_s_at | 40060_r_at |
| 203242_s_at | 40060_r_at |
| 203241_at | 39429_at |
| 203233_at | 404_at |
| 203219_s_at | 34310_at |
| 203218_at | 1238_at |
| 203218_at | 38431_at |
| 203197_s_at | 39743_at |
| 203196_at | 1931_at |
| 203196_at | 34955_at |
| 203186_s_at | 38087_s_at |

TABLE 17-continued

| probeID U133 | probeID U95A |
|---|---|
| 203180_at | 36686_at |
| 203174_s_at | 35765_at |
| 203167_at | 1375_s_at |
| 203167_at | 34722_at |
| 203151_at | 35917_at |
| 203140_at | 40091_at |
| 203139_at | 40049_at |
| 203138_at | 41855_at |
| 203099_s_at | 32111_at |
| 203088_at | 39038_at |
| 203068_at | 35190_at |
| 203066_at | 35350_at |
| 203065_s_at | 36119_at |
| 203063_at | 37384_at |
| 203043_at | 39168_at |
| 203041_s_at | 38402_at |
| 203041_s_at | 38403_at |
| 203033_x_at | 32546_at |
| 203007_x_at | 39396_at |
| 202995_s_at | 38026_at |
| 202995_s_at | 38027_at |
| 202994_s_at | 38026_at |
| 202994_s_at | 38027_at |
| 202992_at | 37394_at |
| 202978_s_at | 41495_at |
| 202949_s_at | 38422_s_at |
| 202946_s_at | 37755_at |
| 202941_at | 34893_at |
| 202936_s_at | 33436_at |
| 202935_s_at | 33436_at |
| 202931_x_at | 459_s_at |
| 202929_s_at | 33689_s_at |
| 202929_s_at | 41180_i_at |
| 202921_s_at | 39850_at |
| 202916_s_at | 35318_at |
| 202915_s_at | 35318_at |
| 202908_at | 35164_at |
| 202898_at | 32092_at |
| 202890_at | 39732_at |
| 202889_x_at | 39732_at |
| 202886_s_at | 41429_at |
| 202884_s_at | 41429_at |
| 202836_s_at | 33631_at |
| 202836_s_at | 33632_g_at |
| 202828_s_at | 34747_at |
| 202812_at | 31816_at |
| 202802_at | 37722_s_at |
| 202796_at | 33719_at |
| 202796_at | 36452_at |
| 202795_x_at | 34046_at |
| 202787_s_at | 1637_at |
| 202786_at | 40966_at |
| 202784_s_at | 41722_at |
| 202779_s_at | 893_at |
| 202770_s_at | 1913_at |
| 202770_s_at | 37723_at |
| 202769_at | 1913_at |
| 202769_at | 37723_at |
| 202766_s_at | 32535_at |
| 202765_s_at | 32535_at |
| 202760_s_at | 35985_at |
| 202759_s_at | 35985_at |
| 202748_at | 32700_at |
| 202740_at | 37713_at |
| 202738_s_at | 37392_at |
| 202736_s_at | 32559_s_at |
| 202736_s_at | 32560_s_at |
| 202734_at | 36116_at |
| 202732_at | 34376_at |
| 202729_s_at | 1495_at |
| 202728_s_at | 1495_at |
| 202722_s_at | 32626_at |
| 202721_s_at | 32626_at |
| 202719_s_at | 32134_at |
| 202688_at | 1715_at |
| 202686_s_at | 38433_at |
| 202685_s_at | 38433_at |
| 202655_at | 36615_at |
| 202637_s_at | 32640_at |
| 202609_at | 1467_at |
| 202606_s_at | 32219_at |
| 202605_at | 33308_at |
| 202599_s_at | 40088_at |
| 202598_at | 39712_at |
| 202583_s_at | 39547_at |
| 202579_x_at | 35737_at |
| 202579_x_at | 35738_at |
| 202566_s_at | 40069_at |
| 202565_s_at | 40069_at |
| 202555_s_at | 32847_at |
| 202554_s_at | 1121_g_at |
| 202554_s_at | 32798_at |
| 202548_s_at | 40828_at |
| 202542_s_at | 39734_at |
| 202534_x_at | 37913_at |
| 202522_at | 353_at |
| 202506_at | 38409_at |
| 202504_at | 1898_at |
| 202499_s_at | 36979_at |
| 202497_x_at | 36979_at |
| 202465_at | 31609_s_at |
| 202450_s_at | 128_at |
| 202450_s_at | 129_g_at |
| 202440_s_at | 37745_s_at |
| 202440_s_at | 37746_r_at |
| 202428_x_at | 37692_at |
| 202427_s_at | 37000_at |
| 202410_x_at | 1664_at |
| 202407_s_at | 40904_at |
| 202404_s_at | 32305_at |
| 202404_s_at | 32306_g_at |
| 202404_s_at | 32307_s_at |
| 202403_s_at | 32305_at |
| 202403_s_at | 32306_g_at |
| 202403_s_at | 32307_s_at |
| 202401_s_at | 40109_at |
| 202395_at | 38719_at |
| 202388_at | 37701_at |
| 202371_at | 32251_at |
| 202362_at | 1848_at |
| 202350_s_at | 32239_at |
| 202296_s_at | 41551_at |
| 202296_s_at | 41552_g_at |
| 202291_s_at | 41287_s_at |
| 202286_s_at | 291_s_at |
| 202286_s_at | 41286_at |
| 202283_at | 40856_at |
| 202274_at | 1197_at |
| 202273_at | 1771_s_at |
| 202269_x_at | 35735_at |
| 202266_at | 34825_at |
| 202262_x_at | 36131_at |
| 202262_x_at | 38621_at |
| 202254_at | 40805_at |
| 202242_at | 38408_at |
| 202228_s_at | 35747_at |
| 202222_s_at | 40776_at |
| 202202_s_at | 37671_at |
| 202201_at | 37002_at |
| 202193_at | 38618_at |
| 202180_s_at | 38064_at |
| 202161_at | 175_s_at |
| 202159_at | 34291_at |
| 202148_s_at | 37741_at |
| 202138_x_at | 41250_at |
| 202133_at | 33876_at |
| 202132_at | 33876_at |
| 202123_s_at | 1635_at |
| 202123_s_at | 32974_at |
| 202123_s_at | 39730_at |
| 202123_s_at | 1636_g_at |
| 202123_s_at | 32975_g_at |
| 202117_at | 39700_at |
| 202117_at | 552_at |
| 202117_at | 553_g_at |
| 202105_at | 34391_at |

TABLE 17-continued

| probeID U133 | probeID U95A |
|---|---|
| 202092_s_at | 33198_at |
| 202089_s_at | 1798_at |
| 202081_at | 36097_at |
| 202075_s_at | 40081_at |
| 202074_s_at | 41742_s_at |
| 202074_s_at | 41744_at |
| 202073_at | 41742_s_at |
| 202073_at | 41744_at |
| 202069_s_at | 36195_at |
| 202023_at | 40425_at |
| 202021_x_at | 33850_at |
| 202005_at | 35309_at |
| 201995_at | 222_at |
| 201993_x_at | 32393_s_at |
| 201980_s_at | 32544_s_at |
| 201977_s_at | 35744_at |
| 201968_s_at | 32210_at |
| 201958_s_at | 34925_at |
| 201958_s_at | 41137_at |
| 201957_at | 34925_at |
| 201957_at | 41137_at |
| 201955_at | 1923_at |
| 201955_at | 39251_at |
| 201947_s_at | 35759_at |
| 201946_s_at | 35759_at |
| 201934_at | 32248_at |
| 201931_at | 40509_at |
| 201923_at | 38435_at |
| 201912_s_at | 33932_at |
| 201909_at | 41214_at |
| 201900_s_at | 38780_at |
| 201892_s_at | 36624_at |
| 201869_s_at | 32554_s_at |
| 201869_s_at | 32555_at |
| 201868_s_at | 32554_s_at |
| 201868_s_at | 32555_at |
| 201867_s_at | 32554_s_at |
| 201867_s_at | 32555_at |
| 201858_s_at | 32227_at |
| 201852_x_at | 32488_at |
| 201848_s_at | 38010_at |
| 201843_s_at | 32551_at |
| 201842_s_at | 32551_at |
| 201841_s_at | 36785_at |
| 201839_s_at | 575_s_at |
| 201828_x_at | 33856_at |
| 201805_at | 34346_at |
| 201792_at | 39069_at |
| 201787_at | 38026_at |
| 201787_at | 38027_at |
| 201785_at | 37402_at |
| 201761_at | 40074_at |
| 201760_s_at | 40167_s_at |
| 201758_at | 147_at |
| 201744_s_at | 38038_at |
| 201743_at | 36661_s_at |
| 201742_x_at | 36098_at |
| 201738_at | 33351_at |
| 201735_s_at | 40880_r_at |
| 201723_s_at | 38041_at |
| 201719_s_at | 32585_at |
| 201718_s_at | 32585_at |
| 201694_s_at | 789_at |
| 201689_s_at | 33840_at |
| 201688_s_at | 33840_at |
| 201667_at | 32531_at |
| 201662_s_at | 33880_at |
| 201662_s_at | 33881_at |
| 201660_at | 33880_at |
| 201660_at | 33881_at |
| 201655_s_at | 32845_at |
| 201650_at | 40899_at |
| 201647_s_at | 33823_at |
| 201641_at | 39061_at |
| 201627_s_at | 35303_at |
| 201625_s_at | 35303_at |
| 201621_at | 37005_at |
| 201617_x_at | 41738_at |
| 201617_x_at | 41739_s_at |
| 201616_s_at | 41738_at |
| 201616_s_at | 41739_s_at |
| 201615_x_at | 41738_at |
| 201615_x_at | 41739_s_at |
| 201609_x_at | 41775_at |
| 201604_s_at | 40438_at |
| 201596_x_at | 35766_at |
| 201583_s_at | 40851_r_at |
| 201582_at | 40851_r_at |
| 201577_at | 1521_at |
| 201577_at | 39073_at |
| 201568_at | 34400_at |
| 201560_at | 33891_at |
| 201559_s_at | 33891_at |
| 201543_s_at | 41451_s_at |
| 201540_at | 32542_at |
| 201539_s_at | 32542_at |
| 201538_s_at | 41225_at |
| 201538_s_at | 41226_at |
| 201537_s_at | 41225_at |
| 201537_s_at | 41226_at |
| 201536_at | 41225_at |
| 201536_at | 41226_at |
| 201524_x_at | 1660_at |
| 201524_x_at | 36604_at |
| 201523_x_at | 1660_at |
| 201523_x_at | 36604_at |
| 201522_x_at | 34842_at |
| 201521_s_at | 32789_at |
| 201516_at | 241_g_at |
| 201505_at | 581_at |
| 201497_x_at | 32582_at |
| 201497_x_at | 37407_s_at |
| 201497_x_at | 767_at |
| 201497_x_at | 773_at |
| 201497_x_at | 774_g_at |
| 201496_x_at | 32582_at |
| 201496_x_at | 37407_s_at |
| 201496_x_at | 767_at |
| 201496_x_at | 773_at |
| 201496_x_at | 774_g_at |
| 201495_x_at | 32582_at |
| 201495_x_at | 37407_s_at |
| 201495_x_at | 767_at |
| 201495_x_at | 773_at |
| 201495_x_at | 774_g_at |
| 201482_at | 1257_s_at |
| 201475_x_at | 39342_at |
| 201460_at | 36179_at |
| 201460_at | 36180_s_at |
| 201459_at | 35758_at |
| 201457_x_at | 34783_s_at |
| 201457_x_at | 41547_at |
| 201446_s_at | 33852_at |
| 201438_at | 38077_at |
| 201431_s_at | 36149_at |
| 201430_s_at | 36149_at |
| 201421_s_at | 38987_at |
| 201420_s_at | 38987_at |
| 201416_at | 33131_at |
| 201403_s_at | 39018_at |
| 201397_at | 34367_at |
| 201391_at | 1468_at |
| 201387_at | 36990_at |
| 201386_s_at | 35306_at |
| 201380_at | 40119_at |
| 201375_s_at | 924_s_at |
| 201361_at | 39693_at |
| 201361_at | 39694_at |
| 201347_x_at | 40133_s_at |
| 201339_s_at | 36688_at |
| 201337_s_at | 35783_at |
| 201327_s_at | 38416_at |
| 201312_s_at | 39714_at |
| 201311_s_at | 39714_at |
| 201301_s_at | 37374_at |
| 201300_s_at | 36159_s_at |

TABLE 17-continued

| probeID U133 | probeID U95A |
|---|---|
| 201293_x_at | 33667_at |
| 201289_at | 38772_at |
| 201284_s_at | 37401_g_at |
| 201272_at | 36589_at |
| 201268_at | 1980_s_at |
| 201268_at | 33415_at |
| 201266_at | 39425_at |
| 201264_at | 38647_at |
| 201263_at | 38473_at |
| 201240_s_at | 37359_at |
| 201234_at | 35365_at |
| 201221_s_at | 40875_s_at |
| 201215_at | 34793_s_at |
| 201193_at | 39023_at |
| 201185_at | 719_g_at |
| 201161_s_at | 39839_at |
| 201155_s_at | 34369_at |
| 201153_s_at | 34306_at |
| 201152_s_at | 34306_at |
| 201151_s_at | 34306_at |
| 201150_s_at | 1034_at |
| 201150_s_at | 1035_g_at |
| 201149_s_at | 1034_at |
| 201149_s_at | 1035_g_at |
| 201148_s_at | 1034_at |
| 201148_s_at | 1035_g_at |
| 201147_s_at | 1034_at |
| 201147_s_at | 1035_g_at |
| 201146_at | 853_at |
| 201144_s_at | 1154_at |
| 201144_s_at | 39784_at |
| 201142_at | 1154_at |
| 201142_at | 39784_at |
| 201137_s_at | 38095_i_at |
| 201130_s_at | 977_s_at |
| 201127_s_at | 40881_at |
| 201120_s_at | 38802_at |
| 201115_at | 1470_at |
| 201108_s_at | 115_at |
| 201105_at | 33412_at |
| 201098_at | 36677_at |
| 201091_s_at | 38084_at |
| 201091_s_at | 38085_at |
| 201079_at | 34885_at |
| 201069_at | 39007_at |
| 201061_s_at | 40419_at |
| 201060_x_at | 40419_at |
| 201058_s_at | 39145_at |
| 201042_at | 231_at |
| 201042_at | 38404_at |
| 201040_at | 37307_at |
| 201037_at | 39175_at |
| 201022_s_at | 38385_at |
| 201021_s_at | 38385_at |
| 201020_at | 1424_s_at |
| 201014_s_at | 39056_at |
| 201013_s_at | 39056_at |
| 201005_at | 39389_at |
| 201001_s_at | 36959_at |
| 200996_at | 35271_at |
| 200986_at | 39775_at |
| 200985_s_at | 39351_at |
| 200982_s_at | 39082_at |
| 200974_at | 32755_at |
| 200971_s_at | 37035_at |
| 200970_s_at | 37035_at |
| 200968_s_at | 35823_at |
| 200931_s_at | 36601_at |
| 200930_s_at | 36601_at |
| 200923_at | 37754_at |
| 200911_s_at | 40841_at |
| 200910_at | 40774_at |
| 200907_s_at | 41191_at |
| 200906_s_at | 41191_at |
| 200904_at | 32321_at |
| 200903_s_at | 40821_at |
| 200897_s_at | 41191_at |
| 200894_s_at | 38729_at |
| 200889_s_at | 34648_at |
| 200886_s_at | 41221_at |
| 200884_at | 40862_i_at |
| 200884_at | 40863_r_at |
| 200863_s_at | 36660_at |
| 200859_x_at | 32749_s_at |
| 200859_x_at | 32750_r_at |
| 200836_s_at | 242_at |
| 200836_s_at | 243_g_at |
| 200836_s_at | 32226_at |
| 200835_s_at | 242_at |
| 200835_s_at | 243_g_at |
| 200835_s_at | 32226_at |
| 200823_x_at | 33674_at |
| 200820_at | 1312_at |
| 200820_at | 32584_at |
| 200813_s_at | 32569_at |
| 200808_s_at | 36958_at |
| 200807_s_at | 37720_at |
| 200806_s_at | 37720_at |
| 200803_s_at | 33988_at |
| 200803_s_at | 33989_f_at |
| 200801_x_at | 32318_s_at |
| 200801_x_at | AFFX-HSAC07/X00351_3_at |
| 200801_x_at | AFFX-HSAC07/X00351_3_st |
| 200801_x_at | AFFX-HSAC07/X00351_5_at |
| 200801_x_at | AFFX-HSAC07/X00351_5_st |
| 200801_x_at | AFFX-HSAC07/X00351_M_at |
| 200795_at | 36627_at |
| 200790_at | 1081_at |
| 200790_at | 36203_at |
| 200788_s_at | 32260_at |
| 200778_s_at | 40281_at |
| 200762_at | 40607_at |
| 200750_s_at | 1839_at |
| 200750_s_at | 38708_at |
| 200750_s_at | 1840_g_at |
| 200715_x_at | 35119_at |
| 200700_s_at | 39080_at |
| 200698_at | 39080_at |
| 200696_s_at | 32612_at |
| 200693_at | 409_at |
| 200672_x_at | 39556_at |
| 200671_s_at | 39556_at |
| 200670_at | 39755_at |
| 200670_at | 39756_g_at |
| 200669_s_at | 504_at |
| 200665_s_at | 671_at |
| 200657_at | 37740_r_at |
| 200652_at | 36147_at |
| 200644_at | 36174_at |
| 200625_s_at | 935_at |
| 200622_x_at | 955_at |
| 200621_at | 38700_at |
| 200620_at | 39033_at |
| 200611_s_at | 38736_at |
| 200609_s_at | 38736_at |
| 200604_s_at | 227_g_at |
| 200604_s_at | 41768_at |
| 200082_s_at | 34646_at |
| 200074_s_at | 31907_at |
| 200068_s_at | 40125_at |
| 200066_at | 218_at |
| 200059_s_at | 1394_at |
| 200059_s_at | 37309_at |
| 200055_at | 868_at |
| 200052_s_at | 36189_at |
| 200024_at | 32437_at |
| 200015_s_at | 40281_at |
| 200008_s_at | 35307_at |

SEQUENCE LISTING (38888 sequences)

SEQ ID NO: 1 - DNA, 25 bp, Homo sapiens
gctgggaacgtgtgtccaggctctg

SEQ ID NO: 2 - DNA, 25 bp, Homo sapiens
ggctctgggcacagtgctgcccctt

SEQ ID NO: 3 - DNA, 25 bp, Homo sapiens
gaggcagaaacctatctcagggagg

SEQ ID NO: 4 - DNA, 25 bp, Homo sapiens
gggtgatgcttttgctgctgcttaa

SEQ ID NO: 5 - DNA, 25 bp, Homo sapiens
tgcttttgctgctgcttaatcctac

SEQ ID NO: 6 - DNA, 25 bp, Homo sapiens
cttcaaagcagagtgggacttggag

SEQ ID NO: 7 - DNA, 25 bp, Homo sapiens
ctctcatcatttgcattgggcatta

SEQ ID NO: 8 - DNA, 25 bp, Homo sapiens
tcatttgcattgggcattagtgtcc

SEQ ID NO: 9 - DNA, 25 bp, Homo sapiens
cccccttgaagcaataactccaagc

SEQ ID NO: 10 - DNA, 25 bp, Homo sapiens
tgaagcaataactccaagcagactc

SEQ ID NO: 11 - DNA, 25 bp, Homo sapiens
taggagagcactgcctctatgccct

SEQ ID NO: 12 - DNA, 25 bp, Homo sapiens
gcctctatgccctgcagagcaataa

SEQ ID NO: 13 - DNA, 25 bp, Homo sapiens
gcaagccagggcccagagcccttgg

SEQ ID NO: 14 - DNA, 25 bp, Homo sapiens
cagggcccagagcccttggctgtac

SEQ ID NO: 15 - DNA, 25 bp, Homo sapiens
ccagagcccttggctgtacagagac

SEQ ID NO: 16 - DNA, 25 bp, Homo sapiens
gtatatttgctgcaaagagaaaccg

SEQ ID NO: 17 - DNA, 25 bp, Homo sapiens
gcggcaggcttctcagtctctgtcc

SEQ ID NO: 18 - DNA, 25 bp, Homo sapiens
caggcttctcagtctctgtccgaga

SEQ ID NO: 19 - DNA, 25 bp, Homo sapiens
cttctcagtctctgtccgagacagc

SEQ ID NO: 20 - DNA, 25 bp, Homo sapiens
accacgtggggccatgctgagagct

SEQ ID NO: 21 - DNA, 25 bp, Homo sapiens
ccatgctgagagctgggctttcctc

SEQ ID NO: 22 - DNA, 25 bp, Homo sapiens
agagctgggctttcctctgtgacca

SEQ ID NO: 23 - DNA, 25 bp, Homo sapiens
ctgggctttcctctgtgaccatccc

SEQ ID NO: 24 - DNA, 25 bp, Homo sapiens
ggctttcctctgtgaccatcccggc

SEQ ID NO: 25 - DNA, 25 bp, Homo sapiens
tcctctgtgaccatcccggcctgta

SEQ ID NO: 26 - DNA, 25 bp, Homo sapiens
accatcccggcctgtaacatatctg

SEQ ID NO: 27 - DNA, 25 bp, Homo sapiens
ctgtaacatatctgtaaatagtgag

SEQ ID NO: 28 - DNA, 25 bp, Homo sapiens
atagtgagatggacttggggcctct

SEQ ID NO: 29 - DNA, 25 bp, Homo sapiens
agatggacttggggcctctgacgcc

SEQ ID NO: 30 - DNA, 25 bp, Homo sapiens
tggacttggggcctctgacgccgcg

SEQ ID NO: 31 - DNA, 25 bp, Homo sapiens
ttggggcctctgacgccgcgcactc

SEQ ID NO: 32 - DNA, 25 bp, Homo sapiens
tgacgccgcgcactcagccgtgggc

SEQ ID NO: 33 - DNA, 25 bp, Homo sapiens
gttccttctgcggctattgctgaac

SEQ ID NO: 34 - DNA, 25 bp, Homo sapiens
cacttggcctatctgctggacctgc

SEQ ID NO: 35 - DNA, 25 bp, Homo sapiens
gcctatctgctggacctgctggggc

SEQ ID NO: 36 - DNA, 25 bp, Homo sapiens
gacctgctggggcagagttgattgc

SEQ ID NO: 37 - DNA, 25 bp, Homo sapiens
ggggtgcatcattggggattctgcc

SEQ ID NO: 38 - DNA, 25 bp, Homo sapiens
ttctgcctcaggtactttgatagag

SEQ ID NO: 39 - DNA, 25 bp, Homo sapiens
ttgctttggagatcagcctcacctt

SEQ ID NO: 40 - DNA, 25 bp, Homo sapiens
tacagtttcactcatgaagcacctt

SEQ ID NO: 41 - DNA, 25 bp, Homo sapiens
catgaagcaccttgatctttggtgt

SEQ ID NO: 42 - DNA, 25 bp, Homo sapiens
tgatctttggtgtcctggacttcat

SEQ ID NO: 43 - DNA, 25 bp, Homo sapiens
acttcatcctgggtgctgcagatac

SEQ ID NO: 44 - DNA, 25 bp, Homo sapiens
tcctgggtgctgcagatactgcagt

SEQ ID NO: 45 - DNA, 25 bp, Homo sapiens
gtgctgcagatactgcagtgaagta

SEQ ID NO: 46 - DNA, 25 bp, Homo sapiens
ggaggcactcgaggagaacgagctc

SEQ ID NO: 47 - DNA, 25 bp, Homo sapiens
caccagcctggcagaggacttgctg

SEQ ID NO: 48 - DNA, 25 bp, Homo sapiens
ctagaccaggggtgcagccagcttt

SEQ ID NO: 49 - DNA, 25 bp, Homo sapiens
aataacttgaaggcccgcaattcct

SEQ ID NO: 50 - DNA, 25 bp, Homo sapiens
caattccttccgctacaacggactg

SEQ ID NO: 51 - DNA, 25 bp, Homo sapiens
ttccgctacaacggactgattcacc

SEQ ID NO: 52 - DNA, 25 bp, Homo sapiens
gattcaccgcaagactgtgggcgtg

SEQ ID NO: 53 - DNA, 25 bp, Homo sapiens
caagactgtgggcgtggagccggca

SEQ ID NO: 54 - DNA, 25 bp, Homo sapiens
agccgacggcaaaggtgtcgtggtg

SEQ ID NO: 55 - DNA, 25 bp, Homo sapiens
ggtgtcgtggtggtcattaagcgga

SEQ ID NO: 56 - DNA, 25 bp, Homo sapiens
ggtggtcattaagcggagatccggc

SEQ ID NO: 57 - DNA, 25 bp, Homo sapiens
ttaagcggagatccggccagcggaa

SEQ ID NO: 58 - DNA, 25 bp, Homo sapiens
cctgcgcatggcagccatccgcagg

SEQ ID NO: 59 - DNA, 25 bp, Homo sapiens
aatggatggtcgtgcggaactgctc

SEQ ID NO: 60 - DNA, 25 bp, Homo sapiens
cagatatctacgtctgcatgatctc

SEQ ID NO: 61 - DNA, 25 bp, Homo sapiens
tgatctcctttgcgcacaatgtagc

SEQ ID NO: 62 - DNA, 25 bp, Homo sapiens
gaccagctttggagctcttggaacc

SEQ ID NO: 63 - DNA, 25 bp, Homo sapiens
gttagcatcagtgacctcctggtac

SEQ ID NO: 64 - DNA, 25 bp, Homo sapiens
gatctttatttcccgcacatatgat

SEQ ID NO: 65 - DNA, 25 bp, Homo sapiens
atgatgccaccactcattttgagac

SEQ ID NO: 66 - DNA, 25 bp, Homo sapiens
gctcgctgtaagcagctcatctgtg

SEQ ID NO: 67 - DNA, 25 bp, Homo sapiens
tgtgaccccagctacgtaaaagatc

SEQ ID NO: 68 - DNA, 25 bp, Homo sapiens
agtgggccaggtgatcagagttatt

SEQ ID NO: 69 - DNA, 25 bp, Homo sapiens
cagagttatttgcatcctcagccac

SEQ ID NO: 70 - DNA, 25 bp, Homo sapiens
tattccacagaaccaagtcaatcga

SEQ ID NO: 71 - DNA, 25 bp, Homo sapiens
atctggtgttcttgctaactttgcc

SEQ ID NO: 72 - DNA, 25 bp, Homo sapiens
tgcccttcactgttgcttaattgtg

SEQ ID NO: 73 - DNA, 25 bp, Homo sapiens
acatccatgcggagtccattatttg

SEQ ID NO: 74 - DNA, 25 bp, Homo sapiens
aagtttgctagtgactaagccccgc

SEQ ID NO: 75 - DNA, 25 bp, Homo sapiens
gactaagccccgcatatgtgagtga

SEQ ID NO: 76 - DNA, 25 bp, Homo sapiens
gtgaaagtacttcaggcacgctgcc

SEQ ID NO: 77 - DNA, 25 bp, Homo sapiens
cctcctggtaacagctatgcaggga

SEQ ID NO: 78 - DNA, 25 bp, Homo sapiens
tatgcagggagggaggacccacact

SEQ ID NO: 79 - DNA, 25 bp, Homo sapiens
gataactgctcttttactaagacat

SEQ ID NO: 80 - DNA, 25 bp, Homo sapiens
taagacatagtctctacctatagaa

SEQ ID NO: 81 - DNA, 25 bp, Homo sapiens
aacacttattttacacagcaatttt

SEQ ID NO: 82 - DNA, 25 bp, Homo sapiens
gtttctggccagaagaaccaactcc

SEQ ID NO: 83 - DNA, 25 bp, Homo sapiens
aaccaactccacattcaaccaggtt

SEQ ID NO: 84 - DNA, 25 bp, Homo sapiens
gttgtttatgagtcgcaccaaccgg

SEQ ID NO: 85 - DNA, 25 bp, Homo sapiens
tgtccctttcccggatgatccggaa

SEQ ID NO: 86 - DNA, 25 bp, Homo sapiens
gaagcttcctggccgggaaaacaag

SEQ ID NO: 87 - DNA, 25 bp, Homo sapiens
gatgatgtgcgggttcaggaggtac

SEQ ID NO: 88 - DNA, 25 bp, Homo sapiens
aactgaaggtatgtgcactgcgcgt

SEQ ID NO: 89 - DNA, 25 bp, Homo sapiens
ggtcctcgcaagggccgagaggtgt

SEQ ID NO: 90 - DNA, 25 bp, Homo sapiens
aggtgtaccggcatttcggcaaggc

SEQ ID NO: 91 - DNA, 25 bp, Homo sapiens
gaaaggttcggcgcaaggagcccaa

SEQ ID NO: 92 - DNA, 25 bp, Homo sapiens
ggatatctacctgaggctgttggtc

SEQ ID NO: 93 - DNA, 25 bp, Homo sapiens
cctccctcacagtgcagggcggtat

SEQ ID NO: 94 - DNA, 25 bp, Homo sapiens
gggcggtatgccgcaaacgctttcc

SEQ ID NO: 95 - DNA, 25 bp, Homo sapiens
aacgctttccgcaaagctcagtgtc

SEQ ID NO: 96 - DNA, 25 bp, Homo sapiens
gctcagtgtcccattgtggagcgcc

SEQ ID NO: 97 - DNA, 25 bp, Homo sapiens
cgcctcactaactccatgatgatgc

SEQ ID NO: 98 - DNA, 25 bp, Homo sapiens
tgcacggccgcaacaacggcaagaa

SEQ ID NO: 99 - DNA, 25 bp, Homo sapiens
catcgtcaagcatgccttcgagatc

SEQ ID NO: 100 - DNA, 25 bp, Homo sapiens
cttcgagatcatacacctgctcacg

SEQ ID NO: 101 - DNA, 25 bp, Homo sapiens
gaacgccatcatcaacagtggtccc

SEQ ID NO: 102 - DNA, 25 bp, Homo sapiens
tccggaacattaagaccattgctga

SEQ ID NO: 103 - DNA, 25 bp, Homo sapiens
aagtccaaccgctgattttccagct

SEQ ID NO: 104 - DNA, 25 bp, Homo sapiens
ttactgtgactgagtcggcccattc

SEQ ID NO: 105 - DNA, 25 bp, Homo sapiens
gagtggggatggtcgagtatctcag

SEQ ID NO: 106 - DNA, 25 bp, Homo sapiens
tatgccctgcgtaaactggatgaca

SEQ ID NO: 107 - DNA, 25 bp, Homo sapiens
ctggatgacaccaaattccgctctc

SEQ ID NO: 108 - DNA, 25 bp, Homo sapiens
aattccgctctcatgagggtgaaac

SEQ ID NO: 109 - DNA, 25 bp, Homo sapiens
ttttaggttaactgagctgctttgt

SEQ ID NO: 110 - DNA, 25 bp, Homo sapiens
gctttgtgctcagaatctacattcc

SEQ ID NO: 111 - DNA, 25 bp, Homo sapiens
actacataatttctaccagggccat

SEQ ID NO: 112 - DNA, 25 bp, Homo sapiens
tgtatatttttcacccctgattatg

SEQ ID NO: 113 - DNA, 25 bp, Homo sapiens
aatcgttctgtctttgtggggttcg

SEQ ID NO: 114 - DNA, 25 bp, Homo sapiens
gtggggttcgctctactatggagat

SEQ ID NO: 115 - DNA, 25 bp, Homo sapiens
ctttcaccttaaagctctgccaagc

SEQ ID NO: 116 - DNA, 25 bp, Homo sapiens
cagaggctcccgtgcaggaagagaa

SEQ ID NO: 117 - DNA, 25 bp, Homo sapiens
gcacctcaaatttgccatgctggct

SEQ ID NO: 118 - DNA, 25 bp, Homo sapiens
catgctctaatttccgggctaaaac

SEQ ID NO: 119 - DNA, 25 bp, Homo sapiens
aaatcacatgcagctcatctaagag

SEQ ID NO: 120 - DNA, 25 bp, Homo sapiens
atgagttcaaaagctgccgctcagc

SEQ ID NO: 121 - DNA, 25 bp, Homo sapiens
gccgctcagctttgatggaacaacg

SEQ ID NO: 122 - DNA, 25 bp, Homo sapiens
tcattcgtcagcgacaattggacag

SEQ ID NO: 123 - DNA, 25 bp, Homo sapiens
aaatcgagtccatatagctacattc

SEQ ID NO: 124 - DNA, 25 bp, Homo sapiens
ccacccttgtatcctgggtcttaga

SEQ ID NO: 125 - DNA, 25 bp, Homo sapiens
tgaaatggactgatttgcactcttg

SEQ ID NO: 126 - DNA, 25 bp, Homo sapiens
cgaatcctctcacatggtggcttta

SEQ ID NO: 127 - DNA, 25 bp, Homo sapiens
aatcctctcacatggtggctttagg

SEQ ID NO: 128 - DNA, 25 bp, Homo sapiens
ggtggctttaggaagatccttggcc

SEQ ID NO: 129 - DNA, 25 bp, Homo sapiens
tgatgccagctatcttgcttctgaa

SEQ ID NO: 130 - DNA, 25 bp, Homo sapiens
cttgcttctgaaatatctacctggg

SEQ ID NO: 131 - DNA, 25 bp, Homo sapiens
aaatatctacctgggatggagtgat

SEQ ID NO: 132 - DNA, 25 bp, Homo sapiens
ggagtgatagtaacaccttcagaaa

SEQ ID NO: 133 - DNA, 25 bp, Homo sapiens
tggaaactcaggagtgacattccct

SEQ ID NO: 134 - DNA, 25 bp, Homo sapiens
atattctataatctccaactcctga

SEQ ID NO: 135 - DNA, 25 bp, Homo sapiens
ggacatggtctgctatacagctcag

SEQ ID NO: 136 - DNA, 25 bp, Homo sapiens
ctgctatacagctcagactctcgtc

SEQ ID NO: 137 - DNA, 25 bp, Homo sapiens
gtccagcacgcctttggtggacttc

SEQ ID NO: 138 - DNA, 25 bp, Homo sapiens
tggtggacttcttgatgcagctgga

SEQ ID NO: 139 - DNA, 25 bp, Homo sapiens
tggaagattacacgcctacgatccc

SEQ ID NO: 140 - DNA, 25 bp, Homo sapiens
acctgaaccgtgctggctttgaggc

SEQ ID NO: 141 - DNA, 25 bp, Homo sapiens
tcagacccacgcataattcggctca

SEQ ID NO: 142 - DNA, 25 bp, Homo sapiens
tcatctccttagctgcccagaaatt

SEQ ID NO: 143 - DNA, 25 bp, Homo sapiens
attgccaatgatgccctacagcact

SEQ ID NO: 144 - DNA, 25 bp, Homo sapiens
agcaaggaccgcaagtacactctaa

SEQ ID NO: 145 - DNA, 25 bp, Homo sapiens
taaccatggaggacttgacccctgc

SEQ ID NO: 146 - DNA, 25 bp, Homo sapiens
tgaagaagccgcactacttcacctg

SEQ ID NO: 147 - DNA, 25 bp, Homo sapiens
tgagccacccaacctaaatgtactt

SEQ ID NO: 148 - DNA, 25 bp, Homo sapiens
aactaacatgtcctgcctattatct

SEQ ID NO: 149 - DNA, 25 bp, Homo sapiens
attatctgtcagctgcaaggtactc

SEQ ID NO: 150 - DNA, 25 bp, Homo sapiens
gcaaggtactctggtgagtcaccac

SEQ ID NO: 151 - DNA, 25 bp, Homo sapiens
acttcagggctttactccgtaacag

SEQ ID NO: 152 - DNA, 25 bp, Homo sapiens
gttacagttctgtggtttcatgtta

SEQ ID NO: 153 - DNA, 25 bp, Homo sapiens
agtgccacttaatgtatgttaccaa

SEQ ID NO: 154 - DNA, 25 bp, Homo sapiens
gatttcctaatactgtcatcctcaa

SEQ ID NO: 155 - DNA, 25 bp, Homo sapiens
tattaacgatgtccaacccgtctgg

SEQ ID NO: 156 - DNA, 25 bp, Homo sapiens
gtccttttgacactgctctaacagc

SEQ ID NO: 157 - DNA, 25 bp, Homo sapiens
gacacaccaggcgctaattcaagga

SEQ ID NO: 158 - DNA, 25 bp, Homo sapiens
ggaatttcttaacttcttgcttctt

SEQ ID NO: 159 - DNA, 25 bp, Homo sapiens
gtggtggtggcgcagcagactgcga

SEQ ID NO: 160 - DNA, 25 bp, Homo sapiens
cgcagcagactgcgatcaattctgc

SEQ ID NO: 161 - DNA, 25 bp, Homo sapiens
tgcatggtcacagtagagatccccg

SEQ ID NO: 162 - DNA, 25 bp, Homo sapiens
cctgcattccatagccatgtgcttg

SEQ ID NO: 163 - DNA, 25 bp, Homo sapiens
tgcattccatagccatgtgcttgtc

SEQ ID NO: 164 - DNA, 25 bp, Homo sapiens
tgctcgctcagacactttggcagga

SEQ ID NO: 165 - DNA, 25 bp, Homo sapiens
cactttggcaggatgtctggggcct

SEQ ID NO: 166 - DNA, 25 bp, Homo sapiens
ccacctctgtgtgtgatgtagcttt

SEQ ID NO: 167 - DNA, 25 bp, Homo sapiens
gccatcgaaaaagacaacctctact

SEQ ID NO: 168 - DNA, 25 bp, Homo sapiens
gaacctcttactgctttcaatacac

SEQ ID NO: 169 - DNA, 25 bp, Homo sapiens
cttactgctttcaatacacgattag

SEQ ID NO: 170 - DNA, 25 bp, Homo sapiens
gaaaagtttgctgggtctgctggct

SEQ ID NO: 171 - DNA, 25 bp, Homo sapiens
ggctgggaaggcacagaatcgctga

SEQ ID NO: 172 - DNA, 25 bp, Homo sapiens
aaagcagctgggagatttctttggc

SEQ ID NO: 173 - DNA, 25 bp, Homo sapiens
agttatgcagagtgctacccagcca

SEQ ID NO: 174 - DNA, 25 bp, Homo sapiens
gctacccagccacgatggatgacat

SEQ ID NO: 175 - DNA, 25 bp, Homo sapiens
gggactttgatacccaggaagaata

SEQ ID NO: 176 - DNA, 25 bp, Homo sapiens
gaagggcggaaaaccaggcgcttca

SEQ ID NO: 177 - DNA, 25 bp, Homo sapiens
aaagcagagcttgatcgccagtgga

SEQ ID NO: 178 - DNA, 25 bp, Homo sapiens
gaagatggaagctgatggggttgaa

SEQ ID NO: 179 - DNA, 25 bp, Homo sapiens
ctagttacaaccagagatgctccac

SEQ ID NO: 180 - DNA, 25 bp, Homo sapiens
gatgctccacaaggatatgctcccc

SEQ ID NO: 181 - DNA, 25 bp, Homo sapiens
cctctcccacaccactatagtgtaa

SEQ ID NO: 182 - DNA, 25 bp, Homo sapiens
ttcttgctgttcagtgctttttcct

SEQ ID NO: 183 - DNA, 25 bp, Homo sapiens
ttttccttttcatctgttgttctgt

SEQ ID NO: 184 - DNA, 25 bp, Homo sapiens
gtcacagtgaccttagctacatagc

SEQ ID NO: 185 - DNA, 25 bp, Homo sapiens
agctacatagcagactttcccaaat

SEQ ID NO: 186 - DNA, 25 bp, Homo sapiens
atgtctgcaggtttctccttgaagc

SEQ ID NO: 187 - DNA, 25 bp, Homo sapiens
ttgcatttccagaaatctgcctcct

SEQ ID NO: 188 - DNA, 25 bp, Homo sapiens
cttcaccctccgttgacagtatatg

SEQ ID NO: 189 - DNA, 25 bp, Homo sapiens
cagtatatgtcatgcctcactttct

SEQ ID NO: 190 - DNA, 25 bp, Homo sapiens
ctcactttcttctagctgagcttta

SEQ ID NO: 191 - DNA, 25 bp, Homo sapiens
attgtcagatcgttcattgcctttc

SEQ ID NO: 192 - DNA, 25 bp, Homo sapiens
tcagaacagggctttggtcgatgga

SEQ ID NO: 193 - DNA, 25 bp, Homo sapiens
ggctttggtcgatggaccttgcact

SEQ ID NO: 194 - DNA, 25 bp, Homo sapiens
tgcctttcaagtgcatgcagctcac

SEQ ID NO: 195 - DNA, 25 bp, Homo sapiens
atgcagctcactgatttcatcctca

SEQ ID NO: 196 - DNA, 25 bp, Homo sapiens
aaatgggcagccacacgatgggcca

SEQ ID NO: 197 - DNA, 25 bp, Homo sapiens
ggcagccacacgatgggccaagaag

SEQ ID NO: 198 - DNA, 25 bp, Homo sapiens
aagatgacagattttgatcgtttta

SEQ ID NO: 199 - DNA, 25 bp, Homo sapiens
gaagcttcaaaaggcagctctcctg

SEQ ID NO: 200 - DNA, 25 bp, Homo sapiens
tcccaaaaaagcacctggtactaag

SEQ ID NO: 201 - DNA, 25 bp, Homo sapiens
gcacctggtactaagggtactgctg

SEQ ID NO: 202 - DNA, 25 bp, Homo sapiens
tgctgctgctaaagttccagcaaaa

SEQ ID NO: 203 - DNA, 25 bp, Homo sapiens
tcactctggacccagggctgacatc

SEQ ID NO: 204 - DNA, 25 bp, Homo sapiens
ccgcatctgtgtgctggacgtggac

SEQ ID NO: 205 - DNA, 25 bp, Homo sapiens
ggacctgcagggtgtgcggaacatc

SEQ ID NO: 206 - DNA, 25 bp, Homo sapiens
gtgcggaacatcaaggccaccgatc

SEQ ID NO: 207 - DNA, 25 bp, Homo sapiens
gcggcagcgcaacactgaaaccgag

SEQ ID NO: 208 - DNA, 25 bp, Homo sapiens
tgcccaggccgacatggagagcagc

SEQ ID NO: 209 - DNA, 25 bp, Homo sapiens
gatgtggtcatcattaacgacagcc

SEQ ID NO: 210 - DNA, 25 bp, Homo sapiens
tcatcattaacgacagcctggacca

SEQ ID NO: 211 - DNA, 25 bp, Homo sapiens
gaaggaggcgctctctgaggaaatc

SEQ ID NO: 212 - DNA, 25 bp, Homo sapiens
aatcaagaaagctcaaaggaccggc

SEQ ID NO: 213 - DNA, 25 bp, Homo sapiens
cccttggccagcatgtggagtggag

SEQ ID NO: 214 - DNA, 25 bp, Homo sapiens
ccaaggccatcggccatcggaacta

SEQ ID NO: 215 - DNA, 25 bp, Homo sapiens
atcggaactaccatgcaggctactc

SEQ ID NO: 216 - DNA, 25 bp, Homo sapiens
tgcaggctactccatgtttggggct

SEQ ID NO: 217 - DNA, 25 bp, Homo sapiens
gtctaacctcttctgtggagtctgc

SEQ ID NO: 218 - DNA, 25 bp, Homo sapiens
agtctgcgtgggcatcgtgggcagt

SEQ ID NO: 219 - DNA, 25 bp, Homo sapiens
catcgtggagatctttggcagcgcc

SEQ ID NO: 220 - DNA, 25 bp, Homo sapiens
gtcatcgtcgcaattcttcagacct

SEQ ID NO: 221 - DNA, 25 bp, Homo sapiens
ccctcttgctgcgtgttgatttgga

SEQ ID NO: 222 - DNA, 25 bp, Homo sapiens
gatttggaggcactgcagtccaggc

SEQ ID NO: 223 - DNA, 25 bp, Homo sapiens
tgctgctgactctgtgcagctgcgc

SEQ ID NO: 224 - DNA, 25 bp, Homo sapiens
tcaacccatcttcctagtgtttgtg

SEQ ID NO: 225 - DNA, 25 bp, Homo sapiens
agaaagccatgttcagttcgagcgc

SEQ ID NO: 226 - DNA, 25 bp, Homo sapiens
tcgagcgccaagatcgtgaagccca

SEQ ID NO: 227 - DNA, 25 bp, Homo sapiens
gaagcccaatggcgagaagccggac

SEQ ID NO: 228 - DNA, 25 bp, Homo sapiens
cggacgagttcgagtccggcatctc

SEQ ID NO: 229 - DNA, 25 bp, Homo sapiens
ggagctggagatgaactcggacctc

SEQ ID NO: 230 - DNA, 25 bp, Homo sapiens
tggagatgaactcggacctcaaggc

SEQ ID NO: 231 - DNA, 25 bp, Homo sapiens
gaagttggtggtggtcggaaagcta

SEQ ID NO: 232 - DNA, 25 bp, Homo sapiens
gctatcataatctttgttcccgttc

SEQ ID NO: 233 - DNA, 25 bp, Homo sapiens
ttcccgttcctcaactgaaatcttt

SEQ ID NO: 234 - DNA, 25 bp, Homo sapiens
gttcagtgggaagcatgtcgtcttt

SEQ ID NO: 235 - DNA, 25 bp, Homo sapiens
gaagcatgtcgtctttatcgctcag

SEQ ID NO: 236 - DNA, 25 bp, Homo sapiens
ctggtggcgacacgatctttgggaa

SEQ ID NO: 237 - DNA, 25 bp, Homo sapiens
ttttgaggatgaccggtgccttgct

SEQ ID NO: 238 - DNA, 25 bp, Homo sapiens
ctcaagcaccaacacattttctggt

SEQ ID NO: 239 - DNA, 25 bp, Homo sapiens
acacattttctggtgatacccaaga

SEQ ID NO: 240 - DNA, 25 bp, Homo sapiens
acccaagaaacatatatcccagatt

SEQ ID NO: 241 - DNA, 25 bp, Homo sapiens
agaaatgtgctgctgatctgggcct

SEQ ID NO: 242 - DNA, 25 bp, Homo sapiens
gatctgggcctgaataagggttatc

SEQ ID NO: 243 - DNA, 25 bp, Homo sapiens
atgaaggttcagatggtggacagtc

SEQ ID NO: 244 - DNA, 25 bp, Homo sapiens
atgttcttggaggtcggcaaatgca

SEQ ID NO: 245 - DNA, 25 bp, Homo sapiens
caaatgcattggcctcctggttaag

SEQ ID NO: 246 - DNA, 25 bp, Homo sapiens
tcctggttaagcacgttttggggat

SEQ ID NO: 247 - DNA, 25 bp, Homo sapiens
cgagcccatcttggctgacggggct

SEQ ID NO: 248 - DNA, 25 bp, Homo sapiens
cctggacaaaggtcgtgccatgttc

SEQ ID NO: 249 - DNA, 25 bp, Homo sapiens
ccatgttcttagtggccaagtgcca

SEQ ID NO: 250 - DNA, 25 bp, Homo sapiens
agctctggaggctgccatcgagaac

SEQ ID NO: 251 - DNA, 25 bp, Homo sapiens
aaaggttgactgcaaagagcgcatc

SEQ ID NO: 252 - DNA, 25 bp, Homo sapiens
aagagcgcatcagggacgtcgttta

SEQ ID NO: 253 - DNA, 25 bp, Homo sapiens
ccctctcatggggtacccttgataa

SEQ ID NO: 254 - DNA, 25 bp, Homo sapiens
gtacccttgataaaccatctctaga

SEQ ID NO: 255 - DNA, 25 bp, Homo sapiens
tgctgggctgctgtgcagagtataa

SEQ ID NO: 256 - DNA, 25 bp, Homo sapiens
gatgtatttgtgacaccctatcttg

SEQ ID NO: 257 - DNA, 25 bp, Homo sapiens
acaccctatcttgtcaataaacagc

SEQ ID NO: 258 - DNA, 25 bp, Homo sapiens
cctgctgcatgtcacagacaccggt

SEQ ID NO: 259 - DNA, 25 bp, Homo sapiens
tggtaccatagccaaatctgggaca

SEQ ID NO: 260 - DNA, 25 bp, Homo sapiens
ggaagatggccagtcaacttctgaa

SEQ ID NO: 261 - DNA, 25 bp, Homo sapiens
gattggccagtttggtgtcggtttc

SEQ ID NO: 262 - DNA, 25 bp, Homo sapiens
tttggtgtcggtttctattccgcct

SEQ ID NO: 263 - DNA, 25 bp, Homo sapiens
aaaacacaacaacgatacccagcac

SEQ ID NO: 264 - DNA, 25 bp, Homo sapiens
ccagcacatctgggagtctgactcc

SEQ ID NO: 265 - DNA, 25 bp, Homo sapiens
gtctgactccaatgaattttctgta

SEQ ID NO: 266 - DNA, 25 bp, Homo sapiens
attgctgacccaagaggaaacactc

SEQ ID NO: 267 - DNA, 25 bp, Homo sapiens
acactctaggacggggaacgacaat

SEQ ID NO: 268 - DNA, 25 bp, Homo sapiens
gaagcatctgattaccttgaattgg

SEQ ID NO: 269 - DNA, 25 bp, Homo sapiens
tagtcttggggcaggatgattttgg

SEQ ID NO: 270 - DNA, 25 bp, Homo sapiens
gattttggcctcattactttaccac

SEQ ID NO: 271 - DNA, 25 bp, Homo sapiens
gatgtcatctgtcactataggtcat

SEQ ID NO: 272 - DNA, 25 bp, Homo sapiens
actataggtcatacaatccattctt

SEQ ID NO: 273 - DNA, 25 bp, Homo sapiens
ttattattactgtttgtcttctccc

SEQ ID NO: 274 - DNA, 25 bp, Homo sapiens
tgaggagtcttgtgtgcattgctgt

SEQ ID NO: 275 - DNA, 25 bp, Homo sapiens
gcattgctgtgaattagctcacttg

SEQ ID NO: 276 - DNA, 25 bp, Homo sapiens
gctcacttggtgatatgtcctatat

SEQ ID NO: 277 - DNA, 25 bp, Homo sapiens
atagctgccttaaagtcagtaactt

SEQ ID NO: 278 - DNA, 25 bp, Homo sapiens
cagtaacttacccttagggaggctg

SEQ ID NO: 279 - DNA, 25 bp, Homo sapiens
ggaggggtttatgctcaatccatgt

SEQ ID NO: 280 - DNA, 25 bp, Homo sapiens
tctctctttgtgggttggccaggag

SEQ ID NO: 281 - DNA, 25 bp, Homo sapiens
tctctttgtgggttggccaggaggt

SEQ ID NO: 282 - DNA, 25 bp, Homo sapiens
gccagcgcttctggtctggtaaata

SEQ ID NO: 283 - DNA, 25 bp, Homo sapiens
agcgcttctggtctggtaaatatgt

SEQ ID NO: 284 - DNA, 25 bp, Homo sapiens
gcttctggtctggtaaatatgtatg

SEQ ID NO: 285 - DNA, 25 bp, Homo sapiens
taaccaaggaggggccagtggattc

SEQ ID NO: 286 - DNA, 25 bp, Homo sapiens
ccatgtgccttgtccagggaactgc

SEQ ID NO: 287 - DNA, 25 bp, Homo sapiens
ctgggccatgcgaggggccagcaga

SEQ ID NO: 288 - DNA, 25 bp, Homo sapiens
gactcacttgccattgccaggagat

SEQ ID NO: 289 - DNA, 25 bp, Homo sapiens
tgccaggagatggccccaacaagca

SEQ ID NO: 290 - DNA, 25 bp, Homo sapiens
gaggagctgagttggcagaccgggc

SEQ ID NO: 291 - DNA, 25 bp, Homo sapiens
tgctgtgctacaacgtcggtcagaa

SEQ ID NO: 292 - DNA, 25 bp, Homo sapiens
actactgatgaatcgtcctcgtgct

SEQ ID NO: 293 - DNA, 25 bp, Homo sapiens
tgaagtgcgttaagctggaccgacc

SEQ ID NO: 294 - DNA, 25 bp, Homo sapiens
tggaccgacctagatttgaacgtgt

SEQ ID NO: 295 - DNA, 25 bp, Homo sapiens
atttgaacgtgttcttggcccatgc

SEQ ID NO: 296 - DNA, 25 bp, Homo sapiens
ccaatccatgcttcactcatgcaaa

SEQ ID NO: 297 - DNA, 25 bp, Homo sapiens
gcttcactcatgcaaactgctttat

SEQ ID NO: 298 - DNA, 25 bp, Homo sapiens
attgcaccattttcaatttggagca

SEQ ID NO: 299 - DNA, 25 bp, Homo sapiens
agtgggaacgtcttacggtagctga

SEQ ID NO: 300 - DNA, 25 bp, Homo sapiens
gtagctgatgcattggaaccagtgc

SEQ ID NO: 301 - DNA, 25 bp, Homo sapiens
attttagaggggtcagctgctgtgc

SEQ ID NO: 302 - DNA, 25 bp, Homo sapiens
gtaaaggctgttctggctttttatc

SEQ ID NO: 303 - DNA, 25 bp, Homo sapiens
ctttttatcttcttagctcatctta

SEQ ID NO: 304 - DNA, 25 bp, Homo sapiens
ggatgcagtgcgtctgaagtgctaa

SEQ ID NO: 305 - DNA, 25 bp, Homo sapiens
cgaacttaggatttgtttcttctct

SEQ ID NO: 306 - DNA, 25 bp, Homo sapiens
tcttctcttctgtgtttcgattttt

SEQ ID NO: 307 - DNA, 25 bp, Homo sapiens
attttagtcattctgcttctcatct

SEQ ID NO: 308 - DNA, 25 bp, Homo sapiens
taggagaaaattaccctcccagcac

SEQ ID NO: 309 - DNA, 25 bp, Homo sapiens
tggaatgagtctcctttagtttcag

SEQ ID NO: 310 - DNA, 25 bp, Homo sapiens
ataacccatatactcttcgatgtac

SEQ ID NO: 311 - DNA, 25 bp, Homo sapiens
actcttcgatgtacttgtttggttt

SEQ ID NO: 312 - DNA, 25 bp, Homo sapiens
gacagcggcaatcttttctttggtc

SEQ ID NO: 313 - DNA, 25 bp, Homo sapiens
ggctctcactatctgtcaggggagg

SEQ ID NO: 314 - DNA, 25 bp, Homo sapiens
gcaaagccggaattctgtgttgaac

SEQ ID NO: 315 - DNA, 25 bp, Homo sapiens
tgaacagatgtctgtctccctagtg

SEQ ID NO: 316 - DNA, 25 bp, Homo sapiens
agtgtgtgactcacaccttgtggct

SEQ ID NO: 317 - DNA, 25 bp, Homo sapiens
cgccacctccagatcagatggggac

SEQ ID NO: 318 - DNA, 25 bp, Homo sapiens
gacacacaacccctggatatgtttc

SEQ ID NO: 319 - DNA, 25 bp, Homo sapiens
gttgcctgtcagtgtttacaaacta

SEQ ID NO: 320 - DNA, 25 bp, Homo sapiens
tgacggcaccgtgtccaagttttta

SEQ ID NO: 321 - DNA, 25 bp, Homo sapiens
tttagaacccttgttagccagaccg

SEQ ID NO: 322 - DNA, 25 bp, Homo sapiens
tagccagaccgaggtgtcctggtca

SEQ ID NO: 323 - DNA, 25 bp, Homo sapiens
accatcatgctttgatgttcccctg

SEQ ID NO: 324 - DNA, 25 bp, Homo sapiens
ggtttggttttgtagacttcaacag

SEQ ID NO: 325 - DNA, 25 bp, Homo sapiens
ggaggccatggaagacggtgaaatt

SEQ ID NO: 326 - DNA, 25 bp, Homo sapiens
tggactgggccaaacctaagggtga

SEQ ID NO: 327 - DNA, 25 bp, Homo sapiens
gaggtggtggtagaggaggccgagg

SEQ ID NO: 328 - DNA, 25 bp, Homo sapiens
aagtttgaatagcttctgtccctct

SEQ ID NO: 329 - DNA, 25 bp, Homo sapiens
tggggtttttactgttacctgatca

SEQ ID NO: 330 - DNA, 25 bp, Homo sapiens
acctgatcaatgacagagccttctg

SEQ ID NO: 331 - DNA, 25 bp, Homo sapiens
gacagtatacagtcctgtggtctcc

SEQ ID NO: 332 - DNA, 25 bp, Homo sapiens
tgtggtctccttggaaatccgtcta

SEQ ID NO: 333 - DNA, 25 bp, Homo sapiens
gggcaataccgtgttggttttgact

SEQ ID NO: 334 - DNA, 25 bp, Homo sapiens
atagagctaacccttatctgtaagt

SEQ ID NO: 335 - DNA, 25 bp, Homo sapiens
catgcaaaaatcgtctgcctggcct

SEQ ID NO: 336 - DNA, 25 bp, Homo sapiens
tggcctggtccccagacaatgaaca

SEQ ID NO: 337 - DNA, 25 bp, Homo sapiens
agacaatgaacactttgcctccggt

SEQ ID NO: 338 - DNA, 25 bp, Homo sapiens
actttgcctccggtggcatggacat

SEQ ID NO: 339 - DNA, 25 bp, Homo sapiens
gtgtatgtttggaccctgagtgacc

SEQ ID NO: 340 - DNA, 25 bp, Homo sapiens
aagatccaagatgcacaccggctgc

SEQ ID NO: 341 - DNA, 25 bp, Homo sapiens
atgatgcctctgtcaaggagtggac

SEQ ID NO: 342 - DNA, 25 bp, Homo sapiens
aggagtggacaatcacctactgagg

SEQ ID NO: 343 - DNA, 25 bp, Homo sapiens
ccgcctctggatggaccgaatcagg

SEQ ID NO: 344 - DNA, 25 bp, Homo sapiens
aactgcagcggaacatgtcatttct

SEQ ID NO: 345 - DNA, 25 bp, Homo sapiens
tcgtctctgcagggtgtctgtacac

SEQ ID NO: 346 - DNA, 25 bp, Homo sapiens
gggcaggacatgctgtaccaatccc

SEQ ID NO: 347 - DNA, 25 bp, Homo sapiens
taccaatccctgaagctcactaatg

SEQ ID NO: 348 - DNA, 25 bp, Homo sapiens
tggccgaactacgtatccagccagg

SEQ ID NO: 349 - DNA, 25 bp, Homo sapiens
cagccaggaaaccccaattacacgc

SEQ ID NO: 350 - DNA, 25 bp, Homo sapiens
gagctcctgaagtctctcaatacat

SEQ ID NO: 351 - DNA, 25 bp, Homo sapiens
atacatctatcaggtctacgacagc

SEQ ID NO: 352 - DNA, 25 bp, Homo sapiens
caagactggtccagtacccttcaac

SEQ ID NO: 353 - DNA, 25 bp, Homo sapiens
acccttcaaccatgctgtgatcggt

SEQ ID NO: 354 - DNA, 25 bp, Homo sapiens
gtaactagtctaacctgtgctaaca

SEQ ID NO: 355 - DNA, 25 bp, Homo sapiens
gatagttttagcttcctgtgaacat

SEQ ID NO: 356 - DNA, 25 bp, Homo sapiens
gccaatggctggctttttctacacc

SEQ ID NO: 357 - DNA, 25 bp, Homo sapiens
agaagagcacagagccctgaggggc

SEQ ID NO: 358 - DNA, 25 bp, Homo sapiens
gttcacagaggtctttcagctcatt

SEQ ID NO: 359 - DNA, 25 bp, Homo sapiens
cagctcatttaatcccaggaaagag

SEQ ID NO: 360 - DNA, 25 bp, Homo sapiens
gtgaggaaagtgcgttctcccagca

SEQ ID NO: 361 - DNA, 25 bp, Homo sapiens
gtccctccagggaaaatgactttat

SEQ ID NO: 362 - DNA, 25 bp, Homo sapiens
ttattgcttaatttctgcctttccc

SEQ ID NO: 363 - DNA, 25 bp, Homo sapiens
gaaatgaccacgtgaaatttgcctc

SEQ ID NO: 364 - DNA, 25 bp, Homo sapiens
cctctgtccaaacatttcatccgtg

SEQ ID NO: 365 - DNA, 25 bp, Homo sapiens
gttgttgtctcattttggtctgttt

SEQ ID NO: 366 - DNA, 25 bp, Homo sapiens
ctggcctgttatgattctgaacatt

SEQ ID NO: 367 - DNA, 25 bp, Homo sapiens
cttgaaccacaagtgaatctttctc

SEQ ID NO: 368 - DNA, 25 bp, Homo sapiens
tagacatctaaaattccactcctca

SEQ ID NO: 369 - DNA, 25 bp, Homo sapiens
aattccactcctcatagagctttta

SEQ ID NO: 370 - DNA, 25 bp, Homo sapiens
ccagtacgcaccacatttggagcag

SEQ ID NO: 371 - DNA, 25 bp, Homo sapiens
ctctctcttaactctgggtggattt

SEQ ID NO: 372 - DNA, 25 bp, Homo sapiens
gggtggattttaactacaactcttg

SEQ ID NO: 373 - DNA, 25 bp, Homo sapiens
ttgtcctctcggtgatggtattgct

SEQ ID NO: 374 - DNA, 25 bp, Homo sapiens
gtgcaactgttgctacagctgtgga

SEQ ID NO: 375 - DNA, 25 bp, Homo sapiens
tgtggagcagtatgttccctctgag

SEQ ID NO: 376 - DNA, 25 bp, Homo sapiens
aaacagatatccagcttcttctctt

SEQ ID NO: 377 - DNA, 25 bp, Homo sapiens
agcttcttctcttgtggttgttaga

SEQ ID NO: 378 - DNA, 25 bp, Homo sapiens
gcagggcctctacctacaaaagtga

SEQ ID NO: 379 - DNA, 25 bp, Homo sapiens
gatagcctcccactaggactgggag

SEQ ID NO: 380 - DNA, 25 bp, Homo sapiens
gtcaggatgttgtttgatcttctca

SEQ ID NO: 381 - DNA, 25 bp, Homo sapiens
gatcttctcaaacatctagttccct

SEQ ID NO: 382 - DNA, 25 bp, Homo sapiens
aacatctagttccctgcttgatggg

SEQ ID NO: 383 - DNA, 25 bp, Homo sapiens
acacctgcttgatcctcagatgtgg

SEQ ID NO: 384 - DNA, 25 bp, Homo sapiens
agggaggtaggcactgcctcagtct

SEQ ID NO: 385 - DNA, 25 bp, Homo sapiens
ctccagggacccttagatcacatca

SEQ ID NO: 386 - DNA, 25 bp, Homo sapiens
gccaggccccaggttaggaatagtg

SEQ ID NO: 387 - DNA, 25 bp, Homo sapiens
aaaggacaacactatctggagccac

SEQ ID NO: 388 - DNA, 25 bp, Homo sapiens
ggagccacccactgaaagggctgca

SEQ ID NO: 389 - DNA, 25 bp, Homo sapiens
aaagggctgcaggcatgggctgtac

SEQ ID NO: 390 - DNA, 25 bp, Homo sapiens
cagagttcaaggaggccttctccct

SEQ ID NO: 391 - DNA, 25 bp, Homo sapiens
ccttctccctctttgacaaggatgg

SEQ ID NO: 392 - DNA, 25 bp, Homo sapiens
gatggagatggcactatcaccacca

SEQ ID NO: 393 - DNA, 25 bp, Homo sapiens
tgagatccctgggacagaaccccac

SEQ ID NO: 394 - DNA, 25 bp, Homo sapiens
agaaccccactgaagcagagctgca

SEQ ID NO: 395 - DNA, 25 bp, Homo sapiens
gaacgggaccattgacttcccggag

SEQ ID NO: 396 - DNA, 25 bp, Homo sapiens
ggagttcctgaccatgatggccaga

SEQ ID NO: 397 - DNA, 25 bp, Homo sapiens
aggcgttccgtgtctttgacaagga

SEQ ID NO: 398 - DNA, 25 bp, Homo sapiens
tgggaatggctacatcagcgccgca

SEQ ID NO: 399 - DNA, 25 bp, Homo sapiens
gccgcagagctgcgtcacgtaatga

SEQ ID NO: 400 - DNA, 25 bp, Homo sapiens
taccccggttctagcaaacaccaat

SEQ ID NO: 401 - DNA, 25 bp, Homo sapiens
ccatatcagcccaatgttcctgttg

SEQ ID NO: 402 - DNA, 25 bp, Homo sapiens
atgttcctgttggtatagactatgt

SEQ ID NO: 403 - DNA, 25 bp, Homo sapiens
gggttttactgtaagctgtgttcac

SEQ ID NO: 404 - DNA, 25 bp, Homo sapiens
agctgtgttcactcttttatacaaa

SEQ ID NO: 405 - DNA, 25 bp, Homo sapiens
agaatactcattgcagcagccttcc

SEQ ID NO: 406 - DNA, 25 bp, Homo sapiens
gatgtctgttcatgtgttaagtgtt

SEQ ID NO: 407 - DNA, 25 bp, Homo sapiens
gtttttgttttatcagaatggcaac

SEQ ID NO: 408 - DNA, 25 bp, Homo sapiens
gaatggcaacagacagaagtacttt

SEQ ID NO: 409 - DNA, 25 bp, Homo sapiens
agagattgacttcctaagctactta

SEQ ID NO: 410 - DNA, 25 bp, Homo sapiens
gctacttaagacaacttgcaccact

SEQ ID NO: 411 - DNA, 25 bp, Homo sapiens
aagacaacttgcaccactaagaaaa

SEQ ID NO: 412 - DNA, 25 bp, Homo sapiens
aaacccacatgatttcaaggagtct

SEQ ID NO: 413 - DNA, 25 bp, Homo sapiens
tcaaggagtctggcattcctgaatc

SEQ ID NO: 414 - DNA, 25 bp, Homo sapiens
gctcatcagcttatggcttctgtct

SEQ ID NO: 415 - DNA, 25 bp, Homo sapiens
ggcttctgtctaagcacctgaacag

SEQ ID NO: 416 - DNA, 25 bp, Homo sapiens
acagaggactgaaacctccactgca

SEQ ID NO: 417 - DNA, 25 bp, Homo sapiens
acctccactgcaggctggttttagg

SEQ ID NO: 418 - DNA, 25 bp, Homo sapiens
gcaggctggttttaggtcttgaatt

SEQ ID NO: 419 - DNA, 25 bp, Homo sapiens
agaatcttgcacagcactgctaatg

SEQ ID NO: 420 - DNA, 25 bp, Homo sapiens
ttccctctaggacaaacacttacca

SEQ ID NO: 421 - DNA, 25 bp, Homo sapiens
gggaagagagattgtcctgtgattt

SEQ ID NO: 422 - DNA, 25 bp, Homo sapiens
tacccatttcctgaggcctgtggaa

SEQ ID NO: 423 - DNA, 25 bp, Homo sapiens
ggaacaaattggctgacaccttact

SEQ ID NO: 424 - DNA, 25 bp, Homo sapiens
gacaccttactggtaacctgctatt

SEQ ID NO: 425 - DNA, 25 bp, Homo sapiens
ggtaacctgctattcttctggtgtt

SEQ ID NO: 426 - DNA, 25 bp, Homo sapiens
gatgacttgtcagtgttccaggtgt

SEQ ID NO: 427 - DNA, 25 bp, Homo sapiens
gtgttccaggtgtatcttagctaaa

SEQ ID NO: 428 - DNA, 25 bp, Homo sapiens
ttacatctcttagcatggaggacga

SEQ ID NO: 429 - DNA, 25 bp, Homo sapiens
gctgtacattgttgcttgagagtct

SEQ ID NO: 430 - DNA, 25 bp, Homo sapiens
ttttttgattcagcttatacccggg

SEQ ID NO: 431 - DNA, 25 bp, Homo sapiens
tatacccgggctgaaaacctcaatt

SEQ ID NO: 432 - DNA, 25 bp, Homo sapiens
cctaagtctccttttcttcataaca

SEQ ID NO: 433 - DNA, 25 bp, Homo sapiens
tgacatgataggaagctctcagctt

SEQ ID NO: 434 - DNA, 25 bp, Homo sapiens
aggataaagaaggcatccctcccga

SEQ ID NO: 435 - DNA, 25 bp, Homo sapiens
aagataaagaaggcatccctcccga

SEQ ID NO: 436 - DNA, 25 bp, Homo sapiens
ttcttcagtcatggcattcgcagtg

SEQ ID NO: 437 - DNA, 25 bp, Homo sapiens
cagtcatggcattcgcagtgcccag

SEQ ID NO: 438 - DNA, 25 bp, Homo sapiens
tcatggcattcgcagtgcccagtga

SEQ ID NO: 439 - DNA, 25 bp, Homo sapiens
ggcattcgcagtgcccagtgatggc

SEQ ID NO: 440 - DNA, 25 bp, Homo sapiens
attcgcagtgcccagtgatggcatt

SEQ ID NO: 441 - DNA, 25 bp, Homo sapiens
gtgatggcattactctgcactatag

SEQ ID NO: 442 - DNA, 25 bp, Homo sapiens
gcattactctgcactatagccattt

SEQ ID NO: 443 - DNA, 25 bp, Homo sapiens
tactctgcactatagccatttgccc

SEQ ID NO: 444 - DNA, 25 bp, Homo sapiens
gccatttgccccaacttaagtttag

SEQ ID NO: 445 - DNA, 25 bp, Homo sapiens
ccctggtttgcagctgttttcaaag

SEQ ID NO: 446 - DNA, 25 bp, Homo sapiens
ttcaaagcccccgataatcgctctt

SEQ ID NO: 447 - DNA, 25 bp, Homo sapiens
aagatgccctcataaaccaatgtgg

SEQ ID NO: 448 - DNA, 25 bp, Homo sapiens
gtggcaagactactggacttctatc

SEQ ID NO: 449 - DNA, 25 bp, Homo sapiens
gacttctatcaatggtactctaatc

SEQ ID NO: 450 - DNA, 25 bp, Homo sapiens
taatcagtccttattatcccagctt

SEQ ID NO: 451 - DNA, 25 bp, Homo sapiens
tatcccagcttgctgaggggcaggg

SEQ ID NO: 452 - DNA, 25 bp, Homo sapiens
ctctgggcagcgctatctagatagg

SEQ ID NO: 453 - DNA, 25 bp, Homo sapiens
cgtccccaaacctagctaggctaag

SEQ ID NO: 454 - DNA, 25 bp, Homo sapiens
gaaacattcatttttaccttgtgga

SEQ ID NO: 455 - DNA, 25 bp, Homo sapiens
gtacacagtctgttttctatttgtt

SEQ ID NO: 456 - DNA, 25 bp, Homo sapiens
tggacaggatgggcctatcacggtg

SEQ ID NO: 457 - DNA, 25 bp, Homo sapiens
atcgtcctggagcgcatgcgctatg

SEQ ID NO: 458 - DNA, 25 bp, Homo sapiens
tgagggcgtggtcgacatgtttcag

SEQ ID NO: 459 - DNA, 25 bp, Homo sapiens
tgtttcagaccgtgaagaccctgcg

SEQ ID NO: 460 - DNA, 25 bp, Homo sapiens
gaggaccagtatcagctgtgctacc

SEQ ID NO: 461 - DNA, 25 bp, Homo sapiens
ccactatgcaacgtaactaccgctc

SEQ ID NO: 462 - DNA, 25 bp, Homo sapiens
ctcctacgcagatgctgtcactggc

SEQ ID NO: 463 - DNA, 25 bp, Homo sapiens
agcgtttcaggaacgttgccacacc

SEQ ID NO: 464 - DNA, 25 bp, Homo sapiens
ttgccacaccaatcagagagcctag

SEQ ID NO: 465 - DNA, 25 bp, Homo sapiens
gagcctagaacatccctgggcaagt

SEQ ID NO: 466 - DNA, 25 bp, Homo sapiens
tttctcatgcttcttctcatggggt

SEQ ID NO: 467 - DNA, 25 bp, Homo sapiens
ggctgtggtagaatcataccccatg

SEQ ID NO: 468 - DNA, 25 bp, Homo sapiens
gtggaatactcaatgtgtacacctt

SEQ ID NO: 469 - DNA, 25 bp, Homo sapiens
gtgtacacctttgactacagctgca

SEQ ID NO: 470 - DNA, 25 bp, Homo sapiens
tacagctgcagaagtgttcctttag

SEQ ID NO: 471 - DNA, 25 bp, Homo sapiens
agttgtgacccattttactctggat

SEQ ID NO: 472 - DNA, 25 bp, Homo sapiens
gaaacggttcacattccattatttg

SEQ ID NO: 473 - DNA, 25 bp, Homo sapiens
aagttacctgctgttagctttcatt

SEQ ID NO: 474 - DNA, 25 bp, Homo sapiens
tcattatttttgctacactcatttt

SEQ ID NO: 475 - DNA, 25 bp, Homo sapiens
attgcttggtattcattacttcatg

SEQ ID NO: 476 - DNA, 25 bp, Homo sapiens
tacttgcctaacatgcatgtgctgt

SEQ ID NO: 477 - DNA, 25 bp, Homo sapiens
atgatggctagctttgtttaatgtc

SEQ ID NO: 478 - DNA, 25 bp, Homo sapiens
aaaagttcttgatccccaatgcttc

SEQ ID NO: 479 - DNA, 25 bp, Homo sapiens
gattactaccgttacttggctgagg

SEQ ID NO: 480 - DNA, 25 bp, Homo sapiens
tgaggttgccgctggtgatgacaag

SEQ ID NO: 481 - DNA, 25 bp, Homo sapiens
gtcgatcagtcacaacaagcatacc

SEQ ID NO: 482 - DNA, 25 bp, Homo sapiens
ggaaatgcaaccaacacatcctatc

SEQ ID NO: 483 - DNA, 25 bp, Homo sapiens
acacatcctatcagactgggtctgg

SEQ ID NO: 484 - DNA, 25 bp, Homo sapiens
attctgaactccccagagaaagcct

SEQ ID NO: 485 - DNA, 25 bp, Homo sapiens
aagcctgctctcttgcaaagacagc

SEQ ID NO: 486 - DNA, 25 bp, Homo sapiens
gacattgtggacatcggatacccaa

SEQ ID NO: 487 - DNA, 25 bp, Homo sapiens
gtagaccatttgtcatccatgctgt

SEQ ID NO: 488 - DNA, 25 bp, Homo sapiens
catccatgctgtcccacaaatagtt

SEQ ID NO: 489 - DNA, 25 bp, Homo sapiens
actcccaaaccttgagtgtccagcc

SEQ ID NO: 490 - DNA, 25 bp, Homo sapiens
cccctgttgtttttagtctcttgtg

SEQ ID NO: 491 - DNA, 25 bp, Homo sapiens
tgctgtgcctagtggcacctgggct

SEQ ID NO: 492 - DNA, 25 bp, Homo sapiens
ttactcaagttcaaacctccagcct

SEQ ID NO: 493 - DNA, 25 bp, Homo sapiens
gcctgtgaatcaactgtgtctcttt

SEQ ID NO: 494 - DNA, 25 bp, Homo sapiens
gtgtctcttttttgacttggtaagc

SEQ ID NO: 495 - DNA, 25 bp, Homo sapiens
ttctcccactgttgtaaataacttt

SEQ ID NO: 496 - DNA, 25 bp, Homo sapiens
atggccaaaccccagatttgtactt

SEQ ID NO: 497 - DNA, 25 bp, Homo sapiens
agttgaagatggtcccttacagctt

SEQ ID NO: 498 - DNA, 25 bp, Homo sapiens
ccccacccctgcataaggcagttgt

SEQ ID NO: 499 - DNA, 25 bp, Homo sapiens
gtggggtgcttatactcccaaacct

SEQ ID NO: 500 - DNA, 25 bp, Homo sapiens
ggactcttggaggatacccagtgtc

SEQ ID NO: 501 - DNA, 25 bp, Homo sapiens
gcagcctttggggtcatgacccttc

SEQ ID NO: 502 - DNA, 25 bp, Homo sapiens
cccctgctattgtggtactccagca

SEQ ID NO: 503 - DNA, 25 bp, Homo sapiens
agaactgattggggcttccacagcc

SEQ ID NO: 504 - DNA, 25 bp, Homo sapiens
agaaatccaggtgctttccagactc

SEQ ID NO: 505 - DNA, 25 bp, Homo sapiens
tgaaggaccagccctaggagtctgc

SEQ ID NO: 506 - DNA, 25 bp, Homo sapiens
taggagtctgcgagagcctccttgg

SEQ ID NO: 507 - DNA, 25 bp, Homo sapiens
ctccttggttccatcgtgaagccat

SEQ ID NO: 508 - DNA, 25 bp, Homo sapiens
atagccttgagcctagagggccctc

SEQ ID NO: 509 - DNA, 25 bp, Homo sapiens
gccccactgaggtgctgttggttta

SEQ ID NO: 510 - DNA, 25 bp, Homo sapiens
ggcaacgtgaattctctcaggggtc

SEQ ID NO: 511 - DNA, 25 bp, Homo sapiens
atcagggtatttgttccaccttggc

SEQ ID NO: 512 - DNA, 25 bp, Homo sapiens
ccggactggacatggtcactcagta

SEQ ID NO: 513 - DNA, 25 bp, Homo sapiens
actggacatggtcactcagtaccgc

SEQ ID NO: 514 - DNA, 25 bp, Homo sapiens
cctgcagtgtcgccatgactgatca

SEQ ID NO: 515 - DNA, 25 bp, Homo sapiens
atgactgatcatggctcttgcattt

SEQ ID NO: 516 - DNA, 25 bp, Homo sapiens
catggctcttgcatttttgggtaaa

SEQ ID NO: 517 - DNA, 25 bp, Homo sapiens
gacttccggatcctgtcagggtgtc

SEQ ID NO: 518 - DNA, 25 bp, Homo sapiens
aggctcaggccaggtctggacagct

SEQ ID NO: 519 - DNA, 25 bp, Homo sapiens
aggccaggtctggacagctgtgact

SEQ ID NO: 520 - DNA, 25 bp, Homo sapiens
accagccggctatgggcacattacg

SEQ ID NO: 521 - DNA, 25 bp, Homo sapiens
tgggcacattacgtgaccactggcc

SEQ ID NO: 522 - DNA, 25 bp, Homo sapiens
agtgccgacaggacggtcattgatt

SEQ ID NO: 523 - DNA, 25 bp, Homo sapiens
ggacggtcattgattacaacgggga

SEQ ID NO: 524 - DNA, 25 bp, Homo sapiens
gattacaacggggaacgcacgctgg

SEQ ID NO: 525 - DNA, 25 bp, Homo sapiens
tacaacggggaacgcacgctggatg

SEQ ID NO: 526 - DNA, 25 bp, Homo sapiens
gggaacgcacgctggatggttttaa

SEQ ID NO: 527 - DNA, 25 bp, Homo sapiens
gaagcagaggagccagacatggagg

SEQ ID NO: 528 - DNA, 25 bp, Homo sapiens
aagatgaactgtaatacgcaaagcc

SEQ ID NO: 529 - DNA, 25 bp, Homo sapiens
gtttcctgaaaccatgatgtacttt

SEQ ID NO: 530 - DNA, 25 bp, Homo sapiens
gtactttttcatacatgagtctgtc

SEQ ID NO: 531 - DNA, 25 bp, Homo sapiens
catacatgagtctgtccagagtgct

SEQ ID NO: 532 - DNA, 25 bp, Homo sapiens
tgcttgctaccgtgttcggagtctc

SEQ ID NO: 533 - DNA, 25 bp, Homo sapiens
taacacaatcttgagcattcttgac

SEQ ID NO: 534 - DNA, 25 bp, Homo sapiens
cattcttgacagactcctggctgtc

SEQ ID NO: 535 - DNA, 25 bp, Homo sapiens
tggctgtcagtttctcagtggcaac

SEQ ID NO: 536 - DNA, 25 bp, Homo sapiens
cctacttcggtatctatgacactgc

SEQ ID NO: 537 - DNA, 25 bp, Homo sapiens
gggaatgcttccggatcccaagaac

SEQ ID NO: 538 - DNA, 25 bp, Homo sapiens
caagaacactcacatcgtcatcagc

SEQ ID NO: 539 - DNA, 25 bp, Homo sapiens
atgatcgcacagactgtcactgctg

SEQ ID NO: 540 - DNA, 25 bp, Homo sapiens
gctggcggaagattgctcgtgatga

SEQ ID NO: 541 - DNA, 25 bp, Homo sapiens
gggtgcatggtccaatgttctcaga

SEQ ID NO: 542 - DNA, 25 bp, Homo sapiens
gaggcatgggtggtgcttttgtgct

SEQ ID NO: 543 - DNA, 25 bp, Homo sapiens
tgcttttgtgcttgtcttgtatgat

SEQ ID NO: 544 - DNA, 25 bp, Homo sapiens
gttggttcaaacttttgggagcacg

SEQ ID NO: 545 - DNA, 25 bp, Homo sapiens
ttgggagcacggactgtcagttctc

SEQ ID NO: 546 - DNA, 25 bp, Homo sapiens
cggactgtcagttctctgggaagtg

SEQ ID NO: 547 - DNA, 25 bp, Homo sapiens
tgtcttttggagaaccagggctctt

SEQ ID NO: 548 - DNA, 25 bp, Homo sapiens
ctagggactgccaggctgtttcagc

SEQ ID NO: 549 - DNA, 25 bp, Homo sapiens
agccaggaaggccaaaatcaagagt

SEQ ID NO: 550 - DNA, 25 bp, Homo sapiens
gatgattgtcataaggtttttagca

SEQ ID NO: 551 - DNA, 25 bp, Homo sapiens
aatgggatggtcggatctcacaggc

SEQ ID NO: 552 - DNA, 25 bp, Homo sapiens
ggtcggatctcacaggctgagaact

SEQ ID NO: 553 - DNA, 25 bp, Homo sapiens
gctgcttcttattaatcatacaaac

SEQ ID NO: 554 - DNA, 25 bp, Homo sapiens
tcatacaaactctcaccatgatgtg

SEQ ID NO: 555 - DNA, 25 bp, Homo sapiens
ggacctaatgacagcccatatcaag

SEQ ID NO: 556 - DNA, 25 bp, Homo sapiens
caaggcggtgtattctttttgacaa

SEQ ID NO: 557 - DNA, 25 bp, Homo sapiens
ctaagatcacagtggtcgcctgctt

SEQ ID NO: 558 - DNA, 25 bp, Homo sapiens
acagtggtcgcctgctttaacaatt

SEQ ID NO: 559 - DNA, 25 bp, Homo sapiens
gttcttttatccatttgttcactgc

SEQ ID NO: 560 - DNA, 25 bp, Homo sapiens
tatgtgatccaaacccagatgaccc

SEQ ID NO: 561 - DNA, 25 bp, Homo sapiens
gaccccctagtgccagagattgcac

SEQ ID NO: 562 - DNA, 25 bp, Homo sapiens
gaagtatgccatgtgatgctacctt

SEQ ID NO: 563 - DNA, 25 bp, Homo sapiens
tttttgattttcttatccggctgct

SEQ ID NO: 564 - DNA, 25 bp, Homo sapiens
tccattcattcacatgctcatctga

SEQ ID NO: 565 - DNA, 25 bp, Homo sapiens
gaagacttaagttcttccagctttg

SEQ ID NO: 566 - DNA, 25 bp, Homo sapiens
agcagagaagcctgtctgtacttca

SEQ ID NO: 567 - DNA, 25 bp, Homo sapiens
agtatacagtcctagagaatccctc

SEQ ID NO: 568 - DNA, 25 bp, Homo sapiens
gaatccctctatttgttcagatctc

SEQ ID NO: 569 - DNA, 25 bp, Homo sapiens
gttcagatctcatagatgaccccca

SEQ ID NO: 570 - DNA, 25 bp, Homo sapiens
catagatgacccccaggtattgcct

SEQ ID NO: 571 - DNA, 25 bp, Homo sapiens
caggtattgccttttgacatccagc

SEQ ID NO: 572 - DNA, 25 bp, Homo sapiens
attgccttttgacatccagcagtcc

SEQ ID NO: 573 - DNA, 25 bp, Homo sapiens
aattgagaactacagcttttaagat

SEQ ID NO: 574 - DNA, 25 bp, Homo sapiens
gcttctgcaagcaacgggaacacct

SEQ ID NO: 575 - DNA, 25 bp, Homo sapiens
tttttcctgctagtgtagcttctga

SEQ ID NO: 576 - DNA, 25 bp, Homo sapiens
gcttctgaaaggtgctttctccatt

SEQ ID NO: 577 - DNA, 25 bp, Homo sapiens
gccgcagggtgcggctggtggacac

SEQ ID NO: 578 - DNA, 25 bp, Homo sapiens
ttcagcatggtgcgcgacctcatgc

SEQ ID NO: 579 - DNA, 25 bp, Homo sapiens
gggatgtatcatctgttgaactctt

SEQ ID NO: 580 - DNA, 25 bp, Homo sapiens
atgacagtttcacaacctgcattga

SEQ ID NO: 581 - DNA, 25 bp, Homo sapiens
ttgggaaatccctgttggcgagaaa

SEQ ID NO: 582 - DNA, 25 bp, Homo sapiens
ttctggaggtccatcagttctcaag

SEQ ID NO: 583 - DNA, 25 bp, Homo sapiens
agttctcaagagacgccagtgtggc

SEQ ID NO: 584 - DNA, 25 bp, Homo sapiens
tgcttggacaggagccgtacctatc

SEQ ID NO: 585 - DNA, 25 bp, Homo sapiens
agctcatcaagcgccacgaggcatt

SEQ ID NO: 586 - DNA, 25 bp, Homo sapiens
aaagtctgcagcaacctgggatgag

SEQ ID NO: 587 - DNA, 25 bp, Homo sapiens
ctgggatgagaggttctctgccctg

SEQ ID NO: 588 - DNA, 25 bp, Homo sapiens
aagcaggtcctggcacaatgtttat

SEQ ID NO: 589 - DNA, 25 bp, Homo sapiens
aaagactgctgcttctggaattccc

SEQ ID NO: 590 - DNA, 25 bp, Homo sapiens
agcgaggtccctgtgagtttgaaag

SEQ ID NO: 591 - DNA, 25 bp, Homo sapiens
aagaagctgtctgcgaagtggccct

SEQ ID NO: 592 - DNA, 25 bp, Homo sapiens
ggcaatgagtacctcttccaagcca

SEQ ID NO: 593 - DNA, 25 bp, Homo sapiens
acacatggatccaggctatctcttc

SEQ ID NO: 594 - DNA, 25 bp, Homo sapiens
cgccatctcctctgataaacacgag

SEQ ID NO: 595 - DNA, 25 bp, Homo sapiens
agagaagcggttcagcctttttggc

SEQ ID NO: 596 - DNA, 25 bp, Homo sapiens
ccttctcttaccttttcagtgaaat

SEQ ID NO: 597 - DNA, 25 bp, Homo sapiens
gaaccaacacattactctctgtgcc

SEQ ID NO: 598 - DNA, 25 bp, Homo sapiens
ctgtgcctaatgttcctcaatgtgg

SEQ ID NO: 599 - DNA, 25 bp, Homo sapiens
tgacatctgttaaacgtctttttgt

SEQ ID NO: 600 - DNA, 25 bp, Homo sapiens
agtgccattgtttgcctttaattgg

SEQ ID NO: 601 - DNA, 25 bp, Homo sapiens
gaaagagggtacttgccacatagtt

SEQ ID NO: 602 - DNA, 25 bp, Homo sapiens
gcattttgttacttgctaccctgag

SEQ ID NO: 603 - DNA, 25 bp, Homo sapiens
tgaacttttcatctgcagaggcaag

SEQ ID NO: 604 - DNA, 25 bp, Homo sapiens
gaagatgatggttgcatgtttctag

SEQ ID NO: 605 - DNA, 25 bp, Homo sapiens
gtttctagtttgtatatgtttccat

SEQ ID NO: 606 - DNA, 25 bp, Homo sapiens
atgcctgaaaaagaaccaccacctc

SEQ ID NO: 607 - DNA, 25 bp, Homo sapiens
aatcctataccagctttttgtttgt

SEQ ID NO: 608 - DNA, 25 bp, Homo sapiens
gaatgctgcaattcagggctcttca

SEQ ID NO: 609 - DNA, 25 bp, Homo sapiens
attcagggctcttcaaacttgtttg

SEQ ID NO: 610 - DNA, 25 bp, Homo sapiens
tcatccggcaccagtcagaccgata

SEQ ID NO: 611 - DNA, 25 bp, Homo sapiens
gccagatcttgatgcccaacattgg

SEQ ID NO: 612 - DNA, 25 bp, Homo sapiens
aacaaagcacatgctgcccagtggc

SEQ ID NO: 613 - DNA, 25 bp, Homo sapiens
cccagtggcttccggaagttcctgg

SEQ ID NO: 614 - DNA, 25 bp, Homo sapiens
ttcctggtccacaacgtcaaggagc

SEQ ID NO: 615 - DNA, 25 bp, Homo sapiens
cttactgtgccgagatcgctcacaa

SEQ ID NO: 616 - DNA, 25 bp, Homo sapiens
ctcacaatgtttcctccaagaaccg

SEQ ID NO: 617 - DNA, 25 bp, Homo sapiens
gccatcgtggaaagagctgcccaac

SEQ ID NO: 618 - DNA, 25 bp, Homo sapiens
ccaatgccaggctgcgcagtgaaga

SEQ ID NO: 619 - DNA, 25 bp, Homo sapiens
gtaggcagctcatgtgcacgttttc

SEQ ID NO: 620 - DNA, 25 bp, Homo sapiens
accccttgtgaagcccaagatcgtc

SEQ ID NO: 621 - DNA, 25 bp, Homo sapiens
gattgtgcctcaaagttgtagtacc

SEQ ID NO: 622 - DNA, 25 bp, Homo sapiens
ttgtagtacctcacaatacctccac

SEQ ID NO: 623 - DNA, 25 bp, Homo sapiens
agtttgaccattgtgctcttggctc

SEQ ID NO: 624 - DNA, 25 bp, Homo sapiens
ctcttgggctggagtaccgtggtga

SEQ ID NO: 625 - DNA, 25 bp, Homo sapiens
agtacaaaactgctctagggacacc

SEQ ID NO: 626 - DNA, 25 bp, Homo sapiens
tcataaagagtcttccctatcccaa

SEQ ID NO: 627 - DNA, 25 bp, Homo sapiens
aggtcttcatgatgccagtagccat

SEQ ID NO: 628 - DNA, 25 bp, Homo sapiens
tcagaaatcagctcagtggtcttcc

SEQ ID NO: 629 - DNA, 25 bp, Homo sapiens
tccccgccatgattcacatttgatg

SEQ ID NO: 630 - DNA, 25 bp, Homo sapiens
ccaaccgtgcttgtactgctagaag

SEQ ID NO: 631 - DNA, 25 bp, Homo sapiens
gaagcactttatgtttcctttttgg

SEQ ID NO: 632 - DNA, 25 bp, Homo sapiens
aataatttattcccacatctacatc

SEQ ID NO: 633 - DNA, 25 bp, Homo sapiens
tattcccacatctacatcagtgaaa

SEQ ID NO: 634 - DNA, 25 bp, Homo sapiens
gtgaaagctatctacctatcctgag

SEQ ID NO: 635 - DNA, 25 bp, Homo sapiens
tatctacctatcctgagtctatctt

SEQ ID NO: 636 - DNA, 25 bp, Homo sapiens
tacctatcctgagtctatcttaaag

SEQ ID NO: 637 - DNA, 25 bp, Homo sapiens
ttttaaattgaccttcatacgcttt

SEQ ID NO: 638 - DNA, 25 bp, Homo sapiens
aaatctacttgataatgtaccttta

SEQ ID NO: 639 - DNA, 25 bp, Homo sapiens
gtagtaatcttatgcacacggtgat

SEQ ID NO: 640 - DNA, 25 bp, Homo sapiens
tgcacacggtgatttcatgttatat

SEQ ID NO: 641 - DNA, 25 bp, Homo sapiens
gcaactgttttcttagttacagaag

SEQ ID NO: 642 - DNA, 25 bp, Homo sapiens
gatgtacagtttctgaaattgtttt

SEQ ID NO: 643 - DNA, 25 bp, Homo sapiens
aagcaacttttccatgctcttaatg

SEQ ID NO: 644 - DNA, 25 bp, Homo sapiens
tttccatgctcttaatgtattcctt

SEQ ID NO: 645 - DNA, 25 bp, Homo sapiens
gctcttaatgtattcctttttagta

SEQ ID NO: 646 - DNA, 25 bp, Homo sapiens
tggaaaagcacttgccatctctgtc

SEQ ID NO: 647 - DNA, 25 bp, Homo sapiens
ccatctctgtctaggggtcacaaat

SEQ ID NO: 648 - DNA, 25 bp, Homo sapiens
gaaatggctcctgtatcacatacgg

SEQ ID NO: 649 - DNA, 25 bp, Homo sapiens
ggctcctgtatcacatacggaggtc

SEQ ID NO: 650 - DNA, 25 bp, Homo sapiens
atacggaggtcttgtgtatctgtgg

SEQ ID NO: 651 - DNA, 25 bp, Homo sapiens
gtgtatctgtggcaacagggagttt

SEQ ID NO: 652 - DNA, 25 bp, Homo sapiens
ggcaacagggagtttccttattcac

SEQ ID NO: 653 - DNA, 25 bp, Homo sapiens
cagggagtttccttattcactcttt

SEQ ID NO: 654 - DNA, 25 bp, Homo sapiens
ccagccactgtttacggagagccag

SEQ ID NO: 655 - DNA, 25 bp, Homo sapiens
gtctgccccaagtaagagcgagtct

SEQ ID NO: 656 - DNA, 25 bp, Homo sapiens
ctgctttgagctgtctctccaagca

SEQ ID NO: 657 - DNA, 25 bp, Homo sapiens
gtgactgcacattggtttctgttct

SEQ ID NO: 658 - DNA, 25 bp, Homo sapiens
tttctgttctctggctatttgcaaa

SEQ ID NO: 659 - DNA, 25 bp, Homo sapiens
ctggctatttgcaaaacctctccca

SEQ ID NO: 660 - DNA, 25 bp, Homo sapiens
tccactcacacccatagcgggagag

SEQ ID NO: 661 - DNA, 25 bp, Homo sapiens
agcgggagagacctcatgcagattt

SEQ ID NO: 662 - DNA, 25 bp, Homo sapiens
aatgcagcagcttaatttttctgta

SEQ ID NO: 663 - DNA, 25 bp, Homo sapiens
tgcagtgtttataggcttcttgtgt

SEQ ID NO: 664 - DNA, 25 bp, Homo sapiens
aggcttcttgtgtgttaaacttgat

SEQ ID NO: 665 - DNA, 25 bp, Homo sapiens
gcatcaatgtgctgtctgaggtctg

SEQ ID NO: 666 - DNA, 25 bp, Homo sapiens
tgccaatgtccgcttcaatgtggcc

SEQ ID NO: 667 - DNA, 25 bp, Homo sapiens
caatgtggccaagtctctgcagaag

SEQ ID NO: 668 - DNA, 25 bp, Homo sapiens
gcagaagatagggcccatcctggac

SEQ ID NO: 669 - DNA, 25 bp, Homo sapiens
gaagtcaagcccatcctagagaagc

SEQ ID NO: 670 - DNA, 25 bp, Homo sapiens
actttgcccaggaggctctgactgt

SEQ ID NO: 671 - DNA, 25 bp, Homo sapiens
gaggagcaaacactggcctctggtg

SEQ ID NO: 672 - DNA, 25 bp, Homo sapiens
acaagtccctctttggggagacact

SEQ ID NO: 673 - DNA, 25 bp, Homo sapiens
tccacctcccaacggctaggggagc

SEQ ID NO: 674 - DNA, 25 bp, Homo sapiens
ctaggggagcacggggttggacagg

SEQ ID NO: 675 - DNA, 25 bp, Homo sapiens
ttgggaggaaggggctactccgcca

SEQ ID NO: 676 - DNA, 25 bp, Homo sapiens
tgcttctggacacctgggaccaggt

SEQ ID NO: 677 - DNA, 25 bp, Homo sapiens
gggaccaggtctttgtctgggttgg

SEQ ID NO: 678 - DNA, 25 bp, Homo sapiens
gaagccttgacttctgctaagcggt

SEQ ID NO: 679 - DNA, 25 bp, Homo sapiens
taagcggtacatcgagacggaccca

SEQ ID NO: 680 - DNA, 25 bp, Homo sapiens
tgaagcaaggctttgagcctccctc

SEQ ID NO: 681 - DNA, 25 bp, Homo sapiens
gctggttccttggctgggatgatga

SEQ ID NO: 682 - DNA, 25 bp, Homo sapiens
tgattactggtctgtggaccccttg

SEQ ID NO: 683 - DNA, 25 bp, Homo sapiens
tcaccggtcagtgccttttggaact

SEQ ID NO: 684 - DNA, 25 bp, Homo sapiens
ctgtccttccctcaaagaggcctta

SEQ ID NO: 685 - DNA, 25 bp, Homo sapiens
agaggccttagagcgagcagagcag

SEQ ID NO: 686 - DNA, 25 bp, Homo sapiens
gagcagctctgctatgagtgtgtgt

SEQ ID NO: 687 - DNA, 25 bp, Homo sapiens
aggagttacctatcactttcactta

SEQ ID NO: 688 - DNA, 25 bp, Homo sapiens
gatgactacaaccatgtccatgctc

SEQ ID NO: 689 - DNA, 25 bp, Homo sapiens
aacagttttccatatcacttttggg

SEQ ID NO: 690 - DNA, 25 bp, Homo sapiens
taattggcagcaccactaaccattc

SEQ ID NO: 691 - DNA, 25 bp, Homo sapiens
cactaaccattccttacattctttt

SEQ ID NO: 692 - DNA, 25 bp, Homo sapiens
tttttatttaacccgcagccgacat

SEQ ID NO: 693 - DNA, 25 bp, Homo sapiens
gcagccgacatcgtagtttcttgtt

SEQ ID NO: 694 - DNA, 25 bp, Homo sapiens
gttgcatgacttatgttaccatcct

SEQ ID NO: 695 - DNA, 25 bp, Homo sapiens
attaggctttttgaacatcctgtgt

SEQ ID NO: 696 - DNA, 25 bp, Homo sapiens
gggctgcagacatttaaagttcaca

SEQ ID NO: 697 - DNA, 25 bp, Homo sapiens
ttttttcctgattttgccattatat

SEQ ID NO: 698 - DNA, 25 bp, Homo sapiens
aactcttaagtctttgtgtctgcaa

SEQ ID NO: 699 - DNA, 25 bp, Homo sapiens
ccctcaaacttgcattccactatat

SEQ ID NO: 700 - DNA, 25 bp, Homo sapiens
cgtagtccagaccatcctatactgt

SEQ ID NO: 701 - DNA, 25 bp, Homo sapiens
agaccatcctatactgtgacttctt

SEQ ID NO: 702 - DNA, 25 bp, Homo sapiens
agctcagtttgccagcataagtgcc

SEQ ID NO: 703 - DNA, 25 bp, Homo sapiens
cataagtgccaaagaccatcaccag

SEQ ID NO: 704 - DNA, 25 bp, Homo sapiens
caccagcatctgtccttcagggtgc

SEQ ID NO: 705 - DNA, 25 bp, Homo sapiens
ggtgctcggacagaattcttaccac

SEQ ID NO: 706 - DNA, 25 bp, Homo sapiens
gttgcagatagtcatcagtggctct

SEQ ID NO: 707 - DNA, 25 bp, Homo sapiens
gtttaatgcatcttgccttatcttt

SEQ ID NO: 708 - DNA, 25 bp, Homo sapiens
gccttatctttttttattactgtgt

SEQ ID NO: 709 - DNA, 25 bp, Homo sapiens
acttgtccacccggagttgagtcgg

SEQ ID NO: 710 - DNA, 25 bp, Homo sapiens
agtggcgagctggcagtacgggctc

SEQ ID NO: 711 - DNA, 25 bp, Homo sapiens
catcgacctctatgccatggtggtg

SEQ ID NO: 712 - DNA, 25 bp, Homo sapiens
ggttctctcgagggcctcaagatcc

SEQ ID NO: 713 - DNA, 25 bp, Homo sapiens
caagatccctgagtgagggccaccc

SEQ ID NO: 714 - DNA, 25 bp, Homo sapiens
tgacacctggtgtatcgaggctgca

SEQ ID NO: 715 - DNA, 25 bp, Homo sapiens
gctcggatccgagagggcatggccg

SEQ ID NO: 716 - DNA, 25 bp, Homo sapiens
taccgcaacttcaaaagcatctcca

SEQ ID NO: 717 - DNA, 25 bp, Homo sapiens
cagcaacccacttggcttctgaata

SEQ ID NO: 718 - DNA, 25 bp, Homo sapiens
cttccctcaagccaaagccgaagcc

SEQ ID NO: 719 - DNA, 25 bp, Homo sapiens
cactgtgcctgctctcaagagcact

SEQ ID NO: 720 - DNA, 25 bp, Homo sapiens
tactcccttttgttatccttagagg

SEQ ID NO: 721 - DNA, 25 bp, Homo sapiens
agtacctcttcttaaagtgcacttt

SEQ ID NO: 722 - DNA, 25 bp, Homo sapiens
agtgcactttgcagacgtttcactc

SEQ ID NO: 723 - DNA, 25 bp, Homo sapiens
ggagcttttaccttgtagcagagca

SEQ ID NO: 724 - DNA, 25 bp, Homo sapiens
aggtggcgacctcagtggagaaatg

SEQ ID NO: 725 - DNA, 25 bp, Homo sapiens
gggggaaaacgaccctgtattgcag

SEQ ID NO: 726 - DNA, 25 bp, Homo sapiens
gattgtagacattctgtatgccaca

SEQ ID NO: 727 - DNA, 25 bp, Homo sapiens
tgaagggggcccacaggaggagcaa

SEQ ID NO: 728 - DNA, 25 bp, Homo sapiens
gagtattaacagcctggaccagcag

SEQ ID NO: 729 - DNA, 25 bp, Homo sapiens
ggaccagcagagcaacatcggaatt

SEQ ID NO: 730 - DNA, 25 bp, Homo sapiens
atcggaattcttcactccaaatcat

SEQ ID NO: 731 - DNA, 25 bp, Homo sapiens
ggtgttttcggtatctgctgttcac

SEQ ID NO: 732 - DNA, 25 bp, Homo sapiens
agctctccactgtaatccgaatact

SEQ ID NO: 733 - DNA, 25 bp, Homo sapiens
ttgccagtgcactaatctctttgga

SEQ ID NO: 734 - DNA, 25 bp, Homo sapiens
cacagcctattcagttcctttgttt

SEQ ID NO: 735 - DNA, 25 bp, Homo sapiens
atgtgtctcacccactactgagatt

SEQ ID NO: 736 - DNA, 25 bp, Homo sapiens
gagattgttcagcccctgatgtatt

SEQ ID NO: 737 - DNA, 25 bp, Homo sapiens
gtttctggtggtagcttgtcctgaa

SEQ ID NO: 738 - DNA, 25 bp, Homo sapiens
gttgtgtagtgcatgctctgtgtgg

SEQ ID NO: 739 - DNA, 25 bp, Homo sapiens
gacagtggtgctatttctcttttgt

SEQ ID NO: 740 - DNA, 25 bp, Homo sapiens
tggccttttagacttttgttgccct

SEQ ID NO: 741 - DNA, 25 bp, Homo sapiens
ttccacctggtctttcttgacaggg

SEQ ID NO: 742 - DNA, 25 bp, Homo sapiens
caaggggttacaggcatcgcccatg

SEQ ID NO: 743 - DNA, 25 bp, Homo sapiens
atgctcctcacctgtattttgtaat

SEQ ID NO: 744 - DNA, 25 bp, Homo sapiens
cacagaggtcctcaagacccacgga

SEQ ID NO: 745 - DNA, 25 bp, Homo sapiens
agactgttaattcctcatgcgttgc

SEQ ID NO: 746 - DNA, 25 bp, Homo sapiens
tcctccattgttgccctggaatgta

SEQ ID NO: 747 - DNA, 25 bp, Homo sapiens
gaatgtacgggacccaggggcagca

SEQ ID NO: 748 - DNA, 25 bp, Homo sapiens
ggaaagggtcttagtcactgcctcc

SEQ ID NO: 749 - DNA, 25 bp, Homo sapiens
ctgcctcccgaagttgcttgaaagc

SEQ ID NO: 750 - DNA, 25 bp, Homo sapiens
ggagggccctatcttgtgagtgggg

SEQ ID NO: 751 - DNA, 25 bp, Homo sapiens
agtggggcatctgttggactttcca

SEQ ID NO: 752 - DNA, 25 bp, Homo sapiens
ggactttccacctggtcatatactc

SEQ ID NO: 753 - DNA, 25 bp, Homo sapiens
acattgtcctctcaggaggctctac

SEQ ID NO: 754 - DNA, 25 bp, Homo sapiens
aggttttggtgacaggctcctgagt

SEQ ID NO: 755 - DNA, 25 bp, Homo sapiens
agatcaggatatctgcacctcagga

SEQ ID NO: 756 - DNA, 25 bp, Homo sapiens
tgaggaagacggtgcccgatccatc

SEQ ID NO: 757 - DNA, 25 bp, Homo sapiens
taatgtcgggacatcatcttcacct

SEQ ID NO: 758 - DNA, 25 bp, Homo sapiens
agaaagagcctgttacctatccata

SEQ ID NO: 759 - DNA, 25 bp, Homo sapiens
gagaaagctcagtactacctgcctg

SEQ ID NO: 760 - DNA, 25 bp, Homo sapiens
ccattgagattggtccttcccgatt

SEQ ID NO: 761 - DNA, 25 bp, Homo sapiens
agttgctcttcaggccagatttgat

SEQ ID NO: 762 - DNA, 25 bp, Homo sapiens
ctggtgttcgccattcagaagtcag

SEQ ID NO: 763 - DNA, 25 bp, Homo sapiens
agaagtcagacatggacctgcggcg

SEQ ID NO: 764 - DNA, 25 bp, Homo sapiens
agtgactggtaaccaccagcagcct

SEQ ID NO: 765 - DNA, 25 bp, Homo sapiens
ccacgtagcaatcagccctattaca

SEQ ID NO: 766 - DNA, 25 bp, Homo sapiens
aatagtcgtggtgtgtctcgtggag

SEQ ID NO: 767 - DNA, 25 bp, Homo sapiens
tgatgaatggataccggggccctgc

SEQ ID NO: 768 - DNA, 25 bp, Homo sapiens
cttcattctctaacactccaaacag

SEQ ID NO: 769 - DNA, 25 bp, Homo sapiens
gtggttatacacagtctcagttcag

SEQ ID NO: 770 - DNA, 25 bp, Homo sapiens
ccgggattactctggctatcaacgg

SEQ ID NO: 771 - DNA, 25 bp, Homo sapiens
gagccccacgaggtcgtggagggcc

SEQ ID NO: 772 - DNA, 25 bp, Homo sapiens
gcccccaagacccaacagagggatg

SEQ ID NO: 773 - DNA, 25 bp, Homo sapiens
gggatgccgcaaatgaacactcagc

SEQ ID NO: 774 - DNA, 25 bp, Homo sapiens
tatttgttctccctttcaggaaact

SEQ ID NO: 775 - DNA, 25 bp, Homo sapiens
ctgaacgttcagatgcataccaaat

SEQ ID NO: 776 - DNA, 25 bp, Homo sapiens
gcatgggtcctaatcacacatataa

SEQ ID NO: 777 - DNA, 25 bp, Homo sapiens
tgacacagcactgttcatctggcca

SEQ ID NO: 778 - DNA, 25 bp, Homo sapiens
gttcatctggccaaacaactgtggt

SEQ ID NO: 779 - DNA, 25 bp, Homo sapiens
taggctttgattggcactttttgaa

SEQ ID NO: 780 - DNA, 25 bp, Homo sapiens
ggatgtaatccggatggccgcttct

SEQ ID NO: 781 - DNA, 25 bp, Homo sapiens
attggtactatctatcattccttat

SEQ ID NO: 782 - DNA, 25 bp, Homo sapiens
gtacattgtctgtcactaatccttg

SEQ ID NO: 783 - DNA, 25 bp, Homo sapiens
ggataatcataacactctcggtcac

SEQ ID NO: 784 - DNA, 25 bp, Homo sapiens
aacactctcggtcacatgtttttcc

SEQ ID NO: 785 - DNA, 25 bp, Homo sapiens
aagataccaaatgcctgctgctacc

SEQ ID NO: 786 - DNA, 25 bp, Homo sapiens
gaacagataagtttgcctgcatgct

SEQ ID NO: 787 - DNA, 25 bp, Homo sapiens
catgctggacatgcctcagaaccat

SEQ ID NO: 788 - DNA, 25 bp, Homo sapiens
tcagaaccatgaatagcccgtacta

SEQ ID NO: 789 - DNA, 25 bp, Homo sapiens
tagcccgtactagatcttgggaaca

SEQ ID NO: 790 - DNA, 25 bp, Homo sapiens
ggaacatggatcttagagtcacttt

SEQ ID NO: 791 - DNA, 25 bp, Homo sapiens
cggggcttgttaaaggacgcgtatg

SEQ ID NO: 792 - DNA, 25 bp, Homo sapiens
gtatgtagggcccgtacctactggc

SEQ ID NO: 793 - DNA, 25 bp, Homo sapiens
acctactggcagttgggttcaggga

SEQ ID NO: 794 - DNA, 25 bp, Homo sapiens
aaatgggattgacttggccttcagg

SEQ ID NO: 795 - DNA, 25 bp, Homo sapiens
cttcaggctcctttggtcataattt

SEQ ID NO: 796 - DNA, 25 bp, Homo sapiens
aagagcatttatcgtttgtcccttg

SEQ ID NO: 797 - DNA, 25 bp, Homo sapiens
tgaaggtggccgggcaggacggctc

SEQ ID NO: 798 - DNA, 25 bp, Homo sapiens
gctccgtggtgcagttcaagatcaa

SEQ ID NO: 799 - DNA, 25 bp, Homo sapiens
agctgatgaaggcctactgcgagag

SEQ ID NO: 800 - DNA, 25 bp, Homo sapiens
gaggcagggcttgtcaatgaggcag

SEQ ID NO: 801 - DNA, 25 bp, Homo sapiens
tcagattcaggttcgacgggcagcc

SEQ ID NO: 802 - DNA, 25 bp, Homo sapiens
atgaaactgacactccagcacagct

SEQ ID NO: 803 - DNA, 25 bp, Homo sapiens
aggacgaggacaccatcgacgtgtt

SEQ ID NO: 804 - DNA, 25 bp, Homo sapiens
agcctggcagggcacagtttctaga

SEQ ID NO: 805 - DNA, 25 bp, Homo sapiens
tccatcctcgcattgctgttgaatg

SEQ ID NO: 806 - DNA, 25 bp, Homo sapiens
gaccatgccgaccacaaaggtgtct

SEQ ID NO: 807 - DNA, 25 bp, Homo sapiens
gacattcaccacgatgattttcctc

SEQ ID NO: 808 - DNA, 25 bp, Homo sapiens
aattcccacatttctcatttggtaa

SEQ ID NO: 809 - DNA, 25 bp, Homo sapiens
taatggtgttgtggcctcagatttc

SEQ ID NO: 810 - DNA, 25 bp, Homo sapiens
gcctcagatttcttctagtatttgc

SEQ ID NO: 811 - DNA, 25 bp, Homo sapiens
gaatttgcagttatgttgtcgtgta

SEQ ID NO: 812 - DNA, 25 bp, Homo sapiens
aagagctacttccaagtgtggttac

SEQ ID NO: 813 - DNA, 25 bp, Homo sapiens
acattttcatagttctgcctattgt

SEQ ID NO: 814 - DNA, 25 bp, Homo sapiens
ctgcctttttacagtcacctgaaca

SEQ ID NO: 815 - DNA, 25 bp, Homo sapiens
cacctgaacaatgacccatcatctc

SEQ ID NO: 816 - DNA, 25 bp, Homo sapiens
gaaatgttctcatttcctgtttgct

SEQ ID NO: 817 - DNA, 25 bp, Homo sapiens
tcctgtttgctgtatgggctcgggt

SEQ ID NO: 818 - DNA, 25 bp, Homo sapiens
tgttggctctgttgtgtttattcac

SEQ ID NO: 819 - DNA, 25 bp, Homo sapiens
cttcgtgctgaccaggagctcatga

SEQ ID NO: 820 - DNA, 25 bp, Homo sapiens
gagctcatgacttactcccatgaca

SEQ ID NO: 821 - DNA, 25 bp, Homo sapiens
tgacaacatcatctgcgggatcacc

SEQ ID NO: 822 - DNA, 25 bp, Homo sapiens
acgtctgggatgcactcaaagccga

SEQ ID NO: 823 - DNA, 25 bp, Homo sapiens
caaagccgaccgggcaggtgtcttg

SEQ ID NO: 824 - DNA, 25 bp, Homo sapiens
ctgcctgggcgtgactgacgatggc

SEQ ID NO: 825 - DNA, 25 bp, Homo sapiens
tggcatggctgtggcgacagggtcc

SEQ ID NO: 826 - DNA, 25 bp, Homo sapiens
ggaactaacgccagtagcatgtgga

SEQ ID NO: 827 - DNA, 25 bp, Homo sapiens
attccaacttggacgcgttaccatg

SEQ ID NO: 828 - DNA, 25 bp, Homo sapiens
gaaaccaagagcacaattcccattg

SEQ ID NO: 829 - DNA, 25 bp, Homo sapiens
aaaacaaattgtgcattccttccgg

SEQ ID NO: 830 - DNA, 25 bp, Homo sapiens
ggcttgctaggaagctcattggaga

SEQ ID NO: 831 - DNA, 25 bp, Homo sapiens
ggaagctcattggagaccctaactt

SEQ ID NO: 832 - DNA, 25 bp, Homo sapiens
agctcattggagaccctaacttgga

SEQ ID NO: 833 - DNA, 25 bp, Homo sapiens
cattggagaccctaacttggaattt

SEQ ID NO: 834 - DNA, 25 bp, Homo sapiens
ccaccagaagttgtcatggacccag

SEQ ID NO: 835 - DNA, 25 bp, Homo sapiens
accagaagttgtcatggacccagct

SEQ ID NO: 836 - DNA, 25 bp, Homo sapiens
acccagctttggcagcacagtatga

SEQ ID NO: 837 - DNA, 25 bp, Homo sapiens
ttggcagcacagtatgagcacgact

SEQ ID NO: 838 - DNA, 25 bp, Homo sapiens
gcagcacagtatgagcacgacttag

SEQ ID NO: 839 - DNA, 25 bp, Homo sapiens
acagtatgagcacgacttagaggtt

SEQ ID NO: 840 - DNA, 25 bp, Homo sapiens
tgatgacctgtgagaatgaagctgg

SEQ ID NO: 841 - DNA, 25 bp, Homo sapiens
gagaacacttagtcttgcctgtcaa

SEQ ID NO: 842 - DNA, 25 bp, Homo sapiens
taggggccacatattacattcagtt

SEQ ID NO: 843 - DNA, 25 bp, Homo sapiens
ttacattcagttgctataggtccag

SEQ ID NO: 844 - DNA, 25 bp, Homo sapiens
gaacctgccattacctgggcaagga

SEQ ID NO: 845 - DNA, 25 bp, Homo sapiens
ggcaaggaaagatccctttgctcta

SEQ ID NO: 846 - DNA, 25 bp, Homo sapiens
tttgctctaggaaagcttggcccaa

SEQ ID NO: 847 - DNA, 25 bp, Homo sapiens
ttccccctgtaggactgactgttgg

SEQ ID NO: 848 - DNA, 25 bp, Homo sapiens
gagttagggccagtgtcttgaaaat

SEQ ID NO: 849 - DNA, 25 bp, Homo sapiens
tacattttttttctgggtgtgcatc

SEQ ID NO: 850 - DNA, 25 bp, Homo sapiens
tgaaatcactgtaaatgcccccatc

SEQ ID NO: 851 - DNA, 25 bp, Homo sapiens
tcttcttcccaggtgtgccaaggaa

SEQ ID NO: 852 - DNA, 25 bp, Homo sapiens
atgccacctacggctacgttttaga

SEQ ID NO: 853 - DNA, 25 bp, Homo sapiens
aaggatggagacctcattgccacca

SEQ ID NO: 854 - DNA, 25 bp, Homo sapiens
aggaggagttcacagctttcctgca

SEQ ID NO: 855 - DNA, 25 bp, Homo sapiens
ctttcctgcaccctgaggagtatga

SEQ ID NO: 856 - DNA, 25 bp, Homo sapiens
gagaccaaagactggatccttccct

SEQ ID NO: 857 - DNA, 25 bp, Homo sapiens
tccttccctcagactatgatcatgc

SEQ ID NO: 858 - DNA, 25 bp, Homo sapiens
gcagaggcagaagccaggcacctgg

SEQ ID NO: 859 - DNA, 25 bp, Homo sapiens
gccaggcacctggtctatgaatcag

SEQ ID NO: 860 - DNA, 25 bp, Homo sapiens
atgacttatttgttggcagccaggc

SEQ ID NO: 861 - DNA, 25 bp, Homo sapiens
gcagccaggccacagattttgggga

SEQ ID NO: 862 - DNA, 25 bp, Homo sapiens
ggggaggccttagtacggcatgatg

SEQ ID NO: 863 - DNA, 25 bp, Homo sapiens
taggtatatcctttggtcttccaca

SEQ ID NO: 864 - DNA, 25 bp, Homo sapiens
tggtcttccacagtcatgttgaggt

SEQ ID NO: 865 - DNA, 25 bp, Homo sapiens
ttgaggtgggctccctggtatggta

SEQ ID NO: 866 - DNA, 25 bp, Homo sapiens
ggtataatgtaacttcaccccagcc

SEQ ID NO: 867 - DNA, 25 bp, Homo sapiens
ccccagcctttgtactaagctcttg

SEQ ID NO: 868 - DNA, 25 bp, Homo sapiens
agcctcacacctcactaggtgcaga

SEQ ID NO: 869 - DNA, 25 bp, Homo sapiens
taggtgcagagagcccaggccttat

SEQ ID NO: 870 - DNA, 25 bp, Homo sapiens
cagcagcaagcattatacggtcatc

SEQ ID NO: 871 - DNA, 25 bp, Homo sapiens
acggtcatcttgaatgatccctttg

SEQ ID NO: 872 - DNA, 25 bp, Homo sapiens
gtgtgttctgtgaatgctagctctc

SEQ ID NO: 873 - DNA, 25 bp, Homo sapiens
atgctagctctcttgaatttggata

SEQ ID NO: 874 - DNA, 25 bp, Homo sapiens
catgttgcaacagccccaacatcac

SEQ ID NO: 875 - DNA, 25 bp, Homo sapiens
acatcacgcatgtcattcactgcct

SEQ ID NO: 876 - DNA, 25 bp, Homo sapiens
ctgcctgagctcttctgtaagctgg

SEQ ID NO: 877 - DNA, 25 bp, Homo sapiens
taagctggggtagggtgatggcagt

SEQ ID NO: 878 - DNA, 25 bp, Homo sapiens
gagaatctagtgtagcagcctccag

SEQ ID NO: 879 - DNA, 25 bp, Homo sapiens
gcctccaggcaggattcagcacaac

SEQ ID NO: 880 - DNA, 25 bp, Homo sapiens
gcacaacactggggagtcacccttc

SEQ ID NO: 881 - DNA, 25 bp, Homo sapiens
ctctgcctaccaacaactgggctta

SEQ ID NO: 882 - DNA, 25 bp, Homo sapiens
actgggcttatcactgggaaaacac

SEQ ID NO: 883 - DNA, 25 bp, Homo sapiens
atagggtctagaatgcttgtgttga

SEQ ID NO: 884 - DNA, 25 bp, Homo sapiens
gttctctttgccataaagactccgt

SEQ ID NO: 885 - DNA, 25 bp, Homo sapiens
ctttttttctcacctgcacttagag

SEQ ID NO: 886 - DNA, 25 bp, Homo sapiens
gaaacacttgcagctctagtattca

SEQ ID NO: 887 - DNA, 25 bp, Homo sapiens
gctctagtattcacttgagtcttcc

SEQ ID NO: 888 - DNA, 25 bp, Homo sapiens
tgtttttcctgtaccgggtcatggt

SEQ ID NO: 889 - DNA, 25 bp, Homo sapiens
caagttaaaacctgacgatttctgc

SEQ ID NO: 890 - DNA, 25 bp, Homo sapiens
gatttctgcagtgacttgatgctct

SEQ ID NO: 891 - DNA, 25 bp, Homo sapiens
gaaattgtgattgtgacccatgagt

SEQ ID NO: 892 - DNA, 25 bp, Homo sapiens
gacccatgagtggaggaactttcag

SEQ ID NO: 893 - DNA, 25 bp, Homo sapiens
ttgtaaccactgtcttgatggcaaa

SEQ ID NO: 894 - DNA, 25 bp, Homo sapiens
agtctcgtgtttattattccttaag

SEQ ID NO: 895 - DNA, 25 bp, Homo sapiens
gtgttatattaccatggaacgccta

SEQ ID NO: 896 - DNA, 25 bp, Homo sapiens
gcagggatggcttcacaggctgctc

SEQ ID NO: 897 - DNA, 25 bp, Homo sapiens
gccaaaaactctgttactagcctcc

SEQ ID NO: 898 - DNA, 25 bp, Homo sapiens
ttactagcctcctcagcattattaa

SEQ ID NO: 899 - DNA, 25 bp, Homo sapiens
gggcagctggatacagtggacctga

SEQ ID NO: 900 - DNA, 25 bp, Homo sapiens
gctgccatcatggactataaccgag

SEQ ID NO: 901 - DNA, 25 bp, Homo sapiens
aggacattcgcaatctggaggacat

SEQ ID NO: 902 - DNA, 25 bp, Homo sapiens
atcaggaagaccttaccatctggct

SEQ ID NO: 903 - DNA, 25 bp, Homo sapiens
cccgtccattgaaaagccctagtgt

SEQ ID NO: 904 - DNA, 25 bp, Homo sapiens
tagggctggaaggcagcatccctct

SEQ ID NO: 905 - DNA, 25 bp, Homo sapiens
gcatccctctgacaggggggcagtt

SEQ ID NO: 906 - DNA, 25 bp, Homo sapiens
ccatcactgtccttttgaaccagga

SEQ ID NO: 907 - DNA, 25 bp, Homo sapiens
aaagttttcacgtcatcgtttcctg

SEQ ID NO: 908 - DNA, 25 bp, Homo sapiens
gtttcctggctagttcatttcatta

SEQ ID NO: 909 - DNA, 25 bp, Homo sapiens
gtggctacatcctaacatatgcatt

SEQ ID NO: 910 - DNA, 25 bp, Homo sapiens
agcaagtctcaggccacaatggggt

SEQ ID NO: 911 - DNA, 25 bp, Homo sapiens
ttctcctccacctgtgtggtatatt

SEQ ID NO: 912 - DNA, 25 bp, Homo sapiens
gatgataccttaattacactcccgc

SEQ ID NO: 913 - DNA, 25 bp, Homo sapiens
tattgtctagctccagttatctgta

SEQ ID NO: 914 - DNA, 25 bp, Homo sapiens
ggctgctgcagaatgctggttgaca

SEQ ID NO: 915 - DNA, 25 bp, Homo sapiens
tatactgctatttttccctgaattc

SEQ ID NO: 916 - DNA, 25 bp, Homo sapiens
caactgtggaccttttatatgtgcc

SEQ ID NO: 917 - DNA, 25 bp, Homo sapiens
tcactttagctgtttgccttactct

SEQ ID NO: 918 - DNA, 25 bp, Homo sapiens
ctcagtaatgactcaagcctctggc

SEQ ID NO: 919 - DNA, 25 bp, Homo sapiens
aagcctctggctattaacataccct

SEQ ID NO: 920 - DNA, 25 bp, Homo sapiens
tattaacataccctagttgccgttt

SEQ ID NO: 921 - DNA, 25 bp, Homo sapiens
gttgccgttttttaattgccatgag

SEQ ID NO: 922 - DNA, 25 bp, Homo sapiens
ttgctgctacccatctatgtatgta

SEQ ID NO: 923 - DNA, 25 bp, Homo sapiens
tacccatctatgtatgtagtcattg

SEQ ID NO: 924 - DNA, 25 bp, Homo sapiens
tttaactggtgaaactagcctggaa

SEQ ID NO: 925 - DNA, 25 bp, Homo sapiens
ggaataatgccaccagagactgagt

SEQ ID NO: 926 - DNA, 25 bp, Homo sapiens
caccagagactgagtggaaatcgcc

SEQ ID NO: 927 - DNA, 25 bp, Homo sapiens
gaaggtgccattcttatgagccaaa

SEQ ID NO: 928 - DNA, 25 bp, Homo sapiens
aaatgtattcactagatttctacgt

SEQ ID NO: 929 - DNA, 25 bp, Homo sapiens
gatgcatgatccagctgtgtgtttt

SEQ ID NO: 930 - DNA, 25 bp, Homo sapiens
gctgtgtgttttcaatccttgggag

SEQ ID NO: 931 - DNA, 25 bp, Homo sapiens
ttgggagggtgccatccacatttta

SEQ ID NO: 932 - DNA, 25 bp, Homo sapiens
taacagtacctgtgcctgagaattt

SEQ ID NO: 933 - DNA, 25 bp, Homo sapiens
gtatttcattgctgtgtcacactct

SEQ ID NO: 934 - DNA, 25 bp, Homo sapiens
ttgtgaggtgaatgtcttccttttc

SEQ ID NO: 935 - DNA, 25 bp, Homo sapiens
gactaaccattgatgagcactcctg

SEQ ID NO: 936 - DNA, 25 bp, Homo sapiens
gagcactcctgatttttatctagaa

SEQ ID NO: 937 - DNA, 25 bp, Homo sapiens
ttggtgcaaggccatctgcttacca

SEQ ID NO: 938 - DNA, 25 bp, Homo sapiens
cttaccacatcacaccacttggaga

SEQ ID NO: 939 - DNA, 25 bp, Homo sapiens
tcgtctgcgattttatctgttaacc

SEQ ID NO: 940 - DNA, 25 bp, Homo sapiens
gcagcagccaggacatatagcctcc

SEQ ID NO: 941 - DNA, 25 bp, Homo sapiens
gtccaaggggctaagggcttccagc

SEQ ID NO: 942 - DNA, 25 bp, Homo sapiens
agcaccaacggatgaccaacggggc

SEQ ID NO: 943 - DNA, 25 bp, Homo sapiens
gaaaccccacctacaagatgtacga

SEQ ID NO: 944 - DNA, 25 bp, Homo sapiens
atgatgtgggaggcctactggacgc

SEQ ID NO: 945 - DNA, 25 bp, Homo sapiens
gtatgccacactctacatggggggc

SEQ ID NO: 946 - DNA, 25 bp, Homo sapiens
ctggccagcacggacgagaagcgag

SEQ ID NO: 947 - DNA, 25 bp, Homo sapiens
acgagaagcgagaactcctgggccg

SEQ ID NO: 948 - DNA, 25 bp, Homo sapiens
gataggggaccccttggcatagggc

SEQ ID NO: 949 - DNA, 25 bp, Homo sapiens
ccctgccggtgaagtccttcagtga

SEQ ID NO: 950 - DNA, 25 bp, Homo sapiens
tggccccgccggatgtataaatgta

SEQ ID NO: 951 - DNA, 25 bp, Homo sapiens
taaattcacatgcagtctcagagac

SEQ ID NO: 952 - DNA, 25 bp, Homo sapiens
tagacagtactcttaactcctagcc

SEQ ID NO: 953 - DNA, 25 bp, Homo sapiens
acacctctaggactccacagttttg

SEQ ID NO: 954 - DNA, 25 bp, Homo sapiens
taggactccacagttttgccttaaa

SEQ ID NO: 955 - DNA, 25 bp, Homo sapiens
tgccttaaaggaccttcccaagtct

SEQ ID NO: 956 - DNA, 25 bp, Homo sapiens
gtggggggaatgagcatgaactgtc

SEQ ID NO: 957 - DNA, 25 bp, Homo sapiens
gaactgtccttccatttgggatatg

SEQ ID NO: 958 - DNA, 25 bp, Homo sapiens
agtctagtagtttctctgtaaggca

SEQ ID NO: 959 - DNA, 25 bp, Homo sapiens
taatctaaaaagactaacctgccca

SEQ ID NO: 960 - DNA, 25 bp, Homo sapiens
ccacccactccttatattgctgtga

SEQ ID NO: 961 - DNA, 25 bp, Homo sapiens
ccttatattgctgtgagattgcccc

SEQ ID NO: 962 - DNA, 25 bp, Homo sapiens
aaaacatgggcgcttacactgttgc

SEQ ID NO: 963 - DNA, 25 bp, Homo sapiens
tgctgcctctacgttcaatggcttc

SEQ ID NO: 964 - DNA, 25 bp, Homo sapiens
ccagaggccgacgatctactatgtg

SEQ ID NO: 965 - DNA, 25 bp, Homo sapiens
tactatgtgatgtcagggcctgcgt

SEQ ID NO: 966 - DNA, 25 bp, Homo sapiens
gcctgcgtggcaactcatgcagcaa

SEQ ID NO: 967 - DNA, 25 bp, Homo sapiens
gcagcctgtgcttcggctagtatta

SEQ ID NO: 968 - DNA, 25 bp, Homo sapiens
agcactctggtagctgttaactgca

SEQ ID NO: 969 - DNA, 25 bp, Homo sapiens
agagtagggtcgccatgatgcagcc

SEQ ID NO: 970 - DNA, 25 bp, Homo sapiens
gggtcacacttatctgtgttcctat

SEQ ID NO: 971 - DNA, 25 bp, Homo sapiens
ttattcactcttcagacacgctact

SEQ ID NO: 972 - DNA, 25 bp, Homo sapiens
agacacgctactcaagagtgcccct

SEQ ID NO: 973 - DNA, 25 bp, Homo sapiens
tgccatggaaggattcgccactacc

SEQ ID NO: 974 - DNA, 25 bp, Homo sapiens
gcattgcctcaaaaactgggaccaa

SEQ ID NO: 975 - DNA, 25 bp, Homo sapiens
accaaccaaagtgtgtcaaccctgt

SEQ ID NO: 976 - DNA, 25 bp, Homo sapiens
tgtgtcaaccctgtttccttaaaag

SEQ ID NO: 977 - DNA, 25 bp, Homo sapiens
tgaatcccaaaggccacatccaaga

SEQ ID NO: 978 - DNA, 25 bp, Homo sapiens
taaggtttatagttccctcaacaca

SEQ ID NO: 979 - DNA, 25 bp, Homo sapiens
gttccctcaacacaattgctaatgc

SEQ ID NO: 980 - DNA, 25 bp, Homo sapiens
gaggatgccccaacaaactcatggc

SEQ ID NO: 981 - DNA, 25 bp, Homo sapiens
aactcatggcgttgaaaccacacag

SEQ ID NO: 982 - DNA, 25 bp, Homo sapiens
ttaccatgaatttacttcctcccaa

SEQ ID NO: 983 - DNA, 25 bp, Homo sapiens
ttcctcccaagagtttggactgccc

SEQ ID NO: 984 - DNA, 25 bp, Homo sapiens
aacactgcataacccgtttctttga

SEQ ID NO: 985 - DNA, 25 bp, Homo sapiens
tgaggagtgtgaccccaacaaggat

SEQ ID NO: 986 - DNA, 25 bp, Homo sapiens
aggataagcacatcaccctgaagga

SEQ ID NO: 987 - DNA, 25 bp, Homo sapiens
agtggggccactgctttggaattaa

SEQ ID NO: 988 - DNA, 25 bp, Homo sapiens
aaagaactcaactttccagcatcct

SEQ ID NO: 989 - DNA, 25 bp, Homo sapiens
ctcctctgttctaaccacttcagaa

SEQ ID NO: 990 - DNA, 25 bp, Homo sapiens
atatgcagctgtgatacttgtagat

SEQ ID NO: 991 - DNA, 25 bp, Homo sapiens
gcttgacaacaacctatgcaccagg

SEQ ID NO: 992 - DNA, 25 bp, Homo sapiens
gtaatttcactctctgcattgactt

SEQ ID NO: 993 - DNA, 25 bp, Homo sapiens
gttcataatatcatgtgcacttcaa

SEQ ID NO: 994 - DNA, 25 bp, Homo sapiens
ggaatgctactcttttgtggtttac

SEQ ID NO: 995 - DNA, 25 bp, Homo sapiens
tatgacttagttgcgttacaccctt

SEQ ID NO: 996 - DNA, 25 bp, Homo sapiens
cagcagtcggttggagcgagcatcc

SEQ ID NO: 997 - DNA, 25 bp, Homo sapiens
gcatcccccaaagttcacaatgtgg

SEQ ID NO: 998 - DNA, 25 bp, Homo sapiens
ggccgaggactttgattgcacattg

SEQ ID NO: 999 - DNA, 25 bp, Homo sapiens
ttgttacaggaagtcccttgccatc

SEQ ID NO: 1000 - DNA, 25 bp, Homo sapiens
taaggagaatggcccagtcctctcc

SEQ ID NO: 1001 - DNA, 25 bp, Homo sapiens
ttttgaatgatgagccttcgtgccc

SEQ ID NO: 1002 - DNA, 25 bp, Homo sapiens
tttttgtcccccaacttgagatgta

SEQ ID NO: 1003 - DNA, 25 bp, Homo sapiens
tgtatgaaggcttttggtctccctg

SEQ ID NO: 1004 - DNA, 25 bp, Homo sapiens
ggagtgggtggaggcagccagggct

SEQ ID NO: 1005 - DNA, 25 bp, Homo sapiens
gccagggcttacctgtacactgact

SEQ ID NO: 1006 - DNA, 25 bp, Homo sapiens
cttgctggatttgcattccttacag

SEQ ID NO: 1007 - DNA, 25 bp, Homo sapiens
ccctgccctggagttttgtattgct

SEQ ID NO: 1008 - DNA, 25 bp, Homo sapiens
tgtattgctgtcaaccccagcatcc

SEQ ID NO: 1009 - DNA, 25 bp, Homo sapiens
tcccactgctttcatgggcacagca

SEQ ID NO: 1010 - DNA, 25 bp, Homo sapiens
agcaatgatctttacctgcttcacc

SEQ ID NO: 1011 - DNA, 25 bp, Homo sapiens
tgatgtcagccctgagcttgttgct

SEQ ID NO: 1012 - DNA, 25 bp, Homo sapiens
gggactggtggtcatgtgtggcttc

SEQ ID NO: 1013 - DNA, 25 bp, Homo sapiens
tatctggcactgcattgatctcttc

SEQ ID NO: 1014 - DNA, 25 bp, Homo sapiens
gaaaactcatgatgatcctggccat

SEQ ID NO: 1015 - DNA, 25 bp, Homo sapiens
aaatgaagtgaccatccagcctttc

SEQ ID NO: 1016 - DNA, 25 bp, Homo sapiens
atttcctttttgcacacattacagg

SEQ ID NO: 1017 - DNA, 25 bp, Homo sapiens
ggcaggagcggaacaagcgcttcta

SEQ ID NO: 1018 - DNA, 25 bp, Homo sapiens
ggcccaggagccaatgtgaactttt

SEQ ID NO: 1019 - DNA, 25 bp, Homo sapiens
gggacaggtggcagagccgaggctt

SEQ ID NO: 1020 - DNA, 25 bp, Homo sapiens
agagccgaggcttagggtctggcac

SEQ ID NO: 1021 - DNA, 25 bp, Homo sapiens
ccccacagctggagacggaggctct

SEQ ID NO: 1022 - DNA, 25 bp, Homo sapiens
caggggtctgtgtctacagatgggc

SEQ ID NO: 1023 - DNA, 25 bp, Homo sapiens
tctacagatgggctgtggcccctgc

SEQ ID NO: 1024 - DNA, 25 bp, Homo sapiens
acgaggagagcatcgactggaccaa

SEQ ID NO: 1025 - DNA, 25 bp, Homo sapiens
ctggaccaagatcgagcccagcgtc

SEQ ID NO: 1026 - DNA, 25 bp, Homo sapiens
cttcctcaagtcgcccaaagacaac

SEQ ID NO: 1027 - DNA, 25 bp, Homo sapiens
caaagacaacgtggacgaccccacg

SEQ ID NO: 1028 - DNA, 25 bp, Homo sapiens
aaaggttggtcttcaggttgtggca

SEQ ID NO: 1029 - DNA, 25 bp, Homo sapiens
caggttgtggcagtcaaggctccag

SEQ ID NO: 1030 - DNA, 25 bp, Homo sapiens
atatggctattgctactggtggtgc

SEQ ID NO: 1031 - DNA, 25 bp, Homo sapiens
aagacgttcagcctcatgacttagg

SEQ ID NO: 1032 - DNA, 25 bp, Homo sapiens
gtgaccaaagacgatgccatgctct

SEQ ID NO: 1033 - DNA, 25 bp, Homo sapiens
ttgatcgaggctatatttctccata

SEQ ID NO: 1034 - DNA, 25 bp, Homo sapiens
aggatgcctatgttctgttgagtga

SEQ ID NO: 1035 - DNA, 25 bp, Homo sapiens
tagtatccagtccattgtacctgct

SEQ ID NO: 1036 - DNA, 25 bp, Homo sapiens
gctcttgaaattgccaatgctcacc

SEQ ID NO: 1037 - DNA, 25 bp, Homo sapiens
atgctcaccgtaagcctttggtcat

SEQ ID NO: 1038 - DNA, 25 bp, Homo sapiens
gaagctctaagtacactcgtcttga

SEQ ID NO: 1039 - DNA, 25 bp, Homo sapiens
aactgctttattggatgctgctggt

SEQ ID NO: 1040 - DNA, 25 bp, Homo sapiens
gaggtggcatgttctaactcctaga

SEQ ID NO: 1041 - DNA, 25 bp, Homo sapiens
ctcctagactagtgctttaccttta

SEQ ID NO: 1042 - DNA, 25 bp, Homo sapiens
gaactgtgacaggaagcccaaggca

SEQ ID NO: 1043 - DNA, 25 bp, Homo sapiens
aaggcagtgttcctcaccaataact

SEQ ID NO: 1044 - DNA, 25 bp, Homo sapiens
ggtttactgctgtcattgtccatgc

SEQ ID NO: 1045 - DNA, 25 bp, Homo sapiens
gtcattgtccatgcctacagataat

SEQ ID NO: 1046 - DNA, 25 bp, Homo sapiens
acatttgtacattcctgatactggg

SEQ ID NO: 1047 - DNA, 25 bp, Homo sapiens
gccatgtaccagtgtactgctttca

SEQ ID NO: 1048 - DNA, 25 bp, Homo sapiens
gaggcatttttactactattctgtt

SEQ ID NO: 1049 - DNA, 25 bp, Homo sapiens
gaagttaagcagcctttctgtggag

SEQ ID NO: 1050 - DNA, 25 bp, Homo sapiens
agtggtcgccctggacaagaacttc

SEQ ID NO: 1051 - DNA, 25 bp, Homo sapiens
tggtcgccctggacaagaacttcca

SEQ ID NO: 1052 - DNA, 25 bp, Homo sapiens
tgttacaagtgtgaggactgcggga

SEQ ID NO: 1053 - DNA, 25 bp, Homo sapiens
gtcgattgaggcagatgacaatggc

SEQ ID NO: 1054 - DNA, 25 bp, Homo sapiens
gcagatgacaatggctgcttccccc

SEQ ID NO: 1055 - DNA, 25 bp, Homo sapiens
tcggaagtgccacactgctagagcc

SEQ ID NO: 1056 - DNA, 25 bp, Homo sapiens
ctgacccaggacccaacatggtcta

SEQ ID NO: 1057 - DNA, 25 bp, Homo sapiens
tgacccaggacccaacatggtctag

SEQ ID NO: 1058 - DNA, 25 bp, Homo sapiens
aggacccaacatggtctagggatgc

SEQ ID NO: 1059 - DNA, 25 bp, Homo sapiens
acccaacatggtctagggatgcagg

SEQ ID NO: 1060 - DNA, 25 bp, Homo sapiens
aacatggtctagggatgcaggatcc

SEQ ID NO: 1061 - DNA, 25 bp, Homo sapiens
ttctgagtgtagtgtggtaggaccc

SEQ ID NO: 1062 - DNA, 25 bp, Homo sapiens
cgccccacagtagacgtgcagacgt

SEQ ID NO: 1063 - DNA, 25 bp, Homo sapiens
cagtagacgtgcagacgtccctgag

SEQ ID NO: 1064 - DNA, 25 bp, Homo sapiens
gacgtgcagacgtccctgagaggtt

SEQ ID NO: 1065 - DNA, 25 bp, Homo sapiens
gcagacgtccctgagaggttcttga

SEQ ID NO: 1066 - DNA, 25 bp, Homo sapiens
gacgtccctgagaggttcttgaaga

SEQ ID NO: 1067 - DNA, 25 bp, Homo sapiens
gagaggttcttgaagatgtttattt

SEQ ID NO: 1068 - DNA, 25 bp, Homo sapiens
tattgtccttttttactggaagacg

SEQ ID NO: 1069 - DNA, 25 bp, Homo sapiens
tggaagacgtacgcatactccatcg

SEQ ID NO: 1070 - DNA, 25 bp, Homo sapiens
ttgcagtggctgaggaattcttgta

SEQ ID NO: 1071 - DNA, 25 bp, Homo sapiens
agtggctgaggaattcttgtacgca

SEQ ID NO: 1072 - DNA, 25 bp, Homo sapiens
aactctccaagtacctgcgggatta

SEQ ID NO: 1073 - DNA, 25 bp, Homo sapiens
gattggggcttatgccaaggccttg

SEQ ID NO: 1074 - DNA, 25 bp, Homo sapiens
aaggccttggagattatcccacgcc

SEQ ID NO: 1075 - DNA, 25 bp, Homo sapiens
cccacgccagctgtgtgacaatgct

SEQ ID NO: 1076 - DNA, 25 bp, Homo sapiens
gacaatgctggctttgatgccacaa

SEQ ID NO: 1077 - DNA, 25 bp, Homo sapiens
tcggcatgcccaggggggtacatgg

SEQ ID NO: 1078 - DNA, 25 bp, Homo sapiens
tgtgggagccagctatggtgcggat

SEQ ID NO: 1079 - DNA, 25 bp, Homo sapiens
tggtgcggatcaatgcgctgacagc

SEQ ID NO: 1080 - DNA, 25 bp, Homo sapiens
cgtgcctgatcgtgtctgtagatga

SEQ ID NO: 1081 - DNA, 25 bp, Homo sapiens
gctcgactgtggatgctcccacagc

SEQ ID NO: 1082 - DNA, 25 bp, Homo sapiens
gaaggggtagtaattggcccactct

SEQ ID NO: 1083 - DNA, 25 bp, Homo sapiens
ggaggaagcaagcgtgtcttcccct

SEQ ID NO: 1084 - DNA, 25 bp, Homo sapiens
cagcacacagcgacttgcgttgaca

SEQ ID NO: 1085 - DNA, 25 bp, Homo sapiens
ttacttgggagattgccacagcctg

SEQ ID NO: 1086 - DNA, 25 bp, Homo sapiens
agcctgctgctgagttgagttacca

SEQ ID NO: 1087 - DNA, 25 bp, Homo sapiens
ttgagttaccagacatcctccatgt

SEQ ID NO: 1088 - DNA, 25 bp, Homo sapiens
gaagcagcgaacattgaatctcagg

SEQ ID NO: 1089 - DNA, 25 bp, Homo sapiens
gaatctcagggatggcccacaactg

SEQ ID NO: 1090 - DNA, 25 bp, Homo sapiens
gcccacaactgggtccacatgtaat

SEQ ID NO: 1091 - DNA, 25 bp, Homo sapiens
agcagtccgtctacaacctggaatc

SEQ ID NO: 1092 - DNA, 25 bp, Homo sapiens
caaaatttcctgcactgctgtctga

SEQ ID NO: 1093 - DNA, 25 bp, Homo sapiens
aattggtttagaggttcactgctgc

SEQ ID NO: 1094 - DNA, 25 bp, Homo sapiens
ggttactttcatgtccagctgtata

SEQ ID NO: 1095 - DNA, 25 bp, Homo sapiens
ggggggagggcaagctggatttaca

SEQ ID NO: 1096 - DNA, 25 bp, Homo sapiens
ggatttacaggtcacggctggactg

SEQ ID NO: 1097 - DNA, 25 bp, Homo sapiens
gactgaatgggcctttttatcttcc

SEQ ID NO: 1098 - DNA, 25 bp, Homo sapiens
tttatcttcccactgtatcatggaa

SEQ ID NO: 1099 - DNA, 25 bp, Homo sapiens
tggaagtagctgcttgcttgtactg

SEQ ID NO: 1100 - DNA, 25 bp, Homo sapiens
catccctaaagctcactctgaagat

SEQ ID NO: 1101 - DNA, 25 bp, Homo sapiens
tgacactgacatgaaggcaagcctt

SEQ ID NO: 1102 - DNA, 25 bp, Homo sapiens
ggcaagccttgatttcgtatgaacg

SEQ ID NO: 1103 - DNA, 25 bp, Homo sapiens
gttccccagattgttaagagttcac

SEQ ID NO: 1104 - DNA, 25 bp, Homo sapiens
ttgttgctctcagactgtgtaaaac

SEQ ID NO: 1105 - DNA, 25 bp, Homo sapiens
gccggaagtggtgaagacgcacctg

SEQ ID NO: 1106 - DNA, 25 bp, Homo sapiens
agacgcacctgcgggacatgatcat

SEQ ID NO: 1107 - DNA, 25 bp, Homo sapiens
acctgcgggacatgatcatcctacc

SEQ ID NO: 1108 - DNA, 25 bp, Homo sapiens
tgcgggacatgatcatcctacccga

SEQ ID NO: 1109 - DNA, 25 bp, Homo sapiens
cgggacatgatcatcctacccgaga

SEQ ID NO: 1110 - DNA, 25 bp, Homo sapiens
acatgatcatcctacccgagatggt

SEQ ID NO: 1111 - DNA, 25 bp, Homo sapiens
atgatcatcctacccgagatggtgg

SEQ ID NO: 1112 - DNA, 25 bp, Homo sapiens
cctacccgagatggtgggcagcatg

SEQ ID NO: 1113 - DNA, 25 bp, Homo sapiens
tgggcgtctacaacggcaagacctt

SEQ ID NO: 1114 - DNA, 25 bp, Homo sapiens
ggcgtctacaacggcaagaccttca

SEQ ID NO: 1115 - DNA, 25 bp, Homo sapiens
ctacaacggcaagaccttcaaccag

SEQ ID NO: 1116 - DNA, 25 bp, Homo sapiens
tccacacggagttggagcggctgcc

SEQ ID NO: 1117 - DNA, 25 bp, Homo sapiens
ctgcctgccaaggacatacagacca

SEQ ID NO: 1118 - DNA, 25 bp, Homo sapiens
ccagtgtccctggagcaatacctga

SEQ ID NO: 1119 - DNA, 25 bp, Homo sapiens
gagggcagctacaacaaagtgttcc

SEQ ID NO: 1120 - DNA, 25 bp, Homo sapiens
ttcctggccaagggtaacatccccg

SEQ ID NO: 1121 - DNA, 25 bp, Homo sapiens
tgacatcctgctcgacactatcagg

SEQ ID NO: 1122 - DNA, 25 bp, Homo sapiens
tcagggatgagatcgctgggtgcat

SEQ ID NO: 1123 - DNA, 25 bp, Homo sapiens
cgctgggtgcatcgagaaggcctac

SEQ ID NO: 1124 - DNA, 25 bp, Homo sapiens
caagaagcgagggtgggtcctgggc

SEQ ID NO: 1125 - DNA, 25 bp, Homo sapiens
ccctccacagaactggccaaacagg

SEQ ID NO: 1126 - DNA, 25 bp, Homo sapiens
cagctggagatgatcgtctgagccc

SEQ ID NO: 1127 - DNA, 25 bp, Homo sapiens
aaacgtcaccaaggtggcttctcct

SEQ ID NO: 1128 - DNA, 25 bp, Homo sapiens
agaaggcaggagtgctgccctctcc

SEQ ID NO: 1129 - DNA, 25 bp, Homo sapiens
gtgcctctgtgctgtgtatgtgaac

SEQ ID NO: 1130 - DNA, 25 bp, Homo sapiens
tatggaggctctgtgactggggcaa

SEQ ID NO: 1131 - DNA, 25 bp, Homo sapiens
gcagcccagaagcccagtaactgcc

SEQ ID NO: 1132 - DNA, 25 bp, Homo sapiens
ctttccctgcatatgcttctgatgg

SEQ ID NO: 1133 - DNA, 25 bp, Homo sapiens
ttctgatggtgtcatctgctccttc

SEQ ID NO: 1134 - DNA, 25 bp, Homo sapiens
ctcatccaaactgtatcttccttta

SEQ ID NO: 1135 - DNA, 25 bp, Homo sapiens
tttactgtttatatcttcaccctgt

SEQ ID NO: 1136 - DNA, 25 bp, Homo sapiens
atggttgggaccaggccaatccctt

SEQ ID NO: 1137 - DNA, 25 bp, Homo sapiens
atcccttctccacttactataatgg

SEQ ID NO: 1138 - DNA, 25 bp, Homo sapiens
tcctgaggaacatgcgctttgccaa

SEQ ID NO: 1139 - DNA, 25 bp, Homo sapiens
gccaaggccatgagtgcacgtgccg

SEQ ID NO: 1140 - DNA, 25 bp, Homo sapiens
tgcacgtgccgaggctatcaaggcc

SEQ ID NO: 1141 - DNA, 25 bp, Homo sapiens
tcaaggccctcgtaaagcccaagga

SEQ ID NO: 1142 - DNA, 25 bp, Homo sapiens
agccgcaagctcgatcgacttgcct

SEQ ID NO: 1143 - DNA, 25 bp, Homo sapiens
caagcttgggaagcgtgctcgtgcc

SEQ ID NO: 1144 - DNA, 25 bp, Homo sapiens
tcgtgcccgtattgccaaggggctc

SEQ ID NO: 1145 - DNA, 25 bp, Homo sapiens
ctgtgccggccaaaggccaaggcca

SEQ ID NO: 1146 - DNA, 25 bp, Homo sapiens
atcaaaccaaggcccaggctgcagc

SEQ ID NO: 1147 - DNA, 25 bp, Homo sapiens
ccaggcccctacaaaggcttcagag

SEQ ID NO: 1148 - DNA, 25 bp, Homo sapiens
taccatctgcatggggctggggtcc

SEQ ID NO: 1149 - DNA, 25 bp, Homo sapiens
cccctgccacactgatggctcaaga

SEQ ID NO: 1150 - DNA, 25 bp, Homo sapiens
cctcccagaaacatctctggcccag

SEQ ID NO: 1151 - DNA, 25 bp, Homo sapiens
cagagggcatgctgaatgccccctg

SEQ ID NO: 1152 - DNA, 25 bp, Homo sapiens
tgccccctgcttacttggtgagggt

SEQ ID NO: 1153 - DNA, 25 bp, Homo sapiens
gctctcagctggcagtgcaatgctt

SEQ ID NO: 1154 - DNA, 25 bp, Homo sapiens
agggcaagaacccaagtgcctcacc

SEQ ID NO: 1155 - DNA, 25 bp, Homo sapiens
gtgcctcacctcgaaaggaggccct

SEQ ID NO: 1156 - DNA, 25 bp, Homo sapiens
gccctgttccctggagtcagggtga

SEQ ID NO: 1157 - DNA, 25 bp, Homo sapiens
ttgagataccacaaaccctgctgaa

SEQ ID NO: 1158 - DNA, 25 bp, Homo sapiens
gtgtctgttcagcaaactaaccagc

SEQ ID NO: 1159 - DNA, 25 bp, Homo sapiens
gcattccctacagcctagggcagac

SEQ ID NO: 1160 - DNA, 25 bp, Homo sapiens
tggccaaggacatgcagccatccat

SEQ ID NO: 1161 - DNA, 25 bp, Homo sapiens
ggaatcagatatggccctagtcaag

SEQ ID NO: 1162 - DNA, 25 bp, Homo sapiens
gaagtggccctggttaaggatgtca

SEQ ID NO: 1163 - DNA, 25 bp, Homo sapiens
gcccacagaaacagaggtagcccca

SEQ ID NO: 1164 - DNA, 25 bp, Homo sapiens
gtagccccagccaaggatgtgacac

SEQ ID NO: 1165 - DNA, 25 bp, Homo sapiens
ccctgcaacacagctgttgtacctc

SEQ ID NO: 1166 - DNA, 25 bp, Homo sapiens
tgtacctcaggggtggtctgtggaa

SEQ ID NO: 1167 - DNA, 25 bp, Homo sapiens
tggaagccttaaactctccacactc

SEQ ID NO: 1168 - DNA, 25 bp, Homo sapiens
acggcagttcccttagagctagcca

SEQ ID NO: 1169 - DNA, 25 bp, Homo sapiens
tgaagactactgacatggcaccatc

SEQ ID NO: 1170 - DNA, 25 bp, Homo sapiens
ccctcgccaaggacatggcactagc

SEQ ID NO: 1171 - DNA, 25 bp, Homo sapiens
cgagtggtgacaggacgctgaccgt

SEQ ID NO: 1172 - DNA, 25 bp, Homo sapiens
gaccgtggagcttaagccactgcct

SEQ ID NO: 1173 - DNA, 25 bp, Homo sapiens
ctgccctgccccaagttgggggtca

SEQ ID NO: 1174 - DNA, 25 bp, Homo sapiens
tctgcaggttgaagccatgtctaca

SEQ ID NO: 1175 - DNA, 25 bp, Homo sapiens
gggcggagatatccttatgccaccc

SEQ ID NO: 1176 - DNA, 25 bp, Homo sapiens
ctggaggcggtgcggcagggaagag

SEQ ID NO: 1177 - DNA, 25 bp, Homo sapiens
ctggtgagccggtcaggcacacaag

SEQ ID NO: 1178 - DNA, 25 bp, Homo sapiens
cacaaggggcccttggagcgtggac

SEQ ID NO: 1179 - DNA, 25 bp, Homo sapiens
ggagcgtggactggttggttttgcc

SEQ ID NO: 1180 - DNA, 25 bp, Homo sapiens
gtcccattccctgggatctggtggt

SEQ ID NO: 1181 - DNA, 25 bp, Homo sapiens
gatctggtggtcagccctaggataa

SEQ ID NO: 1182 - DNA, 25 bp, Homo sapiens
cagttggcacttctgtctagaaaat

SEQ ID NO: 1183 - DNA, 25 bp, Homo sapiens
gcaagttgtataactcaggcgtctt

SEQ ID NO: 1184 - DNA, 25 bp, Homo sapiens
gttgtataactcaggcgtctttgca

SEQ ID NO: 1185 - DNA, 25 bp, Homo sapiens
ataactcaggcgtctttgcatttct

SEQ ID NO: 1186 - DNA, 25 bp, Homo sapiens
tcaggcgtctttgcatttctgcgaa

SEQ ID NO: 1187 - DNA, 25 bp, Homo sapiens
ggcgtctttgcatttctgcgaaaga

SEQ ID NO: 1188 - DNA, 25 bp, Homo sapiens
atttctgcgaaagatcaaggtctgc

SEQ ID NO: 1189 - DNA, 25 bp, Homo sapiens
gatcaaggtctgcaagggaattctt

SEQ ID NO: 1190 - DNA, 25 bp, Homo sapiens
aagggaattcttgtgtgctgctttc

SEQ ID NO: 1191 - DNA, 25 bp, Homo sapiens
ggaattcttgtgtgctgctttccat

SEQ ID NO: 1192 - DNA, 25 bp, Homo sapiens
atttgacaccgcagttctgttcagc

SEQ ID NO: 1193 - DNA, 25 bp, Homo sapiens
ccaggtcacccttttcacaagggct

SEQ ID NO: 1194 - DNA, 25 bp, Homo sapiens
agggcttctgaagaccttaagactc

SEQ ID NO: 1195 - DNA, 25 bp, Homo sapiens
accactgccagggatcaagatcttg

SEQ ID NO: 1196 - DNA, 25 bp, Homo sapiens
aacctggtgctccatccatgggagc

SEQ ID NO: 1197 - DNA, 25 bp, Homo sapiens
gggagctaaaagcctttgcatcccc

SEQ ID NO: 1198 - DNA, 25 bp, Homo sapiens
caaaccactctgtgaactgcagcct

SEQ ID NO: 1199 - DNA, 25 bp, Homo sapiens
cagcctggagccaaatgtgtctgtg

SEQ ID NO: 1200 - DNA, 25 bp, Homo sapiens
gcaagaaccctgccaagtactacac

SEQ ID NO: 1201 - DNA, 25 bp, Homo sapiens
gtactacaccttatttggtcgcagc

SEQ ID NO: 1202 - DNA, 25 bp, Homo sapiens
ttggtcgcagctactgagggatgaa

SEQ ID NO: 1203 - DNA, 25 bp, Homo sapiens
gagggatgaacgaaagccccctctt

SEQ ID NO: 1204 - DNA, 25 bp, Homo sapiens
ttaccttttcccatcatcgatgata

SEQ ID NO: 1205 - DNA, 25 bp, Homo sapiens
taggaatcgggagcttgccatcctg

SEQ ID NO: 1206 - DNA, 25 bp, Homo sapiens
gccatcctgttgggcatgctggatc

SEQ ID NO: 1207 - DNA, 25 bp, Homo sapiens
catgcctgtgacagctcgtgtggtg

SEQ ID NO: 1208 - DNA, 25 bp, Homo sapiens
agattctcagggtagtcatctctct

SEQ ID NO: 1209 - DNA, 25 bp, Homo sapiens
ggatagtgtgatggtccttccaacc

SEQ ID NO: 1210 - DNA, 25 bp, Homo sapiens
ggagtcttcaccaaagagctcccat

SEQ ID NO: 1211 - DNA, 25 bp, Homo sapiens
gtgagccagaggatgtcagctgcca

SEQ ID NO: 1212 - DNA, 25 bp, Homo sapiens
gtcagctgccaattgtgttttcctg

SEQ ID NO: 1213 - DNA, 25 bp, Homo sapiens
gtgttttcctgcagcaattccataa

SEQ ID NO: 1214 - DNA, 25 bp, Homo sapiens
catcctggtgtcatcacagccaagg

SEQ ID NO: 1215 - DNA, 25 bp, Homo sapiens
cgcaattccgccaaagccaagaaat

SEQ ID NO: 1216 - DNA, 25 bp, Homo sapiens
cctgtgccccagatgatggattgat

SEQ ID NO: 1217 - DNA, 25 bp, Homo sapiens
ggggaacatggagccttggtgtatt

SEQ ID NO: 1218 - DNA, 25 bp, Homo sapiens
tgaatcaatagcagcgtccagtccc

SEQ ID NO: 1219 - DNA, 25 bp, Homo sapiens
gcggtactgtgagcaggatcctggg

SEQ ID NO: 1220 - DNA, 25 bp, Homo sapiens
agctcccaactactgtggcgagttt

SEQ ID NO: 1221 - DNA, 25 bp, Homo sapiens
gcgagtttgacaatgctggcgccat

SEQ ID NO: 1222 - DNA, 25 bp, Homo sapiens
acaatgctggcgccatgatgagtgt

SEQ ID NO: 1223 - DNA, 25 bp, Homo sapiens
tgagtgtggacgagaccctcatgtg

SEQ ID NO: 1224 - DNA, 25 bp, Homo sapiens
caagcccgccgacaagaacaagggg

SEQ ID NO: 1225 - DNA, 25 bp, Homo sapiens
aagtacgggcagttcagtggcctga

SEQ ID NO: 1226 - DNA, 25 bp, Homo sapiens
atttctaaaacctgtgatgccctaa

SEQ ID NO: 1227 - DNA, 25 bp, Homo sapiens
aggtggttgtagctgatgagttatt

SEQ ID NO: 1228 - DNA, 25 bp, Homo sapiens
ttatgctaatttgtgagttctgatc

SEQ ID NO: 1229 - DNA, 25 bp, Homo sapiens
tctgatcacttttgagctctgaagc

SEQ ID NO: 1230 - DNA, 25 bp, Homo sapiens
gagctctgaagctttgaatcattca

SEQ ID NO: 1231 - DNA, 25 bp, Homo sapiens
tcagtggtggagatggccttctggt

SEQ ID NO: 1232 - DNA, 25 bp, Homo sapiens
ggagatggccttctggtaactgaat

SEQ ID NO: 1233 - DNA, 25 bp, Homo sapiens
taactgaatattaccttctgtagga

SEQ ID NO: 1234 - DNA, 25 bp, Homo sapiens
tgtgaatgactctgtgctggcaaaa

SEQ ID NO: 1235 - DNA, 25 bp, Homo sapiens
aaacctctatatttctttcgttcat

SEQ ID NO: 1236 - DNA, 25 bp, Homo sapiens
taacaaaagcatgcagttctctgtg

SEQ ID NO: 1237 - DNA, 25 bp, Homo sapiens
tggctacgacgacttcaactgcaac

SEQ ID NO: 1238 - DNA, 25 bp, Homo sapiens
tcaactgcaacatctgggatgccat

SEQ ID NO: 1239 - DNA, 25 bp, Homo sapiens
gggatgccatgaagggcgaccgtgc

SEQ ID NO: 1240 - DNA, 25 bp, Homo sapiens
gtcaccgacgatggcatggctgtgg

SEQ ID NO: 1241 - DNA, 25 bp, Homo sapiens
ggactccttcctcaagatctggaac

SEQ ID NO: 1242 - DNA, 25 bp, Homo sapiens
aagatctggaactaatggccccacc

SEQ ID NO: 1243 - DNA, 25 bp, Homo sapiens
cactgggcccaggccaggaggggcc

SEQ ID NO: 1244 - DNA, 25 bp, Homo sapiens
catgcccacactacaggccagggct

SEQ ID NO: 1245 - DNA, 25 bp, Homo sapiens
tggagggccggacagggaggtggaa

SEQ ID NO: 1246 - DNA, 25 bp, Homo sapiens
gaggtggaaaccccaggggctggct

SEQ ID NO: 1247 - DNA, 25 bp, Homo sapiens
caacatcatctgtggcatcacctct

SEQ ID NO: 1248 - DNA, 25 bp, Homo sapiens
acctcaccgcagaggtacttgaact

SEQ ID NO: 1249 - DNA, 25 bp, Homo sapiens
gaggtacttgaactggcaggaaatg

SEQ ID NO: 1250 - DNA, 25 bp, Homo sapiens
gaactggcaggaaatgcatcaaaag

SEQ ID NO: 1251 - DNA, 25 bp, Homo sapiens
agaattggattctctcatcaaggct

SEQ ID NO: 1252 - DNA, 25 bp, Homo sapiens
ggattctctcatcaaggctacaatt

SEQ ID NO: 1253 - DNA, 25 bp, Homo sapiens
ctctcatcaaggctacaattgctgg

SEQ ID NO: 1254 - DNA, 25 bp, Homo sapiens
tcaaggctacaattgctggtggtgg

SEQ ID NO: 1255 - DNA, 25 bp, Homo sapiens
agtgttggtgattccagtggactgt

SEQ ID NO: 1256 - DNA, 25 bp, Homo sapiens
gtgattccagtggactgtatctctg

SEQ ID NO: 1257 - DNA, 25 bp, Homo sapiens
acatttggttttgttcagaccttat

SEQ ID NO: 1258 - DNA, 25 bp, Homo sapiens
gttttgttcagaccttatttccact

SEQ ID NO: 1259 - DNA, 25 bp, Homo sapiens
gtttgtagactctctgaccaaggcc

SEQ ID NO: 1260 - DNA, 25 bp, Homo sapiens
gctgacgccagcaaggtggtggcca

SEQ ID NO: 1261 - DNA, 25 bp, Homo sapiens
cctggggctgagcaaggcctacgta

SEQ ID NO: 1262 - DNA, 25 bp, Homo sapiens
acaacatgctgctggtgggggttca

SEQ ID NO: 1263 - DNA, 25 bp, Homo sapiens
gatcctggtgaagcacgtgggcagc

SEQ ID NO: 1264 - DNA, 25 bp, Homo sapiens
gcgtgtcctacctgctcaaggacaa

SEQ ID NO: 1265 - DNA, 25 bp, Homo sapiens
gggggagtacacactggtggtcaaa

SEQ ID NO: 1266 - DNA, 25 bp, Homo sapiens
aaatgggggcacgagcacatcccag

SEQ ID NO: 1267 - DNA, 25 bp, Homo sapiens
cgttgtggtgccctgagtctggggc

SEQ ID NO: 1268 - DNA, 25 bp, Homo sapiens
tctcggctttcacttgggcagaggg

SEQ ID NO: 1269 - DNA, 25 bp, Homo sapiens
gagggagccatttggtggcgctgct

SEQ ID NO: 1270 - DNA, 25 bp, Homo sapiens
atcgtggagctgtaggtgccttatt

SEQ ID NO: 1271 - DNA, 25 bp, Homo sapiens
aagagtgatctacgtcatctcaggg

SEQ ID NO: 1272 - DNA, 25 bp, Homo sapiens
gtcattcattgaaacttcggcccta

SEQ ID NO: 1273 - DNA, 25 bp, Homo sapiens
cttcggccctagactctacaaatgt

SEQ ID NO: 1274 - DNA, 25 bp, Homo sapiens
gatttaccgcattgtttctcagaag

SEQ ID NO: 1275 - DNA, 25 bp, Homo sapiens
tgtggttcctattcatgttccacca

SEQ ID NO: 1276 - DNA, 25 bp, Homo sapiens
ggtgcagtgctgtcagaacatctaa

SEQ ID NO: 1277 - DNA, 25 bp, Homo sapiens
aacatctaaggcatttctcttctcc

SEQ ID NO: 1278 - DNA, 25 bp, Homo sapiens
ctcttctcccctagaaggctgtgta

SEQ ID NO: 1279 - DNA, 25 bp, Homo sapiens
aaggctgtgtatagtccatttccca

SEQ ID NO: 1280 - DNA, 25 bp, Homo sapiens
atagtccatttcccaggtctgagat

SEQ ID NO: 1281 - DNA, 25 bp, Homo sapiens
gtggtatggaatcctactgcgttcg

SEQ ID NO: 1282 - DNA, 25 bp, Homo sapiens
gcgttcgtgcttttgcagatgctat

SEQ ID NO: 1283 - DNA, 25 bp, Homo sapiens
gtcattccatctacactagctgaaa

SEQ ID NO: 1284 - DNA, 25 bp, Homo sapiens
ctagctgaaaatgccggcctgaatc

SEQ ID NO: 1285 - DNA, 25 bp, Homo sapiens
ggcctgaatcccatttctacagtaa

SEQ ID NO: 1286 - DNA, 25 bp, Homo sapiens
gaactaagaaaccggcatgcccagg

SEQ ID NO: 1287 - DNA, 25 bp, Homo sapiens
tggaggaactggttgtccagcctct

SEQ ID NO: 1288 - DNA, 25 bp, Homo sapiens
ccagcctctgttggtatcagtcagt

SEQ ID NO: 1289 - DNA, 25 bp, Homo sapiens
cagtgctctgactcttgcaactgaa

SEQ ID NO: 1290 - DNA, 25 bp, Homo sapiens
gactagcaccattatgatcaccagt

SEQ ID NO: 1291 - DNA, 25 bp, Homo sapiens
tctgggcttggtcttccagttggca

SEQ ID NO: 1292 - DNA, 25 bp, Homo sapiens
cactttgcaactccctgggtaagag

SEQ ID NO: 1293 - DNA, 25 bp, Homo sapiens
ggacgacacctctggtttttcaata

SEQ ID NO: 1294 - DNA, 25 bp, Homo sapiens
acacacaaagcacattgggccaact

SEQ ID NO: 1295 - DNA, 25 bp, Homo sapiens
ggccaactatttagtaagcccggat

SEQ ID NO: 1296 - DNA, 25 bp, Homo sapiens
aagcccggatagacttattgccaaa

SEQ ID NO: 1297 - DNA, 25 bp, Homo sapiens
aattccttagtcatggtgttgcgta

SEQ ID NO: 1298 - DNA, 25 bp, Homo sapiens
tattttagctgcacggcattacccc

SEQ ID NO: 1299 - DNA, 25 bp, Homo sapiens
gcattaccccacacagggtggcaga

SEQ ID NO: 1300 - DNA, 25 bp, Homo sapiens
taagggcattttacccttgcagttt

SEQ ID NO: 1301 - DNA, 25 bp, Homo sapiens
ccaagcttcatattaaccctacctg

SEQ ID NO: 1302 - DNA, 25 bp, Homo sapiens
taaccctacctgtcaacgtaacgat

SEQ ID NO: 1303 - DNA, 25 bp, Homo sapiens
gcacctcacatttgatgtggaaacg

SEQ ID NO: 1304 - DNA, 25 bp, Homo sapiens
agaacctcaggggtgggagctgccc

SEQ ID NO: 1305 - DNA, 25 bp, Homo sapiens
ccggacaagccactgagcgcaaatg

SEQ ID NO: 1306 - DNA, 25 bp, Homo sapiens
gccactgagcgcaaatgtacccaat

SEQ ID NO: 1307 - DNA, 25 bp, Homo sapiens
tgtacccaatgataagttcacccaa

SEQ ID NO: 1308 - DNA, 25 bp, Homo sapiens
atgataagttcacccaaaaccccat

SEQ ID NO: 1309 - DNA, 25 bp, Homo sapiens
tctgccatcagtcccggggagaaca

SEQ ID NO: 1310 - DNA, 25 bp, Homo sapiens
agtcccggggagaacagcaagagca

SEQ ID NO: 1311 - DNA, 25 bp, Homo sapiens
gtaccaggactacagcctgtcgtca

SEQ ID NO: 1312 - DNA, 25 bp, Homo sapiens
tcgtcagcccacaaggtgtcaggca

SEQ ID NO: 1313 - DNA, 25 bp, Homo sapiens
gctgcccgaactgaccagatatgac

SEQ ID NO: 1314 - DNA, 25 bp, Homo sapiens
catcgagatggaacagcggctggag

SEQ ID NO: 1315 - DNA, 25 bp, Homo sapiens
gcctgcccagaaatgaagcccggcc

SEQ ID NO: 1316 - DNA, 25 bp, Homo sapiens
tgcttcctaacttattgcctgcagt

SEQ ID NO: 1317 - DNA, 25 bp, Homo sapiens
gagcccttagccttgctgtaaggaa

SEQ ID NO: 1318 - DNA, 25 bp, Homo sapiens
tgtaaggaaggcttccgtcaccctt

SEQ ID NO: 1319 - DNA, 25 bp, Homo sapiens
ttccgtcacccttggtagagtttat

SEQ ID NO: 1320 - DNA, 25 bp, Homo sapiens
cctcacccagattgaaactctcttc

SEQ ID NO: 1321 - DNA, 25 bp, Homo sapiens
gctgcgggcaggtgtcgatatcaag

SEQ ID NO: 1322 - DNA, 25 bp, Homo sapiens
agttctcggaggtgcttaagcggct

SEQ ID NO: 1323 - DNA, 25 bp, Homo sapiens
taagcggctgcgacttcagaagcga

SEQ ID NO: 1324 - DNA, 25 bp, Homo sapiens
gaagcgaggcacaggcggtgtggac

SEQ ID NO: 1325 - DNA, 25 bp, Homo sapiens
ggaaccatgctaagccatgaccagt

SEQ ID NO: 1326 - DNA, 25 bp, Homo sapiens
cctgggggctctagtcattccagtg

SEQ ID NO: 1327 - DNA, 25 bp, Homo sapiens
tggtgatgtgacaactgtttcctcc

SEQ ID NO: 1328 - DNA, 25 bp, Homo sapiens
gaccccagaggatctggctctaggt

SEQ ID NO: 1329 - DNA, 25 bp, Homo sapiens
ggcggttgaaatagtcccacatgtg

SEQ ID NO: 1330 - DNA, 25 bp, Homo sapiens
atataggatcagctccttgacctct

SEQ ID NO: 1331 - DNA, 25 bp, Homo sapiens
ggtgtgtgtattagaatcccttcct

SEQ ID NO: 1332 - DNA, 25 bp, Homo sapiens
cagtgaaatgcctcttggtcctgtc

SEQ ID NO: 1333 - DNA, 25 bp, Homo sapiens
atcatgttctagttgcttgaccctg

SEQ ID NO: 1334 - DNA, 25 bp, Homo sapiens
cttgaccctgccacatgggtccagt

SEQ ID NO: 1335 - DNA, 25 bp, Homo sapiens
gcataactgtactaaatcctttttc

SEQ ID NO: 1336 - DNA, 25 bp, Homo sapiens
tctttacttaacctgccctaatatt

SEQ ID NO: 1337 - DNA, 25 bp, Homo sapiens
atttttcggcctgatgggaattagt

SEQ ID NO: 1338 - DNA, 25 bp, Homo sapiens
gtcaccatagaaggcaactcctact

SEQ ID NO: 1339 - DNA, 25 bp, Homo sapiens
ggcaactcctacttgtgtgtggact

SEQ ID NO: 1340 - DNA, 25 bp, Homo sapiens
gagtctgtggcgataatattgctga

SEQ ID NO: 1341 - DNA, 25 bp, Homo sapiens
gcagtcttcaatcaaacagttacag

SEQ ID NO: 1342 - DNA, 25 bp, Homo sapiens
tgtatatgttccttgctggtcttgg

SEQ ID NO: 1343 - DNA, 25 bp, Homo sapiens
gggcttctggttattgttggccttc

SEQ ID NO: 1344 - DNA, 25 bp, Homo sapiens
gccttcatcaactcctagaatctag

SEQ ID NO: 1345 - DNA, 25 bp, Homo sapiens
cttcaccaagaaggttgcccaggaa

SEQ ID NO: 1346 - DNA, 25 bp, Homo sapiens
tgtgcaacaattcggtctttactta

SEQ ID NO: 1347 - DNA, 25 bp, Homo sapiens
tcaacctggccatgtgtcatctgaa

SEQ ID NO: 1348 - DNA, 25 bp, Homo sapiens
atctgaaactacaggccttctctgc

SEQ ID NO: 1349 - DNA, 25 bp, Homo sapiens
ccttctctgctgccattgaaagctg

SEQ ID NO: 1350 - DNA, 25 bp, Homo sapiens
aacaaggccctagaactggacagca

SEQ ID NO: 1351 - DNA, 25 bp, Homo sapiens
gaatgactttgaactggcacgggct

SEQ ID NO: 1352 - DNA, 25 bp, Homo sapiens
ggcacgggctgatttccagaaggtc

SEQ ID NO: 1353 - DNA, 25 bp, Homo sapiens
tttccagaaggtcctgcagctctac

SEQ ID NO: 1354 - DNA, 25 bp, Homo sapiens
tgtgccagcagcggatccgaaggca

SEQ ID NO: 1355 - DNA, 25 bp, Homo sapiens
tccgaaggcagcttgcccgggagaa

SEQ ID NO: 1356 - DNA, 25 bp, Homo sapiens
gaagaagctctatgccaatatgttt

SEQ ID NO: 1357 - DNA, 25 bp, Homo sapiens
acacggcagggagccagtctcaggt

SEQ ID NO: 1358 - DNA, 25 bp, Homo sapiens
tggttggatggtggctttaggggaa

SEQ ID NO: 1359 - DNA, 25 bp, Homo sapiens
gtaggctgggggattgaggtgggga

SEQ ID NO: 1360 - DNA, 25 bp, Homo sapiens
tcattttagctggtgtcagcccctc

SEQ ID NO: 1361 - DNA, 25 bp, Homo sapiens
ccttcctccattgcacatgaacata

SEQ ID NO: 1362 - DNA, 25 bp, Homo sapiens
tgtccatccatatatattcatcaga

SEQ ID NO: 1363 - DNA, 25 bp, Homo sapiens
tggagagggagactcctgggcagcc

SEQ ID NO: 1364 - DNA, 25 bp, Homo sapiens
catttccaaatgtggcctccatgtg

SEQ ID NO: 1365 - DNA, 25 bp, Homo sapiens
cacccccgacggtgtggctgatgat

SEQ ID NO: 1366 - DNA, 25 bp, Homo sapiens
gatgtcttctggtgtcatggtgacc

SEQ ID NO: 1367 - DNA, 25 bp, Homo sapiens
ctcttctctgcacgttgctgaaggt

SEQ ID NO: 1368 - DNA, 25 bp, Homo sapiens
tgcacgttgctgaaggtccaggctt

SEQ ID NO: 1369 - DNA, 25 bp, Homo sapiens
ctctcttagctcagttactcaattc

SEQ ID NO: 1370 - DNA, 25 bp, Homo sapiens
atctgtgtaccaccccatatatttc

SEQ ID NO: 1371 - DNA, 25 bp, Homo sapiens
ttcacatgtacagctttctacttct

SEQ ID NO: 1372 - DNA, 25 bp, Homo sapiens
gagcaccgggtggcagatgttctat

SEQ ID NO: 1373 - DNA, 25 bp, Homo sapiens
gatgttctatgcagtgtggttcaag

SEQ ID NO: 1374 - DNA, 25 bp, Homo sapiens
gtggttcaagtttctttgaccgcac

SEQ ID NO: 1375 - DNA, 25 bp, Homo sapiens
ttgaccgcacttatatgcattgcta

SEQ ID NO: 1376 - DNA, 25 bp, Homo sapiens
aagataccatacacagtctctcatg

SEQ ID NO: 1377 - DNA, 25 bp, Homo sapiens
tctctcatggacctatctctattgt

SEQ ID NO: 1378 - DNA, 25 bp, Homo sapiens
atgtgacctttttttgctgatttgc

SEQ ID NO: 1379 - DNA, 25 bp, Homo sapiens
ttaactagcattattttgccacctt

SEQ ID NO: 1380 - DNA, 25 bp, Homo sapiens
gtactgccagaaactttccttgcta

SEQ ID NO: 1381 - DNA, 25 bp, Homo sapiens
gtaactgacccaagtgtggccaaaa

SEQ ID NO: 1382 - DNA, 25 bp, Homo sapiens
aaaagcatgatggcttgcctcctgt

SEQ ID NO: 1383 - DNA, 25 bp, Homo sapiens
tcactgaaggctaatggctcccggg

SEQ ID NO: 1384 - DNA, 25 bp, Homo sapiens
tcccggggagctttctgtgaagtga

SEQ ID NO: 1385 - DNA, 25 bp, Homo sapiens
ggttatacttggtcggagcctgtga

SEQ ID NO: 1386 - DNA, 25 bp, Homo sapiens
agtctcttaactgcaccttgtgaat

SEQ ID NO: 1387 - DNA, 25 bp, Homo sapiens
aggtcttcatacagttcagcctcta

SEQ ID NO: 1388 - DNA, 25 bp, Homo sapiens
cacccatcacactttgagactactc

SEQ ID NO: 1389 - DNA, 25 bp, Homo sapiens
gagatgtgggcttcctttttgagtc

SEQ ID NO: 1390 - DNA, 25 bp, Homo sapiens
ggtgctgagaccttttacatgggct

SEQ ID NO: 1391 - DNA, 25 bp, Homo sapiens
taagttttctttcacagaactccac

SEQ ID NO: 1392 - DNA, 25 bp, Homo sapiens
agaactccaccattgtgggctttga

SEQ ID NO: 1393 - DNA, 25 bp, Homo sapiens
gagagagccctaaagcattgtacct

SEQ ID NO: 1394 - DNA, 25 bp, Homo sapiens
tagtggtacctagtgacttccaacc

SEQ ID NO: 1395 - DNA, 25 bp, Homo sapiens
tgacttccaaccaaagcctttgagt

SEQ ID NO: 1396 - DNA, 25 bp, Homo sapiens
tcagttttctcgtcttaacactagt

SEQ ID NO: 1397 - DNA, 25 bp, Homo sapiens
gtttgcttttggttttatcttggct

SEQ ID NO: 1398 - DNA, 25 bp, Homo sapiens
taatcatgttggctggtctggtcac

SEQ ID NO: 1399 - DNA, 25 bp, Homo sapiens
tgctttcatcactctaggatcatga

SEQ ID NO: 1400 - DNA, 25 bp, Homo sapiens
tcatgaagtgctatgctatttcctg

SEQ ID NO: 1401 - DNA, 25 bp, Homo sapiens
ggatcagagctcagttcctgtagaa

SEQ ID NO: 1402 - DNA, 25 bp, Homo sapiens
gcagcgggaacagagtaccctcttc

SEQ ID NO: 1403 - DNA, 25 bp, Homo sapiens
tcaagccccggtcatgatggaggtc

SEQ ID NO: 1404 - DNA, 25 bp, Homo sapiens
gccacagggaaccatgagctcagtg

SEQ ID NO: 1405 - DNA, 25 bp, Homo sapiens
gctcagtggtcttggaacagctcac

SEQ ID NO: 1406 - DNA, 25 bp, Homo sapiens
gaacagctcactaagtcagtccttc

SEQ ID NO: 1407 - DNA, 25 bp, Homo sapiens
gtctgtggacttatacctgtgtgct

SEQ ID NO: 1408 - DNA, 25 bp, Homo sapiens
ttacaggtccagtggttcttcagcc

SEQ ID NO: 1409 - DNA, 25 bp, Homo sapiens
ggttcttcagcccatgacagatgag

SEQ ID NO: 1410 - DNA, 25 bp, Homo sapiens
gtttgaattttcctgagagcctggc

SEQ ID NO: 1411 - DNA, 25 bp, Homo sapiens
tgagagcctggcttagtgctgggcc

SEQ ID NO: 1412 - DNA, 25 bp, Homo sapiens
tgaggttagtacttttagtccctgt

SEQ ID NO: 1413 - DNA, 25 bp, Homo sapiens
tgtgccttcattcatgggttaatgg

SEQ ID NO: 1414 - DNA, 25 bp, Homo sapiens
aatgggttatcacaggaatgggact

SEQ ID NO: 1415 - DNA, 25 bp, Homo sapiens
agagaactgagctagcatgcccagc

SEQ ID NO: 1416 - DNA, 25 bp, Homo sapiens
cccacagagagcctccactagagtg

SEQ ID NO: 1417 - DNA, 25 bp, Homo sapiens
gagcctccactagagtgatgctaag

SEQ ID NO: 1418 - DNA, 25 bp, Homo sapiens
gtctagtgtctagtggatccaggcc

SEQ ID NO: 1419 - DNA, 25 bp, Homo sapiens
ggatccaggccacaggagagagtgc

SEQ ID NO: 1420 - DNA, 25 bp, Homo sapiens
aactgtggagtcagtggcagcatgc

SEQ ID NO: 1421 - DNA, 25 bp, Homo sapiens
aaagctttaggcaccagcctgcaac

SEQ ID NO: 1422 - DNA, 25 bp, Homo sapiens
cgagcagccacgtaggctgcaccca

SEQ ID NO: 1423 - DNA, 25 bp, Homo sapiens
ccttcccaggctgatctgaggtaaa

SEQ ID NO: 1424 - DNA, 25 bp, Homo sapiens
gttgctgatgggtacccagtgcggc

SEQ ID NO: 1425 - DNA, 25 bp, Homo sapiens
cagtgcggctggaatgtcgtgtatt

SEQ ID NO: 1426 - DNA, 25 bp, Homo sapiens
gtcgtgtattgggagtgccaccacc

SEQ ID NO: 1427 - DNA, 25 bp, Homo sapiens
gtgccaccacctcagatattttgga

SEQ ID NO: 1428 - DNA, 25 bp, Homo sapiens
gaccgagtgagcatgcaccaggaca

SEQ ID NO: 1429 - DNA, 25 bp, Homo sapiens
tgcctgctcattcagggagccacaa

SEQ ID NO: 1430 - DNA, 25 bp, Homo sapiens
aggctggacgtttacacccagtggc

SEQ ID NO: 1431 - DNA, 25 bp, Homo sapiens
gcatcagcagtcacagagcaccaag

SEQ ID NO: 1432 - DNA, 25 bp, Homo sapiens
cagcactttcggaccagggactaga

SEQ ID NO: 1433 - DNA, 25 bp, Homo sapiens
tcaaagcagcgttccaacctgaggc

SEQ ID NO: 1434 - DNA, 25 bp, Homo sapiens
gccattgccttgaccaacatattcc

SEQ ID NO: 1435 - DNA, 25 bp, Homo sapiens
aaacactgccattcacaagtcaagg

SEQ ID NO: 1436 - DNA, 25 bp, Homo sapiens
ggaacccagggccagctggaagtgt

SEQ ID NO: 1437 - DNA, 25 bp, Homo sapiens
gtggagcacacatgctgtggagcac

SEQ ID NO: 1438 - DNA, 25 bp, Homo sapiens
gctgtggagcacacatgctgtggag

SEQ ID NO: 1439 - DNA, 25 bp, Homo sapiens
gcagtgtgtctgaggtttgtgtagt

SEQ ID NO: 1440 - DNA, 25 bp, Homo sapiens
gaaattgcctgtagcatctagtcta

SEQ ID NO: 1441 - DNA, 25 bp, Homo sapiens
aaattattagttcacttccctgctg

SEQ ID NO: 1442 - DNA, 25 bp, Homo sapiens
tgctgccatgaaactttgccttaag

SEQ ID NO: 1443 - DNA, 25 bp, Homo sapiens
gaaggtgctggattccaaggtttgt

SEQ ID NO: 1444 - DNA, 25 bp, Homo sapiens
aaggcatctcggtaaagactgcttt

SEQ ID NO: 1445 - DNA, 25 bp, Homo sapiens
gactgagttgattctgaccagactt

SEQ ID NO: 1446 - DNA, 25 bp, Homo sapiens
gccaagcacacccaggagaactgtg

SEQ ID NO: 1447 - DNA, 25 bp, Homo sapiens
ggagaactgtgagacctggggtgta

SEQ ID NO: 1448 - DNA, 25 bp, Homo sapiens
ggtgagacgggtactttggtggaca

SEQ ID NO: 1449 - DNA, 25 bp, Homo sapiens
ggagccattggctgtgaagctgcag

SEQ ID NO: 1450 - DNA, 25 bp, Homo sapiens
ggagacggcagttctgctactgcga

SEQ ID NO: 1451 - DNA, 25 bp, Homo sapiens
tctgctactgcgaattgatgacatc

SEQ ID NO: 1452 - DNA, 25 bp, Homo sapiens
ttgatgacatcgtttcaggccacaa

SEQ ID NO: 1453 - DNA, 25 bp, Homo sapiens
cgatgaccagagccggcaaggcggg

SEQ ID NO: 1454 - DNA, 25 bp, Homo sapiens
gagtgctaggcaaggctacttcaat

SEQ ID NO: 1455 - DNA, 25 bp, Homo sapiens
ggctacttcaatgcacagaaccagc

SEQ ID NO: 1456 - DNA, 25 bp, Homo sapiens
acactgtggacgtctttgttcagaa

SEQ ID NO: 1457 - DNA, 25 bp, Homo sapiens
atttcctggtcacatcattaactgc

SEQ ID NO: 1458 - DNA, 25 bp, Homo sapiens
ccatccccagtccagatacagggca

SEQ ID NO: 1459 - DNA, 25 bp, Homo sapiens
ggcagcgtgtaggtgaccacaccag

SEQ ID NO: 1460 - DNA, 25 bp, Homo sapiens
tccttctcagccgtcgggataggat

SEQ ID NO: 1461 - DNA, 25 bp, Homo sapiens
gtgtgtttgccaatagatacccatt

SEQ ID NO: 1462 - DNA, 25 bp, Homo sapiens
aatgttcattgcacatctgcttcca

SEQ ID NO: 1463 - DNA, 25 bp, Homo sapiens
ttcccacgggtgccatgaagtgtgt

SEQ ID NO: 1464 - DNA, 25 bp, Homo sapiens
aagtgtgtgaggagcccctcatctg

SEQ ID NO: 1465 - DNA, 25 bp, Homo sapiens
atgagtgctgcgttgactactgcta

SEQ ID NO: 1466 - DNA, 25 bp, Homo sapiens
tatgcacagtaatttccctttttat

SEQ ID NO: 1467 - DNA, 25 bp, Homo sapiens
attttttccatgtttcattgcctga

SEQ ID NO: 1468 - DNA, 25 bp, Homo sapiens
tcaccaagtctggcggctcagatcg

SEQ ID NO: 1469 - DNA, 25 bp, Homo sapiens
gatcgcaccattgcctacgaaaaca

SEQ ID NO: 1470 - DNA, 25 bp, Homo sapiens
gctctgcgaagggctcttcgtggca

SEQ ID NO: 1471 - DNA, 25 bp, Homo sapiens
agacgtcaccgatttcgagggctgg

SEQ ID NO: 1472 - DNA, 25 bp, Homo sapiens
gctggaaggctgcgattcccagtgc

SEQ ID NO: 1473 - DNA, 25 bp, Homo sapiens
ccaacagctcgaagagcacctcctc

SEQ ID NO: 1474 - DNA, 25 bp, Homo sapiens
tgaccaactcctcaggtgtggacta

SEQ ID NO: 1475 - DNA, 25 bp, Homo sapiens
actagacgcgtggccaagggtggtg

SEQ ID NO: 1476 - DNA, 25 bp, Homo sapiens
ctctgcaatgaccttcaacaaccgg

SEQ ID NO: 1477 - DNA, 25 bp, Homo sapiens
ttccactagggtccaccaggagttc

SEQ ID NO: 1478 - DNA, 25 bp, Homo sapiens
acctcaccagtttccaggtggtaag

SEQ ID NO: 1479 - DNA, 25 bp, Homo sapiens
gctcgcatgtggaagactctcacct

SEQ ID NO: 1480 - DNA, 25 bp, Homo sapiens
cggggtggcagtcagcatgctgaat

SEQ ID NO: 1481 - DNA, 25 bp, Homo sapiens
agcacgagagacccgagttcatcgc

SEQ ID NO: 1482 - DNA, 25 bp, Homo sapiens
gtaaccatactctattccataaccc

SEQ ID NO: 1483 - DNA, 25 bp, Homo sapiens
ctctattccataaccctcatgtgaa

SEQ ID NO: 1484 - DNA, 25 bp, Homo sapiens
ctcatgtgaatccacttccaactgg

SEQ ID NO: 1485 - DNA, 25 bp, Homo sapiens
aaagagaatctggaccactacccgg

SEQ ID NO: 1486 - DNA, 25 bp, Homo sapiens
atgtggtagttggtgtgtcctcggt

SEQ ID NO: 1487 - DNA, 25 bp, Homo sapiens
gtatatgggaccttaagctaacctt

SEQ ID NO: 1488 - DNA, 25 bp, Homo sapiens
aagctaaccttctttacttgtatca

SEQ ID NO: 1489 - DNA, 25 bp, Homo sapiens
atgactggtatactggtctcccatc

SEQ ID NO: 1490 - DNA, 25 bp, Homo sapiens
tcccacttgctcagcagcttgggct

SEQ ID NO: 1491 - DNA, 25 bp, Homo sapiens
ggcttccattctagttcttttacca

SEQ ID NO: 1492 - DNA, 25 bp, Homo sapiens
atttggattgccctctttcaatttc

SEQ ID NO: 1493 - DNA, 25 bp, Homo sapiens
acatagcttctggtgatatcttctc

SEQ ID NO: 1494 - DNA, 25 bp, Homo sapiens
agcagaacatcgctgggacgtgcct

SEQ ID NO: 1495 - DNA, 25 bp, Homo sapiens
acagcaccatcaaggcacgttggag

SEQ ID NO: 1496 - DNA, 25 bp, Homo sapiens
cacgttggagctttcttgccagaac

SEQ ID NO: 1497 - DNA, 25 bp, Homo sapiens
cttgccagaactgatctcttttggt

SEQ ID NO: 1498 - DNA, 25 bp, Homo sapiens
tgggaggacatggggtaccacctac

SEQ ID NO: 1499 - DNA, 25 bp, Homo sapiens
atgccaaagtcagcatttgtcctgg

SEQ ID NO: 1500 - DNA, 25 bp, Homo sapiens
ggttcccttgtgtgatctgtttgga

SEQ ID NO: 1501 - DNA, 25 bp, Homo sapiens
ttacgaacctgagctgctgttaatg

SEQ ID NO: 1502 - DNA, 25 bp, Homo sapiens
acctgagctgctgttaatgccatcc

SEQ ID NO: 1503 - DNA, 25 bp, Homo sapiens
tgagctgctgttaatgccatccaat

SEQ ID NO: 1504 - DNA, 25 bp, Homo sapiens
gctgctgttaatgccatccaatcag

SEQ ID NO: 1505 - DNA, 25 bp, Homo sapiens
tgttaatgccatccaatcagccggt

SEQ ID NO: 1506 - DNA, 25 bp, Homo sapiens
tcagtccttgcatcgggaagctacc

SEQ ID NO: 1507 - DNA, 25 bp, Homo sapiens
gtccttgcatcgggaagctaccaag

SEQ ID NO: 1508 - DNA, 25 bp, Homo sapiens
gcatcgggaagctaccaagtggtct

SEQ ID NO: 1509 - DNA, 25 bp, Homo sapiens
cgggaagctaccaagtggtctagta

SEQ ID NO: 1510 - DNA, 25 bp, Homo sapiens
accaagtggtctagtaagggcaatg

SEQ ID NO: 1511 - DNA, 25 bp, Homo sapiens
gtggtctagtaagggcaatgacatc

SEQ ID NO: 1512 - DNA, 25 bp, Homo sapiens
tgcaaccaactacaaccaagctctc

SEQ ID NO: 1513 - DNA, 25 bp, Homo sapiens
ctctgcatctactcccaagtatggg

SEQ ID NO: 1514 - DNA, 25 bp, Homo sapiens
gtttcatatttcttatcaccacagt

SEQ ID NO: 1515 - DNA, 25 bp, Homo sapiens
taagaaccttgcctgaacatccttc

SEQ ID NO: 1516 - DNA, 25 bp, Homo sapiens
atcgctgtgtgttagttcccaacat

SEQ ID NO: 1517 - DNA, 25 bp, Homo sapiens
aagttggtcctttacactcaggctt

SEQ ID NO: 1518 - DNA, 25 bp, Homo sapiens
gatgattattttcaaggccctcagc

SEQ ID NO: 1519 - DNA, 25 bp, Homo sapiens
atatttgtatagttgcttgcctgat

SEQ ID NO: 1520 - DNA, 25 bp, Homo sapiens
agaaaaatcatgtttgctctcccgg

SEQ ID NO: 1521 - DNA, 25 bp, Homo sapiens
tcccggttcttccagtggtttgaga

SEQ ID NO: 1522 - DNA, 25 bp, Homo sapiens
ttatgccggatgtgcttttctccaa

SEQ ID NO: 1523 - DNA, 25 bp, Homo sapiens
gcagctgcacgagcaagccatgcag

SEQ ID NO: 1524 - DNA, 25 bp, Homo sapiens
gacccaggtgcagacaaccatgcgt

SEQ ID NO: 1525 - DNA, 25 bp, Homo sapiens
ttactataactctagcatccccatc

SEQ ID NO: 1526 - DNA, 25 bp, Homo sapiens
atccccatcccatttgacactgggg

SEQ ID NO: 1527 - DNA, 25 bp, Homo sapiens
ttgacactgggggcaagggttcttc

SEQ ID NO: 1528 - DNA, 25 bp, Homo sapiens
ggttcttcttgcatgtggggtttat

SEQ ID NO: 1529 - DNA, 25 bp, Homo sapiens
gagtggtagctaggggttggttatc

SEQ ID NO: 1530 - DNA, 25 bp, Homo sapiens
gttatcatcagaaggtggtctcccc

SEQ ID NO: 1531 - DNA, 25 bp, Homo sapiens
atgccaactcatgtccaatactgct

SEQ ID NO: 1532 - DNA, 25 bp, Homo sapiens
tcccccaacacagcttctgtggctg

SEQ ID NO: 1533 - DNA, 25 bp, Homo sapiens
actgtacaactgtttctgaccatta

SEQ ID NO: 1534 - DNA, 25 bp, Homo sapiens
cactatcctcttcacatgtaacttc

SEQ ID NO: 1535 - DNA, 25 bp, Homo sapiens
gtaacttctgcagacctatcacaag

SEQ ID NO: 1536 - DNA, 25 bp, Homo sapiens
gtaaccacagaaatccctttctctc

SEQ ID NO: 1537 - DNA, 25 bp, Homo sapiens
cctttctctcctgactcattaataa

SEQ ID NO: 1538 - DNA, 25 bp, Homo sapiens
caacaagtcaatccaagtcagcccg

SEQ ID NO: 1539 - DNA, 25 bp, Homo sapiens
tcacctacaccagagagccattttg

SEQ ID NO: 1540 - DNA, 25 bp, Homo sapiens
aaaagcctcctttatctggctgtgc

SEQ ID NO: 1541 - DNA, 25 bp, Homo sapiens
ggcttttcccaacacaatcagtgct

SEQ ID NO: 1542 - DNA, 25 bp, Homo sapiens
gttgcttgcttattttttctggatg

SEQ ID NO: 1543 - DNA, 25 bp, Homo sapiens
gagtctgggacacactgtaacttta

SEQ ID NO: 1544 - DNA, 25 bp, Homo sapiens
ggtggcatggtcctcaagtgagttc

SEQ ID NO: 1545 - DNA, 25 bp, Homo sapiens
gacgctgcaccagaatagcatcact

SEQ ID NO: 1546 - DNA, 25 bp, Homo sapiens
tttcaagaccctcgagtcttccatc

SEQ ID NO: 1547 - DNA, 25 bp, Homo sapiens
gtgtctgttgctgatgcctcaaaaa

SEQ ID NO: 1548 - DNA, 25 bp, Homo sapiens
aagtgtgcaggtctcgactctgaag

SEQ ID NO: 1549 - DNA, 25 bp, Homo sapiens
ctcctaagtgtgtcatttgtctcag

SEQ ID NO: 1550 - DNA, 25 bp, Homo sapiens
agagaacagcgtcgtggctgctggc

SEQ ID NO: 1551 - DNA, 25 bp, Homo sapiens
gcccaatgctctttatctacgatga

SEQ ID NO: 1552 - DNA, 25 bp, Homo sapiens
gaccttcgtctccaagttagatatt

SEQ ID NO: 1553 - DNA, 25 bp, Homo sapiens
catccaacgcaacatgtctgccatg

SEQ ID NO: 1554 - DNA, 25 bp, Homo sapiens
tggaacgcttccgcaacatggacaa

SEQ ID NO: 1555 - DNA, 25 bp, Homo sapiens
agagagccacaactgaggaccgcaa

SEQ ID NO: 1556 - DNA, 25 bp, Homo sapiens
tagcctgcagcagtaccgtcaggac

SEQ ID NO: 1557 - DNA, 25 bp, Homo sapiens
ggaccaacgtgacggatccaagtcg

SEQ ID NO: 1558 - DNA, 25 bp, Homo sapiens
gatgaactggaccaagccagcaccc

SEQ ID NO: 1559 - DNA, 25 bp, Homo sapiens
agacgtgcgggatatcgacctgtga

SEQ ID NO: 1560 - DNA, 25 bp, Homo sapiens
agacgcgtccataatctggtctctt

SEQ ID NO: 1561 - DNA, 25 bp, Homo sapiens
tgcccccacctagatcatatttaaa

SEQ ID NO: 1562 - DNA, 25 bp, Homo sapiens
aagcatgctcagaccttcattgctc

SEQ ID NO: 1563 - DNA, 25 bp, Homo sapiens
gactttaagtttgccatgtacccac

SEQ ID NO: 1564 - DNA, 25 bp, Homo sapiens
acccaccgtcgatgatcgcaactgg

SEQ ID NO: 1565 - DNA, 25 bp, Homo sapiens
tgggagcagccatctgtgggctcca

SEQ ID NO: 1566 - DNA, 25 bp, Homo sapiens
gagctgctggctaagatcaccaaca

SEQ ID NO: 1567 - DNA, 25 bp, Homo sapiens
gccattacagtatccaatgtctttt

SEQ ID NO: 1568 - DNA, 25 bp, Homo sapiens
gtttagttcttaactgctggccaac

SEQ ID NO: 1569 - DNA, 25 bp, Homo sapiens
cttacatccccagcaaatcatcggg

SEQ ID NO: 1570 - DNA, 25 bp, Homo sapiens
tatgttcatcacccttatatcatgt

SEQ ID NO: 1571 - DNA, 25 bp, Homo sapiens
ttatatcatgtacctcagatctctc

SEQ ID NO: 1572 - DNA, 25 bp, Homo sapiens
tctcctctctctcagttatatagtt

SEQ ID NO: 1573 - DNA, 25 bp, Homo sapiens
gtgtgatgccatatcaagtccatgt

SEQ ID NO: 1574 - DNA, 25 bp, Homo sapiens
agtccatgttattctctcacagtgt

SEQ ID NO: 1575 - DNA, 25 bp, Homo sapiens
ggtgtgggtgtctgtttggtcagga

SEQ ID NO: 1576 - DNA, 25 bp, Homo sapiens
atgttgtattggctatgatggtgac

SEQ ID NO: 1577 - DNA, 25 bp, Homo sapiens
taagaggtcttatctgttcagtgtt

SEQ ID NO: 1578 - DNA, 25 bp, Homo sapiens
caagagtagcctcaacctgtgcttc

SEQ ID NO: 1579 - DNA, 25 bp, Homo sapiens
cagggtggcagatgaagctttctac

SEQ ID NO: 1580 - DNA, 25 bp, Homo sapiens
acaacccttcgctgacgtgattggt

SEQ ID NO: 1581 - DNA, 25 bp, Homo sapiens
accatccttgctacagcctagaaca

SEQ ID NO: 1582 - DNA, 25 bp, Homo sapiens
tgacattgacgagtcgtccccaggc

SEQ ID NO: 1583 - DNA, 25 bp, Homo sapiens
taaccccaagtctagcaagcaggcc

SEQ ID NO: 1584 - DNA, 25 bp, Homo sapiens
gcaagcaggccaaagatgtctcccg

SEQ ID NO: 1585 - DNA, 25 bp, Homo sapiens
gccaccctgtggaaacactacatct

SEQ ID NO: 1586 - DNA, 25 bp, Homo sapiens
atctgcaatatcttaatcctactca

SEQ ID NO: 1587 - DNA, 25 bp, Homo sapiens
gaagctcttcacagtcattggatta

SEQ ID NO: 1588 - DNA, 25 bp, Homo sapiens
tgtttgtgattgcatgtttccttcc

SEQ ID NO: 1589 - DNA, 25 bp, Homo sapiens
gtgaggaggaggcgtccatcaacct

SEQ ID NO: 1590 - DNA, 25 bp, Homo sapiens
tcaatgccattaacaagtgccccct

SEQ ID NO: 1591 - DNA, 25 bp, Homo sapiens
aggagtatgtcaagcgagccctggc

SEQ ID NO: 1592 - DNA, 25 bp, Homo sapiens
aaagtacactccgagcggtcaggct

SEQ ID NO: 1593 - DNA, 25 bp, Homo sapiens
tcgtctctaaccacgcctattaagc

SEQ ID NO: 1594 - DNA, 25 bp, Homo sapiens
attaagcggaggtgttcccaggctg

SEQ ID NO: 1595 - DNA, 25 bp, Homo sapiens
ttccctcgtgacagtggtgtgtggt

SEQ ID NO: 1596 - DNA, 25 bp, Homo sapiens
tgtgtggtgtcgtctgtgaatgcta

SEQ ID NO: 1597 - DNA, 25 bp, Homo sapiens
gtgaatgctaagtccatcacccttt

SEQ ID NO: 1598 - DNA, 25 bp, Homo sapiens
caggccatgcttgcactcagaagtt

SEQ ID NO: 1599 - DNA, 25 bp, Homo sapiens
tgaggagattgccatggcgaccgtc

SEQ ID NO: 1600 - DNA, 25 bp, Homo sapiens
gacttcatgatccagggcggagact

SEQ ID NO: 1601 - DNA, 25 bp, Homo sapiens
atgatccagggcggagacttcacca

SEQ ID NO: 1602 - DNA, 25 bp, Homo sapiens
cctggctgggtgagcatggccaacg

SEQ ID NO: 1603 - DNA, 25 bp, Homo sapiens
tgggtgagcatggccaacgcaggca

SEQ ID NO: 1604 - DNA, 25 bp, Homo sapiens
gagcatggccaacgcaggcaaagac

SEQ ID NO: 1605 - DNA, 25 bp, Homo sapiens
ggccaacgcaggcaaagacaccaac

SEQ ID NO: 1606 - DNA, 25 bp, Homo sapiens
ccagttcttcatcacgacagtcaag

SEQ ID NO: 1607 - DNA, 25 bp, Homo sapiens
gttcttcatcacgacagtcaagaca

SEQ ID NO: 1608 - DNA, 25 bp, Homo sapiens
atcacgacagtcaagacagcctggc

SEQ ID NO: 1609 - DNA, 25 bp, Homo sapiens
gacagtcaagacagcctggctagat

SEQ ID NO: 1610 - DNA, 25 bp, Homo sapiens
agtcaagacagcctggctagatggc

SEQ ID NO: 1611 - DNA, 25 bp, Homo sapiens
atctgagtgtaccttttatagttag

SEQ ID NO: 1612 - DNA, 25 bp, Homo sapiens
aatggtatgcagaggcacagatgta

SEQ ID NO: 1613 - DNA, 25 bp, Homo sapiens
gaagcacaattctttgatctccctt

SEQ ID NO: 1614 - DNA, 25 bp, Homo sapiens
gatcatctaatgttgagcacagtat

SEQ ID NO: 1615 - DNA, 25 bp, Homo sapiens
ggggttgtcaacattactcagttac

SEQ ID NO: 1616 - DNA, 25 bp, Homo sapiens
agttactctttgtggtttagctcta

SEQ ID NO: 1617 - DNA, 25 bp, Homo sapiens
ggtttagctctaacatttcaacaag

SEQ ID NO: 1618 - DNA, 25 bp, Homo sapiens
attaattgtatctgttgggttgtat

SEQ ID NO: 1619 - DNA, 25 bp, Homo sapiens
gttgggttgtatataatgttgctca

SEQ ID NO: 1620 - DNA, 25 bp, Homo sapiens
gtaacaggatgcattgtgatgggct

SEQ ID NO: 1621 - DNA, 25 bp, Homo sapiens
gtgatgggctttgacttacattaaa

SEQ ID NO: 1622 - DNA, 25 bp, Homo sapiens
gaacctcacagggggcttctgatac

SEQ ID NO: 1623 - DNA, 25 bp, Homo sapiens
ggactttcaggaacttaactattct

SEQ ID NO: 1624 - DNA, 25 bp, Homo sapiens
tgaatcaactgaccttgggccagca

SEQ ID NO: 1625 - DNA, 25 bp, Homo sapiens
tgggccagcaggtttttaactaaat

SEQ ID NO: 1626 - DNA, 25 bp, Homo sapiens
ctttctcacccagttaatcagtctc

SEQ ID NO: 1627 - DNA, 25 bp, Homo sapiens
taatcagtctctgtacttgtttccc

SEQ ID NO: 1628 - DNA, 25 bp, Homo sapiens
gtgtcttggttaactaattctgttt

SEQ ID NO: 1629 - DNA, 25 bp, Homo sapiens
agcaggtgccttattctttgctttt

SEQ ID NO: 1630 - DNA, 25 bp, Homo sapiens
gcttttagtcaaaccattccatatc

SEQ ID NO: 1631 - DNA, 25 bp, Homo sapiens
taaaaaattgcattccctttgtatt

SEQ ID NO: 1632 - DNA, 25 bp, Homo sapiens
gctgtgtcttacttgatttattctt

SEQ ID NO: 1633 - DNA, 25 bp, Homo sapiens
gaggaggcaggcgagtgagcgagtc

SEQ ID NO: 1634 - DNA, 25 bp, Homo sapiens
ggcgccgcgaagatggtcgccaagc

SEQ ID NO: 1635 - DNA, 25 bp, Homo sapiens
caacgtcgccaagacctcgagaaat

SEQ ID NO: 1636 - DNA, 25 bp, Homo sapiens
agaaggcgtctgtaggaccctggtt

SEQ ID NO: 1637 - DNA, 25 bp, Homo sapiens
tgttgtctgtggttctgcaattttc

SEQ ID NO: 1638 - DNA, 25 bp, Homo sapiens
gactgaccttaagatgtttccattc

SEQ ID NO: 1639 - DNA, 25 bp, Homo sapiens
tcctgatgtttgataccctggttga

SEQ ID NO: 1640 - DNA, 25 bp, Homo sapiens
tcctgcctcagaatgactttcctat

SEQ ID NO: 1641 - DNA, 25 bp, Homo sapiens
tgactttcctatcatgcttcatgtg

SEQ ID NO: 1642 - DNA, 25 bp, Homo sapiens
gcttcatgtgtcattccaaggtttc

SEQ ID NO: 1643 - DNA, 25 bp, Homo sapiens
gagtcattccaagttttctagtcca

SEQ ID NO: 1644 - DNA, 25 bp, Homo sapiens
gcagaaggagatcacggccctagca

SEQ ID NO: 1645 - DNA, 25 bp, Homo sapiens
aatacgatgaagccgggccttccat

SEQ ID NO: 1646 - DNA, 25 bp, Homo sapiens
aatgcttctaaaacactttcctgct

SEQ ID NO: 1647 - DNA, 25 bp, Homo sapiens
ctctgtctctagcacacaactgtga

SEQ ID NO: 1648 - DNA, 25 bp, Homo sapiens
gtggaattatgccttcagttctttt

SEQ ID NO: 1649 - DNA, 25 bp, Homo sapiens
attcctagccaaagctctgactcgt

SEQ ID NO: 1650 - DNA, 25 bp, Homo sapiens
aagagttacgagttgcctgatgggc

SEQ ID NO: 1651 - DNA, 25 bp, Homo sapiens
ttcatcgggatggagtctgctggca

SEQ ID NO: 1652 - DNA, 25 bp, Homo sapiens
ggcatccatgaaaccacctacaaca

SEQ ID NO: 1653 - DNA, 25 bp, Homo sapiens
ggaaggacctctatgctaacaatgt

SEQ ID NO: 1654 - DNA, 25 bp, Homo sapiens
tcctatcagggggcaccactatgta

SEQ ID NO: 1655 - DNA, 25 bp, Homo sapiens
gaccctggagtcagttaccgtacac

SEQ ID NO: 1656 - DNA, 25 bp, Homo sapiens
gaccctattatgcttctcaaggaca

SEQ ID NO: 1657 - DNA, 25 bp, Homo sapiens
tggaagagctgggctaccacatcta

SEQ ID NO: 1658 - DNA, 25 bp, Homo sapiens
cagcgacccaccttttgaagttcgt

SEQ ID NO: 1659 - DNA, 25 bp, Homo sapiens
gttcgtggtgccaatcagtggatca

SEQ ID NO: 1660 - DNA, 25 bp, Homo sapiens
tataccttcagggggctaccagaca

SEQ ID NO: 1661 - DNA, 25 bp, Homo sapiens
ggctaccagacagtgttctcaactt

SEQ ID NO: 1662 - DNA, 25 bp, Homo sapiens
atatcctgtgcgtccgagaggcaac

SEQ ID NO: 1663 - DNA, 25 bp, Homo sapiens
ggtttgctgctgcctattgtagatc

SEQ ID NO: 1664 - DNA, 25 bp, Homo sapiens
ctgggaaggggcccatcctgatgga

SEQ ID NO: 1665 - DNA, 25 bp, Homo sapiens
tggagctgcagacttaccgttacca

SEQ ID NO: 1666 - DNA, 25 bp, Homo sapiens
gggatgcatttgtggccattgttca

SEQ ID NO: 1667 - DNA, 25 bp, Homo sapiens
caagaacaagcctctcttctttgcc

SEQ ID NO: 1668 - DNA, 25 bp, Homo sapiens
gaccaggatcatggtatcccgcagt

SEQ ID NO: 1669 - DNA, 25 bp, Homo sapiens
gtgagattgacctgctcaacatccg

SEQ ID NO: 1670 - DNA, 25 bp, Homo sapiens
aatatgacaagtctctccaccaagc

SEQ ID NO: 1671 - DNA, 25 bp, Homo sapiens
ttgagggtgacacctccggagactt

SEQ ID NO: 1672 - DNA, 25 bp, Homo sapiens
tggtgaggactagggccacagcttt

SEQ ID NO: 1673 - DNA, 25 bp, Homo sapiens
atggccaagcctgattgttccagct

SEQ ID NO: 1674 - DNA, 25 bp, Homo sapiens
ggttgggctcttatcttcatggagc

SEQ ID NO: 1675 - DNA, 25 bp, Homo sapiens
ggagcttaggaaacgctcccactcc

SEQ ID NO: 1676 - DNA, 25 bp, Homo sapiens
aaaaccgtagccatagatcctgtcc

SEQ ID NO: 1677 - DNA, 25 bp, Homo sapiens
ggtaggatatcttggctttgccaca

SEQ ID NO: 1678 - DNA, 25 bp, Homo sapiens
gctttgccacacacagttacagagt

SEQ ID NO: 1679 - DNA, 25 bp, Homo sapiens
gaacactctactacatgtgactggc

SEQ ID NO: 1680 - DNA, 25 bp, Homo sapiens
gaaaggcagttcaggtatgtgtgta

SEQ ID NO: 1681 - DNA, 25 bp, Homo sapiens
tggggacaccctttgtggttacagt

SEQ ID NO: 1682 - DNA, 25 bp, Homo sapiens
ggggtatgttttaccatctgcatcc

SEQ ID NO: 1683 - DNA, 25 bp, Homo sapiens
ctgctaactcctagctgactcagca

SEQ ID NO: 1684 - DNA, 25 bp, Homo sapiens
aatacctttgtaacggctcttagca

SEQ ID NO: 1685 - DNA, 25 bp, Homo sapiens
gctcttagcacactcacagatgttt

SEQ ID NO: 1686 - DNA, 25 bp, Homo sapiens
gtttgaggctttcagaagctcttct

SEQ ID NO: 1687 - DNA, 25 bp, Homo sapiens
atggcataggctgacttttgcagat

SEQ ID NO: 1688 - DNA, 25 bp, Homo sapiens
gacgaccagccaggatatgctctca

SEQ ID NO: 1689 - DNA, 25 bp, Homo sapiens
tcttcgatttttcttatgaccttaa

SEQ ID NO: 1690 - DNA, 25 bp, Homo sapiens
tgacagaggacccagatcttcaggt

SEQ ID NO: 1691 - DNA, 25 bp, Homo sapiens
aggtttctgcgatgcagcaccagac

SEQ ID NO: 1692 - DNA, 25 bp, Homo sapiens
ctggtctttgaagtgcagcagccct

SEQ ID NO: 1693 - DNA, 25 bp, Homo sapiens
ttccctgtcttcatggggcgagtat

SEQ ID NO: 1694 - DNA, 25 bp, Homo sapiens
gagtatatgaccccagggcctgaga

SEQ ID NO: 1695 - DNA, 25 bp, Homo sapiens
gcaggatcaggttagggcgagcgct

SEQ ID NO: 1696 - DNA, 25 bp, Homo sapiens
tccaccaaaagggctcctgagggtc

SEQ ID NO: 1697 - DNA, 25 bp, Homo sapiens
gcaagggacctgcttctattagccc

SEQ ID NO: 1698 - DNA, 25 bp, Homo sapiens
ccaaaccactttttgcagctttctc

SEQ ID NO: 1699 - DNA, 25 bp, Homo sapiens
atcgagaagatcaaacggccccgga

SEQ ID NO: 1700 - DNA, 25 bp, Homo sapiens
agagactctgtactgaggccagggc

SEQ ID NO: 1701 - DNA, 25 bp, Homo sapiens
ggactctgtgagtctggctcaagac

SEQ ID NO: 1702 - DNA, 25 bp, Homo sapiens
gaccgacattgccttggtttgttac

SEQ ID NO: 1703 - DNA, 25 bp, Homo sapiens
gtaatcacacctctctgtttttagt

SEQ ID NO: 1704 - DNA, 25 bp, Homo sapiens
gaaacctgagatccggctgttgatt

SEQ ID NO: 1705 - DNA, 25 bp, Homo sapiens
atgtgggtacagctcctgattccca

SEQ ID NO: 1706 - DNA, 25 bp, Homo sapiens
gtgaagctgcatcttatctggacca

SEQ ID NO: 1707 - DNA, 25 bp, Homo sapiens
tatccccatgtggaggactatcgcc

SEQ ID NO: 1708 - DNA, 25 bp, Homo sapiens
tatcgccgcaccgtgacagagattg

SEQ ID NO: 1709 - DNA, 25 bp, Homo sapiens
atatcagccttcggctcatcatatc

SEQ ID NO: 1710 - DNA, 25 bp, Homo sapiens
aagtgtatcaccatgcagatgtaga

SEQ ID NO: 1711 - DNA, 25 bp, Homo sapiens
gagcgaaagtgattgtgtttttctt

SEQ ID NO: 1712 - DNA, 25 bp, Homo sapiens
gattcgatgggatttatcagtgtgt

SEQ ID NO: 1713 - DNA, 25 bp, Homo sapiens
gtgtgtagatagctctataatgctt

SEQ ID NO: 1714 - DNA, 25 bp, Homo sapiens
aagtgtgcagtgcaagagcttgttt

SEQ ID NO: 1715 - DNA, 25 bp, Homo sapiens
tttcatactttttatactttgagga

SEQ ID NO: 1716 - DNA, 25 bp, Homo sapiens
agcctcatgagacttggcatacaca

SEQ ID NO: 1717 - DNA, 25 bp, Homo sapiens
ggcatacacactcgtgggattccag

SEQ ID NO: 1718 - DNA, 25 bp, Homo sapiens
cactcgtgggattccagttattatg

SEQ ID NO: 1719 - DNA, 25 bp, Homo sapiens
tattatggagtgcttccatccctct

SEQ ID NO: 1720 - DNA, 25 bp, Homo sapiens
ggttttctttgcaagtgcttttgga

SEQ ID NO: 1721 - DNA, 25 bp, Homo sapiens
agggctacggttacgggcatgagag

SEQ ID NO: 1722 - DNA, 25 bp, Homo sapiens
agcgggagcagtatgccgatcgggc

SEQ ID NO: 1723 - DNA, 25 bp, Homo sapiens
ggtgggatgtgtgtgggctgaaatt

SEQ ID NO: 1724 - DNA, 25 bp, Homo sapiens
gaaattccgagctgcggttgtgcat

SEQ ID NO: 1725 - DNA, 25 bp, Homo sapiens
tgagaatacacccttcgtggtaccc

SEQ ID NO: 1726 - DNA, 25 bp, Homo sapiens
gttcagtccctcaggaaccgtggac

SEQ ID NO: 1727 - DNA, 25 bp, Homo sapiens
gtggaccttaatttaccttgctaag

SEQ ID NO: 1728 - DNA, 25 bp, Homo sapiens
cttgctaagttcagaccttctcttc

SEQ ID NO: 1729 - DNA, 25 bp, Homo sapiens
aggcctcattgtgtgcagaaactgt

SEQ ID NO: 1730 - DNA, 25 bp, Homo sapiens
cctcctgcggctgttggatttggga

SEQ ID NO: 1731 - DNA, 25 bp, Homo sapiens
tggtgagagtctcactgctccaggg

SEQ ID NO: 1732 - DNA, 25 bp, Homo sapiens
atgaaaaccgaatatacagccttaa

SEQ ID NO: 1733 - DNA, 25 bp, Homo sapiens
gagtggtggacccaagagccatatc

SEQ ID NO: 1734 - DNA, 25 bp, Homo sapiens
gacccaagagccatatcagtgctag

SEQ ID NO: 1735 - DNA, 25 bp, Homo sapiens
tgcaagagcttcggcgcctaatgat

SEQ ID NO: 1736 - DNA, 25 bp, Homo sapiens
agcttcggcgcctaatgatgtctaa

SEQ ID NO: 1737 - DNA, 25 bp, Homo sapiens
ttccccccaattcgatttaatcagt

SEQ ID NO: 1738 - DNA, 25 bp, Homo sapiens
taatcagtcttcattttccacagta

SEQ ID NO: 1739 - DNA, 25 bp, Homo sapiens
tctagatacgtcttgtagacctcaa

SEQ ID NO: 1740 - DNA, 25 bp, Homo sapiens
gtcttgtagacctcaaagtaccgga

SEQ ID NO: 1741 - DNA, 25 bp, Homo sapiens
gtaccggaaaggaagctcccattca

SEQ ID NO: 1742 - DNA, 25 bp, Homo sapiens
aggaagctcccattcaaaggaaatt

SEQ ID NO: 1743 - DNA, 25 bp, Homo sapiens
gaagtatacacttccgctgtaccac

SEQ ID NO: 1744 - DNA, 25 bp, Homo sapiens
gccaaggagacttttgcatccaccg

SEQ ID NO: 1745 - DNA, 25 bp, Homo sapiens
tcccagctccacagcaatgttgtca

SEQ ID NO: 1746 - DNA, 25 bp, Homo sapiens
gttagaggctcgtgtgcatggcccc

SEQ ID NO: 1747 - DNA, 25 bp, Homo sapiens
ctgttcccgtgatcaatttcctgga

SEQ ID NO: 1748 - DNA, 25 bp, Homo sapiens
tttcctggagtttatatcccctcag

SEQ ID NO: 1749 - DNA, 25 bp, Homo sapiens
gcttaggtatctgtgactcttgggc

SEQ ID NO: 1750 - DNA, 25 bp, Homo sapiens
gggaacttacttctctatagcccac

SEQ ID NO: 1751 - DNA, 25 bp, Homo sapiens
gaggactgatgctcttcttttttct

SEQ ID NO: 1752 - DNA, 25 bp, Homo sapiens
tctgtcctttttcttgctgatttat

SEQ ID NO: 1753 - DNA, 25 bp, Homo sapiens
gggctggcattctgatgcttttcag

SEQ ID NO: 1754 - DNA, 25 bp, Homo sapiens
ctgatgccatcaaagaggtcttcga

SEQ ID NO: 1755 - DNA, 25 bp, Homo sapiens
ggtcttcgacaataaattccacatc

SEQ ID NO: 1756 - DNA, 25 bp, Homo sapiens
attccacatcatcggcgcagtgggc

SEQ ID NO: 1757 - DNA, 25 bp, Homo sapiens
gcagtgggcatcggcattgccgtgg

SEQ ID NO: 1758 - DNA, 25 bp, Homo sapiens
ggcattgccgtggtcatgatatttg

SEQ ID NO: 1759 - DNA, 25 bp, Homo sapiens
gtatgatcttgtgctgtgctatccg

SEQ ID NO: 1760 - DNA, 25 bp, Homo sapiens
tgtgctatccgcaggaaccgcgaga

SEQ ID NO: 1761 - DNA, 25 bp, Homo sapiens
gcaggaaccgcgagatggtctagag

SEQ ID NO: 1762 - DNA, 25 bp, Homo sapiens
tggtctagagtcagcttacatccct

SEQ ID NO: 1763 - DNA, 25 bp, Homo sapiens
gtcagcttacatccctgagcaggaa

SEQ ID NO: 1764 - DNA, 25 bp, Homo sapiens
gagcaggaaagtttacccatgaaga

SEQ ID NO: 1765 - DNA, 25 bp, Homo sapiens
gcaaaggggtttcctcgatttggag

SEQ ID NO: 1766 - DNA, 25 bp, Homo sapiens
ttccaccgtcatttctaactcttaa

SEQ ID NO: 1767 - DNA, 25 bp, Homo sapiens
aaaccaactcagttccatcatggtg

SEQ ID NO: 1768 - DNA, 25 bp, Homo sapiens
tgaggtggtctttaacgaccctgaa

SEQ ID NO: 1769 - DNA, 25 bp, Homo sapiens
gaagttactcgtgtcaaagccgtta

SEQ ID NO: 1770 - DNA, 25 bp, Homo sapiens
gatcctggcttgcggagtggctaaa

SEQ ID NO: 1771 - DNA, 25 bp, Homo sapiens
tggatgcagggatcccagcagtgca

SEQ ID NO: 1772 - DNA, 25 bp, Homo sapiens
cggagtacctgcgctatgaagacac

SEQ ID NO: 1773 - DNA, 25 bp, Homo sapiens
tacaagttcggctttgagcttcctc

SEQ ID NO: 1774 - DNA, 25 bp, Homo sapiens
ccgagccagccaactcaagagacaa

SEQ ID NO: 1775 - DNA, 25 bp, Homo sapiens
ggtggatgtcaatacccctgattta

SEQ ID NO: 1776 - DNA, 25 bp, Homo sapiens
agaagatgtatggtatctccctttg

SEQ ID NO: 1777 - DNA, 25 bp, Homo sapiens
cctttgccaagccatcctggatgaa

SEQ ID NO: 1778 - DNA, 25 bp, Homo sapiens
gaaactaaacattcccttgatggtc

SEQ ID NO: 1779 - DNA, 25 bp, Homo sapiens
gatggtctcaagctatgatcagaag

SEQ ID NO: 1780 - DNA, 25 bp, Homo sapiens
agaaatgcctcacagctatcgtgaa

SEQ ID NO: 1781 - DNA, 25 bp, Homo sapiens
gctatcgtgaagtgcgccacaagca

SEQ ID NO: 1782 - DNA, 25 bp, Homo sapiens
gcgccacaagcaaaccagctttctt

SEQ ID NO: 1783 - DNA, 25 bp, Homo sapiens
aaaccagctttctttgcagagaagc

SEQ ID NO: 1784 - DNA, 25 bp, Homo sapiens
gcagagaagcttcatcaagccatga

SEQ ID NO: 1785 - DNA, 25 bp, Homo sapiens
ggtgttggaactcgccataaggcat

SEQ ID NO: 1786 - DNA, 25 bp, Homo sapiens
tatggtttcccgttctgaaattgac

SEQ ID NO: 1787 - DNA, 25 bp, Homo sapiens
aactggcattactgactcccagcta

SEQ ID NO: 1788 - DNA, 25 bp, Homo sapiens
ccagctatatttctccagacttgca

SEQ ID NO: 1789 - DNA, 25 bp, Homo sapiens
aattgctgatgtgacccatgaaggg

SEQ ID NO: 1790 - DNA, 25 bp, Homo sapiens
ttttcctcgtaattttggactgcca

SEQ ID NO: 1791 - DNA, 25 bp, Homo sapiens
tggactgccacacattggtaccttt

SEQ ID NO: 1792 - DNA, 25 bp, Homo sapiens
acattggtacctttagttctctgaa

SEQ ID NO: 1793 - DNA, 25 bp, Homo sapiens
ttctctgaaggcccacgtttttatc

SEQ ID NO: 1794 - DNA, 25 bp, Homo sapiens
gtagagctttatgttcgctgtccat

SEQ ID NO: 1795 - DNA, 25 bp, Homo sapiens
gctgtccatgaaaccttctgtaacc

SEQ ID NO: 1796 - DNA, 25 bp, Homo sapiens
tgactacaagtagttctttctctat

SEQ ID NO: 1797 - DNA, 25 bp, Homo sapiens
gctatgcttagctatctgtcagaga

SEQ ID NO: 1798 - DNA, 25 bp, Homo sapiens
tgtggcagtggcaggcagaagtaat

SEQ ID NO: 1799 - DNA, 25 bp, Homo sapiens
caggcagaagtaatggtttgggacc

SEQ ID NO: 1800 - DNA, 25 bp, Homo sapiens
ggtttgggaccagtgatgtctggga

SEQ ID NO: 1801 - DNA, 25 bp, Homo sapiens
gatgtctgggaacactgcatatcca

SEQ ID NO: 1802 - DNA, 25 bp, Homo sapiens
gaacactgcatatccagttatcagc

SEQ ID NO: 1803 - DNA, 25 bp, Homo sapiens
agtgttgatgggctctacttctgat

SEQ ID NO: 1804 - DNA, 25 bp, Homo sapiens
tacttctgatcttggtcactgtgaa

SEQ ID NO: 1805 - DNA, 25 bp, Homo sapiens
tttggcattccatgtgaacttcgag

SEQ ID NO: 1806 - DNA, 25 bp, Homo sapiens
gaacttcgagtaacatctgcgcata

SEQ ID NO: 1807 - DNA, 25 bp, Homo sapiens
agtaacatctgcgcataaaggacca

SEQ ID NO: 1808 - DNA, 25 bp, Homo sapiens
gaaggggatggcattcctactgtat

SEQ ID NO: 1809 - DNA, 25 bp, Homo sapiens
agcttcagactcaagtacccattct

SEQ ID NO: 1810 - DNA, 25 bp, Homo sapiens
tctctgggtctgattttctcactga

SEQ ID NO: 1811 - DNA, 25 bp, Homo sapiens
gtctgattttctcactgaactccac

SEQ ID NO: 1812 - DNA, 25 bp, Homo sapiens
ttgaaaagttcagggaccgtccagg

SEQ ID NO: 1813 - DNA, 25 bp, Homo sapiens
ggaccgtccaggggagatggggagg

SEQ ID NO: 1814 - DNA, 25 bp, Homo sapiens
atggagtgagtcacctgctccagaa

SEQ ID NO: 1815 - DNA, 25 bp, Homo sapiens
tctctctccagggtgcttagttggc

SEQ ID NO: 1816 - DNA, 25 bp, Homo sapiens
ccagggtgcttagttggctttgccc

SEQ ID NO: 1817 - DNA, 25 bp, Homo sapiens
cccatttcccgcacatggtgtgggg

SEQ ID NO: 1818 - DNA, 25 bp, Homo sapiens
ggggaggtccaagcagagtgtttta

SEQ ID NO: 1819 - DNA, 25 bp, Homo sapiens
attatcgctttatgtttttggttat

SEQ ID NO: 1820 - DNA, 25 bp, Homo sapiens
gtaagcttagtagttgcagaaattg

SEQ ID NO: 1821 - DNA, 25 bp, Homo sapiens
gaacactaggtggcactcagttatc

SEQ ID NO: 1822 - DNA, 25 bp, Homo sapiens
gtggcactcagttatcttaacaggg

SEQ ID NO: 1823 - DNA, 25 bp, Homo sapiens
actgatacaattgttgacttttctt

SEQ ID NO: 1824 - DNA, 25 bp, Homo sapiens
tactatgtgtaagaaataccccaaa

SEQ ID NO: 1825 - DNA, 25 bp, Homo sapiens
gaaataccccaaacatgaaaagatt

SEQ ID NO: 1826 - DNA, 25 bp, Homo sapiens
attgttttgatcatatgcatgtatg

SEQ ID NO: 1827 - DNA, 25 bp, Homo sapiens
gaagtcatatacatgtaagctacaa

SEQ ID NO: 1828 - DNA, 25 bp, Homo sapiens
gaaaagcctttttcaacatatccct

SEQ ID NO: 1829 - DNA, 25 bp, Homo sapiens
tttttcaacatatccctaagctaag

SEQ ID NO: 1830 - DNA, 25 bp, Homo sapiens
caactcagtgaaaagatggtctcca

SEQ ID NO: 1831 - DNA, 25 bp, Homo sapiens
tctgattaagccctggcctcttgat

SEQ ID NO: 1832 - DNA, 25 bp, Homo sapiens
tccagttacctagatattcccttga

SEQ ID NO: 1833 - DNA, 25 bp, Homo sapiens
agatattcccttgagattttgatac

SEQ ID NO: 1834 - DNA, 25 bp, Homo sapiens
acattttacattccatcttttctga

SEQ ID NO: 1835 - DNA, 25 bp, Homo sapiens
tcttttctgaagattgtcctacaat

SEQ ID NO: 1836 - DNA, 25 bp, Homo sapiens
gtcctacaatttggattttgatcat

SEQ ID NO: 1837 - DNA, 25 bp, Homo sapiens
aaagcagactgatttgtttctaaga

SEQ ID NO: 1838 - DNA, 25 bp, Homo sapiens
gagatgttaagcccactttgttctt

SEQ ID NO: 1839 - DNA, 25 bp, Homo sapiens
gaagaccatgtctactaattacaaa

SEQ ID NO: 1840 - DNA, 25 bp, Homo sapiens
ttcctaccacttccagtaagaaaat

SEQ ID NO: 1841 - DNA, 25 bp, Homo sapiens
cacggaatctgattaagccctggcc

SEQ ID NO: 1842 - DNA, 25 bp, Homo sapiens
gctaaacctatctgtattggcagca

SEQ ID NO: 1843 - DNA, 25 bp, Homo sapiens
agcacagctactcagatctgcactc

SEQ ID NO: 1844 - DNA, 25 bp, Homo sapiens
cactcctgtctcttgggaagcagtt

SEQ ID NO: 1845 - DNA, 25 bp, Homo sapiens
aaatcatgggcattgctggactgat

SEQ ID NO: 1846 - DNA, 25 bp, Homo sapiens
ctggactgatggttgctttgagccc

SEQ ID NO: 1847 - DNA, 25 bp, Homo sapiens
caggagctccctttttgaattgtgt

SEQ ID NO: 1848 - DNA, 25 bp, Homo sapiens
attttactatgcctgttgatctatg

SEQ ID NO: 1849 - DNA, 25 bp, Homo sapiens
taagcagtacatcttgtgcatgcaa

SEQ ID NO: 1850 - DNA, 25 bp, Homo sapiens
tgcaaaaatgaattcacccctccca

SEQ ID NO: 1851 - DNA, 25 bp, Homo sapiens
agctgagctggacacactaaacgag

SEQ ID NO: 1852 - DNA, 25 bp, Homo sapiens
ctataaggactccacgctgatcatg

SEQ ID NO: 1853 - DNA, 25 bp, Homo sapiens
gtagctgatgaagtatgtcgcattt

SEQ ID NO: 1854 - DNA, 25 bp, Homo sapiens
aagtgcatcattgtagaagaaggca

SEQ ID NO: 1855 - DNA, 25 bp, Homo sapiens
ggtgtaaccataactgatcctttca

SEQ ID NO: 1856 - DNA, 25 bp, Homo sapiens
ccataactgatcctttcaagcattt

SEQ ID NO: 1857 - DNA, 25 bp, Homo sapiens
gcttcctgaaaaagattgtcgctat

SEQ ID NO: 1858 - DNA, 25 bp, Homo sapiens
aaagattgtcgctatgctttgtatg

SEQ ID NO: 1859 - DNA, 25 bp, Homo sapiens
tttttttgtgggcaccagaactagc

SEQ ID NO: 1860 - DNA, 25 bp, Homo sapiens
gcaccagaactagcacctctgaaaa

SEQ ID NO: 1861 - DNA, 25 bp, Homo sapiens
gaatgtcaagcaaatggaccagaag

SEQ ID NO: 1862 - DNA, 25 bp, Homo sapiens
ttaatgttatcctcttgctatataa

SEQ ID NO: 1863 - DNA, 25 bp, Homo sapiens
gttatcctcttgctatataaataaa

SEQ ID NO: 1864 - DNA, 25 bp, Homo sapiens
taagttaggcagtcttctaccaaat

SEQ ID NO: 1865 - DNA, 25 bp, Homo sapiens
aattgtgtccacataatccacgctc

SEQ ID NO: 1866 - DNA, 25 bp, Homo sapiens
atccacgctcatcttgcaaagcgct

SEQ ID NO: 1867 - DNA, 25 bp, Homo sapiens
aaagcgctatttcaggcacatcatt

SEQ ID NO: 1868 - DNA, 25 bp, Homo sapiens
tgagctcgccattcactgattggaa

SEQ ID NO: 1869 - DNA, 25 bp, Homo sapiens
ggaagagtgacctggcatcttggaa

SEQ ID NO: 1870 - DNA, 25 bp, Homo sapiens
gaatgtgcagtgtcttgtaacaact

SEQ ID NO: 1871 - DNA, 25 bp, Homo sapiens
gggctacattgtaatctgctttgtt

SEQ ID NO: 1872 - DNA, 25 bp, Homo sapiens
gacaagctaggacacctgtggtatc

SEQ ID NO: 1873 - DNA, 25 bp, Homo sapiens
gtggtatctttaattgtatctcctt

SEQ ID NO: 1874 - DNA, 25 bp, Homo sapiens
tacatctttattaacctcagcattt

SEQ ID NO: 1875 - DNA, 25 bp, Homo sapiens
caccactaaaatctccaggggcacc

SEQ ID NO: 1876 - DNA, 25 bp, Homo sapiens
acgctgctgaacatgctcaacatct

SEQ ID NO: 1877 - DNA, 25 bp, Homo sapiens
ctggtcatccagcaggtgttcgaca

SEQ ID NO: 1878 - DNA, 25 bp, Homo sapiens
ggcagcatctacaaccctgaagtgc

SEQ ID NO: 1879 - DNA, 25 bp, Homo sapiens
cttcctggagggtgtccgcaatgtt

SEQ ID NO: 1880 - DNA, 25 bp, Homo sapiens
atgttgccagtgtctgtctgcagat

SEQ ID NO: 1881 - DNA, 25 bp, Homo sapiens
gattggctacccaactgttgcatca

SEQ ID NO: 1882 - DNA, 25 bp, Homo sapiens
agtaccccattctatcatcaacggg

SEQ ID NO: 1883 - DNA, 25 bp, Homo sapiens
tgtggagacggattacaccttccca

SEQ ID NO: 1884 - DNA, 25 bp, Homo sapiens
aaggtcaaggccttcttggctgatc

SEQ ID NO: 1885 - DNA, 25 bp, Homo sapiens
gcagccccagctaaggttgaagcca

SEQ ID NO: 1886 - DNA, 25 bp, Homo sapiens
gaagaacacctgagagcgctttcca

SEQ ID NO: 1887 - DNA, 25 bp, Homo sapiens
ccgagtgcctgtgggaatgctcttt

SEQ ID NO: 1888 - DNA, 25 bp, Homo sapiens
aatgctctttggtcagacattccct

SEQ ID NO: 1889 - DNA, 25 bp, Homo sapiens
cttcaacccagtgcctgtcatgaaa

SEQ ID NO: 1890 - DNA, 25 bp, Homo sapiens
aaacaccaatgaccagccagaagac

SEQ ID NO: 1891 - DNA, 25 bp, Homo sapiens
ctgtttcttgcaaggacactcctgg

SEQ ID NO: 1892 - DNA, 25 bp, Homo sapiens
tttattgtgaaccgcctcctggttc

SEQ ID NO: 1893 - DNA, 25 bp, Homo sapiens
cctcctggttccatacctcatggaa

SEQ ID NO: 1894 - DNA, 25 bp, Homo sapiens
tgaaattaggagccggttaccccat

SEQ ID NO: 1895 - DNA, 25 bp, Homo sapiens
catgggcccatttgagcttctagat

SEQ ID NO: 1896 - DNA, 25 bp, Homo sapiens
gcccagcccatccttaaataagctg

SEQ ID NO: 1897 - DNA, 25 bp, Homo sapiens
aaaggcgtgtttgactgcaggaaga

SEQ ID NO: 1898 - DNA, 25 bp, Homo sapiens
gaacgtgctgggtcacatgcagcag

SEQ ID NO: 1899 - DNA, 25 bp, Homo sapiens
gcaccctctccatttgatagaaact

SEQ ID NO: 1900 - DNA, 25 bp, Homo sapiens
tggaaccaaaatctctgccagagct

SEQ ID NO: 1901 - DNA, 25 bp, Homo sapiens
gcaaaactcaaggaggcccggggca

SEQ ID NO: 1902 - DNA, 25 bp, Homo sapiens
accaccgatgattccatttgtgtgc

SEQ ID NO: 1903 - DNA, 25 bp, Homo sapiens
aacagtggtggctcaagctacggcc

SEQ ID NO: 1904 - DNA, 25 bp, Homo sapiens
aaggccagctatgacgtgtcggact

SEQ ID NO: 1905 - DNA, 25 bp, Homo sapiens
gactcaggccagctggaacatgtgc

SEQ ID NO: 1906 - DNA, 25 bp, Homo sapiens
tacctaatcggcgagtgcccatctg

SEQ ID NO: 1907 - DNA, 25 bp, Homo sapiens
cagtgcgtgctgtctgtggagtgtg

SEQ ID NO: 1908 - DNA, 25 bp, Homo sapiens
gccccgcagatgaactacatccagg

SEQ ID NO: 1909 - DNA, 25 bp, Homo sapiens
tccaggcctatttcgcgtgtgaaaa

SEQ ID NO: 1910 - DNA, 25 bp, Homo sapiens
tgagaacttggctgccaacttcctc

SEQ ID NO: 1911 - DNA, 25 bp, Homo sapiens
ccaacttcctcctgagtcagaactt

SEQ ID NO: 1912 - DNA, 25 bp, Homo sapiens
gaacacggttctgtccaggagagcc

SEQ ID NO: 1913 - DNA, 25 bp, Homo sapiens
agagccaggtatcggagcagccggc

SEQ ID NO: 1914 - DNA, 25 bp, Homo sapiens
gcagcaggagagaaccccctggagt

SEQ ID NO: 1915 - DNA, 25 bp, Homo sapiens
cagttccagaacatgcggcaggtga

SEQ ID NO: 1916 - DNA, 25 bp, Homo sapiens
gcggcaggtgattcagcagaaccct

SEQ ID NO: 1917 - DNA, 25 bp, Homo sapiens
ggagaaccctcagcttttacagcaa

SEQ ID NO: 1918 - DNA, 25 bp, Homo sapiens
tttacagcaaatcagccggcaccag

SEQ ID NO: 1919 - DNA, 25 bp, Homo sapiens
gccaccgacaccaagaacgtgcagt

SEQ ID NO: 1920 - DNA, 25 bp, Homo sapiens
gaacgtgcagttcgtgtttgacgcc

SEQ ID NO: 1921 - DNA, 25 bp, Homo sapiens
tgtttgacgccgtcaccgatgtcat

SEQ ID NO: 1922 - DNA, 25 bp, Homo sapiens
gaacaacctgaaggactgcggcctc

SEQ ID NO: 1923 - DNA, 25 bp, Homo sapiens
gggggcaagaagatcacgctccccg

SEQ ID NO: 1924 - DNA, 25 bp, Homo sapiens
gtcccctcagctccaaacgtagggg

SEQ ID NO: 1925 - DNA, 25 bp, Homo sapiens
acaggcctccctgtttgaagcctgc

SEQ ID NO: 1926 - DNA, 25 bp, Homo sapiens
tgctggtaatggccatggtaccccc

SEQ ID NO: 1927 - DNA, 25 bp, Homo sapiens
attgtcttgttctgtgatgagggga

SEQ ID NO: 1928 - DNA, 25 bp, Homo sapiens
tctcccaaggctgcgtctggagggg

SEQ ID NO: 1929 - DNA, 25 bp, Homo sapiens
gtccaaatgtttacgggagcctcct

SEQ ID NO: 1930 - DNA, 25 bp, Homo sapiens
ccttcagaccccagttctaggggag

SEQ ID NO: 1931 - DNA, 25 bp, Homo sapiens
aacagccttagctgccagtgctggt

SEQ ID NO: 1932 - DNA, 25 bp, Homo sapiens
agtgctggtcactaaccaacaaggt

SEQ ID NO: 1933 - DNA, 25 bp, Homo sapiens
taccccttctttgcagggctaaggc

SEQ ID NO: 1934 - DNA, 25 bp, Homo sapiens
gcagggctaaggcccccaaacatag

SEQ ID NO: 1935 - DNA, 25 bp, Homo sapiens
ccggaggaagcttggggaacccatg

SEQ ID NO: 1936 - DNA, 25 bp, Homo sapiens
ggaacccatgagttgtcagctttga

SEQ ID NO: 1937 - DNA, 25 bp, Homo sapiens
tgtcagctttgactttatctcctgc

SEQ ID NO: 1938 - DNA, 25 bp, Homo sapiens
gaattggggattctctattggaggt

SEQ ID NO: 1939 - DNA, 25 bp, Homo sapiens
gctgttgcatttagaactttctgct

SEQ ID NO: 1940 - DNA, 25 bp, Homo sapiens
agagctctatttctctacggtttta

SEQ ID NO: 1941 - DNA, 25 bp, Homo sapiens
gcatcctcaaacatggcgccaagga

SEQ ID NO: 1942 - DNA, 25 bp, Homo sapiens
cctcaaacatggcgccaaggataaa

SEQ ID NO: 1943 - DNA, 25 bp, Homo sapiens
tcccagttcccagtggaagaaacag

SEQ ID NO: 1944 - DNA, 25 bp, Homo sapiens
agtgcgtgccgagctgaggcagatg

SEQ ID NO: 1945 - DNA, 25 bp, Homo sapiens
gcgtgccgagctgaggcagatgttc

SEQ ID NO: 1946 - DNA, 25 bp, Homo sapiens
tgccgagctgaggcagatgttccca

SEQ ID NO: 1947 - DNA, 25 bp, Homo sapiens
ccccagagccctgggctatagtctc

SEQ ID NO: 1948 - DNA, 25 bp, Homo sapiens
cagagccctgggctatagtctctga

SEQ ID NO: 1949 - DNA, 25 bp, Homo sapiens
cccacacaaatgcaagctcaccaag

SEQ ID NO: 1950 - DNA, 25 bp, Homo sapiens
acacaaatgcaagctcaccaaggtc

SEQ ID NO: 1951 - DNA, 25 bp, Homo sapiens
acaaatgcaagctcaccaaggtccc

SEQ ID NO: 1952 - DNA, 25 bp, Homo sapiens
ccaggacaccgctgtcctggcattt

SEQ ID NO: 1953 - DNA, 25 bp, Homo sapiens
atttgtggccactcactttgtagga

SEQ ID NO: 1954 - DNA, 25 bp, Homo sapiens
gaaactcatctccttcctgaggagc

SEQ ID NO: 1955 - DNA, 25 bp, Homo sapiens
tgtgtctttccagaaggtcacgtgg

SEQ ID NO: 1956 - DNA, 25 bp, Homo sapiens
gaaggtcacgtggaaatgtctcggg

SEQ ID NO: 1957 - DNA, 25 bp, Homo sapiens
gtggaaatgtctcgggacttgggtc

SEQ ID NO: 1958 - DNA, 25 bp, Homo sapiens
cctgaggtgcattttctcatcatcc

SEQ ID NO: 1959 - DNA, 25 bp, Homo sapiens
catccttgctttaccacaatgagca

SEQ ID NO: 1960 - DNA, 25 bp, Homo sapiens
atctgaattcctgtaggcacaccct

SEQ ID NO: 1961 - DNA, 25 bp, Homo sapiens
gtaggcacaccctccatagggtatg

SEQ ID NO: 1962 - DNA, 25 bp, Homo sapiens
gcacaccctccatagggtatgattt

SEQ ID NO: 1963 - DNA, 25 bp, Homo sapiens
atgttggccaggctagtcacgaact

SEQ ID NO: 1964 - DNA, 25 bp, Homo sapiens
attacaggcatgagctaccacacct

SEQ ID NO: 1965 - DNA, 25 bp, Homo sapiens
taccacacctggtttggagagtctt

SEQ ID NO: 1966 - DNA, 25 bp, Homo sapiens
gtgaaatttccctaatgttcattta

SEQ ID NO: 1967 - DNA, 25 bp, Homo sapiens
ttctaaatccagaccgtgtttcaga

SEQ ID NO: 1968 - DNA, 25 bp, Homo sapiens
tgagagtagccattttcttgcctgt

SEQ ID NO: 1969 - DNA, 25 bp, Homo sapiens
tcttgcctgtacttgtcagaactag

SEQ ID NO: 1970 - DNA, 25 bp, Homo sapiens
acttattttgagcctttcttttatg

SEQ ID NO: 1971 - DNA, 25 bp, Homo sapiens
agtaaatgattcctccttgttctgt

SEQ ID NO: 1972 - DNA, 25 bp, Homo sapiens
ccttgttctgtctttcaaaccagct

SEQ ID NO: 1973 - DNA, 25 bp, Homo sapiens
tttttctcactgttgcctattttca

SEQ ID NO: 1974 - DNA, 25 bp, Homo sapiens
tatagctctctttagctcaaccact

SEQ ID NO: 1975 - DNA, 25 bp, Homo sapiens
ggttttatctgttgtgtgaagtggt

SEQ ID NO: 1976 - DNA, 25 bp, Homo sapiens
ttgtgtgaagtggttcacccttgag

SEQ ID NO: 1977 - DNA, 25 bp, Homo sapiens
tgaggaccaggagcctccatatcct

SEQ ID NO: 1978 - DNA, 25 bp, Homo sapiens
cctccatatcctgactgaaaacctt

SEQ ID NO: 1979 - DNA, 25 bp, Homo sapiens
tgacttttctgccttgtgaattcgt

SEQ ID NO: 1980 - DNA, 25 bp, Homo sapiens
gtgaattcgtagtccaatcagctga

SEQ ID NO: 1981 - DNA, 25 bp, Homo sapiens
aatcacttgggagggacgcatagaa

SEQ ID NO: 1982 - DNA, 25 bp, Homo sapiens
gaaggagctctaggaacacagtgcc

SEQ ID NO: 1983 - DNA, 25 bp, Homo sapiens
ggaacacagtgccagtgcagaagtt

SEQ ID NO: 1984 - DNA, 25 bp, Homo sapiens
agtgcagaagtttctccaggtggcc

SEQ ID NO: 1985 - DNA, 25 bp, Homo sapiens
aggcctgttcaggctcagctaagcc

SEQ ID NO: 1986 - DNA, 25 bp, Homo sapiens
gctaagcctctcttcatctggaaga

SEQ ID NO: 1987 - DNA, 25 bp, Homo sapiens
acctcagctacatcgtgcgagctag

SEQ ID NO: 1988 - DNA, 25 bp, Homo sapiens
tggtggtgaggactacgtcttctcc

SEQ ID NO: 1989 - DNA, 25 bp, Homo sapiens
caccggggtgtcactgcgggaaggt

SEQ ID NO: 1990 - DNA, 25 bp, Homo sapiens
actgcgggaaggtctctacttcaac

SEQ ID NO: 1991 - DNA, 25 bp, Homo sapiens
cagctaccatgtcccagatagccaa

SEQ ID NO: 1992 - DNA, 25 bp, Homo sapiens
agccaaggatgtgtgcaccttcctg

SEQ ID NO: 1993 - DNA, 25 bp, Homo sapiens
ctgcgctgggcatctgagccagagc

SEQ ID NO: 1994 - DNA, 25 bp, Homo sapiens
tggtctacaccataaagcggcacaa

SEQ ID NO: 1995 - DNA, 25 bp, Homo sapiens
agagtcggaagctggcatatcggcc

SEQ ID NO: 1996 - DNA, 25 bp, Homo sapiens
ctcagagccacccctaaagagatcc

SEQ ID NO: 1997 - DNA, 25 bp, Homo sapiens
ggagactgtctcaagagggcactgg

SEQ ID NO: 1998 - DNA, 25 bp, Homo sapiens
caagagggcactggtggcccgacag

SEQ ID NO: 1999 - DNA, 25 bp, Homo sapiens
ttcactgctggctgccttagaacct

SEQ ID NO: 2000 - DNA, 25 bp, Homo sapiens
acctttcttacattagcagtttgct

SEQ ID NO: 2001 - DNA, 25 bp, Homo sapiens
gctttgtatgcactttgtttttttc

SEQ ID NO: 2002 - DNA, 25 bp, Homo sapiens
tcaggttgtctgaagtcactgcaca

SEQ ID NO: 2003 - DNA, 25 bp, Homo sapiens
cagcccacatagtgatggttcccct

SEQ ID NO: 2004 - DNA, 25 bp, Homo sapiens
cctgttcactctacttagcatgtcc

SEQ ID NO: 2005 - DNA, 25 bp, Homo sapiens
cgagtctcttctccactggatggag

SEQ ID NO: 2006 - DNA, 25 bp, Homo sapiens
ccttcaaccattccccatgggaaat

SEQ ID NO: 2007 - DNA, 25 bp, Homo sapiens
atttggctccagaaagaccccagtg

SEQ ID NO: 2008 - DNA, 25 bp, Homo sapiens
ccagtgccttttgacaatggccagg

SEQ ID NO: 2009 - DNA, 25 bp, Homo sapiens
gacaatggccagggttttacctact

SEQ ID NO: 2010 - DNA, 25 bp, Homo sapiens
tcctgccagtctttcccaaaggaaa

SEQ ID NO: 2011 - DNA, 25 bp, Homo sapiens
gaattctggttcatactgtggtccc

SEQ ID NO: 2012 - DNA, 25 bp, Homo sapiens
tcatactgtggtcccttgtaacctc

SEQ ID NO: 2013 - DNA, 25 bp, Homo sapiens
aacctcaggtctttaatgtgatcac

SEQ ID NO: 2014 - DNA, 25 bp, Homo sapiens
aatacctgaattcttaacactgtta

SEQ ID NO: 2015 - DNA, 25 bp, Homo sapiens
catgtctttgatctggttttattcc

SEQ ID NO: 2016 - DNA, 25 bp, Homo sapiens
tattcctgtaattcagccacctgat

SEQ ID NO: 2017 - DNA, 25 bp, Homo sapiens
gaagaaggcctaatctctctctttt

SEQ ID NO: 2018 - DNA, 25 bp, Homo sapiens
ctcacttggcagtcagagcatcatg

SEQ ID NO: 2019 - DNA, 25 bp, Homo sapiens
gagcatcatgctttgaggtttgggg

SEQ ID NO: 2020 - DNA, 25 bp, Homo sapiens
agaatgccattccagaggacaagcc

SEQ ID NO: 2021 - DNA, 25 bp, Homo sapiens
taatttgagctcgtatttacccctg

SEQ ID NO: 2022 - DNA, 25 bp, Homo sapiens
taagtgacttgagagttcccggttt

SEQ ID NO: 2023 - DNA, 25 bp, Homo sapiens
cttctgtccttccatgtgtggggaa

SEQ ID NO: 2024 - DNA, 25 bp, Homo sapiens
agagcttggtttccaaagcgcctgg

SEQ ID NO: 2025 - DNA, 25 bp, Homo sapiens
acattctcaagtggcagtttcatta

SEQ ID NO: 2026 - DNA, 25 bp, Homo sapiens
ggtggacatcttttggatatctttt

SEQ ID NO: 2027 - DNA, 25 bp, Homo sapiens
tgcctttcaaaccctcaggtttgcc

SEQ ID NO: 2028 - DNA, 25 bp, Homo sapiens
tcaggtttgcctctaaccaggtgtc

SEQ ID NO: 2029 - DNA, 25 bp, Homo sapiens
gatgtgaatccaaaggcctatcccc

SEQ ID NO: 2030 - DNA, 25 bp, Homo sapiens
accaagaagctactggacctcgttc

SEQ ID NO: 2031 - DNA, 25 bp, Homo sapiens
gacctcgttcagcagtcatgtaact

SEQ ID NO: 2032 - DNA, 25 bp, Homo sapiens
caggggcatctctgagttcatcgtg

SEQ ID NO: 2033 - DNA, 25 bp, Homo sapiens
cgagccactggagatcattctgcac

SEQ ID NO: 2034 - DNA, 25 bp, Homo sapiens
ctgccgctgctgtgtgaagacaaga

SEQ ID NO: 2035 - DNA, 25 bp, Homo sapiens
aagaatgtgccctacgtgtttgtgc

SEQ ID NO: 2036 - DNA, 25 bp, Homo sapiens
gtcaccatcaaagaaggctcgcagc

SEQ ID NO: 2037 - DNA, 25 bp, Homo sapiens
agcagatccaatccattcagcagtc

SEQ ID NO: 2038 - DNA, 25 bp, Homo sapiens
gcagtccattgaaaggctcttagtc

SEQ ID NO: 2039 - DNA, 25 bp, Homo sapiens
tcttagtctaaacctgtggcctctg

SEQ ID NO: 2040 - DNA, 25 bp, Homo sapiens
tggctagaagccagcaggtgcccat

SEQ ID NO: 2041 - DNA, 25 bp, Homo sapiens
tgcccatgtgctactgacaagtgcc

SEQ ID NO: 2042 - DNA, 25 bp, Homo sapiens
atgtgctactgacaagtgcctcagc

SEQ ID NO: 2043 - DNA, 25 bp, Homo sapiens
ccgtgggagccgctattatctgcgt

SEQ ID NO: 2044 - DNA, 25 bp, Homo sapiens
tgggagccgctattatctgcgttct

SEQ ID NO: 2045 - DNA, 25 bp, Homo sapiens
cgttctctgccaaagactcgtgggg

SEQ ID NO: 2046 - DNA, 25 bp, Homo sapiens
gccaaagactcgtgggggccatcac

SEQ ID NO: 2047 - DNA, 25 bp, Homo sapiens
gtgcccactgctgtatgatctgggg

SEQ ID NO: 2048 - DNA, 25 bp, Homo sapiens
cctgacaacacccagctttatgtaa

SEQ ID NO: 2049 - DNA, 25 bp, Homo sapiens
tctgcagttgttacttaggaagcct

SEQ ID NO: 2050 - DNA, 25 bp, Homo sapiens
cccgcctgcagtggctagaagccag

SEQ ID NO: 2051 - DNA, 25 bp, Homo sapiens
cccattcagacaactgttccccaat

SEQ ID NO: 2052 - DNA, 25 bp, Homo sapiens
ctaccagccatctgcaggggtcagt

SEQ ID NO: 2053 - DNA, 25 bp, Homo sapiens
gtgccacttatgaagagtgccccat

SEQ ID NO: 2054 - DNA, 25 bp, Homo sapiens
aaaaggagactcagctgtcccttgg

SEQ ID NO: 2055 - DNA, 25 bp, Homo sapiens
cttgtgccagtatcccagggcagaa

SEQ ID NO: 2056 - DNA, 25 bp, Homo sapiens
ccttgcgcagagccactgtgagagg

SEQ ID NO: 2057 - DNA, 25 bp, Homo sapiens
tgagaggcggtgggagccaacaccc

SEQ ID NO: 2058 - DNA, 25 bp, Homo sapiens
attaagttcatatccaccttttggg

SEQ ID NO: 2059 - DNA, 25 bp, Homo sapiens
ccaagtgtgtgacttctccatatcc

SEQ ID NO: 2060 - DNA, 25 bp, Homo sapiens
tgggaattttcaatcccctgtgctt

SEQ ID NO: 2061 - DNA, 25 bp, Homo sapiens
tgcttgtctaacgtctgctttaaaa

SEQ ID NO: 2062 - DNA, 25 bp, Homo sapiens
caaggagacagtatctcagcgccct

SEQ ID NO: 2063 - DNA, 25 bp, Homo sapiens
cagcaggatgacacagtctacatgg

SEQ ID NO: 2064 - DNA, 25 bp, Homo sapiens
gcaggatgacacagtctacatgggc

SEQ ID NO: 2065 - DNA, 25 bp, Homo sapiens
gatgacacagtctacatgggcaaag

SEQ ID NO: 2066 - DNA, 25 bp, Homo sapiens
tacatgggcaaagtgaccttctcat

SEQ ID NO: 2067 - DNA, 25 bp, Homo sapiens
cttctcatgtgcggctggttttgga

SEQ ID NO: 2068 - DNA, 25 bp, Homo sapiens
tctcatgtgcggctggttttggaca

SEQ ID NO: 2069 - DNA, 25 bp, Homo sapiens
tgtgcggctggttttggacagcgac

SEQ ID NO: 2070 - DNA, 25 bp, Homo sapiens
gcggctggttttggacagcgacacc

SEQ ID NO: 2071 - DNA, 25 bp, Homo sapiens
gctggttttggacagcgacaccggc

SEQ ID NO: 2072 - DNA, 25 bp, Homo sapiens
tggttttggacagcgacaccggctg

SEQ ID NO: 2073 - DNA, 25 bp, Homo sapiens
aatacatggcttgctgcctgttgta

SEQ ID NO: 2074 - DNA, 25 bp, Homo sapiens
atgtcaatgctgccattgccaccat

SEQ ID NO: 2075 - DNA, 25 bp, Homo sapiens
aaccaagcgcacgatccagtttgtg

SEQ ID NO: 2076 - DNA, 25 bp, Homo sapiens
tgccccactggcttcaaggttggca

SEQ ID NO: 2077 - DNA, 25 bp, Homo sapiens
aaggttggcatcaactaccagcctc

SEQ ID NO: 2078 - DNA, 25 bp, Homo sapiens
acaccacagccattgctgaggcctg

SEQ ID NO: 2079 - DNA, 25 bp, Homo sapiens
gcctggaccacaagtttgacctgat

SEQ ID NO: 2080 - DNA, 25 bp, Homo sapiens
gacctgatgtatgccaagcgtgcct

SEQ ID NO: 2081 - DNA, 25 bp, Homo sapiens
ggcccgtgaagatatggctgccctt

SEQ ID NO: 2082 - DNA, 25 bp, Homo sapiens
ctaattatccattccttttggccct

SEQ ID NO: 2083 - DNA, 25 bp, Homo sapiens
gtcatgctcccagaatttcagcttc

SEQ ID NO: 2084 - DNA, 25 bp, Homo sapiens
actctcagaaagctggcaaagaaaa

SEQ ID NO: 2085 - DNA, 25 bp, Homo sapiens
tatctgacagtgaatctgatgacag

SEQ ID NO: 2086 - DNA, 25 bp, Homo sapiens
gaatctgatgacagcaaatcaaaga

SEQ ID NO: 2087 - DNA, 25 bp, Homo sapiens
gatgaagctcaataattgttcacat

SEQ ID NO: 2088 - DNA, 25 bp, Homo sapiens
ataactacatcctaatgaaaatcaa

SEQ ID NO: 2089 - DNA, 25 bp, Homo sapiens
tgtttgttttgaaagtagcgttgga

SEQ ID NO: 2090 - DNA, 25 bp, Homo sapiens
agtagcgttggaagagttgttgggg

SEQ ID NO: 2091 - DNA, 25 bp, Homo sapiens
ttttttgcatccatagcactggtta

SEQ ID NO: 2092 - DNA, 25 bp, Homo sapiens
tttgcatccatagcactggttactt

SEQ ID NO: 2093 - DNA, 25 bp, Homo sapiens
gcatccatagcactggttactttga

SEQ ID NO: 2094 - DNA, 25 bp, Homo sapiens
atagcactggttactttgaacaaat

SEQ ID NO: 2095 - DNA, 25 bp, Homo sapiens
tggtggagaccctggagctgcagaa

SEQ ID NO: 2096 - DNA, 25 bp, Homo sapiens
gcagaacctgatgctgtgtgcgctg

SEQ ID NO: 2097 - DNA, 25 bp, Homo sapiens
catctacggagcagaggcgcggaag

SEQ ID NO: 2098 - DNA, 25 bp, Homo sapiens
ggcgcggaaggagtcacggggcgcg

SEQ ID NO: 2099 - DNA, 25 bp, Homo sapiens
gcgcgcatgccagggaagactacaa

SEQ ID NO: 2100 - DNA, 25 bp, Homo sapiens
tactccaagcccatccaggggcaac

SEQ ID NO: 2101 - DNA, 25 bp, Homo sapiens
cacaccctgtcctttgtggacgttg

SEQ ID NO: 2102 - DNA, 25 bp, Homo sapiens
tgaacgaggctgactgtgccaccat

SEQ ID NO: 2103 - DNA, 25 bp, Homo sapiens
gccattcgctcctactgatgagaca

SEQ ID NO: 2104 - DNA, 25 bp, Homo sapiens
cataactgtcttcatacgcttctgc

SEQ ID NO: 2105 - DNA, 25 bp, Homo sapiens
gattggcacctagtggctgggagct

SEQ ID NO: 2106 - DNA, 25 bp, Homo sapiens
acagccgatctgctgcaggtcagca

SEQ ID NO: 2107 - DNA, 25 bp, Homo sapiens
aactgtgtcgtgagcagctgccaac

SEQ ID NO: 2108 - DNA, 25 bp, Homo sapiens
tttctggtgctgttctccagttcac

SEQ ID NO: 2109 - DNA, 25 bp, Homo sapiens
tcacgtctgccagctggtgagggca

SEQ ID NO: 2110 - DNA, 25 bp, Homo sapiens
gcacagcctcacacttgaaagacgg

SEQ ID NO: 2111 - DNA, 25 bp, Homo sapiens
gtttggtttcccatctaatcaactt

SEQ ID NO: 2112 - DNA, 25 bp, Homo sapiens
caccacctattttcctgatcagttg

SEQ ID NO: 2113 - DNA, 25 bp, Homo sapiens
agagacccagacttggttggcagcg

SEQ ID NO: 2114 - DNA, 25 bp, Homo sapiens
agcagcacccaggaggggatgccgc

SEQ ID NO: 2115 - DNA, 25 bp, Homo sapiens
gcatccttaatgcttctcagtcttc

SEQ ID NO: 2116 - DNA, 25 bp, Homo sapiens
gaggtgcgctttttatgtactttta

SEQ ID NO: 2117 - DNA, 25 bp, Homo sapiens
caccattcctaccattggttttaat

SEQ ID NO: 2118 - DNA, 25 bp, Homo sapiens
gatagaattaggcctctctggaagc

SEQ ID NO: 2119 - DNA, 25 bp, Homo sapiens
gcattacttccagaatacccagggt

SEQ ID NO: 2120 - DNA, 25 bp, Homo sapiens
gaatacccagggtcttatttttgtg

SEQ ID NO: 2121 - DNA, 25 bp, Homo sapiens
tgagagatgcagtgctgctactttt

SEQ ID NO: 2122 - DNA, 25 bp, Homo sapiens
ggatttgccaaatgctatggccatc

SEQ ID NO: 2123 - DNA, 25 bp, Homo sapiens
ggcttcagtctcttcgtaacagaac

SEQ ID NO: 2124 - DNA, 25 bp, Homo sapiens
ggtatgttcaagccacttgtgcaac

SEQ ID NO: 2125 - DNA, 25 bp, Homo sapiens
gactggctgtcaaatgagctttcaa

SEQ ID NO: 2126 - DNA, 25 bp, Homo sapiens
aattggtctaggcttgttacaacaa

SEQ ID NO: 2127 - DNA, 25 bp, Homo sapiens
gtatctgggactggtttgggcagaa

SEQ ID NO: 2128 - DNA, 25 bp, Homo sapiens
acacatgctgatctgtggccagcca

SEQ ID NO: 2129 - DNA, 25 bp, Homo sapiens
ccacttgtcacgccaaatgaagaga

SEQ ID NO: 2130 - DNA, 25 bp, Homo sapiens
ggaaaagactttcagccctcaagat

SEQ ID NO: 2131 - DNA, 25 bp, Homo sapiens
tcagccctcaagatctacagctcaa

SEQ ID NO: 2132 - DNA, 25 bp, Homo sapiens
agatctacagctcaacaggaacttg

SEQ ID NO: 2133 - DNA, 25 bp, Homo sapiens
gatgattgactgtaatgctttccat

SEQ ID NO: 2134 - DNA, 25 bp, Homo sapiens
atgctttccatttacctgactaaac

SEQ ID NO: 2135 - DNA, 25 bp, Homo sapiens
aggtattgattgctaccctgaccac

SEQ ID NO: 2136 - DNA, 25 bp, Homo sapiens
gtgctttggactatgagaaacttct

SEQ ID NO: 2137 - DNA, 25 bp, Homo sapiens
accactgggagcacaatgcccacat

SEQ ID NO: 2138 - DNA, 25 bp, Homo sapiens
gcacaatgcccacatcatcttaaga

SEQ ID NO: 2139 - DNA, 25 bp, Homo sapiens
aaacctggagagtgccttcgagtgc

SEQ ID NO: 2140 - DNA, 25 bp, Homo sapiens
gtgccttcgagtgcgaggcgaggtg

SEQ ID NO: 2141 - DNA, 25 bp, Homo sapiens
ctcctgacgctaagagcttcgtgct

SEQ ID NO: 2142 - DNA, 25 bp, Homo sapiens
gcttcgtgctgaacctgggcaaaga

SEQ ID NO: 2143 - DNA, 25 bp, Homo sapiens
tgtgcaacagcaaggacggcggggc

SEQ ID NO: 2144 - DNA, 25 bp, Homo sapiens
accgagcagcgggaggctgtctttc

SEQ ID NO: 2145 - DNA, 25 bp, Homo sapiens
gaccgtcaagctgccagatggatac

SEQ ID NO: 2146 - DNA, 25 bp, Homo sapiens
acatggcagctgacggtgacttcaa

SEQ ID NO: 2147 - DNA, 25 bp, Homo sapiens
ctcctggactcaatcatggcttgtg

SEQ ID NO: 2148 - DNA, 25 bp, Homo sapiens
atcatggcttgtggtctggtcgcca

SEQ ID NO: 2149 - DNA, 25 bp, Homo sapiens
gtcgccagcaacctgaatctcaaac

SEQ ID NO: 2150 - DNA, 25 bp, Homo sapiens
acgcccgatacgctgagtgtggttt

SEQ ID NO: 2151 - DNA, 25 bp, Homo sapiens
gtaaccagttcgggaagcaggagcc

SEQ ID NO: 2152 - DNA, 25 bp, Homo sapiens
gatcaaagagttcgccgcgggctac

SEQ ID NO: 2153 - DNA, 25 bp, Homo sapiens
ccgcgggctacaacgtcaaattcga

SEQ ID NO: 2154 - DNA, 25 bp, Homo sapiens
atctgcgtgaacggggacgacgccc

SEQ ID NO: 2155 - DNA, 25 bp, Homo sapiens
aatgccatcaagtggaacttcacca

SEQ ID NO: 2156 - DNA, 25 bp, Homo sapiens
acggctgcgtggtgaagcgctacgg

SEQ ID NO: 2157 - DNA, 25 bp, Homo sapiens
ggaggagcccctggtgatagagaag

SEQ ID NO: 2158 - DNA, 25 bp, Homo sapiens
tgatagagaaggacctgccccacta

SEQ ID NO: 2159 - DNA, 25 bp, Homo sapiens
tagctccacaagtgtgtggccccgc

SEQ ID NO: 2160 - DNA, 25 bp, Homo sapiens
gctggtggggcagacccgaaaatcc

SEQ ID NO: 2161 - DNA, 25 bp, Homo sapiens
tgaccctcgtcacataggctggaaa

SEQ ID NO: 2162 - DNA, 25 bp, Homo sapiens
gaaagatttcaccgcctacagatgg

SEQ ID NO: 2163 - DNA, 25 bp, Homo sapiens
tacagatggcgtctcagccacaggc

SEQ ID NO: 2164 - DNA, 25 bp, Homo sapiens
gactagggttgtttgtcttctctca

SEQ ID NO: 2165 - DNA, 25 bp, Homo sapiens
agaaatggtgttcttctctgacctg

SEQ ID NO: 2166 - DNA, 25 bp, Homo sapiens
accaatgctggtattgcaccttctg

SEQ ID NO: 2167 - DNA, 25 bp, Homo sapiens
gcaccttctggaactatgggcttga

SEQ ID NO: 2168 - DNA, 25 bp, Homo sapiens
gagaaaacccccaggatcacttctc

SEQ ID NO: 2169 - DNA, 25 bp, Homo sapiens
ccttcttttctgtgcttgcatcagt

SEQ ID NO: 2170 - DNA, 25 bp, Homo sapiens
cagtgtggactcctagaacgtgcga

SEQ ID NO: 2171 - DNA, 25 bp, Homo sapiens
aacagactcatcagcattcagcctc

SEQ ID NO: 2172 - DNA, 25 bp, Homo sapiens
ccagagccaccggctgactgtagag

SEQ ID NO: 2173 - DNA, 25 bp, Homo sapiens
ggacccggtcactgtggagtacatc

SEQ ID NO: 2174 - DNA, 25 bp, Homo sapiens
cgctacatcgccagtctgaagcagc

SEQ ID NO: 2175 - DNA, 25 bp, Homo sapiens
cagagcaatgggcgcaggccgtttg

SEQ ID NO: 2176 - DNA, 25 bp, Homo sapiens
ccctcatcgtgggtttcgactttga

SEQ ID NO: 2177 - DNA, 25 bp, Homo sapiens
ttcgactttgatggcactcctaggc

SEQ ID NO: 2178 - DNA, 25 bp, Homo sapiens
gggcacataccatgcctggaaggcc

SEQ ID NO: 2179 - DNA, 25 bp, Homo sapiens
ataggccggggtgccaagtcagtgc

SEQ ID NO: 2180 - DNA, 25 bp, Homo sapiens
aagctggtgatcaaggcactcctgg

SEQ ID NO: 2181 - DNA, 25 bp, Homo sapiens
gaacttgctgtcatgaggcgagatc

SEQ ID NO: 2182 - DNA, 25 bp, Homo sapiens
atgagtctcgatgtgtaggcctttc

SEQ ID NO: 2183 - DNA, 25 bp, Homo sapiens
cctaccaggccaccattgatggagt

SEQ ID NO: 2184 - DNA, 25 bp, Homo sapiens
gagtcagatttttggggacatcagg

SEQ ID NO: 2185 - DNA, 25 bp, Homo sapiens
gggacatcaggacagaacgtgagtg

SEQ ID NO: 2186 - DNA, 25 bp, Homo sapiens
gtgacattttccgatacagcagcat

SEQ ID NO: 2187 - DNA, 25 bp, Homo sapiens
ttccgatacagcagcatggaggatc

SEQ ID NO: 2188 - DNA, 25 bp, Homo sapiens
atcctggagtggaccctgcgggtcc

SEQ ID NO: 2189 - DNA, 25 bp, Homo sapiens
ctacaaaactgacccgttcatcttc

SEQ ID NO: 2190 - DNA, 25 bp, Homo sapiens
ggctccaaaatcatccgaggtcctg

SEQ ID NO: 2191 - DNA, 25 bp, Homo sapiens
gaccagacagtgctgttggtgactg

SEQ ID NO: 2192 - DNA, 25 bp, Homo sapiens
gcttcggggcagaggacgatgacct

SEQ ID NO: 2193 - DNA, 25 bp, Homo sapiens
ggcagaggacgatgacctgggaggc

SEQ ID NO: 2194 - DNA, 25 bp, Homo sapiens
attcgttgccgccggaggggaagct

SEQ ID NO: 2195 - DNA, 25 bp, Homo sapiens
ggctacggctgaccgttttttgtgg

SEQ ID NO: 2196 - DNA, 25 bp, Homo sapiens
gaggggaagcttgggatcatggaat

SEQ ID NO: 2197 - DNA, 25 bp, Homo sapiens
gggatcatggaattggccgttgggc

SEQ ID NO: 2198 - DNA, 25 bp, Homo sapiens
catggaattggccgttgggcttacc

SEQ ID NO: 2199 - DNA, 25 bp, Homo sapiens
tcctgtcacacctggagacctacag

SEQ ID NO: 2200 - DNA, 25 bp, Homo sapiens
gacctacaggaggccagagtgaagg

SEQ ID NO: 2201 - DNA, 25 bp, Homo sapiens
cagagtgaaggggtccgttctgtcc

SEQ ID NO: 2202 - DNA, 25 bp, Homo sapiens
ctcccctggatcatgtcattcaatt

SEQ ID NO: 2203 - DNA, 25 bp, Homo sapiens
tcatgtcattcaattccagtcacct

SEQ ID NO: 2204 - DNA, 25 bp, Homo sapiens
gtcacctcttctgcaatcatgacct

SEQ ID NO: 2205 - DNA, 25 bp, Homo sapiens
cgcatactcatggccatcaacggca

SEQ ID NO: 2206 - DNA, 25 bp, Homo sapiens
gtgttcgatgtgaccaaaggccgca

SEQ ID NO: 2207 - DNA, 25 bp, Homo sapiens
ttctacgggcccgaggggccgtatg

SEQ ID NO: 2208 - DNA, 25 bp, Homo sapiens
gccgtatggggtctttgctggaaga

SEQ ID NO: 2209 - DNA, 25 bp, Homo sapiens
gaagagatgcatccaggggccttgc

SEQ ID NO: 2210 - DNA, 25 bp, Homo sapiens
gccttgccacattttgcctggataa

SEQ ID NO: 2211 - DNA, 25 bp, Homo sapiens
atgagtacgatgacctttctgacct

SEQ ID NO: 2212 - DNA, 25 bp, Homo sapiens
gtctcagttcactttcaagtatcat

SEQ ID NO: 2213 - DNA, 25 bp, Homo sapiens
gtatcatcacgtgggcaaactgctg

SEQ ID NO: 2214 - DNA, 25 bp, Homo sapiens
ggagcccactgtgtactcagatgag

SEQ ID NO: 2215 - DNA, 25 bp, Homo sapiens
ttgtaacagtccactctgtctttaa

SEQ ID NO: 2216 - DNA, 25 bp, Homo sapiens
gctggctggcctaaaaacctaaata

SEQ ID NO: 2217 - DNA, 25 bp, Homo sapiens
aagattgtaggactgtcttcccaag

SEQ ID NO: 2218 - DNA, 25 bp, Homo sapiens
cccaagccccatgttcatggtgggg

SEQ ID NO: 2219 - DNA, 25 bp, Homo sapiens
ttactcaattggttactctcatttg

SEQ ID NO: 2220 - DNA, 25 bp, Homo sapiens
aggaacaggtgtttgctctcctaag

SEQ ID NO: 2221 - DNA, 25 bp, Homo sapiens
gctctcctaagagccttcatgcaca

SEQ ID NO: 2222 - DNA, 25 bp, Homo sapiens
acacccctgaaccacgaggaaacag

SEQ ID NO: 2223 - DNA, 25 bp, Homo sapiens
gaaacagtacagtcgctagtcaagt

SEQ ID NO: 2224 - DNA, 25 bp, Homo sapiens
gtgtctaggtctttgatattgctct

SEQ ID NO: 2225 - DNA, 25 bp, Homo sapiens
gatattgctcttttggttaacacta

SEQ ID NO: 2226 - DNA, 25 bp, Homo sapiens
gaactgtgttttatgattttacctc

SEQ ID NO: 2227 - DNA, 25 bp, Homo sapiens
gacagctggcagtggagcctgcttt

SEQ ID NO: 2228 - DNA, 25 bp, Homo sapiens
agctggcagtggagcctgctttatt

SEQ ID NO: 2229 - DNA, 25 bp, Homo sapiens
aggggcctggaatgtaaacagccac

SEQ ID NO: 2230 - DNA, 25 bp, Homo sapiens
aaacagccactggggtacaggcacc

SEQ ID NO: 2231 - DNA, 25 bp, Homo sapiens
actggggtacaggcaccgaagacca

SEQ ID NO: 2232 - DNA, 25 bp, Homo sapiens
gtacaggcaccgaagaccaacatcc

SEQ ID NO: 2233 - DNA, 25 bp, Homo sapiens
cgaagaccaacatccacaggctaac

SEQ ID NO: 2234 - DNA, 25 bp, Homo sapiens
aagaccaacatccacaggctaacac

SEQ ID NO: 2235 - DNA, 25 bp, Homo sapiens
caccccttcagtccacacaaagaag

SEQ ID NO: 2236 - DNA, 25 bp, Homo sapiens
ttcagtccacacaaagaagcttcat

SEQ ID NO: 2237 - DNA, 25 bp, Homo sapiens
gtccacacaaagaagcttcatattt

SEQ ID NO: 2238 - DNA, 25 bp, Homo sapiens
tcttcctcattgtagggcgttagga

SEQ ID NO: 2239 - DNA, 25 bp, Homo sapiens
ggcgttaggatgttgctttcttttt

SEQ ID NO: 2240 - DNA, 25 bp, Homo sapiens
gaaacatttatggcctcaagatact

SEQ ID NO: 2241 - DNA, 25 bp, Homo sapiens
tactatacatttaaagcaccccaat

SEQ ID NO: 2242 - DNA, 25 bp, Homo sapiens
aagggcttgtttggtatcccactga

SEQ ID NO: 2243 - DNA, 25 bp, Homo sapiens
attgcatccttagccattgtcacaa

SEQ ID NO: 2244 - DNA, 25 bp, Homo sapiens
tcttgtgtcttatgttctctgtatt

SEQ ID NO: 2245 - DNA, 25 bp, Homo sapiens
gttctctgtatttatgcagctgatt

SEQ ID NO: 2246 - DNA, 25 bp, Homo sapiens
aaggactcctaactactttgcatct

SEQ ID NO: 2247 - DNA, 25 bp, Homo sapiens
gcatctgtaatccacaaagattctg

SEQ ID NO: 2248 - DNA, 25 bp, Homo sapiens
gtctcttctctgtattatcatagtc

SEQ ID NO: 2249 - DNA, 25 bp, Homo sapiens
aattcctgccattctggggattctt

SEQ ID NO: 2250 - DNA, 25 bp, Homo sapiens
cttggaggaattcttgctttgctaa

SEQ ID NO: 2251 - DNA, 25 bp, Homo sapiens
gctgtttcttcggaggagagcggtg

SEQ ID NO: 2252 - DNA, 25 bp, Homo sapiens
gatgacacccgggacaacgtttatt

SEQ ID NO: 2253 - DNA, 25 bp, Homo sapiens
ctcggcctgaagtgactcgtaacga

SEQ ID NO: 2254 - DNA, 25 bp, Homo sapiens
gactcgtaacgacgttgcaccaacc

SEQ ID NO: 2255 - DNA, 25 bp, Homo sapiens
gccctgccaatcccgatgaaattgg

SEQ ID NO: 2256 - DNA, 25 bp, Homo sapiens
ctgaaagcggctgatactgacccca

SEQ ID NO: 2257 - DNA, 25 bp, Homo sapiens
attctctgctcgtgtttgactatga

SEQ ID NO: 2258 - DNA, 25 bp, Homo sapiens
gaagcggttccgaagctgctagtct

SEQ ID NO: 2259 - DNA, 25 bp, Homo sapiens
aagctggctgacatgtacggaggcg

SEQ ID NO: 2260 - DNA, 25 bp, Homo sapiens
tttcaagagcagtgtccgtggtgtg

SEQ ID NO: 2261 - DNA, 25 bp, Homo sapiens
gcctgtgagggtcctgactggagca

SEQ ID NO: 2262 - DNA, 25 bp, Homo sapiens
ggcatgctgtgctcggacggaaagc

SEQ ID NO: 2263 - DNA, 25 bp, Homo sapiens
tgtccctgccgctgaagaatggggc

SEQ ID NO: 2264 - DNA, 25 bp, Homo sapiens
ctctgagggaaacgctgtctgctgc

SEQ ID NO: 2265 - DNA, 25 bp, Homo sapiens
actcttttattcaacctttgccact

SEQ ID NO: 2266 - DNA, 25 bp, Homo sapiens
acctttgccactgatgaccggaaag

SEQ ID NO: 2267 - DNA, 25 bp, Homo sapiens
gaagggatgaccgcgtttgtggaaa

SEQ ID NO: 2268 - DNA, 25 bp, Homo sapiens
gaaaggccaacttcaaagaccagtg

SEQ ID NO: 2269 - DNA, 25 bp, Homo sapiens
tgcttcacacctctgcttggagagg

SEQ ID NO: 2270 - DNA, 25 bp, Homo sapiens
gaggacaagtgcagcctgtcagttt

SEQ ID NO: 2271 - DNA, 25 bp, Homo sapiens
gaaaccactccaaaatcgtcgcagg

SEQ ID NO: 2272 - DNA, 25 bp, Homo sapiens
ctacgtgcctctttggctatgacgc

SEQ ID NO: 2273 - DNA, 25 bp, Homo sapiens
ccccgttcggcagccaagacataca

SEQ ID NO: 2274 - DNA, 25 bp, Homo sapiens
agatggcccggtgtaggcgaacttc

SEQ ID NO: 2275 - DNA, 25 bp, Homo sapiens
gcaatctgcaaataactcctccatt

SEQ ID NO: 2276 - DNA, 25 bp, Homo sapiens
ttgggagacttttgtcttccagcct

SEQ ID NO: 2277 - DNA, 25 bp, Homo sapiens
gccaccatatgtgtgtgcctaggtc

SEQ ID NO: 2278 - DNA, 25 bp, Homo sapiens
cctccttctgcacgatccaatagga

SEQ ID NO: 2279 - DNA, 25 bp, Homo sapiens
gacaccagttctgactgaaccatgc

SEQ ID NO: 2280 - DNA, 25 bp, Homo sapiens
acccactccaaataatctcctcggt

SEQ ID NO: 2281 - DNA, 25 bp, Homo sapiens
gtgtgggtggtggttctatagaggg

SEQ ID NO: 2282 - DNA, 25 bp, Homo sapiens
tacaaatgccagtaccttgccgaga

SEQ ID NO: 2283 - DNA, 25 bp, Homo sapiens
caaccccaaggtaatggtcatctac

SEQ ID NO: 2284 - DNA, 25 bp, Homo sapiens
ggtcatctactttgcaacctatgga

SEQ ID NO: 2285 - DNA, 25 bp, Homo sapiens
gatcctgatagctcccatacaaagt

SEQ ID NO: 2286 - DNA, 25 bp, Homo sapiens
gtgaggtacactgttgccaatttgg

SEQ ID NO: 2287 - DNA, 25 bp, Homo sapiens
ggcaggaagccatcaaactaaacgt

SEQ ID NO: 2288 - DNA, 25 bp, Homo sapiens
attccagggacattagaccttggtg

SEQ ID NO: 2289 - DNA, 25 bp, Homo sapiens
taagcactttgaggtatccactccc

SEQ ID NO: 2290 - DNA, 25 bp, Homo sapiens
gtatccactccccttaaatgtaagt

SEQ ID NO: 2291 - DNA, 25 bp, Homo sapiens
aggggaggtccaagcatttgtactt

SEQ ID NO: 2292 - DNA, 25 bp, Homo sapiens
aatagcttgtgccagattactgtat

SEQ ID NO: 2293 - DNA, 25 bp, Homo sapiens
aggaacacagagcagcgcttcctgg

SEQ ID NO: 2294 - DNA, 25 bp, Homo sapiens
cgcttcctggctgtaaatcctagac

SEQ ID NO: 2295 - DNA, 25 bp, Homo sapiens
atcagaacatgaaatgccctcctaa

SEQ ID NO: 2296 - DNA, 25 bp, Homo sapiens
ccctcctaaatgtcagctgttgtca

SEQ ID NO: 2297 - DNA, 25 bp, Homo sapiens
ttgtcacacagtagctccaacactt

SEQ ID NO: 2298 - DNA, 25 bp, Homo sapiens
taagggagtggcctcatttcactag

SEQ ID NO: 2299 - DNA, 25 bp, Homo sapiens
gtgatttccatttctgatgtctcca

SEQ ID NO: 2300 - DNA, 25 bp, Homo sapiens
ttctgatgtctccagattggcaccc

SEQ ID NO: 2301 - DNA, 25 bp, Homo sapiens
atgcctcacgagatttgccaggggc

SEQ ID NO: 2302 - DNA, 25 bp, Homo sapiens
ggcaaacaatcccaatctttctata

SEQ ID NO: 2303 - DNA, 25 bp, Homo sapiens
cagatgagactgaacttgcgaggca

SEQ ID NO: 2304 - DNA, 25 bp, Homo sapiens
gatggaaaaccttattctcctagtg

SEQ ID NO: 2305 - DNA, 25 bp, Homo sapiens
tattctcctagtgaatactccctgc

SEQ ID NO: 2306 - DNA, 25 bp, Homo sapiens
gtgaatactccctgcagcaaacaag

SEQ ID NO: 2307 - DNA, 25 bp, Homo sapiens
agagatggcaatgttttccttgttc

SEQ ID NO: 2308 - DNA, 25 bp, Homo sapiens
ggatttgaccttttctgagctagtt

SEQ ID NO: 2309 - DNA, 25 bp, Homo sapiens
gtactattatactaaaagctcctac

SEQ ID NO: 2310 - DNA, 25 bp, Homo sapiens
aagctcctactgtgatgtgaaatgc

SEQ ID NO: 2311 - DNA, 25 bp, Homo sapiens
gtaaacaatttcttaggacaccatt

SEQ ID NO: 2312 - DNA, 25 bp, Homo sapiens
ggacaccatttgggctagtttctgt

SEQ ID NO: 2313 - DNA, 25 bp, Homo sapiens
atactgttcttatgtcatttgttat

SEQ ID NO: 2314 - DNA, 25 bp, Homo sapiens
tgcaaaactaaccacgatgtacttt

SEQ ID NO: 2315 - DNA, 25 bp, Homo sapiens
gagtcggagatgatgcagcacacac

SEQ ID NO: 2316 - DNA, 25 bp, Homo sapiens
ccccagcccagtgatgcttgtgttg

SEQ ID NO: 2317 - DNA, 25 bp, Homo sapiens
tgatgcttgtgttgaccagatgttc

SEQ ID NO: 2318 - DNA, 25 bp, Homo sapiens
ctgagtctggagcaagcacccaggc

SEQ ID NO: 2319 - DNA, 25 bp, Homo sapiens
gaagacttaaacatctgcctgaggt

SEQ ID NO: 2320 - DNA, 25 bp, Homo sapiens
ttcctcctggaaaacgctttggtag

SEQ ID NO: 2321 - DNA, 25 bp, Homo sapiens
atttggccaggagctttcttttatg

SEQ ID NO: 2322 - DNA, 25 bp, Homo sapiens
ggataaatacacacaccatacacta

SEQ ID NO: 2323 - DNA, 25 bp, Homo sapiens
cacaccatacactatccacagatat

SEQ ID NO: 2324 - DNA, 25 bp, Homo sapiens
agtgtttagctcacctagggggata

SEQ ID NO: 2325 - DNA, 25 bp, Homo sapiens
cacatttgcatatacccacatgggg

SEQ ID NO: 2326 - DNA, 25 bp, Homo sapiens
ttgttgtcgttgcttgtttgaagaa

SEQ ID NO: 2327 - DNA, 25 bp, Homo sapiens
gaaattctgaacaccgtcagcaccc

SEQ ID NO: 2328 - DNA, 25 bp, Homo sapiens
ctctcttccctatcatgggtcatct

SEQ ID NO: 2329 - DNA, 25 bp, Homo sapiens
atcatgggtcatctgacccctgtcc

SEQ ID NO: 2330 - DNA, 25 bp, Homo sapiens
tgtccctgcttcatgtttgggggcc

SEQ ID NO: 2331 - DNA, 25 bp, Homo sapiens
gccttcctggcttagctcagatggc

SEQ ID NO: 2332 - DNA, 25 bp, Homo sapiens
gagagtgtagtcaagggcctgggca

SEQ ID NO: 2333 - DNA, 25 bp, Homo sapiens
gacacctctcctgggtgtggagaca

SEQ ID NO: 2334 - DNA, 25 bp, Homo sapiens
tgggtgtggagacagcttggttccc

SEQ ID NO: 2335 - DNA, 25 bp, Homo sapiens
gatcctcacctcttggaattaaaat

SEQ ID NO: 2336 - DNA, 25 bp, Homo sapiens
gaaagcctgagtttgcaaccagttg

SEQ ID NO: 2337 - DNA, 25 bp, Homo sapiens
attagtgcctgttttcttgcaaatt

SEQ ID NO: 2338 - DNA, 25 bp, Homo sapiens
tttattgggaactatcctcctggcc

SEQ ID NO: 2339 - DNA, 25 bp, Homo sapiens
aggggctgaactatcggtatcacct

SEQ ID NO: 2340 - DNA, 25 bp, Homo sapiens
ggtatcacctgggttgtaactgcaa

SEQ ID NO: 2341 - DNA, 25 bp, Homo sapiens
ctgccttgctttgtgacttccaaga

SEQ ID NO: 2342 - DNA, 25 bp, Homo sapiens
aacgagtgtctctggaccgacatgc

SEQ ID NO: 2343 - DNA, 25 bp, Homo sapiens
cgacatgctctccaatttcggttac

SEQ ID NO: 2344 - DNA, 25 bp, Homo sapiens
tggctaccagtccaaacactacgcc

SEQ ID NO: 2345 - DNA, 25 bp, Homo sapiens
tacgcctgcatccggcagaagggcg

SEQ ID NO: 2346 - DNA, 25 bp, Homo sapiens
ggcagaagggcggctactgcagctg

SEQ ID NO: 2347 - DNA, 25 bp, Homo sapiens
ctgcagctggtaccgaggatgggcc

SEQ ID NO: 2348 - DNA, 25 bp, Homo sapiens
gactttttggaatagccctgtctag

SEQ ID NO: 2349 - DNA, 25 bp, Homo sapiens
gccctgtctagggcaaactgtggcc

SEQ ID NO: 2350 - DNA, 25 bp, Homo sapiens
gacaattgacaatctggactacccc

SEQ ID NO: 2351 - DNA, 25 bp, Homo sapiens
gcacccaagtgtttggcttctggct

SEQ ID NO: 2352 - DNA, 25 bp, Homo sapiens
gctacctaaggttaacatgtcacta

SEQ ID NO: 2353 - DNA, 25 bp, Homo sapiens
ggaggtggatgtgacaacaacttcc

SEQ ID NO: 2354 - DNA, 25 bp, Homo sapiens
tttgctttgggggtagaggcttctt

SEQ ID NO: 2355 - DNA, 25 bp, Homo sapiens
tagaggcttcttagattctcccagc

SEQ ID NO: 2356 - DNA, 25 bp, Homo sapiens
aacaagagatctcgaaccctgtcta

SEQ ID NO: 2357 - DNA, 25 bp, Homo sapiens
gctaaatttcgtagcactgtttaca

SEQ ID NO: 2358 - DNA, 25 bp, Homo sapiens
acagttttcctccatgttatttatg

SEQ ID NO: 2359 - DNA, 25 bp, Homo sapiens
gttcagattaactgcttatagcctt

SEQ ID NO: 2360 - DNA, 25 bp, Homo sapiens
ttatagccttagaaagccttttaca

SEQ ID NO: 2361 - DNA, 25 bp, Homo sapiens
gaggtttggatgttgcagctagtaa

SEQ ID NO: 2362 - DNA, 25 bp, Homo sapiens
atttttgctctgttcagcagttcta

SEQ ID NO: 2363 - DNA, 25 bp, Homo sapiens
gtaggggccaggtcactggtagtta

SEQ ID NO: 2364 - DNA, 25 bp, Homo sapiens
gttatagaactttccatacttccaa

SEQ ID NO: 2365 - DNA, 25 bp, Homo sapiens
gttgattttactgattgtactgtac

SEQ ID NO: 2366 - DNA, 25 bp, Homo sapiens
gtactgtacatctattaaagcctta

SEQ ID NO: 2367 - DNA, 25 bp, Homo sapiens
agccttagattattacattacgggt

SEQ ID NO: 2368 - DNA, 25 bp, Homo sapiens
ggaacccataccaatgtaatttcaa

SEQ ID NO: 2369 - DNA, 25 bp, Homo sapiens
gaataccatttcagtttatagactt

SEQ ID NO: 2370 - DNA, 25 bp, Homo sapiens
gaaatccctgagtatcaggccttgt

SEQ ID NO: 2371 - DNA, 25 bp, Homo sapiens
tatagcgtgtgtgcaaactcttgag

SEQ ID NO: 2372 - DNA, 25 bp, Homo sapiens
actcttgagggttgattatgctgca

SEQ ID NO: 2373 - DNA, 25 bp, Homo sapiens
ttgactttttgcacttctgtatata

SEQ ID NO: 2374 - DNA, 25 bp, Homo sapiens
tccataccccttcaaacatgttgct

SEQ ID NO: 2375 - DNA, 25 bp, Homo sapiens
catgttgctttgctttcttgtggac

SEQ ID NO: 2376 - DNA, 25 bp, Homo sapiens
ggacagcttgtagtttgccaggatt

SEQ ID NO: 2377 - DNA, 25 bp, Homo sapiens
gaaagatacgccatcctttcaaacc

SEQ ID NO: 2378 - DNA, 25 bp, Homo sapiens
gactgacaaaaactccatggggcca

SEQ ID NO: 2379 - DNA, 25 bp, Homo sapiens
actccatggggccaaatctgcctga

SEQ ID NO: 2380 - DNA, 25 bp, Homo sapiens
agcaggtacttctaccattaaggtg

SEQ ID NO: 2381 - DNA, 25 bp, Homo sapiens
ttcagatcagtttctgccaatttca

SEQ ID NO: 2382 - DNA, 25 bp, Homo sapiens
caagtattgactttcacaaaattta

SEQ ID NO: 2383 - DNA, 25 bp, Homo sapiens
gcaaaccaaacagcacactgtagct

SEQ ID NO: 2384 - DNA, 25 bp, Homo sapiens
gttttttaattgctgtaggatcctg

SEQ ID NO: 2385 - DNA, 25 bp, Homo sapiens
ttgctgtaggatcctgttctttcag

SEQ ID NO: 2386 - DNA, 25 bp, Homo sapiens
attttcaactcagaagcactcaaaa

SEQ ID NO: 2387 - DNA, 25 bp, Homo sapiens
tgaaaggacaaatgtgcttggtttt

SEQ ID NO: 2388 - DNA, 25 bp, Homo sapiens
gtaatcacaacttactttctgcttg

SEQ ID NO: 2389 - DNA, 25 bp, Homo sapiens
tactttctgcttgtagttgcttaaa

SEQ ID NO: 2390 - DNA, 25 bp, Homo sapiens
aattatgtattttgtcttgggctgc

SEQ ID NO: 2391 - DNA, 25 bp, Homo sapiens
gtcttgggctgcaatttgttttatg

SEQ ID NO: 2392 - DNA, 25 bp, Homo sapiens
cccagccatcactcatctttgagga

SEQ ID NO: 2393 - DNA, 25 bp, Homo sapiens
agcctctgtgcactgtttggtggcc

SEQ ID NO: 2394 - DNA, 25 bp, Homo sapiens
aggtgatgtcctgttcacatacctg

SEQ ID NO: 2395 - DNA, 25 bp, Homo sapiens
tgtatttaaagccctcagtctgtcc

SEQ ID NO: 2396 - DNA, 25 bp, Homo sapiens
gtcctgttgtgtggggcgaagtgat

SEQ ID NO: 2397 - DNA, 25 bp, Homo sapiens
gcgaagtgatggactctgccaggtg

SEQ ID NO: 2398 - DNA, 25 bp, Homo sapiens
ctgccaggtggacatgctgtgggtg

SEQ ID NO: 2399 - DNA, 25 bp, Homo sapiens
cccggcgtgtgccgggcctgaatgg

SEQ ID NO: 2400 - DNA, 25 bp, Homo sapiens
gcctgaatggacaggggccacttca

SEQ ID NO: 2401 - DNA, 25 bp, Homo sapiens
gccacttcacagcatgtcagggaaa

SEQ ID NO: 2402 - DNA, 25 bp, Homo sapiens
atcactgtcacacaattccaatgga

SEQ ID NO: 2403 - DNA, 25 bp, Homo sapiens
gaaaatcagcaagccaccagtggtc

SEQ ID NO: 2404 - DNA, 25 bp, Homo sapiens
cagcaagccaccagtggtccaaacc

SEQ ID NO: 2405 - DNA, 25 bp, Homo sapiens
cgtctgttcgccgtggataccggcg

SEQ ID NO: 2406 - DNA, 25 bp, Homo sapiens
ctgttcgccgtggataccggcgtcc

SEQ ID NO: 2407 - DNA, 25 bp, Homo sapiens
ctaacgctccttcacaagatggcaa

SEQ ID NO: 2408 - DNA, 25 bp, Homo sapiens
gaagcaccaactgagaaccctgctc

SEQ ID NO: 2409 - DNA, 25 bp, Homo sapiens
agcagagcagtgctgagtaacacca

SEQ ID NO: 2410 - DNA, 25 bp, Homo sapiens
caccttcaccatcggcaggtgacct

SEQ ID NO: 2411 - DNA, 25 bp, Homo sapiens
accatcggcaggtgacctaaagaat

SEQ ID NO: 2412 - DNA, 25 bp, Homo sapiens
acccccctgccactgataggcagtt

SEQ ID NO: 2413 - DNA, 25 bp, Homo sapiens
actgataggcagttctctggggccc

SEQ ID NO: 2414 - DNA, 25 bp, Homo sapiens
tgtcatctagtctcaagtatagcga

SEQ ID NO: 2415 - DNA, 25 bp, Homo sapiens
cgtgcaaaagtctagccttgcccga

SEQ ID NO: 2416 - DNA, 25 bp, Homo sapiens
gagctttccttacaatcagagcccc

SEQ ID NO: 2417 - DNA, 25 bp, Homo sapiens
gcccctctcaccttgtaaagtgtga

SEQ ID NO: 2418 - DNA, 25 bp, Homo sapiens
cttgtaaagtgtgaatcgcccttcc

SEQ ID NO: 2419 - DNA, 25 bp, Homo sapiens
cgcccttcccttttgtacagaagat

SEQ ID NO: 2420 - DNA, 25 bp, Homo sapiens
tgaactgtattttgcattttgtcta

SEQ ID NO: 2421 - DNA, 25 bp, Homo sapiens
catactgtcaattttccttgtttga

SEQ ID NO: 2422 - DNA, 25 bp, Homo sapiens
acacggtgtacatttccagagcctt

SEQ ID NO: 2423 - DNA, 25 bp, Homo sapiens
aacctgtgtatgcttatgcctgggc

SEQ ID NO: 2424 - DNA, 25 bp, Homo sapiens
gtaactcttgtgtagattgtctcta

SEQ ID NO: 2425 - DNA, 25 bp, Homo sapiens
gtgtctgcatgagcatgtggcctcc

SEQ ID NO: 2426 - DNA, 25 bp, Homo sapiens
aacccagtgacccagggacacgtgg

SEQ ID NO: 2427 - DNA, 25 bp, Homo sapiens
ggacagggctgtggagatggctccg

SEQ ID NO: 2428 - DNA, 25 bp, Homo sapiens
gcgaaattgccaacactcaagtcac

SEQ ID NO: 2429 - DNA, 25 bp, Homo sapiens
gtcacctcagtaccatccaggaggc

SEQ ID NO: 2430 - DNA, 25 bp, Homo sapiens
ggaggctgggtattgtcctgcctct

SEQ ID NO: 2431 - DNA, 25 bp, Homo sapiens
tctgccttttctgtctcagcggcag

SEQ ID NO: 2432 - DNA, 25 bp, Homo sapiens
caagagccctcgatggacaggcctg

SEQ ID NO: 2433 - DNA, 25 bp, Homo sapiens
gggccatcagtatttattgcctccg

SEQ ID NO: 2434 - DNA, 25 bp, Homo sapiens
ttccctgacccagccaggacaaaca

SEQ ID NO: 2435 - DNA, 25 bp, Homo sapiens
tgctgagagccgtctcctataggtc

SEQ ID NO: 2436 - DNA, 25 bp, Homo sapiens
cattttgctagaactgttagacaca

SEQ ID NO: 2437 - DNA, 25 bp, Homo sapiens
gttagacacattgcagtatgctgta

SEQ ID NO: 2438 - DNA, 25 bp, Homo sapiens
aagtgtgtgcataaccagtcatgag

SEQ ID NO: 2439 - DNA, 25 bp, Homo sapiens
caacacaatgcatgttgccttttta

SEQ ID NO: 2440 - DNA, 25 bp, Homo sapiens
tagtaaagttgatacctggttataa

SEQ ID NO: 2441 - DNA, 25 bp, Homo sapiens
tatgcctttatttttggctagaaga

SEQ ID NO: 2442 - DNA, 25 bp, Homo sapiens
aatgttagatggcactatgtatatt

SEQ ID NO: 2443 - DNA, 25 bp, Homo sapiens
caagttttcagtttgtaccgcctgg

SEQ ID NO: 2444 - DNA, 25 bp, Homo sapiens
agtttgtaccgcctggtatgtctgt

SEQ ID NO: 2445 - DNA, 25 bp, Homo sapiens
gtctgtgtaagaagccaatttttgt

SEQ ID NO: 2446 - DNA, 25 bp, Homo sapiens
gtattgttacagtttcaggttattt

SEQ ID NO: 2447 - DNA, 25 bp, Homo sapiens
gttgagaccagacaccttttgctgt

SEQ ID NO: 2448 - DNA, 25 bp, Homo sapiens
cagacaccttttgctgtctcatggg

SEQ ID NO: 2449 - DNA, 25 bp, Homo sapiens
ctgtctcatggggcagctacaagca

SEQ ID NO: 2450 - DNA, 25 bp, Homo sapiens
gcagctacaagcatgaacgggacca

SEQ ID NO: 2451 - DNA, 25 bp, Homo sapiens
aacgggaccagggaatggcagcagc

SEQ ID NO: 2452 - DNA, 25 bp, Homo sapiens
atggcagcagcatgcagaatcttag

SEQ ID NO: 2453 - DNA, 25 bp, Homo sapiens
gaatcttagcactctttagcacaat

SEQ ID NO: 2454 - DNA, 25 bp, Homo sapiens
agtgtgattcgatcgtcaagacatc

SEQ ID NO: 2455 - DNA, 25 bp, Homo sapiens
agacatcacttggatttcttaatct

SEQ ID NO: 2456 - DNA, 25 bp, Homo sapiens
gaagatgtgaagttgaggtgctgca

SEQ ID NO: 2457 - DNA, 25 bp, Homo sapiens
tgaggtgctgcattctagaacttca

SEQ ID NO: 2458 - DNA, 25 bp, Homo sapiens
ctcaaagactctcccgtggatgacg

SEQ ID NO: 2459 - DNA, 25 bp, Homo sapiens
ggactctgggctgctggaataggac

SEQ ID NO: 2460 - DNA, 25 bp, Homo sapiens
ggacactcaagacttttgactgcca

SEQ ID NO: 2461 - DNA, 25 bp, Homo sapiens
ttcagtggagactccctggccaaca

SEQ ID NO: 2462 - DNA, 25 bp, Homo sapiens
tatgcagtgtgctttttcttgccag

SEQ ID NO: 2463 - DNA, 25 bp, Homo sapiens
tgggccattcttgcttagacagtca

SEQ ID NO: 2464 - DNA, 25 bp, Homo sapiens
tgtctcctcctttaactgagtcatc

SEQ ID NO: 2465 - DNA, 25 bp, Homo sapiens
atagaagaagccccacgggagccag

SEQ ID NO: 2466 - DNA, 25 bp, Homo sapiens
gatgggactggtcgtgtttgtgctt

SEQ ID NO: 2467 - DNA, 25 bp, Homo sapiens
tgtgcttttctccaagtcagcaccc

SEQ ID NO: 2468 - DNA, 25 bp, Homo sapiens
tcaaacggccgaagttgcctctttt

SEQ ID NO: 2469 - DNA, 25 bp, Homo sapiens
gacagcagatgactaaagccgcctt

SEQ ID NO: 2470 - DNA, 25 bp, Homo sapiens
tcccctctgcactttttgcaagaca

SEQ ID NO: 2471 - DNA, 25 bp, Homo sapiens
gtcaacaggaagacccagcagctcc

SEQ ID NO: 2472 - DNA, 25 bp, Homo sapiens
aagtgacaggccattttcggacgca

SEQ ID NO: 2473 - DNA, 25 bp, Homo sapiens
ttctgtgcccattcttcaggcaact

SEQ ID NO: 2474 - DNA, 25 bp, Homo sapiens
gcaactttcgattccttactgtagc

SEQ ID NO: 2475 - DNA, 25 bp, Homo sapiens
tagaccgtctggtgtcacagagccc

SEQ ID NO: 2476 - DNA, 25 bp, Homo sapiens
ctcctccgagatacgtggcgtgtag

SEQ ID NO: 2477 - DNA, 25 bp, Homo sapiens
gtgtgcatacaaactggtgaccgtc

SEQ ID NO: 2478 - DNA, 25 bp, Homo sapiens
gaggcgtctgtttacaaacttccac

SEQ ID NO: 2479 - DNA, 25 bp, Homo sapiens
cacaggcagctgttctgttggctcg

SEQ ID NO: 2480 - DNA, 25 bp, Homo sapiens
tagccacagtattgctccctaaaat

SEQ ID NO: 2481 - DNA, 25 bp, Homo sapiens
atgaccttgggcacagggaagttct

SEQ ID NO: 2482 - DNA, 25 bp, Homo sapiens
ctggtgtcatagatatcccgttttg

SEQ ID NO: 2483 - DNA, 25 bp, Homo sapiens
gatatcccgttttgtgaggtagagc

SEQ ID NO: 2484 - DNA, 25 bp, Homo sapiens
gaggtagagctgtgcattaaacttg

SEQ ID NO: 2485 - DNA, 25 bp, Homo sapiens
taaacttgcacatgactggaacgaa

SEQ ID NO: 2486 - DNA, 25 bp, Homo sapiens
gtaaagaccttgctgaatgtttcca

SEQ ID NO: 2487 - DNA, 25 bp, Homo sapiens
aatactacctggagtcttgtcctct

SEQ ID NO: 2488 - DNA, 25 bp, Homo sapiens
tggcctggcctgaatattatactac

SEQ ID NO: 2489 - DNA, 25 bp, Homo sapiens
taaacactatcttatcttctcctga

SEQ ID NO: 2490 - DNA, 25 bp, Homo sapiens
tatcttctcctgaactgttgatttt

SEQ ID NO: 2491 - DNA, 25 bp, Homo sapiens
gcccaagtgttgtctctttgttgtc

SEQ ID NO: 2492 - DNA, 25 bp, Homo sapiens
agagagttacaaccctcatgtgcgc

SEQ ID NO: 2493 - DNA, 25 bp, Homo sapiens
atgtgcgctacggagctgcaatggc

SEQ ID NO: 2494 - DNA, 25 bp, Homo sapiens
atggccttggggatatgctgtgctg

SEQ ID NO: 2495 - DNA, 25 bp, Homo sapiens
caaacgaccccgtgaactacgtgag

SEQ ID NO: 2496 - DNA, 25 bp, Homo sapiens
catagcttcagctctcatcatgatc

SEQ ID NO: 2497 - DNA, 25 bp, Homo sapiens
gccaagtttggcgctattctggccc

SEQ ID NO: 2498 - DNA, 25 bp, Homo sapiens
gtccaggactgggcatactcatatg

SEQ ID NO: 2499 - DNA, 25 bp, Homo sapiens
atactcatatgccttctgtggttgg

SEQ ID NO: 2500 - DNA, 25 bp, Homo sapiens
tggttggcgtccttgtatttaccca

SEQ ID NO: 2501 - DNA, 25 bp, Homo sapiens
ctacctgtgtcattggccttaacaa

SEQ ID NO: 2502 - DNA, 25 bp, Homo sapiens
catgtgcacacagattattttttgg

SEQ ID NO: 2503 - DNA, 25 bp, Homo sapiens
gtgtgttcctggtattcttttataa

SEQ ID NO: 2504 - DNA, 25 bp, Homo sapiens
cagcttcagccagggacaaaatccc

SEQ ID NO: 2505 - DNA, 25 bp, Homo sapiens
atacttctactcttaacaattacct

SEQ ID NO: 2506 - DNA, 25 bp, Homo sapiens
attacctaaggcttcctcaactgcc

SEQ ID NO: 2507 - DNA, 25 bp, Homo sapiens
gccccaaatctcttaatagcttcta

SEQ ID NO: 2508 - DNA, 25 bp, Homo sapiens
atagcttctagtgctgctacaatct

SEQ ID NO: 2509 - DNA, 25 bp, Homo sapiens
gctacaatctaagtcaggtcaccag

SEQ ID NO: 2510 - DNA, 25 bp, Homo sapiens
gagtcattgtgtctgaaaactgcaa

SEQ ID NO: 2511 - DNA, 25 bp, Homo sapiens
tgagatccagcaaacaggttctgtt

SEQ ID NO: 2512 - DNA, 25 bp, Homo sapiens
aaaatggacttcttattcaaagcat

SEQ ID NO: 2513 - DNA, 25 bp, Homo sapiens
accaggtgaggtcccagcttgaaga

SEQ ID NO: 2514 - DNA, 25 bp, Homo sapiens
gttccctgtgtttaaggccgtgtca

SEQ ID NO: 2515 - DNA, 25 bp, Homo sapiens
gccgtgtcattcaagagccaggtgg

SEQ ID NO: 2516 - DNA, 25 bp, Homo sapiens
tcgcggggacaaactacttcatcaa

SEQ ID NO: 2517 - DNA, 25 bp, Homo sapiens
catcaaggtgcacgtcggcgacgag

SEQ ID NO: 2518 - DNA, 25 bp, Homo sapiens
gtacacctgcgagtgttccaatctc

SEQ ID NO: 2519 - DNA, 25 bp, Homo sapiens
atctctccctcatgaaaacaagccc

SEQ ID NO: 2520 - DNA, 25 bp, Homo sapiens
gaccttatctaactaccagaccaac

SEQ ID NO: 2521 - DNA, 25 bp, Homo sapiens
gatgagctgacctatttctgatcct

SEQ ID NO: 2522 - DNA, 25 bp, Homo sapiens
gtctaccagagcgtgcacttgtgat

SEQ ID NO: 2523 - DNA, 25 bp, Homo sapiens
tccgtcgccgccaagatgatgtgcg

SEQ ID NO: 2524 - DNA, 25 bp, Homo sapiens
gtattggtcgtacgggacgtgtagg

SEQ ID NO: 2525 - DNA, 25 bp, Homo sapiens
taggaaaccttggcctggcaacctc

SEQ ID NO: 2526 - DNA, 25 bp, Homo sapiens
ggcaacctcattctttaacgagagg

SEQ ID NO: 2527 - DNA, 25 bp, Homo sapiens
gaagtgccgtcttggttagaaaaca

SEQ ID NO: 2528 - DNA, 25 bp, Homo sapiens
gggtagcagtcgtggacgttctaag

SEQ ID NO: 2529 - DNA, 25 bp, Homo sapiens
caaagtagcggtgccagcagttcca

SEQ ID NO: 2530 - DNA, 25 bp, Homo sapiens
gtggccacggtagcagcagaggatt

SEQ ID NO: 2531 - DNA, 25 bp, Homo sapiens
ggaggcttttacaacagtgatggat

SEQ ID NO: 2532 - DNA, 25 bp, Homo sapiens
gactggtggggtaactgagcctgct

SEQ ID NO: 2533 - DNA, 25 bp, Homo sapiens
gagcctgctttgcagtaggtcaccc

SEQ ID NO: 2534 - DNA, 25 bp, Homo sapiens
gtcaccctgccaaacaagctaatat

SEQ ID NO: 2535 - DNA, 25 bp, Homo sapiens
gtatctttttacagtattctttcta

SEQ ID NO: 2536 - DNA, 25 bp, Homo sapiens
attctttctacatgatccttttttg

SEQ ID NO: 2537 - DNA, 25 bp, Homo sapiens
gactgctgattttgctacttttttt

SEQ ID NO: 2538 - DNA, 25 bp, Homo sapiens
tgtaccttaaatttgcatcttccct

SEQ ID NO: 2539 - DNA, 25 bp, Homo sapiens
ccctctcatacccaagctgtaaaca

SEQ ID NO: 2540 - DNA, 25 bp, Homo sapiens
aaatcacttggttcaatacatgctt

SEQ ID NO: 2541 - DNA, 25 bp, Homo sapiens
gtgtgctcagaacttagacgggatt

SEQ ID NO: 2542 - DNA, 25 bp, Homo sapiens
ggtaggccaagtatgctaagtgtac

SEQ ID NO: 2543 - DNA, 25 bp, Homo sapiens
tgtactcttgctttgtcaagctgtt

SEQ ID NO: 2544 - DNA, 25 bp, Homo sapiens
agctgtttgctatagtttccaaggt

SEQ ID NO: 2545 - DNA, 25 bp, Homo sapiens
aggtattatgttactctaactctga

SEQ ID NO: 2546 - DNA, 25 bp, Homo sapiens
tttctcagtttcagatcctctgcta

SEQ ID NO: 2547 - DNA, 25 bp, Homo sapiens
agatcctctgctattttattgagtg

SEQ ID NO: 2548 - DNA, 25 bp, Homo sapiens
gaaagtcttgagctaaaagggttca

SEQ ID NO: 2549 - DNA, 25 bp, Homo sapiens
aatgttgcatttccttatgtctcag

SEQ ID NO: 2550 - DNA, 25 bp, Homo sapiens
tatggtaacttgtcagattgtctat

SEQ ID NO: 2551 - DNA, 25 bp, Homo sapiens
tgaacaaacccacttttttagacat

SEQ ID NO: 2552 - DNA, 25 bp, Homo sapiens
gtatcaactagttacatgttctatt

SEQ ID NO: 2553 - DNA, 25 bp, Homo sapiens
gttacatgttctattcatagtcttt

SEQ ID NO: 2554 - DNA, 25 bp, Homo sapiens
gagcctttgtataggtacattcctg

SEQ ID NO: 2555 - DNA, 25 bp, Homo sapiens
aaggtggacatttagcgttcagtgc

SEQ ID NO: 2556 - DNA, 25 bp, Homo sapiens
tagcgttcagtgcagttttcaataa

SEQ ID NO: 2557 - DNA, 25 bp, Homo sapiens
ggcagttgcattgtcaattagccaa

SEQ ID NO: 2558 - DNA, 25 bp, Homo sapiens
aattagccaatttccagctcttgtt

SEQ ID NO: 2559 - DNA, 25 bp, Homo sapiens
agctcttgttactacagggttccat

SEQ ID NO: 2560 - DNA, 25 bp, Homo sapiens
accagactcaagaccgctgacaatt

SEQ ID NO: 2561 - DNA, 25 bp, Homo sapiens
atcaaaacctcacacaagtccatca

SEQ ID NO: 2562 - DNA, 25 bp, Homo sapiens
aagtccatcattatcacgtcatgcc

SEQ ID NO: 2563 - DNA, 25 bp, Homo sapiens
cacgtcatgccgtccttaagatgca

SEQ ID NO: 2564 - DNA, 25 bp, Homo sapiens
ttctgactttaatctaccccaaagc

SEQ ID NO: 2565 - DNA, 25 bp, Homo sapiens
gacctggacctggttcaagggaggg

SEQ ID NO: 2566 - DNA, 25 bp, Homo sapiens
gtgaaccttgaaactgttttgccaa

SEQ ID NO: 2567 - DNA, 25 bp, Homo sapiens
gaagtgttgcaaatagtcccatgag

SEQ ID NO: 2568 - DNA, 25 bp, Homo sapiens
cggccctgacggtccagaggaaaag

SEQ ID NO: 2569 - DNA, 25 bp, Homo sapiens
ccgggatcgtgaccgggagcgacgg

SEQ ID NO: 2570 - DNA, 25 bp, Homo sapiens
tgaccgtgaccgcgagcacaaacgg

SEQ ID NO: 2571 - DNA, 25 bp, Homo sapiens
caaacggggggagcggggcagtgag

SEQ ID NO: 2572 - DNA, 25 bp, Homo sapiens
ggtggccaggacaacgggctggagg

SEQ ID NO: 2573 - DNA, 25 bp, Homo sapiens
gtctgggcaacgacagccgagacat

SEQ ID NO: 2574 - DNA, 25 bp, Homo sapiens
agtgaagaggtcgtcctctccatct

SEQ ID NO: 2575 - DNA, 25 bp, Homo sapiens
ccatctgctgtgtttggacgcgttc

SEQ ID NO: 2576 - DNA, 25 bp, Homo sapiens
caaccttggccacttgagtttgtcc

SEQ ID NO: 2577 - DNA, 25 bp, Homo sapiens
gagtttgtcctccaagggtaggtgt

SEQ ID NO: 2578 - DNA, 25 bp, Homo sapiens
ggtaggtgtctcatttgttctggcc

SEQ ID NO: 2579 - DNA, 25 bp, Homo sapiens
aatgtcctggtcgcatgtatgcacc

SEQ ID NO: 2580 - DNA, 25 bp, Homo sapiens
gcccccgaagctctgcagaagaagc

SEQ ID NO: 2581 - DNA, 25 bp, Homo sapiens
acatgtggagttttgcagtgcttct

SEQ ID NO: 2582 - DNA, 25 bp, Homo sapiens
gacacgggaggtaccctttgctgac

SEQ ID NO: 2583 - DNA, 25 bp, Homo sapiens
ctttgctgacctctccaatatggag

SEQ ID NO: 2584 - DNA, 25 bp, Homo sapiens
attggaaggccttcggcctaccatc

SEQ ID NO: 2585 - DNA, 25 bp, Homo sapiens
gtatttcccctcatgtgtgtaagct

SEQ ID NO: 2586 - DNA, 25 bp, Homo sapiens
aatgaagaccctgcaaagcgaccca

SEQ ID NO: 2587 - DNA, 25 bp, Homo sapiens
gacatgattgtgcctatccttgaga

SEQ ID NO: 2588 - DNA, 25 bp, Homo sapiens
atccctaccactgtgcgcaagaggg

SEQ ID NO: 2589 - DNA, 25 bp, Homo sapiens
ggctcagagctttgtcacttgccac

SEQ ID NO: 2590 - DNA, 25 bp, Homo sapiens
gtatagctttgggccatgtagcatt

SEQ ID NO: 2591 - DNA, 25 bp, Homo sapiens
aaattattaatctgttgctgactct

SEQ ID NO: 2592 - DNA, 25 bp, Homo sapiens
gttgctgactcttaattcctatttc

SEQ ID NO: 2593 - DNA, 25 bp, Homo sapiens
gtgtatgacagctttccttcacaca

SEQ ID NO: 2594 - DNA, 25 bp, Homo sapiens
tccttcacacactatttttgtgggt

SEQ ID NO: 2595 - DNA, 25 bp, Homo sapiens
gactttctgcctgttacatttttgc

SEQ ID NO: 2596 - DNA, 25 bp, Homo sapiens
gtgttttccactagtatatccctgt

SEQ ID NO: 2597 - DNA, 25 bp, Homo sapiens
tccctgttgatttgtttgtgccttt

SEQ ID NO: 2598 - DNA, 25 bp, Homo sapiens
gagaagttgtagctctgatgtctag

SEQ ID NO: 2599 - DNA, 25 bp, Homo sapiens
gatgtctagctgtagtctccttgat

SEQ ID NO: 2600 - DNA, 25 bp, Homo sapiens
gtctccttgatctgctgattgcatt

SEQ ID NO: 2601 - DNA, 25 bp, Homo sapiens
gatctggatccaggctgtacattga

SEQ ID NO: 2602 - DNA, 25 bp, Homo sapiens
tcactggcactgttaatatccgcac

SEQ ID NO: 2603 - DNA, 25 bp, Homo sapiens
ataaggtccacggggaacgcaccat

SEQ ID NO: 2604 - DNA, 25 bp, Homo sapiens
gggaacgcaccatttctgaaactat

SEQ ID NO: 2605 - DNA, 25 bp, Homo sapiens
gaaactatcgagcggctacagcagc

SEQ ID NO: 2606 - DNA, 25 bp, Homo sapiens
acagcagctcaaagagttccgcagc

SEQ ID NO: 2607 - DNA, 25 bp, Homo sapiens
gagttccgcagcaaacaggcagaag

SEQ ID NO: 2608 - DNA, 25 bp, Homo sapiens
aattacccagattggctccatggaa

SEQ ID NO: 2609 - DNA, 25 bp, Homo sapiens
gaacagcgtttccgtaaaattgact

SEQ ID NO: 2610 - DNA, 25 bp, Homo sapiens
gactttgtactcgaaaacgtcaatt

SEQ ID NO: 2611 - DNA, 25 bp, Homo sapiens
ggtcaacctgcaggcgtaactattt

SEQ ID NO: 2612 - DNA, 25 bp, Homo sapiens
acctcgcccggaaggagctgaagag

SEQ ID NO: 2613 - DNA, 25 bp, Homo sapiens
gagaatgcaggacctggacgaggat

SEQ ID NO: 2614 - DNA, 25 bp, Homo sapiens
gaagctgcaggatgcctactacatc

SEQ ID NO: 2615 - DNA, 25 bp, Homo sapiens
gatgcctactacatcttccaggaga

SEQ ID NO: 2616 - DNA, 25 bp, Homo sapiens
ggagatggctgacaagtgctcgccc

SEQ ID NO: 2617 - DNA, 25 bp, Homo sapiens
tgctcaatgggcaggcggcctgcca

SEQ ID NO: 2618 - DNA, 25 bp, Homo sapiens
tgctgcaggaggcgctagacaagga

SEQ ID NO: 2619 - DNA, 25 bp, Homo sapiens
aggatagtggctacccagagacgct

SEQ ID NO: 2620 - DNA, 25 bp, Homo sapiens
cccagagacgctggtcaacctcatc

SEQ ID NO: 2621 - DNA, 25 bp, Homo sapiens
cccatcccttcatcaaggagtacca

SEQ ID NO: 2622 - DNA, 25 bp, Homo sapiens
gcccagagctgtcaggaccatgaag

SEQ ID NO: 2623 - DNA, 25 bp, Homo sapiens
acacgtgcttgtggacatcagcctc

SEQ ID NO: 2624 - DNA, 25 bp, Homo sapiens
cctgccagcagttcttgaagcttct

SEQ ID NO: 2625 - DNA, 25 bp, Homo sapiens
acctgtatttctcagttgcagcact

SEQ ID NO: 2626 - DNA, 25 bp, Homo sapiens
cccatgcatctgcctggcatttagg

SEQ ID NO: 2627 - DNA, 25 bp, Homo sapiens
tggcatttaggcagcagagcccctg

SEQ ID NO: 2628 - DNA, 25 bp, Homo sapiens
tcctcatctcatttggctgtgtaaa

SEQ ID NO: 2629 - DNA, 25 bp, Homo sapiens
gcaattgaggcagttgaccatattc

SEQ ID NO: 2630 - DNA, 25 bp, Homo sapiens
tccaagtccaccagtctctgaaatt

SEQ ID NO: 2631 - DNA, 25 bp, Homo sapiens
ggagtggaatgttctatccccacaa

SEQ ID NO: 2632 - DNA, 25 bp, Homo sapiens
tagacttgtcttgttcagattctgt

SEQ ID NO: 2633 - DNA, 25 bp, Homo sapiens
tcagattctgtatttacccatttta

SEQ ID NO: 2634 - DNA, 25 bp, Homo sapiens
tcatcgccatcaagccggacggcgt

SEQ ID NO: 2635 - DNA, 25 bp, Homo sapiens
ggcctggtgggcgagatcatcaagc

SEQ ID NO: 2636 - DNA, 25 bp, Homo sapiens
cgagcagaagggattccgcctcgtg

SEQ ID NO: 2637 - DNA, 25 bp, Homo sapiens
acctgaagcagcactacattgacct

SEQ ID NO: 2638 - DNA, 25 bp, Homo sapiens
acattgacctgaaagaccgaccatt

SEQ ID NO: 2639 - DNA, 25 bp, Homo sapiens
tcagggccggttgtggccatggtct

SEQ ID NO: 2640 - DNA, 25 bp, Homo sapiens
aggccgagtgatgcttggggagacc

SEQ ID NO: 2641 - DNA, 25 bp, Homo sapiens
aatccagcagattcaaagccaggca

SEQ ID NO: 2642 - DNA, 25 bp, Homo sapiens
tcttgtgctcatgactgggtctatg

SEQ ID NO: 2643 - DNA, 25 bp, Homo sapiens
gaggtggacacaacagcagtctcct

SEQ ID NO: 2644 - DNA, 25 bp, Homo sapiens
tccttcagcacggcgtggtgtgtcc

SEQ ID NO: 2645 - DNA, 25 bp, Homo sapiens
caccctgtgggtagtcttccagaag

SEQ ID NO: 2646 - DNA, 25 bp, Homo sapiens
atgccctgcaccttgttatttggga

SEQ ID NO: 2647 - DNA, 25 bp, Homo sapiens
ttatattctgtgttgcatttctccc

SEQ ID NO: 2648 - DNA, 25 bp, Homo sapiens
gtattggccccatggcaggaacagc

SEQ ID NO: 2649 - DNA, 25 bp, Homo sapiens
ctgtctggtgggtgattctctgccc

SEQ ID NO: 2650 - DNA, 25 bp, Homo sapiens
ctgcctgttttctctttttagacac

SEQ ID NO: 2651 - DNA, 25 bp, Homo sapiens
gacacaacagccgcagtttggccag

SEQ ID NO: 2652 - DNA, 25 bp, Homo sapiens
tcccaccagctgaggtccgaggaaa

SEQ ID NO: 2653 - DNA, 25 bp, Homo sapiens
aaagcggggtgactcatttcccttg

SEQ ID NO: 2654 - DNA, 25 bp, Homo sapiens
tgaggtgtccagcctgcaaagctat

SEQ ID NO: 2655 - DNA, 25 bp, Homo sapiens
aaagctattccagctccttggtgtt

SEQ ID NO: 2656 - DNA, 25 bp, Homo sapiens
gttttgaagctgtggttgcctgctc

SEQ ID NO: 2657 - DNA, 25 bp, Homo sapiens
ccaagtgacctatacctgtgtttct

SEQ ID NO: 2658 - DNA, 25 bp, Homo sapiens
gcctgtgtcactcagcagtgggaca

SEQ ID NO: 2659 - DNA, 25 bp, Homo sapiens
cgagggcgtgtctagcttgatgttg

SEQ ID NO: 2660 - DNA, 25 bp, Homo sapiens
gtacaacctgaatacccttttctga

SEQ ID NO: 2661 - DNA, 25 bp, Homo sapiens
tagtgccactaacggttgagttttg

SEQ ID NO: 2662 - DNA, 25 bp, Homo sapiens
taaaactacagcccaggtcctgatc

SEQ ID NO: 2663 - DNA, 25 bp, Homo sapiens
ttgactttgaactgagcagccagga

SEQ ID NO: 2664 - DNA, 25 bp, Homo sapiens
gcagccaggatatgaccaccttact

SEQ ID NO: 2665 - DNA, 25 bp, Homo sapiens
accaccttactcagctacaacagga

SEQ ID NO: 2666 - DNA, 25 bp, Homo sapiens
ggtctgtgccttgttgagctgtacc

SEQ ID NO: 2667 - DNA, 25 bp, Homo sapiens
atatttactacatattttccatctg

SEQ ID NO: 2668 - DNA, 25 bp, Homo sapiens
gaactgtcaaatccttgcatacttc

SEQ ID NO: 2669 - DNA, 25 bp, Homo sapiens
aaatccttgcatacttctgtgacac

SEQ ID NO: 2670 - DNA, 25 bp, Homo sapiens
gtgactgtcacaactgttatgtttt

SEQ ID NO: 2671 - DNA, 25 bp, Homo sapiens
gtatttcaccacctaaatgtaatgt

SEQ ID NO: 2672 - DNA, 25 bp, Homo sapiens
gtcatgttgaacagcattttagcat

SEQ ID NO: 2673 - DNA, 25 bp, Homo sapiens
tagcagtgtagtctcaattatatct

SEQ ID NO: 2674 - DNA, 25 bp, Homo sapiens
gtgactaacaagtatgctttgcctt

SEQ ID NO: 2675 - DNA, 25 bp, Homo sapiens
gctttgccttatttccacatttaaa

SEQ ID NO: 2676 - DNA, 25 bp, Homo sapiens
tatttccacatttaaactacctgtt

SEQ ID NO: 2677 - DNA, 25 bp, Homo sapiens
atcagcttgttgagcaatgactttg

SEQ ID NO: 2678 - DNA, 25 bp, Homo sapiens
cttcatttcctgccacttgattggt

SEQ ID NO: 2679 - DNA, 25 bp, Homo sapiens
gccacttgattggtcagtacccaga

SEQ ID NO: 2680 - DNA, 25 bp, Homo sapiens
cagtacccagagacctacagggcct

SEQ ID NO: 2681 - DNA, 25 bp, Homo sapiens
ccagacctcagcgtgtgggctgaga

SEQ ID NO: 2682 - DNA, 25 bp, Homo sapiens
ggctgagatgctggacaaatcgccc

SEQ ID NO: 2683 - DNA, 25 bp, Homo sapiens
gctggacaaatcgcccatcagatac

SEQ ID NO: 2684 - DNA, 25 bp, Homo sapiens
aggtgaagacaccactgttactgat

SEQ ID NO: 2685 - DNA, 25 bp, Homo sapiens
gacaccactgttactgatgttgggc

SEQ ID NO: 2686 - DNA, 25 bp, Homo sapiens
aaaagcacccacgcattatcagagg

SEQ ID NO: 2687 - DNA, 25 bp, Homo sapiens
cctgccattctgcatgagctgatca

SEQ ID NO: 2688 - DNA, 25 bp, Homo sapiens
tgcatgagctgatcagcctgtgcca

SEQ ID NO: 2689 - DNA, 25 bp, Homo sapiens
gccacgattggagaatactttgctt

SEQ ID NO: 2690 - DNA, 25 bp, Homo sapiens
ggagcacatgttactgcttcatttt

SEQ ID NO: 2691 - DNA, 25 bp, Homo sapiens
cttcattttggagcttgtggagttg

SEQ ID NO: 2692 - DNA, 25 bp, Homo sapiens
gtggagttgatgactttctgttttc

SEQ ID NO: 2693 - DNA, 25 bp, Homo sapiens
gcatattttctctaggcttttttcc

SEQ ID NO: 2694 - DNA, 25 bp, Homo sapiens
ttggggttctacagtcgtaaaagag

SEQ ID NO: 2695 - DNA, 25 bp, Homo sapiens
gcttttattcgtcctttgacaaaag

SEQ ID NO: 2696 - DNA, 25 bp, Homo sapiens
aaatgggagggcattccatcccttc

SEQ ID NO: 2697 - DNA, 25 bp, Homo sapiens
gcattccatcccttcctgaaggggg

SEQ ID NO: 2698 - DNA, 25 bp, Homo sapiens
cctgaagggggacactccatgagtg

SEQ ID NO: 2699 - DNA, 25 bp, Homo sapiens
ggcagctatctgcactctaaactgc

SEQ ID NO: 2700 - DNA, 25 bp, Homo sapiens
aagggttcctgctttcacagaatta

SEQ ID NO: 2701 - DNA, 25 bp, Homo sapiens
tcagggtggtgacttcacacgccat

SEQ ID NO: 2702 - DNA, 25 bp, Homo sapiens
ggcactggtggcaagtccatctatg

SEQ ID NO: 2703 - DNA, 25 bp, Homo sapiens
taaagcatacgggtcctggcatctt

SEQ ID NO: 2704 - DNA, 25 bp, Homo sapiens
cctggcatcttgtccatggcaaatg

SEQ ID NO: 2705 - DNA, 25 bp, Homo sapiens
ggacccaacacaaatggttcccagt

SEQ ID NO: 2706 - DNA, 25 bp, Homo sapiens
gtttttcatctgcactgccaagact

SEQ ID NO: 2707 - DNA, 25 bp, Homo sapiens
ggagcgctttgggtccaggaatggc

SEQ ID NO: 2708 - DNA, 25 bp, Homo sapiens
tcttaaccaccagatcattccttct

SEQ ID NO: 2709 - DNA, 25 bp, Homo sapiens
atcctagaatctttgtgctctcgct

SEQ ID NO: 2710 - DNA, 25 bp, Homo sapiens
ctcccatgcctagctggattgcaga

SEQ ID NO: 2711 - DNA, 25 bp, Homo sapiens
ttaggtcaagttcatagtttctgta

SEQ ID NO: 2712 - DNA, 25 bp, Homo sapiens
agtttctgtaattggcttttgaatc

SEQ ID NO: 2713 - DNA, 25 bp, Homo sapiens
gatattgtcacctagcagatatgta

SEQ ID NO: 2714 - DNA, 25 bp, Homo sapiens
attgcataggacagacttaggagtt

SEQ ID NO: 2715 - DNA, 25 bp, Homo sapiens
agcagttaacatctgaagtgtctaa

SEQ ID NO: 2716 - DNA, 25 bp, Homo sapiens
gaagtgtctaatgcattaacttttg

SEQ ID NO: 2717 - DNA, 25 bp, Homo sapiens
cttttgcgtggtccttaggcttaca

SEQ ID NO: 2718 - DNA, 25 bp, Homo sapiens
ggtccttaggcttacaatgtgcact

SEQ ID NO: 2719 - DNA, 25 bp, Homo sapiens
aatgtgcactgaatcgtttcatgta

SEQ ID NO: 2720 - DNA, 25 bp, Homo sapiens
aggtctttgaaatatgcatgtactt

SEQ ID NO: 2721 - DNA, 25 bp, Homo sapiens
aactttgcatgttcttgttttgtta

SEQ ID NO: 2722 - DNA, 25 bp, Homo sapiens
gaaagtctctgtactcgttcatcaa

SEQ ID NO: 2723 - DNA, 25 bp, Homo sapiens
caagggtgacacatctggagactac

SEQ ID NO: 2724 - DNA, 25 bp, Homo sapiens
aaagtactgcttgttctctgtggag

SEQ ID NO: 2725 - DNA, 25 bp, Homo sapiens
ggacaggaggattctcaacactttg

SEQ ID NO: 2726 - DNA, 25 bp, Homo sapiens
tctacactgctattatcattatctc

SEQ ID NO: 2727 - DNA, 25 bp, Homo sapiens
ggtgaaatttctaactgttctctgt

SEQ ID NO: 2728 - DNA, 25 bp, Homo sapiens
tgttctctgttcccggaaccgaaat

SEQ ID NO: 2729 - DNA, 25 bp, Homo sapiens
ggaaccgaaatcacctgttgcatgt

SEQ ID NO: 2730 - DNA, 25 bp, Homo sapiens
tgaagatgctctgctggctatagta

SEQ ID NO: 2731 - DNA, 25 bp, Homo sapiens
ggcaccgatgataacaccctcatca

SEQ ID NO: 2732 - DNA, 25 bp, Homo sapiens
atatccgggcacacttcaagagact

SEQ ID NO: 2733 - DNA, 25 bp, Homo sapiens
aatagtcgaccagccacaggttacc

SEQ ID NO: 2734 - DNA, 25 bp, Homo sapiens
gaaagccagtatcgcggggactatg

SEQ ID NO: 2735 - DNA, 25 bp, Homo sapiens
atgatgccttctttgaagccagaga

SEQ ID NO: 2736 - DNA, 25 bp, Homo sapiens
tgccttcttaggcttgacagcccca

SEQ ID NO: 2737 - DNA, 25 bp, Homo sapiens
cagccccacctggttcaaaggaagc

SEQ ID NO: 2738 - DNA, 25 bp, Homo sapiens
gcaagcatgaaccttaagcactgtg

SEQ ID NO: 2739 - DNA, 25 bp, Homo sapiens
agcactgtgctttaagcatcctgaa

SEQ ID NO: 2740 - DNA, 25 bp, Homo sapiens
aatagtgttgttacctgccaagcca

SEQ ID NO: 2741 - DNA, 25 bp, Homo sapiens
caagccatcctgtatacaccaatga

SEQ ID NO: 2742 - DNA, 25 bp, Homo sapiens
ccctccttctgccattactatggca

SEQ ID NO: 2743 - DNA, 25 bp, Homo sapiens
caacttaagtgtatctgcagctcta

SEQ ID NO: 2744 - DNA, 25 bp, Homo sapiens
taaaacaggttggcgatcatttccc

SEQ ID NO: 2745 - DNA, 25 bp, Homo sapiens
tggcgatcatttcccaagattggtt

SEQ ID NO: 2746 - DNA, 25 bp, Homo sapiens
ttgcccgtttaaaacaactcacaat

SEQ ID NO: 2747 - DNA, 25 bp, Homo sapiens
acaactcacaatcgtaaatgctact

SEQ ID NO: 2748 - DNA, 25 bp, Homo sapiens
aatgctactattcctaagatatctt

SEQ ID NO: 2749 - DNA, 25 bp, Homo sapiens
tatttcagtttagccatgtattgta

SEQ ID NO: 2750 - DNA, 25 bp, Homo sapiens
agaatcttttctatgcctctattcc

SEQ ID NO: 2751 - DNA, 25 bp, Homo sapiens
taagtttcacactaccttattacca

SEQ ID NO: 2752 - DNA, 25 bp, Homo sapiens
gtatatctattgtatgctggtcttt

SEQ ID NO: 2753 - DNA, 25 bp, Homo sapiens
atgctggtctttactttttgccaaa

SEQ ID NO: 2754 - DNA, 25 bp, Homo sapiens
tcaaacttgatgctatgctttaaaa

SEQ ID NO: 2755 - DNA, 25 bp, Homo sapiens
gagggaccatgtgtcacttgtgctt

SEQ ID NO: 2756 - DNA, 25 bp, Homo sapiens
tcttccactttgcatatgagccgtg

SEQ ID NO: 2757 - DNA, 25 bp, Homo sapiens
gtgttgggcatgtgatcacgcctgg

SEQ ID NO: 2758 - DNA, 25 bp, Homo sapiens
tcattcatcccattaatcatttccc

SEQ ID NO: 2759 - DNA, 25 bp, Homo sapiens
catttccccataactcaatggccta

SEQ ID NO: 2760 - DNA, 25 bp, Homo sapiens
ggcctgacttgggggaacgatgtgt

SEQ ID NO: 2761 - DNA, 25 bp, Homo sapiens
ctggggtgggaggtcttgctagaat

SEQ ID NO: 2762 - DNA, 25 bp, Homo sapiens
gaaagggccttgacatcagttcctt

SEQ ID NO: 2763 - DNA, 25 bp, Homo sapiens
ttgtgtgtactcactgaagcctgcg

SEQ ID NO: 2764 - DNA, 25 bp, Homo sapiens
gcctgcgttggtccagagcggaggc

SEQ ID NO: 2765 - DNA, 25 bp, Homo sapiens
ggagttttcctctatacatctctcc

SEQ ID NO: 2766 - DNA, 25 bp, Homo sapiens
taatttcggggatttctgtggtagg

SEQ ID NO: 2767 - DNA, 25 bp, Homo sapiens
ccatggactcctggaaggcacagag

SEQ ID NO: 2768 - DNA, 25 bp, Homo sapiens
agcacttaagcacctccatattatg

SEQ ID NO: 2769 - DNA, 25 bp, Homo sapiens
aagcacctccatattatgacttggt

SEQ ID NO: 2770 - DNA, 25 bp, Homo sapiens
tatgacttggtgggtcaccccttag

SEQ ID NO: 2771 - DNA, 25 bp, Homo sapiens
ccctctcccaccaagactatgagaa

SEQ ID NO: 2772 - DNA, 25 bp, Homo sapiens
gactatgagaacttcagctgatagc

SEQ ID NO: 2773 - DNA, 25 bp, Homo sapiens
gggctccccagatgaggatgcaggg

SEQ ID NO: 2774 - DNA, 25 bp, Homo sapiens
cttctcccctgtgacgggaaggcag

SEQ ID NO: 2775 - DNA, 25 bp, Homo sapiens
cgggaaggcaggtgtgactccaggc

SEQ ID NO: 2776 - DNA, 25 bp, Homo sapiens
cctttcttctgttcaaagttttctg

SEQ ID NO: 2777 - DNA, 25 bp, Homo sapiens
ttggatgctaccactgtactgtcgc

SEQ ID NO: 2778 - DNA, 25 bp, Homo sapiens
tcgcgtgccattgctgagctgggca

SEQ ID NO: 2779 - DNA, 25 bp, Homo sapiens
agctgtggatcctctagactccacc

SEQ ID NO: 2780 - DNA, 25 bp, Homo sapiens
gtgagcattacgatgttgcccgtgg

SEQ ID NO: 2781 - DNA, 25 bp, Homo sapiens
tcctgcaggactacaaatccctcca

SEQ ID NO: 2782 - DNA, 25 bp, Homo sapiens
gaagacaagttgaccgtgtcccgtg

SEQ ID NO: 2783 - DNA, 25 bp, Homo sapiens
ttgtctcagccattccaggttgctg

SEQ ID NO: 2784 - DNA, 25 bp, Homo sapiens
gaggtcttcacaggtcatatgggga

SEQ ID NO: 2785 - DNA, 25 bp, Homo sapiens
gaagctggtacccctgaaggagacc

SEQ ID NO: 2786 - DNA, 25 bp, Homo sapiens
acaggccttctatatggtgggaccc

SEQ ID NO: 2787 - DNA, 25 bp, Homo sapiens
tcgtgaggggtctttgtcctctgta

SEQ ID NO: 2788 - DNA, 25 bp, Homo sapiens
ctctggttttgaccttcaggaaaca

SEQ ID NO: 2789 - DNA, 25 bp, Homo sapiens
agaacattcagaatcaggtcagctt

SEQ ID NO: 2790 - DNA, 25 bp, Homo sapiens
ggtcagcttgtgggtgtggacctga

SEQ ID NO: 2791 - DNA, 25 bp, Homo sapiens
gtggacctgaacacaggtgagccaa

SEQ ID NO: 2792 - DNA, 25 bp, Homo sapiens
gtggcagcagaagtaggcgtatggg

SEQ ID NO: 2793 - DNA, 25 bp, Homo sapiens
ttcttcactcctgcactgtgattgc

SEQ ID NO: 2794 - DNA, 25 bp, Homo sapiens
tctgtatctgaatcttgaagactgc

SEQ ID NO: 2795 - DNA, 25 bp, Homo sapiens
gcaaagtgatcctgaggattacagc

SEQ ID NO: 2796 - DNA, 25 bp, Homo sapiens
acactggcatctgttgaaatttgga

SEQ ID NO: 2797 - DNA, 25 bp, Homo sapiens
agtgtatacacataaagcaggtctt

SEQ ID NO: 2798 - DNA, 25 bp, Homo sapiens
agcatatgttacttaccttgttatt

SEQ ID NO: 2799 - DNA, 25 bp, Homo sapiens
gagactcaacatcaggatccacagc

SEQ ID NO: 2800 - DNA, 25 bp, Homo sapiens
acagactttatcgctctgtggctca

SEQ ID NO: 2801 - DNA, 25 bp, Homo sapiens
aagcagcaacagctgaggcgcacca

SEQ ID NO: 2802 - DNA, 25 bp, Homo sapiens
gcttccatttctttaacgtctgttc

SEQ ID NO: 2803 - DNA, 25 bp, Homo sapiens
tctgttcccttaacatcgctgaaat

SEQ ID NO: 2804 - DNA, 25 bp, Homo sapiens
gaagagatgccttgcggtgtggcca

SEQ ID NO: 2805 - DNA, 25 bp, Homo sapiens
gactcagaaaccttggtactcgccc

SEQ ID NO: 2806 - DNA, 25 bp, Homo sapiens
actggctcctgcattaacccagaaa

SEQ ID NO: 2807 - DNA, 25 bp, Homo sapiens
taacccagaaatacctcgcttctat

SEQ ID NO: 2808 - DNA, 25 bp, Homo sapiens
ctcgcttctatctgtgcacttagct

SEQ ID NO: 2809 - DNA, 25 bp, Homo sapiens
gggaacttacccactgtaatcacct

SEQ ID NO: 2810 - DNA, 25 bp, Homo sapiens
agctctctgagttagacgaccgtgc

SEQ ID NO: 2811 - DNA, 25 bp, Homo sapiens
tgcagacgcactgcaggcaggcgct

SEQ ID NO: 2812 - DNA, 25 bp, Homo sapiens
gaaacgagcgcagccaagttgaaga

SEQ ID NO: 2813 - DNA, 25 bp, Homo sapiens
ggcaatcgggattactgttctggtt

SEQ ID NO: 2814 - DNA, 25 bp, Homo sapiens
atcatcatcgtgtgggttgtctctt

SEQ ID NO: 2815 - DNA, 25 bp, Homo sapiens
aaactgctgttcaagaaacctcttc

SEQ ID NO: 2816 - DNA, 25 bp, Homo sapiens
aagacttttgacttagaacctgcta

SEQ ID NO: 2817 - DNA, 25 bp, Homo sapiens
tcaagcttacctactgttatctcta

SEQ ID NO: 2818 - DNA, 25 bp, Homo sapiens
gcactccaaattagaaggccggccc

SEQ ID NO: 2819 - DNA, 25 bp, Homo sapiens
gcacagtgcctttacagatttacgt

SEQ ID NO: 2820 - DNA, 25 bp, Homo sapiens
gaggccttcttaagttccagagtgc

SEQ ID NO: 2821 - DNA, 25 bp, Homo sapiens
ccatatcctctccttccatgaggaa

SEQ ID NO: 2822 - DNA, 25 bp, Homo sapiens
gtctcactaggcatgctgttgtaca

SEQ ID NO: 2823 - DNA, 25 bp, Homo sapiens
aaaacgggagtttggcctctcatct

SEQ ID NO: 2824 - DNA, 25 bp, Homo sapiens
ttggcctctcatctcagtggatata

SEQ ID NO: 2825 - DNA, 25 bp, Homo sapiens
gggcaaggcttatctttgtgtcaaa

SEQ ID NO: 2826 - DNA, 25 bp, Homo sapiens
aacggagagtcacccaactgtgtgg

SEQ ID NO: 2827 - DNA, 25 bp, Homo sapiens
tcgacagttgcagtacttacccttg

SEQ ID NO: 2828 - DNA, 25 bp, Homo sapiens
acccttggctaagaactgcactgct

SEQ ID NO: 2829 - DNA, 25 bp, Homo sapiens
gaccaaggagtcgagctttctctca

SEQ ID NO: 2830 - DNA, 25 bp, Homo sapiens
gatgtatgtcgctgtccaagagaag

SEQ ID NO: 2831 - DNA, 25 bp, Homo sapiens
gtttaatctccaaagccatatcctc

SEQ ID NO: 2832 - DNA, 25 bp, Homo sapiens
gactgaaactacacattggcaaata

SEQ ID NO: 2833 - DNA, 25 bp, Homo sapiens
atgggtgtgaccaatcctgtttttc

SEQ ID NO: 2834 - DNA, 25 bp, Homo sapiens
ctgtttttcctatgctctgggtgaa

SEQ ID NO: 2835 - DNA, 25 bp, Homo sapiens
agagcctgatggtatactactgctt

SEQ ID NO: 2836 - DNA, 25 bp, Homo sapiens
actactgctttgcggaattgcatac

SEQ ID NO: 2837 - DNA, 25 bp, Homo sapiens
tcagtttaagagttttccttgggag

SEQ ID NO: 2838 - DNA, 25 bp, Homo sapiens
gaaacacaatgccaacagctggcca

SEQ ID NO: 2839 - DNA, 25 bp, Homo sapiens
gctggccagtaattagtgttgtgca

SEQ ID NO: 2840 - DNA, 25 bp, Homo sapiens
tagtgttgtgcacttcatgtcatta

SEQ ID NO: 2841 - DNA, 25 bp, Homo sapiens
gttacaaaatcttcagcttcagcca

SEQ ID NO: 2842 - DNA, 25 bp, Homo sapiens
ttcagccaggcaacgctaagctctg

SEQ ID NO: 2843 - DNA, 25 bp, Homo sapiens
ggtctgttcttgaatcctctattaa

SEQ ID NO: 2844 - DNA, 25 bp, Homo sapiens
gagggagctgtggtaagggttgggc

SEQ ID NO: 2845 - DNA, 25 bp, Homo sapiens
gactcccactctttgaatcgatata

SEQ ID NO: 2846 - DNA, 25 bp, Homo sapiens
atcgatataggcatttggtctcact

SEQ ID NO: 2847 - DNA, 25 bp, Homo sapiens
ggtctcactacttgaccattctcac

SEQ ID NO: 2848 - DNA, 25 bp, Homo sapiens
gaccattctcaccctgtgaaacgtc

SEQ ID NO: 2849 - DNA, 25 bp, Homo sapiens
aaacgtcccacactttgaagcaaat

SEQ ID NO: 2850 - DNA, 25 bp, Homo sapiens
aaggttcttcttattttgtgggctg

SEQ ID NO: 2851 - DNA, 25 bp, Homo sapiens
taacaaagggcagccctccacttct

SEQ ID NO: 2852 - DNA, 25 bp, Homo sapiens
agccctccacttctggtataattgt

SEQ ID NO: 2853 - DNA, 25 bp, Homo sapiens
tagagctgcataatgtccctctctt

SEQ ID NO: 2854 - DNA, 25 bp, Homo sapiens
gatatgttccattggcaagctacaa

SEQ ID NO: 2855 - DNA, 25 bp, Homo sapiens
ggggccaaatgacagtccctatcag

SEQ ID NO: 2856 - DNA, 25 bp, Homo sapiens
atcagggtggagtatttttcttgac

SEQ ID NO: 2857 - DNA, 25 bp, Homo sapiens
ttttcttgacaattcatttcccaac

SEQ ID NO: 2858 - DNA, 25 bp, Homo sapiens
ctacgatcacagtggtctccagcac

SEQ ID NO: 2859 - DNA, 25 bp, Homo sapiens
ggtctccagcactaactatttcaaa

SEQ ID NO: 2860 - DNA, 25 bp, Homo sapiens
aaaagtactcttgtccatctgttct

SEQ ID NO: 2861 - DNA, 25 bp, Homo sapiens
ttctctgttgtgtgatcccaatcca

SEQ ID NO: 2862 - DNA, 25 bp, Homo sapiens
caatccagatgatcctttagtgcct

SEQ ID NO: 2863 - DNA, 25 bp, Homo sapiens
gtgcctgagattgctcggatctaca

SEQ ID NO: 2864 - DNA, 25 bp, Homo sapiens
attgaatgatctggcacgggaccct

SEQ ID NO: 2865 - DNA, 25 bp, Homo sapiens
ggagccgatgcctagtgaactcaag

SEQ ID NO: 2866 - DNA, 25 bp, Homo sapiens
gcaaaccgtgccctggtattgtcag

SEQ ID NO: 2867 - DNA, 25 bp, Homo sapiens
gacacacccaggcttgatttggatc

SEQ ID NO: 2868 - DNA, 25 bp, Homo sapiens
caatctgatttcatcgtcgtggcct

SEQ ID NO: 2869 - DNA, 25 bp, Homo sapiens
taacacctgcaaccgagggactctg

SEQ ID NO: 2870 - DNA, 25 bp, Homo sapiens
gactctgcaacaaggacttcttcca

SEQ ID NO: 2871 - DNA, 25 bp, Homo sapiens
caacatcagcaggggcgacgtcgta

SEQ ID NO: 2872 - DNA, 25 bp, Homo sapiens
cctgtaccaggccttggccagtggt

SEQ ID NO: 2873 - DNA, 25 bp, Homo sapiens
gattctgccccacattggcagtgcc

SEQ ID NO: 2874 - DNA, 25 bp, Homo sapiens
caccatgtccttgttggcagctaac

SEQ ID NO: 2875 - DNA, 25 bp, Homo sapiens
acaacttgctggctggcctgagagg

SEQ ID NO: 2876 - DNA, 25 bp, Homo sapiens
agagaactatgttcttccctgactt

SEQ ID NO: 2877 - DNA, 25 bp, Homo sapiens
ggaaggtgaatgtgttcccgtcctc

SEQ ID NO: 2878 - DNA, 25 bp, Homo sapiens
ccgtcctcccgcagtcagaaaggag

SEQ ID NO: 2879 - DNA, 25 bp, Homo sapiens
tcatgggaccaggcgagagggcacc

SEQ ID NO: 2880 - DNA, 25 bp, Homo sapiens
gataaatgggtccagggctgatcaa

SEQ ID NO: 2881 - DNA, 25 bp, Homo sapiens
ctgccgctctcagtggacagggcat

SEQ ID NO: 2882 - DNA, 25 bp, Homo sapiens
catctgttatcctgaaccttggcag

SEQ ID NO: 2883 - DNA, 25 bp, Homo sapiens
accttggcagacacgtcttgttttc

SEQ ID NO: 2884 - DNA, 25 bp, Homo sapiens
tggcctcagccttaaacttttgttc

SEQ ID NO: 2885 - DNA, 25 bp, Homo sapiens
gcagcacggggagggtttggctacc

SEQ ID NO: 2886 - DNA, 25 bp, Homo sapiens
agccaggtaccaccattgtaaggaa

SEQ ID NO: 2887 - DNA, 25 bp, Homo sapiens
gaggagcttatatttggaaccgacc

SEQ ID NO: 2888 - DNA, 25 bp, Homo sapiens
tattacaacaggtgcttccagtgat

SEQ ID NO: 2889 - DNA, 25 bp, Homo sapiens
agcttggagttatgacctacagtga

SEQ ID NO: 2890 - DNA, 25 bp, Homo sapiens
aagtccagaaacccaatctgccatc

SEQ ID NO: 2891 - DNA, 25 bp, Homo sapiens
atctcgcagaagctttattgaccta

SEQ ID NO: 2892 - DNA, 25 bp, Homo sapiens
aactctcttgatatggatgcttgct

SEQ ID NO: 2893 - DNA, 25 bp, Homo sapiens
gcagtagtctacttttacaacgctt

SEQ ID NO: 2894 - DNA, 25 bp, Homo sapiens
tttcccctcattcttgatgtggtgt

SEQ ID NO: 2895 - DNA, 25 bp, Homo sapiens
tcatttgtcacatttatccagtttg

SEQ ID NO: 2896 - DNA, 25 bp, Homo sapiens
atccagtttgggttattctcattat

SEQ ID NO: 2897 - DNA, 25 bp, Homo sapiens
ttctcattatgacacctattgcaaa

SEQ ID NO: 2898 - DNA, 25 bp, Homo sapiens
gtttgtcttttgtcttaacagttct

SEQ ID NO: 2899 - DNA, 25 bp, Homo sapiens
gtcttttgtcttaacagttctgaat

SEQ ID NO: 2900 - DNA, 25 bp, Homo sapiens
taacagttctgaatgctgtcctcaa

SEQ ID NO: 2901 - DNA, 25 bp, Homo sapiens
agttctgaatgctgtcctcaaagta

SEQ ID NO: 2902 - DNA, 25 bp, Homo sapiens
gaatgctgtcctcaaagtatataat

SEQ ID NO: 2903 - DNA, 25 bp, Homo sapiens
tgctgtcctcaaagtatataatgtt

SEQ ID NO: 2904 - DNA, 25 bp, Homo sapiens
taatgtttcatgtaccaagaccctt

SEQ ID NO: 2905 - DNA, 25 bp, Homo sapiens
gtttcatgtaccaagacccttttca

SEQ ID NO: 2906 - DNA, 25 bp, Homo sapiens
catgtaccaagacccttttcacagt

SEQ ID NO: 2907 - DNA, 25 bp, Homo sapiens
accaagacccttttcacagtacaat

SEQ ID NO: 2908 - DNA, 25 bp, Homo sapiens
gacccttttcacagtacaataaaca

SEQ ID NO: 2909 - DNA, 25 bp, Homo sapiens
aaatgactacttacagcacatatta

SEQ ID NO: 2910 - DNA, 25 bp, Homo sapiens
gccctttctggttactgtggcttta

SEQ ID NO: 2911 - DNA, 25 bp, Homo sapiens
tatggcagccaacctttatgctcgt

SEQ ID NO: 2912 - DNA, 25 bp, Homo sapiens
acctttatgctcgttccatatttgg

SEQ ID NO: 2913 - DNA, 25 bp, Homo sapiens
gatgcacttgcaaatgtcagcattg

SEQ ID NO: 2914 - DNA, 25 bp, Homo sapiens
gaagccaattcaccagggaccagat

SEQ ID NO: 2915 - DNA, 25 bp, Homo sapiens
ctgctgttaccggccatataagaat

SEQ ID NO: 2916 - DNA, 25 bp, Homo sapiens
agtccttgaagctttacagttaatt

SEQ ID NO: 2917 - DNA, 25 bp, Homo sapiens
ggtatgggcttactggactccaaca

SEQ ID NO: 2918 - DNA, 25 bp, Homo sapiens
actccaacatcttttgtactctttc

SEQ ID NO: 2919 - DNA, 25 bp, Homo sapiens
gaatacttttcagccaataatttat

SEQ ID NO: 2920 - DNA, 25 bp, Homo sapiens
gagcagtcactctcagaatcttgat

SEQ ID NO: 2921 - DNA, 25 bp, Homo sapiens
tcagaatcttgattccccatcagcc

SEQ ID NO: 2922 - DNA, 25 bp, Homo sapiens
aagtgggaccttgctgggcattata

SEQ ID NO: 2923 - DNA, 25 bp, Homo sapiens
atgccctgtgggggtttcagagacc

SEQ ID NO: 2924 - DNA, 25 bp, Homo sapiens
tctgcacaactgcatgcacttctct

SEQ ID NO: 2925 - DNA, 25 bp, Homo sapiens
tcgctccacaacctgaaaccgagaa

SEQ ID NO: 2926 - DNA, 25 bp, Homo sapiens
agaaggagttgctgaccagtgccca

SEQ ID NO: 2927 - DNA, 25 bp, Homo sapiens
agcccgggaggaacacaggcagctc

SEQ ID NO: 2928 - DNA, 25 bp, Homo sapiens
ctccaccagggtaccctgtcttggt

SEQ ID NO: 2929 - DNA, 25 bp, Homo sapiens
tagtggaggtggatgtccttctctg

SEQ ID NO: 2930 - DNA, 25 bp, Homo sapiens
aatgcccaattcttactgttcaggt

SEQ ID NO: 2931 - DNA, 25 bp, Homo sapiens
acatcgtccacttccagtatgaggt

SEQ ID NO: 2932 - DNA, 25 bp, Homo sapiens
gaaggtctcttcttgggatgcagtc

SEQ ID NO: 2933 - DNA, 25 bp, Homo sapiens
gtgaactatgtcttcatctgcttca

SEQ ID NO: 2934 - DNA, 25 bp, Homo sapiens
agggccgagaagacagagctccact

SEQ ID NO: 2935 - DNA, 25 bp, Homo sapiens
gggctttgagattgtacgtccaggc

SEQ ID NO: 2936 - DNA, 25 bp, Homo sapiens
ccctctcggccagatgtgatgttca

SEQ ID NO: 2937 - DNA, 25 bp, Homo sapiens
tgttcatggtttatcccctggacca

SEQ ID NO: 2938 - DNA, 25 bp, Homo sapiens
atcccctggaccagaacttgtccga

SEQ ID NO: 2939 - DNA, 25 bp, Homo sapiens
gatgctttacccaagagccacagtg

SEQ ID NO: 2940 - DNA, 25 bp, Homo sapiens
ggctcctcgctgtctagggaaggac

SEQ ID NO: 2941 - DNA, 25 bp, Homo sapiens
tgagggttgcctattgtgttctcgg

SEQ ID NO: 2942 - DNA, 25 bp, Homo sapiens
agtgtttgcttattccaccagttct

SEQ ID NO: 2943 - DNA, 25 bp, Homo sapiens
accagttctactgtgacatactcga

SEQ ID NO: 2944 - DNA, 25 bp, Homo sapiens
gtctcacagtgcctttggaagggcc

SEQ ID NO: 2945 - DNA, 25 bp, Homo sapiens
tgcctttggaagggcccgaacttgc

SEQ ID NO: 2946 - DNA, 25 bp, Homo sapiens
ttgccttaaatcttcctcaaccaaa

SEQ ID NO: 2947 - DNA, 25 bp, Homo sapiens
gtaggatgggttcaactgcacaaaa

SEQ ID NO: 2948 - DNA, 25 bp, Homo sapiens
gtgaagcaaccgccttagtgctgaa

SEQ ID NO: 2949 - DNA, 25 bp, Homo sapiens
agaaaggcaggaatgtctcctaagc

SEQ ID NO: 2950 - DNA, 25 bp, Homo sapiens
gagcggtagctttagtttgtacgta

SEQ ID NO: 2951 - DNA, 25 bp, Homo sapiens
agcactatatgtactctctggacta

SEQ ID NO: 2952 - DNA, 25 bp, Homo sapiens
ggggaatcagctcactacaaattgt

SEQ ID NO: 2953 - DNA, 25 bp, Homo sapiens
gaagctgctatagtgcggataatga

SEQ ID NO: 2954 - DNA, 25 bp, Homo sapiens
gcagcacaatgttctagtagcggag

SEQ ID NO: 2955 - DNA, 25 bp, Homo sapiens
gtagcggaggtaactcagcagttga

SEQ ID NO: 2956 - DNA, 25 bp, Homo sapiens
gcagttgaaggcgcgattcttacca

SEQ ID NO: 2957 - DNA, 25 bp, Homo sapiens
gcgattcttaccaagtccagttgtt

SEQ ID NO: 2958 - DNA, 25 bp, Homo sapiens
ttggcacgaacacctgaggatcgca

SEQ ID NO: 2959 - DNA, 25 bp, Homo sapiens
tattcttggactgtactcttcgcat

SEQ ID NO: 2960 - DNA, 25 bp, Homo sapiens
ctgtactcttcgcatggactgggaa

SEQ ID NO: 2961 - DNA, 25 bp, Homo sapiens
tattaagacgaccatctcttctatt

SEQ ID NO: 2962 - DNA, 25 bp, Homo sapiens
gtacatgttctagaccattgagatc

SEQ ID NO: 2963 - DNA, 25 bp, Homo sapiens
gaatgtgctgcgttttgttttcttt

SEQ ID NO: 2964 - DNA, 25 bp, Homo sapiens
ttgggatctgtcttggcattaaacc

SEQ ID NO: 2965 - DNA, 25 bp, Homo sapiens
ggcattaaaccacatcatggaccaa

SEQ ID NO: 2966 - DNA, 25 bp, Homo sapiens
ggaccaaatgtgccatactaatgat

SEQ ID NO: 2967 - DNA, 25 bp, Homo sapiens
ggtcagtctaacagtttgcctgctg

SEQ ID NO: 2968 - DNA, 25 bp, Homo sapiens
tttcctttggactgttcaagcaaaa

SEQ ID NO: 2969 - DNA, 25 bp, Homo sapiens
tcatctccttttgcgcttatttgga

SEQ ID NO: 2970 - DNA, 25 bp, Homo sapiens
gctaacttccactaatccattatcc

SEQ ID NO: 2971 - DNA, 25 bp, Homo sapiens
ggttcttcttgggagtatgttgtca

SEQ ID NO: 2972 - DNA, 25 bp, Homo sapiens
atgttgatctgcatatttctgtata

SEQ ID NO: 2973 - DNA, 25 bp, Homo sapiens
ggaaacctgcctttgtatgtggaag

SEQ ID NO: 2974 - DNA, 25 bp, Homo sapiens
atgtggaagtatacctggcttttta

SEQ ID NO: 2975 - DNA, 25 bp, Homo sapiens
cagatacggcgacagtgagttcaca

SEQ ID NO: 2976 - DNA, 25 bp, Homo sapiens
aacgacatttacaacttcttctctc

SEQ ID NO: 2977 - DNA, 25 bp, Homo sapiens
aaccctgtgagagtccatattgaga

SEQ ID NO: 2978 - DNA, 25 bp, Homo sapiens
gacagggccaatatgcagcacagat

SEQ ID NO: 2979 - DNA, 25 bp, Homo sapiens
aacaggggccagcaatggggcgtat

SEQ ID NO: 2980 - DNA, 25 bp, Homo sapiens
ggggcgtatagcagccaggtgatgc

SEQ ID NO: 2981 - DNA, 25 bp, Homo sapiens
tgcaaggcatgggggtgtctgctgc

SEQ ID NO: 2982 - DNA, 25 bp, Homo sapiens
acagtggcctggagagccagtcagt

SEQ ID NO: 2983 - DNA, 25 bp, Homo sapiens
cagtgagtggctgttacggggccgg

SEQ ID NO: 2984 - DNA, 25 bp, Homo sapiens
tcaatcattttcacaggcagccaac

SEQ ID NO: 2985 - DNA, 25 bp, Homo sapiens
gaagctgggggacccattttgcacc

SEQ ID NO: 2986 - DNA, 25 bp, Homo sapiens
ttacaccagcctgccatactataca

SEQ ID NO: 2987 - DNA, 25 bp, Homo sapiens
accagcctgccatactatacagggg

SEQ ID NO: 2988 - DNA, 25 bp, Homo sapiens
gcctgccatactatacaggggtccc

SEQ ID NO: 2989 - DNA, 25 bp, Homo sapiens
gccatactatacaggggtcccgggc

SEQ ID NO: 2990 - DNA, 25 bp, Homo sapiens
ctacctcttccaagcagcatggtgt

SEQ ID NO: 2991 - DNA, 25 bp, Homo sapiens
gcagcatggtgtgaatgtcagtgtg

SEQ ID NO: 2992 - DNA, 25 bp, Homo sapiens
tgtcagtgtgaatgcatcggccacc

SEQ ID NO: 2993 - DNA, 25 bp, Homo sapiens
cccctttccaacagccgagtggata

SEQ ID NO: 2994 - DNA, 25 bp, Homo sapiens
aacagccgagtggatatgggtctca

SEQ ID NO: 2995 - DNA, 25 bp, Homo sapiens
gccgagtggatatgggtctcatgga

SEQ ID NO: 2996 - DNA, 25 bp, Homo sapiens
atgggtctcatggatacaacactgg

SEQ ID NO: 2997 - DNA, 25 bp, Homo sapiens
ctcctgcttgctgtacttgggatga

SEQ ID NO: 2998 - DNA, 25 bp, Homo sapiens
tgaaacgaccccacaggtcaggtgg

SEQ ID NO: 2999 - DNA, 25 bp, Homo sapiens
ggcgtgggcatcagccaggattgcc

SEQ ID NO: 3000 - DNA, 25 bp, Homo sapiens
aggattgccgttacagtctttttct

SEQ ID NO: 3001 - DNA, 25 bp, Homo sapiens
ttacagtctttttctcaggagctac

SEQ ID NO: 3002 - DNA, 25 bp, Homo sapiens
ggagctacaaagatctcttcctgtt

SEQ ID NO: 3003 - DNA, 25 bp, Homo sapiens
ggccctgcatgtcagatggcgtggt

SEQ ID NO: 3004 - DNA, 25 bp, Homo sapiens
ctctgtgccttagtggctcttggca

SEQ ID NO: 3005 - DNA, 25 bp, Homo sapiens
cccggacagttcagacacccttggg

SEQ ID NO: 3006 - DNA, 25 bp, Homo sapiens
cacacgacagagatgcaggggccag

SEQ ID NO: 3007 - DNA, 25 bp, Homo sapiens
gttgaccgatgtatcttttccttaa

SEQ ID NO: 3008 - DNA, 25 bp, Homo sapiens
tggtttgaagggcagtcttctctgg

SEQ ID NO: 3009 - DNA, 25 bp, Homo sapiens
agatgataattgtgaaaacctcctt

SEQ ID NO: 3010 - DNA, 25 bp, Homo sapiens
acataggctaaatttctccagcctc

SEQ ID NO: 3011 - DNA, 25 bp, Homo sapiens
cctcacaatggtcttcacttggtct

SEQ ID NO: 3012 - DNA, 25 bp, Homo sapiens
gtctgacttgtaccaattctagcac

SEQ ID NO: 3013 - DNA, 25 bp, Homo sapiens
accaattctagcacccactgaaaaa

SEQ ID NO: 3014 - DNA, 25 bp, Homo sapiens
agtgcagaaatgtggcttttgcccc

SEQ ID NO: 3015 - DNA, 25 bp, Homo sapiens
ccccactttgcatctccaaaattac

SEQ ID NO: 3016 - DNA, 25 bp, Homo sapiens
tagttataagtctccgagttggaaa

SEQ ID NO: 3017 - DNA, 25 bp, Homo sapiens
aagccagagctgtctagtttcattc

SEQ ID NO: 3018 - DNA, 25 bp, Homo sapiens
gctgtctagtttcattcattctttc

SEQ ID NO: 3019 - DNA, 25 bp, Homo sapiens
ggagatcatctgacactgctgaacg

SEQ ID NO: 3020 - DNA, 25 bp, Homo sapiens
tgctgaacgtctaccatgcttttaa

SEQ ID NO: 3021 - DNA, 25 bp, Homo sapiens
caacttcattaactacaggtccctg

SEQ ID NO: 3022 - DNA, 25 bp, Homo sapiens
gtacgccagcagctatctcgaatta

SEQ ID NO: 3023 - DNA, 25 bp, Homo sapiens
gatttaatttgcctcgtcgaagtac

SEQ ID NO: 3024 - DNA, 25 bp, Homo sapiens
gcaggtggcacatttagaacgaaca

SEQ ID NO: 3025 - DNA, 25 bp, Homo sapiens
aaccaggtggttcagttgcatccct

SEQ ID NO: 3026 - DNA, 25 bp, Homo sapiens
cctctactgttcttgaccacaaacc

SEQ ID NO: 3027 - DNA, 25 bp, Homo sapiens
ggttggtgaaaattgcccctcaata

SEQ ID NO: 3028 - DNA, 25 bp, Homo sapiens
atgacatgagcaatttcccacagtg

SEQ ID NO: 3029 - DNA, 25 bp, Homo sapiens
gagacagttggaccgcatcattgcc

SEQ ID NO: 3030 - DNA, 25 bp, Homo sapiens
agcccatgatgccgtggcacaggaa

SEQ ID NO: 3031 - DNA, 25 bp, Homo sapiens
acaacgtggatggccacctctatga

SEQ ID NO: 3032 - DNA, 25 bp, Homo sapiens
tgatggacgaatgccttttccggtg

SEQ ID NO: 3033 - DNA, 25 bp, Homo sapiens
tgccttttccggtgaaccatggcgc

SEQ ID NO: 3034 - DNA, 25 bp, Homo sapiens
tcagaggacaccctgctgaaggacg

SEQ ID NO: 3035 - DNA, 25 bp, Homo sapiens
caaggagaagtccgcttctctgccg

SEQ ID NO: 3036 - DNA, 25 bp, Homo sapiens
gcaaggcagcctaatgctctgtggg

SEQ ID NO: 3037 - DNA, 25 bp, Homo sapiens
gagggactttgctgatttcccctct

SEQ ID NO: 3038 - DNA, 25 bp, Homo sapiens
ccccccatgcagtctaaaatgcttc

SEQ ID NO: 3039 - DNA, 25 bp, Homo sapiens
tgttcttctgttctgcagacacgcc

SEQ ID NO: 3040 - DNA, 25 bp, Homo sapiens
gtgtatgtcttgtatccgatatcta

SEQ ID NO: 3041 - DNA, 25 bp, Homo sapiens
gatatccacaacatgtctgtcaagg

SEQ ID NO: 3042 - DNA, 25 bp, Homo sapiens
tctgtcaaggccatgaggtttcctc

SEQ ID NO: 3043 - DNA, 25 bp, Homo sapiens
gtttcctcccaaatcgtacaacaag

SEQ ID NO: 3044 - DNA, 25 bp, Homo sapiens
ggaacggcgtgagcgagaacagcag

SEQ ID NO: 3045 - DNA, 25 bp, Homo sapiens
gaacagcaggacttggagtttgcca

SEQ ID NO: 3046 - DNA, 25 bp, Homo sapiens
tttcccacacacagctcatatgctg

SEQ ID NO: 3047 - DNA, 25 bp, Homo sapiens
acagctcatatgctgcattcgtgca

SEQ ID NO: 3048 - DNA, 25 bp, Homo sapiens
tgctgcattcgtgcagggggtgggg

SEQ ID NO: 3049 - DNA, 25 bp, Homo sapiens
cccagccggtgacttactgtacagc

SEQ ID NO: 3050 - DNA, 25 bp, Homo sapiens
gatagttctgtgtactcctttaggg

SEQ ID NO: 3051 - DNA, 25 bp, Homo sapiens
ttagggagtgggggactagaactgg

SEQ ID NO: 3052 - DNA, 25 bp, Homo sapiens
cactaactatgcatggtgccccagg

SEQ ID NO: 3053 - DNA, 25 bp, Homo sapiens
acaaggatagatgctggcccagggc

SEQ ID NO: 3054 - DNA, 25 bp, Homo sapiens
gagcccagctccaaggggaatcaga

SEQ ID NO: 3055 - DNA, 25 bp, Homo sapiens
cctggggtctggagttgatctggaa

SEQ ID NO: 3056 - DNA, 25 bp, Homo sapiens
gaacccagactcagacattggcacc

SEQ ID NO: 3057 - DNA, 25 bp, Homo sapiens
ttggcaccaatccaggcagatccag

SEQ ID NO: 3058 - DNA, 25 bp, Homo sapiens
gcccagttcaccctgatttaggaga

SEQ ID NO: 3059 - DNA, 25 bp, Homo sapiens
gaagccaggaatttcccaggacctg

SEQ ID NO: 3060 - DNA, 25 bp, Homo sapiens
ggcaacagatctggaacctcagcct

SEQ ID NO: 3061 - DNA, 25 bp, Homo sapiens
ctgtcctgggcctgcagaatttggg

SEQ ID NO: 3062 - DNA, 25 bp, Homo sapiens
gcaccagacacccaggacttattta

SEQ ID NO: 3063 - DNA, 25 bp, Homo sapiens
gaagtttgaggacaggtccccagcc

SEQ ID NO: 3064 - DNA, 25 bp, Homo sapiens
gccgccgagtgcctatcagagaagg

SEQ ID NO: 3065 - DNA, 25 bp, Homo sapiens
gagaaatgtgctggggtcgcgtgtc

SEQ ID NO: 3066 - DNA, 25 bp, Homo sapiens
caccaacgtgaaggtgaccctccga

SEQ ID NO: 3067 - DNA, 25 bp, Homo sapiens
gccatggtcaccgtgctggagatgg

SEQ ID NO: 3068 - DNA, 25 bp, Homo sapiens
tgaatcagctgcgcgcaagcgagcc

SEQ ID NO: 3069 - DNA, 25 bp, Homo sapiens
gaacgccatgattgctgctggactt

SEQ ID NO: 3070 - DNA, 25 bp, Homo sapiens
gacgaccctagggccatggtgggcc

SEQ ID NO: 3071 - DNA, 25 bp, Homo sapiens
atggtgggccgcttgaatgagctgc

SEQ ID NO: 3072 - DNA, 25 bp, Homo sapiens
tgcttgtcaaggccctggagcgaca

SEQ ID NO: 3073 - DNA, 25 bp, Homo sapiens
cacctccttgagctttatttaccta

SEQ ID NO: 3074 - DNA, 25 bp, Homo sapiens
gcaccaggggagcaaggcttcgggg

SEQ ID NO: 3075 - DNA, 25 bp, Homo sapiens
ttaccaggctgtgggcttggtccaa

SEQ ID NO: 3076 - DNA, 25 bp, Homo sapiens
ggcactacacctgtactgcaggggc

SEQ ID NO: 3077 - DNA, 25 bp, Homo sapiens
gctgtcttcaggccagaagtgcctc

SEQ ID NO: 3078 - DNA, 25 bp, Homo sapiens
aatgctgcctaccatgattggcctc

SEQ ID NO: 3079 - DNA, 25 bp, Homo sapiens
gtcctaccagacttcactggtgtca

SEQ ID NO: 3080 - DNA, 25 bp, Homo sapiens
gtcagatggggagacctggcacgtc

SEQ ID NO: 3081 - DNA, 25 bp, Homo sapiens
tgcccagcctggaagcgtggaagca

SEQ ID NO: 3082 - DNA, 25 bp, Homo sapiens
cacttctaaccttggagctcactgg

SEQ ID NO: 3083 - DNA, 25 bp, Homo sapiens
atccacattcttgggctgaacgcgg

SEQ ID NO: 3084 - DNA, 25 bp, Homo sapiens
gcactctgaccctgtagtacagcaa

SEQ ID NO: 3085 - DNA, 25 bp, Homo sapiens
taatggtggcccacctagccatcaa

SEQ ID NO: 3086 - DNA, 25 bp, Homo sapiens
agccatcaatgtttccaaggcccgc

SEQ ID NO: 3087 - DNA, 25 bp, Homo sapiens
gggcacatcttcaactgcattcagc

SEQ ID NO: 3088 - DNA, 25 bp, Homo sapiens
cacgttggaagtgtatcctcccttc

SEQ ID NO: 3089 - DNA, 25 bp, Homo sapiens
tgttggaggtgtttaccacccgcgt

SEQ ID NO: 3090 - DNA, 25 bp, Homo sapiens
ggcttggcctggattgttggacgag

SEQ ID NO: 3091 - DNA, 25 bp, Homo sapiens
gagaacccagcaagcgtagtcgagg

SEQ ID NO: 3092 - DNA, 25 bp, Homo sapiens
ggcacaactgtgtgctctgctttcc

SEQ ID NO: 3093 - DNA, 25 bp, Homo sapiens
ctgctttccagcatcttggttgggt

SEQ ID NO: 3094 - DNA, 25 bp, Homo sapiens
aaacttacctggcatcagcctcata

SEQ ID NO: 3095 - DNA, 25 bp, Homo sapiens
tttgtgcttctaactggtgctgcca

SEQ ID NO: 3096 - DNA, 25 bp, Homo sapiens
agccaaggagctgaaatatatctca

SEQ ID NO: 3097 - DNA, 25 bp, Homo sapiens
atatctcagtttataaattcaggta

SEQ ID NO: 3098 - DNA, 25 bp, Homo sapiens
ctcttgttttccttgtgagtccatg

SEQ ID NO: 3099 - DNA, 25 bp, Homo sapiens
gttttccttgtgagtccatggctaa

SEQ ID NO: 3100 - DNA, 25 bp, Homo sapiens
ccatggctaaatcaaagctgcccct

SEQ ID NO: 3101 - DNA, 25 bp, Homo sapiens
agaagagacttaatccaagcctgat

SEQ ID NO: 3102 - DNA, 25 bp, Homo sapiens
gcctgattgtactagtggcatcact

SEQ ID NO: 3103 - DNA, 25 bp, Homo sapiens
cacttagaagtaggctttccctctt

SEQ ID NO: 3104 - DNA, 25 bp, Homo sapiens
aaattgggacaacatactttacgca

SEQ ID NO: 3105 - DNA, 25 bp, Homo sapiens
gacaacatactttacgcaatgaaca

SEQ ID NO: 3106 - DNA, 25 bp, Homo sapiens
attgtgattggatacttagatacta

SEQ ID NO: 3107 - DNA, 25 bp, Homo sapiens
acatagatactatgtccttgacata

SEQ ID NO: 3108 - DNA, 25 bp, Homo sapiens
gagtgtgtaagctgagcgatttcta

SEQ ID NO: 3109 - DNA, 25 bp, Homo sapiens
gttgtacacttttagtagtcatagt

SEQ ID NO: 3110 - DNA, 25 bp, Homo sapiens
gggcaatgttgattaatctcagtat

SEQ ID NO: 3111 - DNA, 25 bp, Homo sapiens
aaaccacattaatctgtatcccatt

SEQ ID NO: 3112 - DNA, 25 bp, Homo sapiens
ctgtatcccattgtctggcttttgt

SEQ ID NO: 3113 - DNA, 25 bp, Homo sapiens
gtaaattcatccaggtcaagactaa

SEQ ID NO: 3114 - DNA, 25 bp, Homo sapiens
tattcaagcactcttaaaaccactt

SEQ ID NO: 3115 - DNA, 25 bp, Homo sapiens
taaaaccacttaaacagcctccagt

SEQ ID NO: 3116 - DNA, 25 bp, Homo sapiens
taaacagcctccagtcataaaaatg

SEQ ID NO: 3117 - DNA, 25 bp, Homo sapiens
atatttgcttggcaacacgacttga

SEQ ID NO: 3118 - DNA, 25 bp, Homo sapiens
tgttcttttcattccttgagtcaac

SEQ ID NO: 3119 - DNA, 25 bp, Homo sapiens
agtcaacttcagggtcttggatact

SEQ ID NO: 3120 - DNA, 25 bp, Homo sapiens
gactttgcccattttaggctatcca

SEQ ID NO: 3121 - DNA, 25 bp, Homo sapiens
ggacttaaggtagccatctggatca

SEQ ID NO: 3122 - DNA, 25 bp, Homo sapiens
aaatgacccaagtgtattttccaca

SEQ ID NO: 3123 - DNA, 25 bp, Homo sapiens
gtattttccacaagttttgatcctg

SEQ ID NO: 3124 - DNA, 25 bp, Homo sapiens
gttttgatcctgtgtaatatttctt

SEQ ID NO: 3125 - DNA, 25 bp, Homo sapiens
atggaatgcagttccactttctccc

SEQ ID NO: 3126 - DNA, 25 bp, Homo sapiens
tctccccagagttgatctttttgtg

SEQ ID NO: 3127 - DNA, 25 bp, Homo sapiens
ctttcccgtctctagtagtattctg

SEQ ID NO: 3128 - DNA, 25 bp, Homo sapiens
actgattttttcctacatacgcaaa

SEQ ID NO: 3129 - DNA, 25 bp, Homo sapiens
ggagttgtgggttggtaagctccca

SEQ ID NO: 3130 - DNA, 25 bp, Homo sapiens
gtgggttggtaagctcccaggtact

SEQ ID NO: 3131 - DNA, 25 bp, Homo sapiens
cgaggctatggtgtgagagcccccg

SEQ ID NO: 3132 - DNA, 25 bp, Homo sapiens
ccctggcaaggccgatggctcagga

SEQ ID NO: 3133 - DNA, 25 bp, Homo sapiens
aggccgatggctcaggatgatgggg

SEQ ID NO: 3134 - DNA, 25 bp, Homo sapiens
gcctttgaacaatcatgcttcagaa

SEQ ID NO: 3135 - DNA, 25 bp, Homo sapiens
acaatcatgcttcagaaatctgcct

SEQ ID NO: 3136 - DNA, 25 bp, Homo sapiens
tggctttggtaggcatacttggaga

SEQ ID NO: 3137 - DNA, 25 bp, Homo sapiens
tacttggagaacatatcccacatta

SEQ ID NO: 3138 - DNA, 25 bp, Homo sapiens
cccacattaggaattgatttaagcc

SEQ ID NO: 3139 - DNA, 25 bp, Homo sapiens
taatcctttaaaacttggagaagct

SEQ ID NO: 3140 - DNA, 25 bp, Homo sapiens
tctagttcttgcacgctctttaaga

SEQ ID NO: 3141 - DNA, 25 bp, Homo sapiens
atgccagtctgttgcatgcaggctt

SEQ ID NO: 3142 - DNA, 25 bp, Homo sapiens
tgcaccaactccttagtgccgattc

SEQ ID NO: 3143 - DNA, 25 bp, Homo sapiens
ggagccacagtcttttttgctttgc

SEQ ID NO: 3144 - DNA, 25 bp, Homo sapiens
tagagactatgtcgctttcctgagc

SEQ ID NO: 3145 - DNA, 25 bp, Homo sapiens
ttcctgagctaccgagagcgctcgt

SEQ ID NO: 3146 - DNA, 25 bp, Homo sapiens
gagcgctcgtgaactggaatcaact

SEQ ID NO: 3147 - DNA, 25 bp, Homo sapiens
gaggtcagatttggagcttctcatt

SEQ ID NO: 3148 - DNA, 25 bp, Homo sapiens
attgcatcgggttccaagccaatgg

SEQ ID NO: 3149 - DNA, 25 bp, Homo sapiens
ggaagcgttggttacagcagctgat

SEQ ID NO: 3150 - DNA, 25 bp, Homo sapiens
ggaattggggtctgctctaagctgc

SEQ ID NO: 3151 - DNA, 25 bp, Homo sapiens
gtaaaccacatcttttttgcacttt

SEQ ID NO: 3152 - DNA, 25 bp, Homo sapiens
acgtgccgtttaaaccactggatct

SEQ ID NO: 3153 - DNA, 25 bp, Homo sapiens
accactggatctatctaaatgccga

SEQ ID NO: 3154 - DNA, 25 bp, Homo sapiens
aatgccgatttgagttcgcgacact

SEQ ID NO: 3155 - DNA, 25 bp, Homo sapiens
gcgacactatgtactgcgtttttca

SEQ ID NO: 3156 - DNA, 25 bp, Homo sapiens
tgtactgcgtttttcattcttgtat

SEQ ID NO: 3157 - DNA, 25 bp, Homo sapiens
tgactatttaatcctttctacttgt

SEQ ID NO: 3158 - DNA, 25 bp, Homo sapiens
tcctttctacttgtcgctaaatata

SEQ ID NO: 3159 - DNA, 25 bp, Homo sapiens
gcactaggacgtctgcctttttaag

SEQ ID NO: 3160 - DNA, 25 bp, Homo sapiens
tttttttgccatccatcctgtgcaa

SEQ ID NO: 3161 - DNA, 25 bp, Homo sapiens
tccatcctgtgcaatatgccgtgta

SEQ ID NO: 3162 - DNA, 25 bp, Homo sapiens
ctgtacactcccagtgtgtcactgg

SEQ ID NO: 3163 - DNA, 25 bp, Homo sapiens
tggcctctctcagtgaagactgctc

SEQ ID NO: 3164 - DNA, 25 bp, Homo sapiens
acttgctgtgctggactcaagcctt

SEQ ID NO: 3165 - DNA, 25 bp, Homo sapiens
ttgtgagagatgcgacttggtcccc

SEQ ID NO: 3166 - DNA, 25 bp, Homo sapiens
tccctgcttaccacagtgggctggg

SEQ ID NO: 3167 - DNA, 25 bp, Homo sapiens
ctgccctctcagcttgtgagacaac

SEQ ID NO: 3168 - DNA, 25 bp, Homo sapiens
gagacaacacaggagccttctatag

SEQ ID NO: 3169 - DNA, 25 bp, Homo sapiens
atatgctagatctgtgccgttaata

SEQ ID NO: 3170 - DNA, 25 bp, Homo sapiens
taataggcatcgtctctcagcctga

SEQ ID NO: 3171 - DNA, 25 bp, Homo sapiens
gctggattctgggttcctgtagtca

SEQ ID NO: 3172 - DNA, 25 bp, Homo sapiens
gagtacaagctgtgtcctgagctca

SEQ ID NO: 3173 - DNA, 25 bp, Homo sapiens
gcatccctgggttcttggaagcagc

SEQ ID NO: 3174 - DNA, 25 bp, Homo sapiens
ggaagcagctcttatgctactcata

SEQ ID NO: 3175 - DNA, 25 bp, Homo sapiens
tagagatgggattgactttattttt

SEQ ID NO: 3176 - DNA, 25 bp, Homo sapiens
tagtgcttaattcaccattatgaga

SEQ ID NO: 3177 - DNA, 25 bp, Homo sapiens
ccagtcacaaaaatgcagcccagct

SEQ ID NO: 3178 - DNA, 25 bp, Homo sapiens
gcaggacttggtacggttttacaca

SEQ ID NO: 3179 - DNA, 25 bp, Homo sapiens
tacacaactccttaccattaaactg

SEQ ID NO: 3180 - DNA, 25 bp, Homo sapiens
ttggcttgcctgtgtaatgcccact

SEQ ID NO: 3181 - DNA, 25 bp, Homo sapiens
cccctggctccctagtgatgggaca

SEQ ID NO: 3182 - DNA, 25 bp, Homo sapiens
tttcccaccccaaaacagcatgggg

SEQ ID NO: 3183 - DNA, 25 bp, Homo sapiens
aaaacagcatggggcctgacatctt

SEQ ID NO: 3184 - DNA, 25 bp, Homo sapiens
tgtggatgtttccaagcctgacctc

SEQ ID NO: 3185 - DNA, 25 bp, Homo sapiens
tgccctgcgtgacgtacgtcagcaa

SEQ ID NO: 3186 - DNA, 25 bp, Homo sapiens
gtgtggctgccaagaacctgcagga

SEQ ID NO: 3187 - DNA, 25 bp, Homo sapiens
agtaccggagacaggtgcagtccct

SEQ ID NO: 3188 - DNA, 25 bp, Homo sapiens
gcagtccctcacctgtgaagtggat

SEQ ID NO: 3189 - DNA, 25 bp, Homo sapiens
tgagtccctggaacgccagatgcgt

SEQ ID NO: 3190 - DNA, 25 bp, Homo sapiens
gagaactttgccgttgaagctgcta

SEQ ID NO: 3191 - DNA, 25 bp, Homo sapiens
gaagctgctaactaccaagacacta

SEQ ID NO: 3192 - DNA, 25 bp, Homo sapiens
cactattggccgcctgcaggatgag

SEQ ID NO: 3193 - DNA, 25 bp, Homo sapiens
gtcaccttcgtgaataccaagacct

SEQ ID NO: 3194 - DNA, 25 bp, Homo sapiens
gcccttgacattgagattgccacct

SEQ ID NO: 3195 - DNA, 25 bp, Homo sapiens
tcaagccttatgtttctccaatgtt

SEQ ID NO: 3196 - DNA, 25 bp, Homo sapiens
ctcgcttgcctagctttacgaatat

SEQ ID NO: 3197 - DNA, 25 bp, Homo sapiens
gttttctgtttatgcatagccttga

SEQ ID NO: 3198 - DNA, 25 bp, Homo sapiens
catagccttgatttgtttgactccc

SEQ ID NO: 3199 - DNA, 25 bp, Homo sapiens
ccccccatttacatgcatgcaatca

SEQ ID NO: 3200 - DNA, 25 bp, Homo sapiens
gcatgcaatcagacaggccactaag

SEQ ID NO: 3201 - DNA, 25 bp, Homo sapiens
gagtctgctctatcatagtgttgag

SEQ ID NO: 3202 - DNA, 25 bp, Homo sapiens
gagagcgtgtgtagtgctgcatctt

SEQ ID NO: 3203 - DNA, 25 bp, Homo sapiens
gggacgcaggttatttggggtgagt

SEQ ID NO: 3204 - DNA, 25 bp, Homo sapiens
gatgacgtacgttatttccatggaa

SEQ ID NO: 3205 - DNA, 25 bp, Homo sapiens
tgtcacgtcccctacaagtaaattt

SEQ ID NO: 3206 - DNA, 25 bp, Homo sapiens
tgagggccacgggcttgggtagtgg

SEQ ID NO: 3207 - DNA, 25 bp, Homo sapiens
tgggtttacttcaaaatccctcagc

SEQ ID NO: 3208 - DNA, 25 bp, Homo sapiens
cttgttcttcacgactgtctatact

SEQ ID NO: 3209 - DNA, 25 bp, Homo sapiens
gagtgtcatgtttccacaaagggct

SEQ ID NO: 3210 - DNA, 25 bp, Homo sapiens
gacacctgagcctggattttcactc

SEQ ID NO: 3211 - DNA, 25 bp, Homo sapiens
gattttcactcatccctgagaagcc

SEQ ID NO: 3212 - DNA, 25 bp, Homo sapiens
gagaagccctttccagtagggtggg

SEQ ID NO: 3213 - DNA, 25 bp, Homo sapiens
tagggtgggcaattcccaacttcct

SEQ ID NO: 3214 - DNA, 25 bp, Homo sapiens
gccagcattcattgtaagttccctc

SEQ ID NO: 3215 - DNA, 25 bp, Homo sapiens
gtaatctcctgtgatctgtgctagc

SEQ ID NO: 3216 - DNA, 25 bp, Homo sapiens
gctgtgaggcagctctggaacgtga

SEQ ID NO: 3217 - DNA, 25 bp, Homo sapiens
ttagcgttcatccgtgtaacccgct

SEQ ID NO: 3218 - DNA, 25 bp, Homo sapiens
gtaacccgctcatcactggatgaag

SEQ ID NO: 3219 - DNA, 25 bp, Homo sapiens
gatgaagattctcctgtgctagatg

SEQ ID NO: 3220 - DNA, 25 bp, Homo sapiens
gattctcctgtgctagatgtgcaaa

SEQ ID NO: 3221 - DNA, 25 bp, Homo sapiens
gtgcaaatgcaagctagtggcttca

SEQ ID NO: 3222 - DNA, 25 bp, Homo sapiens
gagaatcccactttctatagcagat

SEQ ID NO: 3223 - DNA, 25 bp, Homo sapiens
caattttaatgctatttccccaggg

SEQ ID NO: 3224 - DNA, 25 bp, Homo sapiens
gtatgtttacatatcacctcatggc

SEQ ID NO: 3225 - DNA, 25 bp, Homo sapiens
tatcacctcatggcctattatatta

SEQ ID NO: 3226 - DNA, 25 bp, Homo sapiens
gataacttgagcaccgtcatggctt

SEQ ID NO: 3227 - DNA, 25 bp, Homo sapiens
gcaccgtcatggcttaatgtttatt

SEQ ID NO: 3228 - DNA, 25 bp, Homo sapiens
cctggcccactctgtaatagttcag

SEQ ID NO: 3229 - DNA, 25 bp, Homo sapiens
atacagattttacctatccacaata

SEQ ID NO: 3230 - DNA, 25 bp, Homo sapiens
aaaacaacttggcatttctatactt

SEQ ID NO: 3231 - DNA, 25 bp, Homo sapiens
tacagttttctagcaattttctttg

SEQ ID NO: 3232 - DNA, 25 bp, Homo sapiens
ttgtctttgctgtactcttgctgat

SEQ ID NO: 3233 - DNA, 25 bp, Homo sapiens
taatttatttgtttccctacttgat

SEQ ID NO: 3234 - DNA, 25 bp, Homo sapiens
gatttccatcttaatgttactcaga

SEQ ID NO: 3235 - DNA, 25 bp, Homo sapiens
taagagaagtctcattcgcctttgt

SEQ ID NO: 3236 - DNA, 25 bp, Homo sapiens
cctttgtcttgtacttctgtgttca

SEQ ID NO: 3237 - DNA, 25 bp, Homo sapiens
tttggctagagtttccactatccca

SEQ ID NO: 3238 - DNA, 25 bp, Homo sapiens
gaattacagtacacatccccagaat

SEQ ID NO: 3239 - DNA, 25 bp, Homo sapiens
cagttagccactgctggtgtttatg

SEQ ID NO: 3240 - DNA, 25 bp, Homo sapiens
ggagtttcatgttatgcctgttgca

SEQ ID NO: 3241 - DNA, 25 bp, Homo sapiens
aatgcaaatgtcacggctactctat

SEQ ID NO: 3242 - DNA, 25 bp, Homo sapiens
gctactctatatacttttgcttggt

SEQ ID NO: 3243 - DNA, 25 bp, Homo sapiens
gggaagcctgtgtatcgtggagaaa

SEQ ID NO: 3244 - DNA, 25 bp, Homo sapiens
aagagaccaactttttcattccctg

SEQ ID NO: 3245 - DNA, 25 bp, Homo sapiens
ccccaatttcccagactagatttca

SEQ ID NO: 3246 - DNA, 25 bp, Homo sapiens
aaaatcccttaatctatgtgcaccg

SEQ ID NO: 3247 - DNA, 25 bp, Homo sapiens
atgtgcaccgttgggaccaatgcct

SEQ ID NO: 3248 - DNA, 25 bp, Homo sapiens
ggcattcctctcaatgttgtgtgtt

SEQ ID NO: 3249 - DNA, 25 bp, Homo sapiens
ctccagcagttctctcgaatacttt

SEQ ID NO: 3250 - DNA, 25 bp, Homo sapiens
tctaagatccttgttgacgctctgc

SEQ ID NO: 3251 - DNA, 25 bp, Homo sapiens
ggtagagttagtcactgtcaagtca

SEQ ID NO: 3252 - DNA, 25 bp, Homo sapiens
tgtcaagtcatttgacacctccctc

SEQ ID NO: 3253 - DNA, 25 bp, Homo sapiens
acccagcaagtccctataaccttgc

SEQ ID NO: 3254 - DNA, 25 bp, Homo sapiens
attccgtggttttcaacatggtact

SEQ ID NO: 3255 - DNA, 25 bp, Homo sapiens
ttggccttggctgtgattatcacct

SEQ ID NO: 3256 - DNA, 25 bp, Homo sapiens
gattatcacctcttacaatatttgg

SEQ ID NO: 3257 - DNA, 25 bp, Homo sapiens
ctgtctcgtcataagcatctagcca

SEQ ID NO: 3258 - DNA, 25 bp, Homo sapiens
gaatgttacctgtgccagaattaga

SEQ ID NO: 3259 - DNA, 25 bp, Homo sapiens
tctagccaaggatcattctcctgat

SEQ ID NO: 3260 - DNA, 25 bp, Homo sapiens
attcactggagctggcaggtttgga

SEQ ID NO: 3261 - DNA, 25 bp, Homo sapiens
ggttggcaagttcctgcatatggaa

SEQ ID NO: 3262 - DNA, 25 bp, Homo sapiens
attatggagtgcaaccgcctcaagg

SEQ ID NO: 3263 - DNA, 25 bp, Homo sapiens
tggcagcatgttgcccaatcagcct

SEQ ID NO: 3264 - DNA, 25 bp, Homo sapiens
caatcagccttctgggtatcgagtg

SEQ ID NO: 3265 - DNA, 25 bp, Homo sapiens
aagccagtggcttgaggctacaggg

SEQ ID NO: 3266 - DNA, 25 bp, Homo sapiens
ttacttatcatccacattgttttaa

SEQ ID NO: 3267 - DNA, 25 bp, Homo sapiens
acaagatgctggatgtctgccaatt

SEQ ID NO: 3268 - DNA, 25 bp, Homo sapiens
gtctgccaatttttgccttcattac

SEQ ID NO: 3269 - DNA, 25 bp, Homo sapiens
tttctcagatccttgtttcaaacac

SEQ ID NO: 3270 - DNA, 25 bp, Homo sapiens
aaatgcagggattgctgccactttt

SEQ ID NO: 3271 - DNA, 25 bp, Homo sapiens
gcagttctagtttgcattcctgata

SEQ ID NO: 3272 - DNA, 25 bp, Homo sapiens
tggtatcttcattcgccaagtgaca

SEQ ID NO: 3273 - DNA, 25 bp, Homo sapiens
aacaaaacccaagtcaccatgtact

SEQ ID NO: 3274 - DNA, 25 bp, Homo sapiens
acaattcgtactccccaatggtgga

SEQ ID NO: 3275 - DNA, 25 bp, Homo sapiens
ttggacccaagccctgaggtacaga

SEQ ID NO: 3276 - DNA, 25 bp, Homo sapiens
gtatgccttcaaatgtcacagacta

SEQ ID NO: 3277 - DNA, 25 bp, Homo sapiens
agatttacccagtcaatgccatttc

SEQ ID NO: 3278 - DNA, 25 bp, Homo sapiens
tgccatttcttttcacaatatccac

SEQ ID NO: 3279 - DNA, 25 bp, Homo sapiens
caggtggttctgatggctttgtaaa

SEQ ID NO: 3280 - DNA, 25 bp, Homo sapiens
aaaaagcgactgtgccaattccatc

SEQ ID NO: 3281 - DNA, 25 bp, Homo sapiens
tcgcatcacttgccttcagtaatga

SEQ ID NO: 3282 - DNA, 25 bp, Homo sapiens
taatgatgggactacgcttgcaata

SEQ ID NO: 3283 - DNA, 25 bp, Homo sapiens
atgagtgaggacgcctacacggtgc

SEQ ID NO: 3284 - DNA, 25 bp, Homo sapiens
tgacccgcatcgggctggagacgtc

SEQ ID NO: 3285 - DNA, 25 bp, Homo sapiens
agctcatcacagctgccagcttggt

SEQ ID NO: 3286 - DNA, 25 bp, Homo sapiens
ccagcttggtgtgccggaaacgcaa

SEQ ID NO: 3287 - DNA, 25 bp, Homo sapiens
gatgacatcaagcgggtctactcac

SEQ ID NO: 3288 - DNA, 25 bp, Homo sapiens
cccgctccacgcagtacatgaagga

SEQ ID NO: 3289 - DNA, 25 bp, Homo sapiens
gaaggagtaccaggacgccttcctc

SEQ ID NO: 3290 - DNA, 25 bp, Homo sapiens
caaaggcgagaccatggacacctcc

SEQ ID NO: 3291 - DNA, 25 bp, Homo sapiens
acctcctgagttggatgtcatcccc

SEQ ID NO: 3292 - DNA, 25 bp, Homo sapiens
ggagtgctgttcatcgacgaggtcc

SEQ ID NO: 3293 - DNA, 25 bp, Homo sapiens
gatcatggccaccaaccgtggcatc

SEQ ID NO: 3294 - DNA, 25 bp, Homo sapiens
tcctgggttctggggcatcagccag

SEQ ID NO: 3295 - DNA, 25 bp, Homo sapiens
agctaccccttgtgggcaaaggcag

SEQ ID NO: 3296 - DNA, 25 bp, Homo sapiens
aaggcagggccacttttgaagtctt

SEQ ID NO: 3297 - DNA, 25 bp, Homo sapiens
cttccctcagatttccattgtgtgg

SEQ ID NO: 3298 - DNA, 25 bp, Homo sapiens
ggtcagggggagtctttgcaccaaa

SEQ ID NO: 3299 - DNA, 25 bp, Homo sapiens
ccaaagatgtcctgactttgccccc

SEQ ID NO: 3300 - DNA, 25 bp, Homo sapiens
tcccccagcacagatgaggagcagc

SEQ ID NO: 3301 - DNA, 25 bp, Homo sapiens
ggtggcaggaatacttcacctttcc

SEQ ID NO: 3302 - DNA, 25 bp, Homo sapiens
gcccagggtcgtctttgtgtatggg

SEQ ID NO: 3303 - DNA, 25 bp, Homo sapiens
ctcccttgtctcagatggtgtgtcc

SEQ ID NO: 3304 - DNA, 25 bp, Homo sapiens
tgtgtccagcactcgattgttgtaa

SEQ ID NO: 3305 - DNA, 25 bp, Homo sapiens
ggacccttccggagtaagaaggcag

SEQ ID NO: 3306 - DNA, 25 bp, Homo sapiens
ctttccatcaccactggtggcagtg

SEQ ID NO: 3307 - DNA, 25 bp, Homo sapiens
gctccatgtactctctgcaagggat

SEQ ID NO: 3308 - DNA, 25 bp, Homo sapiens
ccatgtactctctgcaagggatcca

SEQ ID NO: 3309 - DNA, 25 bp, Homo sapiens
tctctgcaagggatccacggggaca

SEQ ID NO: 3310 - DNA, 25 bp, Homo sapiens
tctgcaagggatccacggggacatg

SEQ ID NO: 3311 - DNA, 25 bp, Homo sapiens
gcaagggatccacggggacatgaat

SEQ ID NO: 3312 - DNA, 25 bp, Homo sapiens
gggatccacggggacatgaatgtca

SEQ ID NO: 3313 - DNA, 25 bp, Homo sapiens
ggggacatgaatgtcattctctggc

SEQ ID NO: 3314 - DNA, 25 bp, Homo sapiens
cattctctggccaattcagagtggc

SEQ ID NO: 3315 - DNA, 25 bp, Homo sapiens
ggccaattcagagtggcattctgca

SEQ ID NO: 3316 - DNA, 25 bp, Homo sapiens
tgaatatagctgccttgctctctgt

SEQ ID NO: 3317 - DNA, 25 bp, Homo sapiens
ctctgtcatgcttcagccttacatg

SEQ ID NO: 3318 - DNA, 25 bp, Homo sapiens
acggttagtgccacaatccaggccc

SEQ ID NO: 3319 - DNA, 25 bp, Homo sapiens
gcagtatcctgctgacaaacttcct

SEQ ID NO: 3320 - DNA, 25 bp, Homo sapiens
acaaacttcctgtgtaccttaccag

SEQ ID NO: 3321 - DNA, 25 bp, Homo sapiens
acaccagattggcacagtcagtccc

SEQ ID NO: 3322 - DNA, 25 bp, Homo sapiens
cagtcagtcccttgttccaaaaatt

SEQ ID NO: 3323 - DNA, 25 bp, Homo sapiens
taaggcagcgctttggagggggcca

SEQ ID NO: 3324 - DNA, 25 bp, Homo sapiens
gtccccgaagccagcagttgtagag

SEQ ID NO: 3325 - DNA, 25 bp, Homo sapiens
acaacagccaagccacagcagatac

SEQ ID NO: 3326 - DNA, 25 bp, Homo sapiens
agaacgaggttgctgcggaggtggc

SEQ ID NO: 3327 - DNA, 25 bp, Homo sapiens
gaacaagcgtcctggggcatttgct

SEQ ID NO: 3328 - DNA, 25 bp, Homo sapiens
gcatttgctatttacctggagcctt

SEQ ID NO: 3329 - DNA, 25 bp, Homo sapiens
ggagccttggcatttagacatcttt

SEQ ID NO: 3330 - DNA, 25 bp, Homo sapiens
agagcagcgtgccagagatcttttc

SEQ ID NO: 3331 - DNA, 25 bp, Homo sapiens
ggattccggatctcttcatgaaacg

SEQ ID NO: 3332 - DNA, 25 bp, Homo sapiens
gaaacaaggtcgtgtccgcaaagtt

SEQ ID NO: 3333 - DNA, 25 bp, Homo sapiens
agctcagcagctttggtatgccatc

SEQ ID NO: 3334 - DNA, 25 bp, Homo sapiens
agtctcagacggaaacaggcacccc

SEQ ID NO: 3335 - DNA, 25 bp, Homo sapiens
gcaccccgtatatgctctacaaaga

SEQ ID NO: 3336 - DNA, 25 bp, Homo sapiens
gctgtttgtaatttggcttccctgg

SEQ ID NO: 3337 - DNA, 25 bp, Homo sapiens
cttccctggccctgaatatgtatgt

SEQ ID NO: 3338 - DNA, 25 bp, Homo sapiens
ttcagacccagtaactgtccgcagc

SEQ ID NO: 3339 - DNA, 25 bp, Homo sapiens
agctgtctgctagtggttgtcttaa

SEQ ID NO: 3340 - DNA, 25 bp, Homo sapiens
gttgtcttaacatcgtagtcctagt

SEQ ID NO: 3341 - DNA, 25 bp, Homo sapiens
tgagttttgtccatgctggtgtctg

SEQ ID NO: 3342 - DNA, 25 bp, Homo sapiens
gctggtgtctgggttataggcctga

SEQ ID NO: 3343 - DNA, 25 bp, Homo sapiens
gcctgatgggcctggtagttttcca

SEQ ID NO: 3344 - DNA, 25 bp, Homo sapiens
ttttccatcttgttctggcctagag

SEQ ID NO: 3345 - DNA, 25 bp, Homo sapiens
tggcctagaggtcagtcctttgcac

SEQ ID NO: 3346 - DNA, 25 bp, Homo sapiens
aaagcttgtgtacagtgctcaccta

SEQ ID NO: 3347 - DNA, 25 bp, Homo sapiens
taaatccatctgactacttgttcct

SEQ ID NO: 3348 - DNA, 25 bp, Homo sapiens
gtattcctgttgggttttcttgttg

SEQ ID NO: 3349 - DNA, 25 bp, Homo sapiens
tggaatggaactcctcactagctgc

SEQ ID NO: 3350 - DNA, 25 bp, Homo sapiens
ctgctcccttccggacaatgaagaa

SEQ ID NO: 3351 - DNA, 25 bp, Homo sapiens
ctcctgggtggggtttggcttcagg

SEQ ID NO: 3352 - DNA, 25 bp, Homo sapiens
tggtctcccaggtgaggcaagccat

SEQ ID NO: 3353 - DNA, 25 bp, Homo sapiens
tagggtgagtggcttgcttggtggg

SEQ ID NO: 3354 - DNA, 25 bp, Homo sapiens
gtgggacctgacgagttggtggcat

SEQ ID NO: 3355 - DNA, 25 bp, Homo sapiens
gggaaggatgtgggtctctagtgcc

SEQ ID NO: 3356 - DNA, 25 bp, Homo sapiens
cttgccctggcttagctgcaggaga

SEQ ID NO: 3357 - DNA, 25 bp, Homo sapiens
gagaagatggctgctttcacttccc

SEQ ID NO: 3358 - DNA, 25 bp, Homo sapiens
tttggtctccaagatgaatgctcat

SEQ ID NO: 3359 - DNA, 25 bp, Homo sapiens
ggagggtgccaggtagaagctaggg

SEQ ID NO: 3360 - DNA, 25 bp, Homo sapiens
tgatgagctttaatctccgagcctg

SEQ ID NO: 3361 - DNA, 25 bp, Homo sapiens
atctccgagcctgtctcagtagagt

SEQ ID NO: 3362 - DNA, 25 bp, Homo sapiens
agtagagtactggctccttttataa

SEQ ID NO: 3363 - DNA, 25 bp, Homo sapiens
gtcttaaccacagtcagaattatct

SEQ ID NO: 3364 - DNA, 25 bp, Homo sapiens
gaatttcttggtgattacaggtggg

SEQ ID NO: 3365 - DNA, 25 bp, Homo sapiens
taacgatggcaggcttgatccccaa

SEQ ID NO: 3366 - DNA, 25 bp, Homo sapiens
gagctgttaccttgggtagtaccta

SEQ ID NO: 3367 - DNA, 25 bp, Homo sapiens
gtacctaataatcagggcattgcac

SEQ ID NO: 3368 - DNA, 25 bp, Homo sapiens
gagattctggaaaacccggacttgt

SEQ ID NO: 3369 - DNA, 25 bp, Homo sapiens
ccacagattatggcagacagctcca

SEQ ID NO: 3370 - DNA, 25 bp, Homo sapiens
acagctccatgatgactatttctat

SEQ ID NO: 3371 - DNA, 25 bp, Homo sapiens
gggttgccatccaagtgaaagtctt

SEQ ID NO: 3372 - DNA, 25 bp, Homo sapiens
gtgaaactgcaacactaacttcccc

SEQ ID NO: 3373 - DNA, 25 bp, Homo sapiens
gagttggtgacacaggccacagacc

SEQ ID NO: 3374 - DNA, 25 bp, Homo sapiens
ttggtttgctgctgtcgtttttgag

SEQ ID NO: 3375 - DNA, 25 bp, Homo sapiens
gtcgtttttgaggagggcccatggg

SEQ ID NO: 3376 - DNA, 25 bp, Homo sapiens
ggcccatgggggtaggagcagttga

SEQ ID NO: 3377 - DNA, 25 bp, Homo sapiens
gaacctgggaacaaacctcacttga

SEQ ID NO: 3378 - DNA, 25 bp, Homo sapiens
ctcacttgagctgtgcctagacaat

SEQ ID NO: 3379 - DNA, 25 bp, Homo sapiens
cagaagtggcctgtaagctcctgtg

SEQ ID NO: 3380 - DNA, 25 bp, Homo sapiens
gctcctgtgctccggagggaagcat

SEQ ID NO: 3381 - DNA, 25 bp, Homo sapiens
gggaagcatttcctggtaggctttg

SEQ ID NO: 3382 - DNA, 25 bp, Homo sapiens
gctgaaggcagatgtcgtcccaaag

SEQ ID NO: 3383 - DNA, 25 bp, Homo sapiens
agaagggcttcggctacaaaggctc

SEQ ID NO: 3384 - DNA, 25 bp, Homo sapiens
aagtccatctacggaagccgctttc

SEQ ID NO: 3385 - DNA, 25 bp, Homo sapiens
ccgctttcctgacgagaactttaca

SEQ ID NO: 3386 - DNA, 25 bp, Homo sapiens
tgtcctgtccatggctaatgctggt

SEQ ID NO: 3387 - DNA, 25 bp, Homo sapiens
taatgctggtcctaacaccaacggc

SEQ ID NO: 3388 - DNA, 25 bp, Homo sapiens
tggcaagcatgttgtgttcggtcac

SEQ ID NO: 3389 - DNA, 25 bp, Homo sapiens
gttcggtcacgtcaaagagggcatg

SEQ ID NO: 3390 - DNA, 25 bp, Homo sapiens
gactgtggccagttgagctaatctg

SEQ ID NO: 3391 - DNA, 25 bp, Homo sapiens
gtggccagggtgctggcatggtggc

SEQ ID NO: 3392 - DNA, 25 bp, Homo sapiens
gcctgaaacgatacgtgtgcccact

SEQ ID NO: 3393 - DNA, 25 bp, Homo sapiens
caagtgcagcgatggggagcgggcc

SEQ ID NO: 3394 - DNA, 25 bp, Homo sapiens
agctggccaaggacgtggcgtccct

SEQ ID NO: 3395 - DNA, 25 bp, Homo sapiens
gacacccaggagctgcttcaagaag

SEQ ID NO: 3396 - DNA, 25 bp, Homo sapiens
gaaacccggcagaagctcaacgtgt

SEQ ID NO: 3397 - DNA, 25 bp, Homo sapiens
tcaacgtgtctacgaagctgcgcca

SEQ ID NO: 3398 - DNA, 25 bp, Homo sapiens
agctgcgccagctggaggaggagcg

SEQ ID NO: 3399 - DNA, 25 bp, Homo sapiens
agcctgcaagaccagctggacgagg

SEQ ID NO: 3400 - DNA, 25 bp, Homo sapiens
ggaggccaagcagaacctggagcgc

SEQ ID NO: 3401 - DNA, 25 bp, Homo sapiens
tccagctctccgactcgaagaagaa

SEQ ID NO: 3402 - DNA, 25 bp, Homo sapiens
gaagctgcaggactttgccagcacc

SEQ ID NO: 3403 - DNA, 25 bp, Homo sapiens
gaaggagatcgagaacctcacccag

SEQ ID NO: 3404 - DNA, 25 bp, Homo sapiens
tcaagtccaagttcaagtccaccat

SEQ ID NO: 3405 - DNA, 25 bp, Homo sapiens
atcgcggcgctggaggccaagattg

SEQ ID NO: 3406 - DNA, 25 bp, Homo sapiens
ggaggagcaggtcgagcaggaggcc

SEQ ID NO: 3407 - DNA, 25 bp, Homo sapiens
gagcgcaagatggccgagcagtaca

SEQ ID NO: 3408 - DNA, 25 bp, Homo sapiens
ggcaatgccagggtcaagcagctca

SEQ ID NO: 3409 - DNA, 25 bp, Homo sapiens
aacgccaaccgcaggaagctgcagc

SEQ ID NO: 3410 - DNA, 25 bp, Homo sapiens
ggatgaggccacggagagcaacgag

SEQ ID NO: 3411 - DNA, 25 bp, Homo sapiens
caacgaggccatgggccgcgaggtg

SEQ ID NO: 3412 - DNA, 25 bp, Homo sapiens
gaaacttcgcagtgatgcaccaggc

SEQ ID NO: 3413 - DNA, 25 bp, Homo sapiens
gacactcgagacgcagacttcaatg

SEQ ID NO: 3414 - DNA, 25 bp, Homo sapiens
aactttctacagttttgcaccacgg

SEQ ID NO: 3415 - DNA, 25 bp, Homo sapiens
tgagccaggaagaacgctccagccc

SEQ ID NO: 3416 - DNA, 25 bp, Homo sapiens
ctccagcccaggacttcgaggctgc

SEQ ID NO: 3417 - DNA, 25 bp, Homo sapiens
ataattgcatcattgcactccagcc

SEQ ID NO: 3418 - DNA, 25 bp, Homo sapiens
acacatcctccagttctatcaatgg

SEQ ID NO: 3419 - DNA, 25 bp, Homo sapiens
gtccctggcaattctgtttacatga

SEQ ID NO: 3420 - DNA, 25 bp, Homo sapiens
aagtcaccgaaatgggtgccgccgg

SEQ ID NO: 3421 - DNA, 25 bp, Homo sapiens
tcaggcctttgagaattctttcccc

SEQ ID NO: 3422 - DNA, 25 bp, Homo sapiens
agttcaccaagtgccttctgtagtc

SEQ ID NO: 3423 - DNA, 25 bp, Homo sapiens
tgaaaaggagacgctgctcccacgg

SEQ ID NO: 3424 - DNA, 25 bp, Homo sapiens
aggaatgctgcactgtttacaccct

SEQ ID NO: 3425 - DNA, 25 bp, Homo sapiens
gtttacaccctgactgtgcttaaaa

SEQ ID NO: 3426 - DNA, 25 bp, Homo sapiens
aagagtcagctgatgccagaaggaa

SEQ ID NO: 3427 - DNA, 25 bp, Homo sapiens
gatgccagaaggaaagccgaaatgc

SEQ ID NO: 3428 - DNA, 25 bp, Homo sapiens
gaagcaaaaactcttttagctcaag

SEQ ID NO: 3429 - DNA, 25 bp, Homo sapiens
aactcttttagctcaagcaaatagc

SEQ ID NO: 3430 - DNA, 25 bp, Homo sapiens
gcaaatagcaagctgcaactgctca

SEQ ID NO: 3431 - DNA, 25 bp, Homo sapiens
gctgcaactgctcaaagatttagaa

SEQ ID NO: 3432 - DNA, 25 bp, Homo sapiens
aaagctcaagaattagcaagactgg

SEQ ID NO: 3433 - DNA, 25 bp, Homo sapiens
actggaaggagaagtccgttcactc

SEQ ID NO: 3434 - DNA, 25 bp, Homo sapiens
gaagtccgttcactcctaaaggata

SEQ ID NO: 3435 - DNA, 25 bp, Homo sapiens
agttgctgtgtatagcacatgcttg

SEQ ID NO: 3436 - DNA, 25 bp, Homo sapiens
atagcacatgcttgtaacagaggag

SEQ ID NO: 3437 - DNA, 25 bp, Homo sapiens
ctaacctttgtcttagctacctgtg

SEQ ID NO: 3438 - DNA, 25 bp, Homo sapiens
tgggcctttggatcgaatatggtca

SEQ ID NO: 3439 - DNA, 25 bp, Homo sapiens
gagggtgagggcaaaggctgacgaa

SEQ ID NO: 3440 - DNA, 25 bp, Homo sapiens
gcaggtgtgggcttacagacacatg

SEQ ID NO: 3441 - DNA, 25 bp, Homo sapiens
cacatggactgggctgggaggcgag

SEQ ID NO: 3442 - DNA, 25 bp, Homo sapiens
gagtgaccttgaccttgaccaagtc

SEQ ID NO: 3443 - DNA, 25 bp, Homo sapiens
gaccttgaccaagtcttgtccttgt

SEQ ID NO: 3444 - DNA, 25 bp, Homo sapiens
ggactgatttttcctattaggctag

SEQ ID NO: 3445 - DNA, 25 bp, Homo sapiens
gctagggtttggacctgatgttctc

SEQ ID NO: 3446 - DNA, 25 bp, Homo sapiens
ggctggccttgtggaatagatggtt

SEQ ID NO: 3447 - DNA, 25 bp, Homo sapiens
ttgcattccagccaagtgtgctgta

SEQ ID NO: 3448 - DNA, 25 bp, Homo sapiens
taaaggtttacttcaacttcagtgg

SEQ ID NO: 3449 - DNA, 25 bp, Homo sapiens
gaggtttggaacttatcagcaaggc

SEQ ID NO: 3450 - DNA, 25 bp, Homo sapiens
gttcaacaaagctattaacctggcc

SEQ ID NO: 3451 - DNA, 25 bp, Homo sapiens
ggagatggcccatctgtattcactt

SEQ ID NO: 3452 - DNA, 25 bp, Homo sapiens
cgcccatgcccagacagaagttgca

SEQ ID NO: 3453 - DNA, 25 bp, Homo sapiens
gaaagcagactgaccctctttttaa

SEQ ID NO: 3454 - DNA, 25 bp, Homo sapiens
ttctgtttgtggtgttgttatttgt

SEQ ID NO: 3455 - DNA, 25 bp, Homo sapiens
ttgttacatctgtttcatgtctagg

SEQ ID NO: 3456 - DNA, 25 bp, Homo sapiens
catgtctaggtgttgtgggtgtggc

SEQ ID NO: 3457 - DNA, 25 bp, Homo sapiens
aagtttgcagtcttgcagcttttat

SEQ ID NO: 3458 - DNA, 25 bp, Homo sapiens
tgcagcttttattccctgtgcaaca

SEQ ID NO: 3459 - DNA, 25 bp, Homo sapiens
tcgcccaccaaccaagtgttacaag

SEQ ID NO: 3460 - DNA, 25 bp, Homo sapiens
accaaccaagtgttacaagccccag

SEQ ID NO: 3461 - DNA, 25 bp, Homo sapiens
taccagctcatgaagacagccctca

SEQ ID NO: 3462 - DNA, 25 bp, Homo sapiens
gaagacagccctcaaggaagatggt

SEQ ID NO: 3463 - DNA, 25 bp, Homo sapiens
aaggaagatggtgtcctctgctgcc

SEQ ID NO: 3464 - DNA, 25 bp, Homo sapiens
ctctgctgccagggcgagtgcgagt

SEQ ID NO: 3465 - DNA, 25 bp, Homo sapiens
gagatgcggcagttctgccagtccc

SEQ ID NO: 3466 - DNA, 25 bp, Homo sapiens
ccgagcacgaacttccaggagccgg

SEQ ID NO: 3467 - DNA, 25 bp, Homo sapiens
ggtggcgcagatgcagctgaagtac

SEQ ID NO: 3468 - DNA, 25 bp, Homo sapiens
tgaagtactacaactccgacgtgca

SEQ ID NO: 3469 - DNA, 25 bp, Homo sapiens
tttgcccgcaaggccctgaatgatg

SEQ ID NO: 3470 - DNA, 25 bp, Homo sapiens
tcttctctgcattttgtccacatga

SEQ ID NO: 3471 - DNA, 25 bp, Homo sapiens
tgagaggattacctttccaagccaa

SEQ ID NO: 3472 - DNA, 25 bp, Homo sapiens
taaacttttttgctccactcaagcc

SEQ ID NO: 3473 - DNA, 25 bp, Homo sapiens
tcaagcctgttagaatcaccatgga

SEQ ID NO: 3474 - DNA, 25 bp, Homo sapiens
ggaatacagctccagtgggaaggcc

SEQ ID NO: 3475 - DNA, 25 bp, Homo sapiens
agctgatgtgcactttgagacccat

SEQ ID NO: 3476 - DNA, 25 bp, Homo sapiens
gaggatgctgttgcagcgatgctca

SEQ ID NO: 3477 - DNA, 25 bp, Homo sapiens
gcagcgatgctcaaggatcggtccc

SEQ ID NO: 3478 - DNA, 25 bp, Homo sapiens
ggtcccacgttcatcataggtatat

SEQ ID NO: 3479 - DNA, 25 bp, Homo sapiens
aagactctaggggctccagataata

SEQ ID NO: 3480 - DNA, 25 bp, Homo sapiens
tttgcacatctttcttggacttggg

SEQ ID NO: 3481 - DNA, 25 bp, Homo sapiens
accagcacttccggggtgacaatga

SEQ ID NO: 3482 - DNA, 25 bp, Homo sapiens
ggaatattactcacgcgcagatgcg

SEQ ID NO: 3483 - DNA, 25 bp, Homo sapiens
ggacgcgtctggatgaccgaatcat

SEQ ID NO: 3484 - DNA, 25 bp, Homo sapiens
ccgaatcattcgcacagactgggac

SEQ ID NO: 3485 - DNA, 25 bp, Homo sapiens
gggacgcaggctttaaggagggcag

SEQ ID NO: 3486 - DNA, 25 bp, Homo sapiens
caatacggccgtgggcgatctgggg

SEQ ID NO: 3487 - DNA, 25 bp, Homo sapiens
ggggccaggttcgggatgagtatcg

SEQ ID NO: 3488 - DNA, 25 bp, Homo sapiens
gagtggtgagagctctgtcagtgac

SEQ ID NO: 3489 - DNA, 25 bp, Homo sapiens
cagtgacaaacactcctttggcctg

SEQ ID NO: 3490 - DNA, 25 bp, Homo sapiens
gaacatcacctaaagtctgcacacg

SEQ ID NO: 3491 - DNA, 25 bp, Homo sapiens
cacgagcccatttttaccaagattt

SEQ ID NO: 3492 - DNA, 25 bp, Homo sapiens
gagggacgccaataggcatgccgcc

SEQ ID NO: 3493 - DNA, 25 bp, Homo sapiens
ccaccaggcattagaggtccacctc

SEQ ID NO: 3494 - DNA, 25 bp, Homo sapiens
gaccttagcatactgttgatccatc

SEQ ID NO: 3495 - DNA, 25 bp, Homo sapiens
tttcccctgcaatgcgtcttgtgaa

SEQ ID NO: 3496 - DNA, 25 bp, Homo sapiens
agtgtttgtgagctttttgttccct

SEQ ID NO: 3497 - DNA, 25 bp, Homo sapiens
ttgttccctcattctgcattaataa

SEQ ID NO: 3498 - DNA, 25 bp, Homo sapiens
agatactggcattgctcgggtacca

SEQ ID NO: 3499 - DNA, 25 bp, Homo sapiens
taccacttgctggagctgctggagg

SEQ ID NO: 3500 - DNA, 25 bp, Homo sapiens
ggaccatcccagcaggtaatgactc

SEQ ID NO: 3501 - DNA, 25 bp, Homo sapiens
aagaggcactgtagcagctgctgct

SEQ ID NO: 3502 - DNA, 25 bp, Homo sapiens
tattgctggagccccaacacagtac

SEQ ID NO: 3503 - DNA, 25 bp, Homo sapiens
gctggcagaaccagttcctggcatc

SEQ ID NO: 3504 - DNA, 25 bp, Homo sapiens
gcaacgcccgttattttcatgtggt

SEQ ID NO: 3505 - DNA, 25 bp, Homo sapiens
ctcaggattccccctttgagggagg

SEQ ID NO: 3506 - DNA, 25 bp, Homo sapiens
agaagaatacccaatggcagcccct

SEQ ID NO: 3507 - DNA, 25 bp, Homo sapiens
cagcccctaaagtacgtttcatgac

SEQ ID NO: 3508 - DNA, 25 bp, Homo sapiens
gatccgcacagttctgctatcgatc

SEQ ID NO: 3509 - DNA, 25 bp, Homo sapiens
gctatcgatccaggccttgttaagt

SEQ ID NO: 3510 - DNA, 25 bp, Homo sapiens
taagtgctcccaatccagatgatcc

SEQ ID NO: 3511 - DNA, 25 bp, Homo sapiens
gaccaacgaagcccaagccatagaa

SEQ ID NO: 3512 - DNA, 25 bp, Homo sapiens
tcaagtgtgcatcacttctcctgtt

SEQ ID NO: 3513 - DNA, 25 bp, Homo sapiens
ttcctcctctttgtttgcatttaat

SEQ ID NO: 3514 - DNA, 25 bp, Homo sapiens
acattaaacaaacatcacagccctc

SEQ ID NO: 3515 - DNA, 25 bp, Homo sapiens
atcacagccctcactaataacattg

SEQ ID NO: 3516 - DNA, 25 bp, Homo sapiens
attgctgtcaagtgtagattccccc

SEQ ID NO: 3517 - DNA, 25 bp, Homo sapiens
gtatggcttgtctggaaacttctgt

SEQ ID NO: 3518 - DNA, 25 bp, Homo sapiens
aaaagcccagacatcttcagtcctt

SEQ ID NO: 3519 - DNA, 25 bp, Homo sapiens
gacatcttcagtcctttggtgatta

SEQ ID NO: 3520 - DNA, 25 bp, Homo sapiens
tctatgtcttgtcctgattcactgt

SEQ ID NO: 3521 - DNA, 25 bp, Homo sapiens
ggtagttgtcaggttagctgcaggg

SEQ ID NO: 3522 - DNA, 25 bp, Homo sapiens
agctgcaggggtgtgggtgttttta

SEQ ID NO: 3523 - DNA, 25 bp, Homo sapiens
tcccccttttttggtgatctaattg

SEQ ID NO: 3524 - DNA, 25 bp, Homo sapiens
atatgctctagccaagtctaacttt

SEQ ID NO: 3525 - DNA, 25 bp, Homo sapiens
gcagtgctgctggtatttgccaaca

SEQ ID NO: 3526 - DNA, 25 bp, Homo sapiens
tgcccgtgagcgagctgactgacaa

SEQ ID NO: 3527 - DNA, 25 bp, Homo sapiens
tgccacccaaggcacaggtctgtac

SEQ ID NO: 3528 - DNA, 25 bp, Homo sapiens
gtacgatggtctggactggctgtcc

SEQ ID NO: 3529 - DNA, 25 bp, Homo sapiens
tcccacgagctgtcaaagcgctaac

SEQ ID NO: 3530 - DNA, 25 bp, Homo sapiens
ctgcgtgcatccccgggatgaccag

SEQ ID NO: 3531 - DNA, 25 bp, Homo sapiens
tctctgttgttggagcctggagcct

SEQ ID NO: 3532 - DNA, 25 bp, Homo sapiens
gccttgctctctgggcacagagggg

SEQ ID NO: 3533 - DNA, 25 bp, Homo sapiens
gcctgctgggacctatggaaggggc

SEQ ID NO: 3534 - DNA, 25 bp, Homo sapiens
gccccctcttccagaggaggagcag

SEQ ID NO: 3535 - DNA, 25 bp, Homo sapiens
gtgtactctaggggccaggttggga

SEQ ID NO: 3536 - DNA, 25 bp, Homo sapiens
gtgaagcccgtggactacagagagt

SEQ ID NO: 3537 - DNA, 25 bp, Homo sapiens
ggccgaaggctggtcatgagcatca

SEQ ID NO: 3538 - DNA, 25 bp, Homo sapiens
cgtgtgacgatcccatgttagctac

SEQ ID NO: 3539 - DNA, 25 bp, Homo sapiens
gcatctcagaacccatcggtaggca

SEQ ID NO: 3540 - DNA, 25 bp, Homo sapiens
aaatacgctcaggtggttgtggtgt

SEQ ID NO: 3541 - DNA, 25 bp, Homo sapiens
tgtgtcaggcctacggagtcagcca

SEQ ID NO: 3542 - DNA, 25 bp, Homo sapiens
agccagtggctagcgcaagaccagt

SEQ ID NO: 3543 - DNA, 25 bp, Homo sapiens
tcaggcttctgtcaatttcattatc

SEQ ID NO: 3544 - DNA, 25 bp, Homo sapiens
gtaagtcactgaccctaactgcaga

SEQ ID NO: 3545 - DNA, 25 bp, Homo sapiens
gtaactaggtttttgcttctccagt

SEQ ID NO: 3546 - DNA, 25 bp, Homo sapiens
gctcacaacttgggttcttctcagc

SEQ ID NO: 3547 - DNA, 25 bp, Homo sapiens
gatttagctcttagttcttcaagta

SEQ ID NO: 3548 - DNA, 25 bp, Homo sapiens
gaacaggaactcagggtgcccttac

SEQ ID NO: 3549 - DNA, 25 bp, Homo sapiens
tgactgacagagcaccatccaggca

SEQ ID NO: 3550 - DNA, 25 bp, Homo sapiens
aaagcagtatacctttccacaggct

SEQ ID NO: 3551 - DNA, 25 bp, Homo sapiens
tccctgccactctgagttatccaga

SEQ ID NO: 3552 - DNA, 25 bp, Homo sapiens
gaaaccaccacctacaaatgagggg

SEQ ID NO: 3553 - DNA, 25 bp, Homo sapiens
aggggactcatctagaagacctcta

SEQ ID NO: 3554 - DNA, 25 bp, Homo sapiens
ccttttggctctgaggggtctctaa

SEQ ID NO: 3555 - DNA, 25 bp, Homo sapiens
gggtctctaataatccccacttgga

SEQ ID NO: 3556 - DNA, 25 bp, Homo sapiens
cccacttggaattcagcaccgcaag

SEQ ID NO: 3557 - DNA, 25 bp, Homo sapiens
gaatgttggtgccttttgtgccaca

SEQ ID NO: 3558 - DNA, 25 bp, Homo sapiens
gctgctctggaatatttcccttcga

SEQ ID NO: 3559 - DNA, 25 bp, Homo sapiens
atcttatctcagtcacttcgttttt

SEQ ID NO: 3560 - DNA, 25 bp, Homo sapiens
tagtgttggcaagcccaagccactc

SEQ ID NO: 3561 - DNA, 25 bp, Homo sapiens
cactcgtgctaactgctttttgtct

SEQ ID NO: 3562 - DNA, 25 bp, Homo sapiens
ctttttgtctcggttgctattccaa

SEQ ID NO: 3563 - DNA, 25 bp, Homo sapiens
gttggccaattacagcgtgtgtgca

SEQ ID NO: 3564 - DNA, 25 bp, Homo sapiens
cctctcagaaacgcggccagaagac

SEQ ID NO: 3565 - DNA, 25 bp, Homo sapiens
ggaagtgaaaggtcccaggcacaca

SEQ ID NO: 3566 - DNA, 25 bp, Homo sapiens
gcccattgcaggtggctcttacagc

SEQ ID NO: 3567 - DNA, 25 bp, Homo sapiens
gccagcacgggatccctgaagtgac

SEQ ID NO: 3568 - DNA, 25 bp, Homo sapiens
cagccctcacatgtgtatgcacatt

SEQ ID NO: 3569 - DNA, 25 bp, Homo sapiens
gcatcacatacctgggcatcaaggc

SEQ ID NO: 3570 - DNA, 25 bp, Homo sapiens
gcatcaaggccaacgacacacagga

SEQ ID NO: 3571 - DNA, 25 bp, Homo sapiens
caacctcagcgcttactttgaaagg

SEQ ID NO: 3572 - DNA, 25 bp, Homo sapiens
tgccgacttcattgaccaggctttg

SEQ ID NO: 3573 - DNA, 25 bp, Homo sapiens
caaaagaatggccgggtgctcgtcc

SEQ ID NO: 3574 - DNA, 25 bp, Homo sapiens
ctgccgggaaggttatagccgctcc

SEQ ID NO: 3575 - DNA, 25 bp, Homo sapiens
ttatcgcctacctcatgatgcggca

SEQ ID NO: 3576 - DNA, 25 bp, Homo sapiens
gaagatggacgtcaagtctgccctg

SEQ ID NO: 3577 - DNA, 25 bp, Homo sapiens
ttaggaaacacactgtaccctgctc

SEQ ID NO: 3578 - DNA, 25 bp, Homo sapiens
caagtgtgtcccaacacagtcctgg

SEQ ID NO: 3579 - DNA, 25 bp, Homo sapiens
ctgtaacttatgatgtcttttccct

SEQ ID NO: 3580 - DNA, 25 bp, Homo sapiens
tgaagtgcaacaaggccatcacatc

SEQ ID NO: 3581 - DNA, 25 bp, Homo sapiens
ggccatcacatctggaggaatcact

SEQ ID NO: 3582 - DNA, 25 bp, Homo sapiens
aggaatcacttaccaggatcagccc

SEQ ID NO: 3583 - DNA, 25 bp, Homo sapiens
cacttaccaggatcagccctggcat

SEQ ID NO: 3584 - DNA, 25 bp, Homo sapiens
agaagctggctgggcagcgtttcac

SEQ ID NO: 3585 - DNA, 25 bp, Homo sapiens
agcgtttcaccgctgtggaggacca

SEQ ID NO: 3586 - DNA, 25 bp, Homo sapiens
gtttcaccgctgtggaggaccagta

SEQ ID NO: 3587 - DNA, 25 bp, Homo sapiens
gctgtggaggaccagtattactgcg

SEQ ID NO: 3588 - DNA, 25 bp, Homo sapiens
ccagtattactgcgtggattgctac

SEQ ID NO: 3589 - DNA, 25 bp, Homo sapiens
tactgcgtggattgctacaagaact

SEQ ID NO: 3590 - DNA, 25 bp, Homo sapiens
ctggatgcaagaaccccatcactgg

SEQ ID NO: 3591 - DNA, 25 bp, Homo sapiens
cagggctgtcatcaacatggatatg

SEQ ID NO: 3592 - DNA, 25 bp, Homo sapiens
gtgactagttgaatcccttgtaacg

SEQ ID NO: 3593 - DNA, 25 bp, Homo sapiens
aacgtagtagttgtctgctctttgt

SEQ ID NO: 3594 - DNA, 25 bp, Homo sapiens
tgcaaagtcccttctgttgtgattc

SEQ ID NO: 3595 - DNA, 25 bp, Homo sapiens
tcccttctgttgtgattcccaggac

SEQ ID NO: 3596 - DNA, 25 bp, Homo sapiens
ttcccaggacttttcctcaagagga

SEQ ID NO: 3597 - DNA, 25 bp, Homo sapiens
cacctaccgcttacctgaaatgcag

SEQ ID NO: 3598 - DNA, 25 bp, Homo sapiens
ggatcacctacttactgtattctac

SEQ ID NO: 3599 - DNA, 25 bp, Homo sapiens
gaagctgatgcctcatttctacatt

SEQ ID NO: 3600 - DNA, 25 bp, Homo sapiens
atgcctcatttctacattctgtcat

SEQ ID NO: 3601 - DNA, 25 bp, Homo sapiens
gctattatcatctaacgtttcagtg

SEQ ID NO: 3602 - DNA, 25 bp, Homo sapiens
aatgcaggcaaaaccactcttcttc

SEQ ID NO: 3603 - DNA, 25 bp, Homo sapiens
ccactcttcttcacatgctcaaaga

SEQ ID NO: 3604 - DNA, 25 bp, Homo sapiens
gattgggccaacatgttccaacact

SEQ ID NO: 3605 - DNA, 25 bp, Homo sapiens
tccaacactacatccgacatcagaa

SEQ ID NO: 3606 - DNA, 25 bp, Homo sapiens
acttttgatcttggtgggcacgagc

SEQ ID NO: 3607 - DNA, 25 bp, Homo sapiens
cgagcaagcacgtcgcgtttggaaa

SEQ ID NO: 3608 - DNA, 25 bp, Homo sapiens
gtggactgtgcagatcattctcgcc

SEQ ID NO: 3609 - DNA, 25 bp, Homo sapiens
caatatccaatgtgccaatccttat

SEQ ID NO: 3610 - DNA, 25 bp, Homo sapiens
tgaaggagctgaatgctcgccccat

SEQ ID NO: 3611 - DNA, 25 bp, Homo sapiens
ggaagtgttcatgtgcagtgtgctc

SEQ ID NO: 3612 - DNA, 25 bp, Homo sapiens
gctggctctcccagtatattgactg

SEQ ID NO: 3613 - DNA, 25 bp, Homo sapiens
tacccccctacttaatgtaattcag

SEQ ID NO: 3614 - DNA, 25 bp, Homo sapiens
ggactccaaccaagaggatttcttc

SEQ ID NO: 3615 - DNA, 25 bp, Homo sapiens
caggactggtactcaagccagcctg

SEQ ID NO: 3616 - DNA, 25 bp, Homo sapiens
aagccagcctgtaaacggtgctatt

SEQ ID NO: 3617 - DNA, 25 bp, Homo sapiens
ggtgctatttctattccttatggga

SEQ ID NO: 3618 - DNA, 25 bp, Homo sapiens
gggatcatttttccaggactctttg

SEQ ID NO: 3619 - DNA, 25 bp, Homo sapiens
gggttcccaccaatttggaaggcat

SEQ ID NO: 3620 - DNA, 25 bp, Homo sapiens
tgaagcttgcaccttttcatgtaca

SEQ ID NO: 3621 - DNA, 25 bp, Homo sapiens
taagagtccaactcacttccagtgc

SEQ ID NO: 3622 - DNA, 25 bp, Homo sapiens
ccttgtttactctgttaccacattg

SEQ ID NO: 3623 - DNA, 25 bp, Homo sapiens
acttctatgttggtttcagtggctg

SEQ ID NO: 3624 - DNA, 25 bp, Homo sapiens
cctgttctgcgctgtgtacaatgtg

SEQ ID NO: 3625 - DNA, 25 bp, Homo sapiens
gttctgcgctgtgtacaatgtgaga

SEQ ID NO: 3626 - DNA, 25 bp, Homo sapiens
tgtacaatgtgagatcggtgcgttc

SEQ ID NO: 3627 - DNA, 25 bp, Homo sapiens
acaatgtgagatcggtgcgttctcc

SEQ ID NO: 3628 - DNA, 25 bp, Homo sapiens
gcttggggattgtacacgggaccag

SEQ ID NO: 3629 - DNA, 25 bp, Homo sapiens
tggggattgtacacgggaccagctc

SEQ ID NO: 3630 - DNA, 25 bp, Homo sapiens
tacacgggaccagctcacgtaatgc

SEQ ID NO: 3631 - DNA, 25 bp, Homo sapiens
ggaccagctcacgtaatgcattgcc

SEQ ID NO: 3632 - DNA, 25 bp, Homo sapiens
ccagctcacgtaatgcattgcctgt

SEQ ID NO: 3633 - DNA, 25 bp, Homo sapiens
gctcacgtaatgcattgcctgtaac

SEQ ID NO: 3634 - DNA, 25 bp, Homo sapiens
cacgtaatgcattgcctgtaacaat

SEQ ID NO: 3635 - DNA, 25 bp, Homo sapiens
aacttgacacttacctccagtagaa

SEQ ID NO: 3636 - DNA, 25 bp, Homo sapiens
catccacttcacaagccttgtttct

SEQ ID NO: 3637 - DNA, 25 bp, Homo sapiens
gacagtgttctgctttttaatccta

SEQ ID NO: 3638 - DNA, 25 bp, Homo sapiens
attctcacttttgttgactgccaac

SEQ ID NO: 3639 - DNA, 25 bp, Homo sapiens
tcaaaatcagtcactcccttcagaa

SEQ ID NO: 3640 - DNA, 25 bp, Homo sapiens
gcagacatggcatctgttccttgct

SEQ ID NO: 3641 - DNA, 25 bp, Homo sapiens
tcaggagccatatcacatctgtccc

SEQ ID NO: 3642 - DNA, 25 bp, Homo sapiens
catctgtcccttggggagatcccag

SEQ ID NO: 3643 - DNA, 25 bp, Homo sapiens
tcccagctatggcacagccgtttgt

SEQ ID NO: 3644 - DNA, 25 bp, Homo sapiens
cagccgtttgtatcctcggaagaac

SEQ ID NO: 3645 - DNA, 25 bp, Homo sapiens
ggagcagattcctttgacaacatca

SEQ ID NO: 3646 - DNA, 25 bp, Homo sapiens
atttggagacactccaccacaaact

SEQ ID NO: 3647 - DNA, 25 bp, Homo sapiens
ttagaggtagcttgccatctctcag

SEQ ID NO: 3648 - DNA, 25 bp, Homo sapiens
ctcaccattgtgtccattcactgtg

SEQ ID NO: 3649 - DNA, 25 bp, Homo sapiens
tagccacgactttatcaggcagccc

SEQ ID NO: 3650 - DNA, 25 bp, Homo sapiens
ggcagccccaaactggtgcataatg

SEQ ID NO: 3651 - DNA, 25 bp, Homo sapiens
gtttcaatttagtctatcctggata

SEQ ID NO: 3652 - DNA, 25 bp, Homo sapiens
aagtcactacagattttgctatatt

SEQ ID NO: 3653 - DNA, 25 bp, Homo sapiens
aaaagcatttatccttcataccaat

SEQ ID NO: 3654 - DNA, 25 bp, Homo sapiens
ggagtgagcgttttctcaagacctt

SEQ ID NO: 3655 - DNA, 25 bp, Homo sapiens
aagaccttcctcaagcattttatct

SEQ ID NO: 3656 - DNA, 25 bp, Homo sapiens
aaactgatgggcacctgatactctg

SEQ ID NO: 3657 - DNA, 25 bp, Homo sapiens
aatggatcaactctaggatttaggc

SEQ ID NO: 3658 - DNA, 25 bp, Homo sapiens
tgttgtgttttgaatctctccagag

SEQ ID NO: 3659 - DNA, 25 bp, Homo sapiens
gaatctctccagagttgcatgtaga

SEQ ID NO: 3660 - DNA, 25 bp, Homo sapiens
aatgattcaccaatttcttgcatta

SEQ ID NO: 3661 - DNA, 25 bp, Homo sapiens
gaggggagcatccattattggtaca

SEQ ID NO: 3662 - DNA, 25 bp, Homo sapiens
attattggtacatgtgggcttttaa

SEQ ID NO: 3663 - DNA, 25 bp, Homo sapiens
aaactccatcctttataaatagtca

SEQ ID NO: 3664 - DNA, 25 bp, Homo sapiens
aatagtcaaggtttgggccacacaa

SEQ ID NO: 3665 - DNA, 25 bp, Homo sapiens
tttcaactcctcaagccgtaatgtt

SEQ ID NO: 3666 - DNA, 25 bp, Homo sapiens
atctttggaacatcagcaccagtat

SEQ ID NO: 3667 - DNA, 25 bp, Homo sapiens
agcaccagtatattgctggcagcta

SEQ ID NO: 3668 - DNA, 25 bp, Homo sapiens
gaatctgacgcggatgcggcatgtg

SEQ ID NO: 3669 - DNA, 25 bp, Homo sapiens
gtgatcagctacagcttgtcaccgt

SEQ ID NO: 3670 - DNA, 25 bp, Homo sapiens
ctatccgcacgtcttcactaaagga

SEQ ID NO: 3671 - DNA, 25 bp, Homo sapiens
taaaggaatccccaatgttctgcgc

SEQ ID NO: 3672 - DNA, 25 bp, Homo sapiens
cgcattcgggagtctttctttcgcg

SEQ ID NO: 3673 - DNA, 25 bp, Homo sapiens
tggtgccgcagtttgtagtgtttta

SEQ ID NO: 3674 - DNA, 25 bp, Homo sapiens
agaggaggatccagctgcctatgaa

SEQ ID NO: 3675 - DNA, 25 bp, Homo sapiens
aaatgagcaacgcatccggatgacg

SEQ ID NO: 3676 - DNA, 25 bp, Homo sapiens
tgtctctgaaagacctttctctgga

SEQ ID NO: 3677 - DNA, 25 bp, Homo sapiens
ttggttcagttttccggagggcgag

SEQ ID NO: 3678 - DNA, 25 bp, Homo sapiens
tgggccgcgagtttgggaatctgac

SEQ ID NO: 3679 - DNA, 25 bp, Homo sapiens
ggcgcctgcatcgtgaattcagaaa

SEQ ID NO: 3680 - DNA, 25 bp, Homo sapiens
cagtgatgacgtgttgccttggaga

SEQ ID NO: 3681 - DNA, 25 bp, Homo sapiens
caccaaatacccgtacgtgtgccat

SEQ ID NO: 3682 - DNA, 25 bp, Homo sapiens
gaatgcgctaagctcatcatccagg

SEQ ID NO: 3683 - DNA, 25 bp, Homo sapiens
taagctcatcatccaggcaggtata

SEQ ID NO: 3684 - DNA, 25 bp, Homo sapiens
agtgacgaggcaactgctgcgaggc

SEQ ID NO: 3685 - DNA, 25 bp, Homo sapiens
gcgaggctcctgtttaatatggccg

SEQ ID NO: 3686 - DNA, 25 bp, Homo sapiens
atatggccggggtgacattccggaa

SEQ ID NO: 3687 - DNA, 25 bp, Homo sapiens
gcagaccgagtcaaaagcttcagtg

SEQ ID NO: 3688 - DNA, 25 bp, Homo sapiens
agtgagttacatctcattcaatctc

SEQ ID NO: 3689 - DNA, 25 bp, Homo sapiens
gaggttgctaatgcctttcatcttg

SEQ ID NO: 3690 - DNA, 25 bp, Homo sapiens
aatggctttaaccttggccgctatt

SEQ ID NO: 3691 - DNA, 25 bp, Homo sapiens
taaccttggccgctattggccagcc

SEQ ID NO: 3692 - DNA, 25 bp, Homo sapiens
accatcaccgtgctggaactggagt

SEQ ID NO: 3693 - DNA, 25 bp, Homo sapiens
gggcaccctgcagcagtgatgatcc

SEQ ID NO: 3694 - DNA, 25 bp, Homo sapiens
actatgtgctgtgacgttcgtggac

SEQ ID NO: 3695 - DNA, 25 bp, Homo sapiens
gacgttcgtggacaggccagttatt

SEQ ID NO: 3696 - DNA, 25 bp, Homo sapiens
gttattggctcatctgtgacctacg

SEQ ID NO: 3697 - DNA, 25 bp, Homo sapiens
gatgaaagcctgtgtctttgaggga

SEQ ID NO: 3698 - DNA, 25 bp, Homo sapiens
attctaccctgaacatacctcacag

SEQ ID NO: 3699 - DNA, 25 bp, Homo sapiens
ctgtcatgccacatttcactgattg

SEQ ID NO: 3700 - DNA, 25 bp, Homo sapiens
gtgcattttcacctgaggtttccct

SEQ ID NO: 3701 - DNA, 25 bp, Homo sapiens
gattccgccttgttggtctgaaatt

SEQ ID NO: 3702 - DNA, 25 bp, Homo sapiens
gcaagcttccgaagatcttctcaag

SEQ ID NO: 3703 - DNA, 25 bp, Homo sapiens
gaacactacgttgacctgaaggacc

SEQ ID NO: 3704 - DNA, 25 bp, Homo sapiens
ctgaaggaccgtccattctttgccg

SEQ ID NO: 3705 - DNA, 25 bp, Homo sapiens
ttctttgccggcctggtgaaataca

SEQ ID NO: 3706 - DNA, 25 bp, Homo sapiens
ggtgaagacgggccgagtcatgctc

SEQ ID NO: 3707 - DNA, 25 bp, Homo sapiens
agtcatgctcggggagaccaaccct

SEQ ID NO: 3708 - DNA, 25 bp, Homo sapiens
catccgtggagacttctgcatacaa

SEQ ID NO: 3709 - DNA, 25 bp, Homo sapiens
aaggagatcggcttgtggtttcacc

SEQ ID NO: 3710 - DNA, 25 bp, Homo sapiens
gtggtttcaccctgaggaactggta

SEQ ID NO: 3711 - DNA, 25 bp, Homo sapiens
gttctccctgtacagtgttaccatc

SEQ ID NO: 3712 - DNA, 25 bp, Homo sapiens
gtattttggcagcttgtttaggtga

SEQ ID NO: 3713 - DNA, 25 bp, Homo sapiens
gtgacttccttaagaggtgtttcct

SEQ ID NO: 3714 - DNA, 25 bp, Homo sapiens
gtttcctgaacctaattctcataat

SEQ ID NO: 3715 - DNA, 25 bp, Homo sapiens
ataccttatcctaaagagctcataa

SEQ ID NO: 3716 - DNA, 25 bp, Homo sapiens
aacaaataagttacctccactctat

SEQ ID NO: 3717 - DNA, 25 bp, Homo sapiens
acctccactctataaactcagacct

SEQ ID NO: 3718 - DNA, 25 bp, Homo sapiens
aaactcagacctactttttgaagat

SEQ ID NO: 3719 - DNA, 25 bp, Homo sapiens
agataactgcttttaacctctcctt

SEQ ID NO: 3720 - DNA, 25 bp, Homo sapiens
taacctctccttacaagatttttgt

SEQ ID NO: 3721 - DNA, 25 bp, Homo sapiens
atttaattttagcccatgtctcaat

SEQ ID NO: 3722 - DNA, 25 bp, Homo sapiens
ttagcccatgtctcaattctcattt

SEQ ID NO: 3723 - DNA, 25 bp, Homo sapiens
agatctccatttcttcaagtgttta

SEQ ID NO: 3724 - DNA, 25 bp, Homo sapiens
tattacagacatcattttgcccggc

SEQ ID NO: 3725 - DNA, 25 bp, Homo sapiens
ttcatgggccaccagagccagtact

SEQ ID NO: 3726 - DNA, 25 bp, Homo sapiens
cttggtgagaccatagcccagtggc

SEQ ID NO: 3727 - DNA, 25 bp, Homo sapiens
aaagctggctaccaggacatgcccg

SEQ ID NO: 3728 - DNA, 25 bp, Homo sapiens
aaaacttcaagcaccttctgcaggc

SEQ ID NO: 3729 - DNA, 25 bp, Homo sapiens
ttcccgatgccacgttacatcaaca

SEQ ID NO: 3730 - DNA, 25 bp, Homo sapiens
atggaggcagtcaggctcgattcct

SEQ ID NO: 3731 - DNA, 25 bp, Homo sapiens
aaagtgaacccatctcagacacaca

SEQ ID NO: 3732 - DNA, 25 bp, Homo sapiens
ggagcacccatcctaactgatgatg

SEQ ID NO: 3733 - DNA, 25 bp, Homo sapiens
gttagcctgcaggtgttcatggacc

SEQ ID NO: 3734 - DNA, 25 bp, Homo sapiens
tccgagccaggtcaggcttcggagg

SEQ ID NO: 3735 - DNA, 25 bp, Homo sapiens
gtggcagaggggccactacccaagg

SEQ ID NO: 3736 - DNA, 25 bp, Homo sapiens
cccaaggtctagctaggcccaagac

SEQ ID NO: 3737 - DNA, 25 bp, Homo sapiens
ccaagacctagttacccagacagtg

SEQ ID NO: 3738 - DNA, 25 bp, Homo sapiens
catgtatcacatgtcttcagaagca

SEQ ID NO: 3739 - DNA, 25 bp, Homo sapiens
tcatgtaaccgagtgtcctcttgcg

SEQ ID NO: 3740 - DNA, 25 bp, Homo sapiens
gtcctcttgcgtgtccaaaagtagc

SEQ ID NO: 3741 - DNA, 25 bp, Homo sapiens
ggctgtagcacaggcttcacagtga

SEQ ID NO: 3742 - DNA, 25 bp, Homo sapiens
gtgattttgtgttcagccgtgagtc

SEQ ID NO: 3743 - DNA, 25 bp, Homo sapiens
tcagccgtgagtcacactacatgcc

SEQ ID NO: 3744 - DNA, 25 bp, Homo sapiens
gtgacgtccaggttgtccttgagta

SEQ ID NO: 3745 - DNA, 25 bp, Homo sapiens
ttttattggtactccagtccaggca

SEQ ID NO: 3746 - DNA, 25 bp, Homo sapiens
gacactggacaaccatattgcaatc

SEQ ID NO: 3747 - DNA, 25 bp, Homo sapiens
gcaatcagatctacagctcctggat

SEQ ID NO: 3748 - DNA, 25 bp, Homo sapiens
gctcctggataattgcttgattctc

SEQ ID NO: 3749 - DNA, 25 bp, Homo sapiens
gcttgattctcgccagagactgtca

SEQ ID NO: 3750 - DNA, 25 bp, Homo sapiens
atgtttcattcattgccattaccaa

SEQ ID NO: 3751 - DNA, 25 bp, Homo sapiens
gtttccattgtaatcttgacacatg

SEQ ID NO: 3752 - DNA, 25 bp, Homo sapiens
cagctgcttattactgtggcattca

SEQ ID NO: 3753 - DNA, 25 bp, Homo sapiens
tcaacctaccccgatctatggattt

SEQ ID NO: 3754 - DNA, 25 bp, Homo sapiens
gtgaaccaactcaagctctggaact

SEQ ID NO: 3755 - DNA, 25 bp, Homo sapiens
aagatggcattgttccacttcgtta

SEQ ID NO: 3756 - DNA, 25 bp, Homo sapiens
cgctacgccctacagatggagcagc

SEQ ID NO: 3757 - DNA, 25 bp, Homo sapiens
agcagctcaacgggatcctgctgca

SEQ ID NO: 3758 - DNA, 25 bp, Homo sapiens
tcctgctgcaccttgagtcagagct

SEQ ID NO: 3759 - DNA, 25 bp, Homo sapiens
gaggccctgctgaacatcaaggtca

SEQ ID NO: 3760 - DNA, 25 bp, Homo sapiens
aagctggaggctgagatcgccacct

SEQ ID NO: 3761 - DNA, 25 bp, Homo sapiens
tgatgccttggacagcagcaactcc

SEQ ID NO: 3762 - DNA, 25 bp, Homo sapiens
ccaccacccgccggatagtggatgg

SEQ ID NO: 3763 - DNA, 25 bp, Homo sapiens
gagagcaccacagtggtcaccacac

SEQ ID NO: 3764 - DNA, 25 bp, Homo sapiens
gtcaccacacagtctgctgaggttg

SEQ ID NO: 3765 - DNA, 25 bp, Homo sapiens
gagctgctgagacgacgctcacaga

SEQ ID NO: 3766 - DNA, 25 bp, Homo sapiens
tgagacgtacagtccagtccttgga

SEQ ID NO: 3767 - DNA, 25 bp, Homo sapiens
tccctgaacccctcttggattaagg

SEQ ID NO: 3768 - DNA, 25 bp, Homo sapiens
gaagactgaagactagccccttttc

SEQ ID NO: 3769 - DNA, 25 bp, Homo sapiens
ctcctccctgtgttaactggggctg

SEQ ID NO: 3770 - DNA, 25 bp, Homo sapiens
tggggacagtgcgtgatttctcagt

SEQ ID NO: 3771 - DNA, 25 bp, Homo sapiens
agtgatttcctacagtgttgttccc

SEQ ID NO: 3772 - DNA, 25 bp, Homo sapiens
cctggctacatcaaacttcgcaaga

SEQ ID NO: 3773 - DNA, 25 bp, Homo sapiens
gatcgccacatcacagaatcgtatc

SEQ ID NO: 3774 - DNA, 25 bp, Homo sapiens
gaatcgtatctatctcacagctgac

SEQ ID NO: 3775 - DNA, 25 bp, Homo sapiens
ctgacaaccttgtgctgaacctaca

SEQ ID NO: 3776 - DNA, 25 bp, Homo sapiens
tgagcctagtcaccaagaactccac

SEQ ID NO: 3777 - DNA, 25 bp, Homo sapiens
gaggaagtggatctgcttctccagt

SEQ ID NO: 3778 - DNA, 25 bp, Homo sapiens
ggaagggtgttttggtaagcaggat

SEQ ID NO: 3779 - DNA, 25 bp, Homo sapiens
gtaagcaggattttaagtcctctct

SEQ ID NO: 3780 - DNA, 25 bp, Homo sapiens
ggttatgctcttactaccaagctca

SEQ ID NO: 3781 - DNA, 25 bp, Homo sapiens
gaactgtatgaatggtaggtctgaa

SEQ ID NO: 3782 - DNA, 25 bp, Homo sapiens
atttccatggtcttatgtggaggta

SEQ ID NO: 3783 - DNA, 25 bp, Homo sapiens
actgcaacatgttctggttgcacaa

SEQ ID NO: 3784 - DNA, 25 bp, Homo sapiens
ggttgcacaacagttaggcatgcta

SEQ ID NO: 3785 - DNA, 25 bp, Homo sapiens
tgtgaagtttggatgcctgtgaaga

SEQ ID NO: 3786 - DNA, 25 bp, Homo sapiens
gaacagctactgtgctatattgatt

SEQ ID NO: 3787 - DNA, 25 bp, Homo sapiens
gtagtattgagcagaccttgtttct

SEQ ID NO: 3788 - DNA, 25 bp, Homo sapiens
gaaactagttgcaaaacccactatt

SEQ ID NO: 3789 - DNA, 25 bp, Homo sapiens
acattatgtggagccctatctttac

SEQ ID NO: 3790 - DNA, 25 bp, Homo sapiens
tacatttcacatacctatatttatc

SEQ ID NO: 3791 - DNA, 25 bp, Homo sapiens
gtctaaaactgttgtgctagccaaa

SEQ ID NO: 3792 - DNA, 25 bp, Homo sapiens
catttgcagaattaacccgtgagtt

SEQ ID NO: 3793 - DNA, 25 bp, Homo sapiens
aatgcactgttattgccatgtgaag

SEQ ID NO: 3794 - DNA, 25 bp, Homo sapiens
agaggcatcgactttgataccacca

SEQ ID NO: 3795 - DNA, 25 bp, Homo sapiens
gataccaccatcatgttcagaccat

SEQ ID NO: 3796 - DNA, 25 bp, Homo sapiens
gtacatagtgacgatggcttttatt

SEQ ID NO: 3797 - DNA, 25 bp, Homo sapiens
atactacatctttctggcacataac

SEQ ID NO: 3798 - DNA, 25 bp, Homo sapiens
tggcacataactgtctccttaacca

SEQ ID NO: 3799 - DNA, 25 bp, Homo sapiens
aaccactggaacagttcagccattt

SEQ ID NO: 3800 - DNA, 25 bp, Homo sapiens
tgccccggggccaggtggagaaagt

SEQ ID NO: 3801 - DNA, 25 bp, Homo sapiens
aagtgagggccgtacaaggaagtga

SEQ ID NO: 3802 - DNA, 25 bp, Homo sapiens
tctgagttgttggggctaagcctga

SEQ ID NO: 3803 - DNA, 25 bp, Homo sapiens
caactcactctggcctcagtagatt

SEQ ID NO: 3804 - DNA, 25 bp, Homo sapiens
tttcagttgtggttgttgcccaggc

SEQ ID NO: 3805 - DNA, 25 bp, Homo sapiens
agtagctaggactgcaggtgctcca

SEQ ID NO: 3806 - DNA, 25 bp, Homo sapiens
gaactcctggcctcaggtgtgatcc

SEQ ID NO: 3807 - DNA, 25 bp, Homo sapiens
cctccccaagcgctgagattacagg

SEQ ID NO: 3808 - DNA, 25 bp, Homo sapiens
tcagtaggttttaaggagtccccag

SEQ ID NO: 3809 - DNA, 25 bp, Homo sapiens
cccgccaagtactgcacagggaccc

SEQ ID NO: 3810 - DNA, 25 bp, Homo sapiens
ggccctgctccgtgagataatgtga

SEQ ID NO: 3811 - DNA, 25 bp, Homo sapiens
cattgtccctcatgtcatttcaaac

SEQ ID NO: 3812 - DNA, 25 bp, Homo sapiens
gttggctttgagtcacacatcgaag

SEQ ID NO: 3813 - DNA, 25 bp, Homo sapiens
agaggtgagacgctggcttcattct

SEQ ID NO: 3814 - DNA, 25 bp, Homo sapiens
gctggcttcattctggactagacag

SEQ ID NO: 3815 - DNA, 25 bp, Homo sapiens
ggaacttggcctcagcgtgagatcc

SEQ ID NO: 3816 - DNA, 25 bp, Homo sapiens
gagatcctgccatgcagtgttgcgg

SEQ ID NO: 3817 - DNA, 25 bp, Homo sapiens
tgaatgtgaaggcggcgtcggcgcg

SEQ ID NO: 3818 - DNA, 25 bp, Homo sapiens
tgtgaggagccactaaacctttccg

SEQ ID NO: 3819 - DNA, 25 bp, Homo sapiens
tagacctccccatctgtggaatggg

SEQ ID NO: 3820 - DNA, 25 bp, Homo sapiens
gaatggggtcaataccacctacctc

SEQ ID NO: 3821 - DNA, 25 bp, Homo sapiens
accacctacctcacaggggtgttgt

SEQ ID NO: 3822 - DNA, 25 bp, Homo sapiens
gactaggataatacatcttccacac

SEQ ID NO: 3823 - DNA, 25 bp, Homo sapiens
tggcccactgataatgttaattctc

SEQ ID NO: 3824 - DNA, 25 bp, Homo sapiens
gttaattctctggcgtatttcaaag

SEQ ID NO: 3825 - DNA, 25 bp, Homo sapiens
gttcctggctgatccaagtgcagtg

SEQ ID NO: 3826 - DNA, 25 bp, Homo sapiens
ctgcttcacttgcctagtcttgaag

SEQ ID NO: 3827 - DNA, 25 bp, Homo sapiens
ttgttcctttataggttcctggtag

SEQ ID NO: 3828 - DNA, 25 bp, Homo sapiens
gacatttttaagctgtatccccttg

SEQ ID NO: 3829 - DNA, 25 bp, Homo sapiens
tatccccttgtcattccattgagaa

SEQ ID NO: 3830 - DNA, 25 bp, Homo sapiens
gaacttgcctagtaagcactttgtc

SEQ ID NO: 3831 - DNA, 25 bp, Homo sapiens
gaaatctactccctatcttgggtcc

SEQ ID NO: 3832 - DNA, 25 bp, Homo sapiens
tacaccagtggagctaccctttaaa

SEQ ID NO: 3833 - DNA, 25 bp, Homo sapiens
gatgataatccggaccatgctgtat

SEQ ID NO: 3834 - DNA, 25 bp, Homo sapiens
ggaccatgctgtatactccacagga

SEQ ID NO: 3835 - DNA, 25 bp, Homo sapiens
agatcattaaaatccgtgcccagac

SEQ ID NO: 3836 - DNA, 25 bp, Homo sapiens
gtgcccagacggaaggaatcaacat

SEQ ID NO: 3837 - DNA, 25 bp, Homo sapiens
agtgaggaggcactgaaccacctgg

SEQ ID NO: 3838 - DNA, 25 bp, Homo sapiens
tgaggtactcagtgcagctgctgac

SEQ ID NO: 3839 - DNA, 25 bp, Homo sapiens
gccaacttgcttgctaaaatcaacg

SEQ ID NO: 3840 - DNA, 25 bp, Homo sapiens
ttttctatgatgccaagtcctccgc

SEQ ID NO: 3841 - DNA, 25 bp, Homo sapiens
ctccgccaaaatcctggctgaccag

SEQ ID NO: 3842 - DNA, 25 bp, Homo sapiens
gctgaccagcaggataagtacatga

SEQ ID NO: 3843 - DNA, 25 bp, Homo sapiens
gtaactgttcctgtggttgctttga

SEQ ID NO: 3844 - DNA, 25 bp, Homo sapiens
tggtctccctgaacctgaaatcaca

SEQ ID NO: 3845 - DNA, 25 bp, Homo sapiens
cccgacaggaacggctgcggcagaa

SEQ ID NO: 3846 - DNA, 25 bp, Homo sapiens
gaatccttgggacaggtgaccgacc

SEQ ID NO: 3847 - DNA, 25 bp, Homo sapiens
gaatgcccagaacagtgtgcctgac

SEQ ID NO: 3848 - DNA, 25 bp, Homo sapiens
tgacgaggaggccaagacaaccacc

SEQ ID NO: 3849 - DNA, 25 bp, Homo sapiens
aaggggatgatgaggccgcattcct

SEQ ID NO: 3850 - DNA, 25 bp, Homo sapiens
gaaagacgccaaaaacgccttcagg

SEQ ID NO: 3851 - DNA, 25 bp, Homo sapiens
cgccttcaggaggctctggagcggc

SEQ ID NO: 3852 - DNA, 25 bp, Homo sapiens
ggcagaaggagttcgacccaacaat

SEQ ID NO: 3853 - DNA, 25 bp, Homo sapiens
aacagatgcaagtctgtcgctccca

SEQ ID NO: 3854 - DNA, 25 bp, Homo sapiens
acagaaacagtcaccaagtcctacc

SEQ ID NO: 3855 - DNA, 25 bp, Homo sapiens
cttgagaccaggagacgtatccagc

SEQ ID NO: 3856 - DNA, 25 bp, Homo sapiens
gacgtatccagcaagcggaacctct

SEQ ID NO: 3857 - DNA, 25 bp, Homo sapiens
gcaagcggaacctctgggaaaagca

SEQ ID NO: 3858 - DNA, 25 bp, Homo sapiens
tctgtggataaggtcacttccccca

SEQ ID NO: 3859 - DNA, 25 bp, Homo sapiens
cttcccccactaaggtttgagacag

SEQ ID NO: 3860 - DNA, 25 bp, Homo sapiens
gaacccaagctcaagacgcaggacg

SEQ ID NO: 3861 - DNA, 25 bp, Homo sapiens
gacgcaggacgagctcagttgtaga

SEQ ID NO: 3862 - DNA, 25 bp, Homo sapiens
ttcaatatcccagtaaacccatgta

SEQ ID NO: 3863 - DNA, 25 bp, Homo sapiens
actgatcatcataactctgtatctg

SEQ ID NO: 3864 - DNA, 25 bp, Homo sapiens
agcagtgataccaaccacatctgaa

SEQ ID NO: 3865 - DNA, 25 bp, Homo sapiens
gcggaatgtgtgcagtatctagaaa

SEQ ID NO: 3866 - DNA, 25 bp, Homo sapiens
tgttgtttctgcactttataataaa

SEQ ID NO: 3867 - DNA, 25 bp, Homo sapiens
gtaggcaattgtaacactttttgaa

SEQ ID NO: 3868 - DNA, 25 bp, Homo sapiens
ggtattactttttttcatgctgatg

SEQ ID NO: 3869 - DNA, 25 bp, Homo sapiens
cagtggtactgattttttaggttgg

SEQ ID NO: 3870 - DNA, 25 bp, Homo sapiens
taggttggttgttttgtggatttct

SEQ ID NO: 3871 - DNA, 25 bp, Homo sapiens
ttagtagtgatagtagcctgaacca

SEQ ID NO: 3872 - DNA, 25 bp, Homo sapiens
gcctgaaccacattttagataactc

SEQ ID NO: 3873 - DNA, 25 bp, Homo sapiens
gcatacacatatacaaacacactaa

SEQ ID NO: 3874 - DNA, 25 bp, Homo sapiens
gaatgcttttttatgtgctagacta

SEQ ID NO: 3875 - DNA, 25 bp, Homo sapiens
gtaactagccaatatcacagctttt

SEQ ID NO: 3876 - DNA, 25 bp, Homo sapiens
atgttttcaatgcctgatgacctat

SEQ ID NO: 3877 - DNA, 25 bp, Homo sapiens
agcacttcccagtggcagaggctga

SEQ ID NO: 3878 - DNA, 25 bp, Homo sapiens
cagaggctgaggctgtggtgctgac

SEQ ID NO: 3879 - DNA, 25 bp, Homo sapiens
gtgctgacactgctggcgatttatg

SEQ ID NO: 3880 - DNA, 25 bp, Homo sapiens
tggcgatttatgcagctggcctggc

SEQ ID NO: 3881 - DNA, 25 bp, Homo sapiens
acccaccgggtggtaagcacacagg

SEQ ID NO: 3882 - DNA, 25 bp, Homo sapiens
gctggtagccctgatctacctagca

SEQ ID NO: 3883 - DNA, 25 bp, Homo sapiens
agcactgcagctgggctgcatcgcc

SEQ ID NO: 3884 - DNA, 25 bp, Homo sapiens
gctagcccagggtgtgctggagcac

SEQ ID NO: 3885 - DNA, 25 bp, Homo sapiens
ggctgcttttctggaatgtgctctt

SEQ ID NO: 3886 - DNA, 25 bp, Homo sapiens
ctggaagtgagatctgcctgtccgg

SEQ ID NO: 3887 - DNA, 25 bp, Homo sapiens
gctgggacagagactccccaaggac

SEQ ID NO: 3888 - DNA, 25 bp, Homo sapiens
gtggctggctagctagtttctacag

SEQ ID NO: 3889 - DNA, 25 bp, Homo sapiens
gaaggctattcttagatcatgtctc

SEQ ID NO: 3890 - DNA, 25 bp, Homo sapiens
tcatgtctcaatggaaacactcttc

SEQ ID NO: 3891 - DNA, 25 bp, Homo sapiens
tcttctttcttagccttacttgaat

SEQ ID NO: 3892 - DNA, 25 bp, Homo sapiens
agccttacttgaatcttgcctataa

SEQ ID NO: 3893 - DNA, 25 bp, Homo sapiens
aagcttctgatcaacggtcctgaaa

SEQ ID NO: 3894 - DNA, 25 bp, Homo sapiens
ttagccgtgtaactcctgcaatgaa

SEQ ID NO: 3895 - DNA, 25 bp, Homo sapiens
actgatcatgcatgatccctcatcc

SEQ ID NO: 3896 - DNA, 25 bp, Homo sapiens
gatccctcatccctgaaattgagtt

SEQ ID NO: 3897 - DNA, 25 bp, Homo sapiens
ggttagttgctagtacaggaatcgt

SEQ ID NO: 3898 - DNA, 25 bp, Homo sapiens
attggtaacatcttggtggctggct

SEQ ID NO: 3899 - DNA, 25 bp, Homo sapiens
ctcctctccctgttagaaatgttag

SEQ ID NO: 3900 - DNA, 25 bp, Homo sapiens
agaaatgttagtgccccgcactgtg

SEQ ID NO: 3901 - DNA, 25 bp, Homo sapiens
cccagaaagctgtcagagccggccg

SEQ ID NO: 3902 - DNA, 25 bp, Homo sapiens
tctcccagggatgctctttgtaaat

SEQ ID NO: 3903 - DNA, 25 bp, Homo sapiens
ggatgggtgtgggagtgaggggtta

SEQ ID NO: 3904 - DNA, 25 bp, Homo sapiens
agaggccctaggcgggatgggctcg

SEQ ID NO: 3905 - DNA, 25 bp, Homo sapiens
ggacgaggaggacatgggacttgcg

SEQ ID NO: 3906 - DNA, 25 bp, Homo sapiens
aggacatgggacttgcgtggacagt

SEQ ID NO: 3907 - DNA, 25 bp, Homo sapiens
gcgtggacagtcagggttcacttgg

SEQ ID NO: 3908 - DNA, 25 bp, Homo sapiens
ccagctgcactttaaccctagaagg

SEQ ID NO: 3909 - DNA, 25 bp, Homo sapiens
accattggacagtctccctgatgga

SEQ ID NO: 3910 - DNA, 25 bp, Homo sapiens
cacttattcttttcagtaacctgct

SEQ ID NO: 3911 - DNA, 25 bp, Homo sapiens
gtaacctgctagtgcacaggctgta

SEQ ID NO: 3912 - DNA, 25 bp, Homo sapiens
gtgcacaggctgtactttaggtact

SEQ ID NO: 3913 - DNA, 25 bp, Homo sapiens
aaggccctaaaatatcactgttatt

SEQ ID NO: 3914 - DNA, 25 bp, Homo sapiens
ggagtaattcagtataggttcgttt

SEQ ID NO: 3915 - DNA, 25 bp, Homo sapiens
ataacttcagacatgcatcagtagg

SEQ ID NO: 3916 - DNA, 25 bp, Homo sapiens
attcatattctgttactacagtaaa

SEQ ID NO: 3917 - DNA, 25 bp, Homo sapiens
ttttctatattacaagggccccagt

SEQ ID NO: 3918 - DNA, 25 bp, Homo sapiens
aagggccccagtgttaatgtcttag

SEQ ID NO: 3919 - DNA, 25 bp, Homo sapiens
gaatgtataattggcatatcatgga

SEQ ID NO: 3920 - DNA, 25 bp, Homo sapiens
atcagttcttaaaagttatgcctag

SEQ ID NO: 3921 - DNA, 25 bp, Homo sapiens
tagcagccctatctttgggcctttg

SEQ ID NO: 3922 - DNA, 25 bp, Homo sapiens
gggcctttggtggacatttgatcgt

SEQ ID NO: 3923 - DNA, 25 bp, Homo sapiens
tgatcgttccagaagtggccttggg

SEQ ID NO: 3924 - DNA, 25 bp, Homo sapiens
ggctggggatcaccatagcttttct

SEQ ID NO: 3925 - DNA, 25 bp, Homo sapiens
tagctacgctgatcacgcagtttct

SEQ ID NO: 3926 - DNA, 25 bp, Homo sapiens
ttcctctatattcgttcttggctcc

SEQ ID NO: 3927 - DNA, 25 bp, Homo sapiens
ttttctcaggaggcgtcacggtggg

SEQ ID NO: 3928 - DNA, 25 bp, Homo sapiens
gttcctgaaaagccccatagtgatt

SEQ ID NO: 3929 - DNA, 25 bp, Homo sapiens
gggctgactgtacaaatgactcctg

SEQ ID NO: 3930 - DNA, 25 bp, Homo sapiens
gatgacttaccctgaagtcttccct

SEQ ID NO: 3931 - DNA, 25 bp, Homo sapiens
cttcccaagtattcgatttcattca

SEQ ID NO: 3932 - DNA, 25 bp, Homo sapiens
agaatgaatacctgtctgccatgta

SEQ ID NO: 3933 - DNA, 25 bp, Homo sapiens
gtctgccatgtatttcaatcttagt

SEQ ID NO: 3934 - DNA, 25 bp, Homo sapiens
gtgcatatggcactgcattaaacgt

SEQ ID NO: 3935 - DNA, 25 bp, Homo sapiens
acgtgtggtgtttctagtcaatgat

SEQ ID NO: 3936 - DNA, 25 bp, Homo sapiens
agaccataccagacctaatttgcaa

SEQ ID NO: 3937 - DNA, 25 bp, Homo sapiens
attgggtcttcaaacttcaagtgca

SEQ ID NO: 3938 - DNA, 25 bp, Homo sapiens
aaccaatctgagccttgtatctctt

SEQ ID NO: 3939 - DNA, 25 bp, Homo sapiens
gagagaagggttctccattcatttc

SEQ ID NO: 3940 - DNA, 25 bp, Homo sapiens
ctccattcatttcagtgctgcctgg

SEQ ID NO: 3941 - DNA, 25 bp, Homo sapiens
gtgctgcctggaggaaactcggcaa

SEQ ID NO: 3942 - DNA, 25 bp, Homo sapiens
cctcaaccttcgaaatactccagtt

SEQ ID NO: 3943 - DNA, 25 bp, Homo sapiens
ccacgttgcccggcagattaccaaa

SEQ ID NO: 3944 - DNA, 25 bp, Homo sapiens
cgttgcccggcagattaccaaagaa

SEQ ID NO: 3945 - DNA, 25 bp, Homo sapiens
cgcggcaacttccgggtatgagata

SEQ ID NO: 3946 - DNA, 25 bp, Homo sapiens
ggcaacttccgggtatgagataggg

SEQ ID NO: 3947 - DNA, 25 bp, Homo sapiens
atgagatagggaacccccctgacta

SEQ ID NO: 3948 - DNA, 25 bp, Homo sapiens
cccctgactaccgagggcagagctg

SEQ ID NO: 3949 - DNA, 25 bp, Homo sapiens
tgactaccgagggcagagctgcatg

SEQ ID NO: 3950 - DNA, 25 bp, Homo sapiens
gggcagagctgcatgaagaggcacg

SEQ ID NO: 3951 - DNA, 25 bp, Homo sapiens
gctgcatgaagaggcacggcattcc

SEQ ID NO: 3952 - DNA, 25 bp, Homo sapiens
tgcatgaagaggcacggcattccca

SEQ ID NO: 3953 - DNA, 25 bp, Homo sapiens
catgaagaggcacggcattcccatg

SEQ ID NO: 3954 - DNA, 25 bp, Homo sapiens
agcttcaggacgcgtctgcagaggt

SEQ ID NO: 3955 - DNA, 25 bp, Homo sapiens
ctctgctgcagtgagatcccaggaa

SEQ ID NO: 3956 - DNA, 25 bp, Homo sapiens
gctggcacatcttggaaggtccgtc

SEQ ID NO: 3957 - DNA, 25 bp, Homo sapiens
ttttcgcttgaacattcccttgatc

SEQ ID NO: 3958 - DNA, 25 bp, Homo sapiens
aacattcccttgatctcatcagttc

SEQ ID NO: 3959 - DNA, 25 bp, Homo sapiens
cgggtcatggggcaacacggttagc

SEQ ID NO: 3960 - DNA, 25 bp, Homo sapiens
ttagcggggagagcacggggtagcc

SEQ ID NO: 3961 - DNA, 25 bp, Homo sapiens
tagccggagaagggcctctggagca

SEQ ID NO: 3962 - DNA, 25 bp, Homo sapiens
tcctgggtgtggggacacagtcggg

SEQ ID NO: 3963 - DNA, 25 bp, Homo sapiens
acagtcgggttgacccagggctgtc

SEQ ID NO: 3964 - DNA, 25 bp, Homo sapiens
ttttctggggtctttgagctccaaa

SEQ ID NO: 3965 - DNA, 25 bp, Homo sapiens
gaaatccatctatctacagcctaag

SEQ ID NO: 3966 - DNA, 25 bp, Homo sapiens
agttctttccagtgttttgtagctc

SEQ ID NO: 3967 - DNA, 25 bp, Homo sapiens
tagctcactgtcactcactgaatag

SEQ ID NO: 3968 - DNA, 25 bp, Homo sapiens
agagaaacgtgtgccctatacttcc

SEQ ID NO: 3969 - DNA, 25 bp, Homo sapiens
tgccctatacttcctgtgacaatca

SEQ ID NO: 3970 - DNA, 25 bp, Homo sapiens
gtgacaatcattttgctgacagaat

SEQ ID NO: 3971 - DNA, 25 bp, Homo sapiens
gagacaccacttttcaaaggacttc

SEQ ID NO: 3972 - DNA, 25 bp, Homo sapiens
ggacttcttggtttcagcataacct

SEQ ID NO: 3973 - DNA, 25 bp, Homo sapiens
ggagccatcatatgtcacagtgttc

SEQ ID NO: 3974 - DNA, 25 bp, Homo sapiens
aagggcattttctttgattctcaaa

SEQ ID NO: 3975 - DNA, 25 bp, Homo sapiens
gagaagcctatacatttagctgaca

SEQ ID NO: 3976 - DNA, 25 bp, Homo sapiens
gacgatgacgtggggaaaccctcca

SEQ ID NO: 3977 - DNA, 25 bp, Homo sapiens
ggaaaaagacacggcgctggcaagt

SEQ ID NO: 3978 - DNA, 25 bp, Homo sapiens
gtgataggaacattctggccagagg

SEQ ID NO: 3979 - DNA, 25 bp, Homo sapiens
gttgttgggtgctggtagctccaga

SEQ ID NO: 3980 - DNA, 25 bp, Homo sapiens
gtagctccagaattttgtgaccact

SEQ ID NO: 3981 - DNA, 25 bp, Homo sapiens
aatgtctctgcatcacttgttaatg

SEQ ID NO: 3982 - DNA, 25 bp, Homo sapiens
ggtctaacttcattcagtatgcttc

SEQ ID NO: 3983 - DNA, 25 bp, Homo sapiens
ttcattcaccgaactttgtgctcaa

SEQ ID NO: 3984 - DNA, 25 bp, Homo sapiens
ttatgttgtattcctccatttcact

SEQ ID NO: 3985 - DNA, 25 bp, Homo sapiens
ggtagcttcatccaatatatcattc

SEQ ID NO: 3986 - DNA, 25 bp, Homo sapiens
aactcagtcttccaactgcaataaa

SEQ ID NO: 3987 - DNA, 25 bp, Homo sapiens
agaaacggaggcgcgctttggagcc

SEQ ID NO: 3988 - DNA, 25 bp, Homo sapiens
cgcatatccaggcgctgatcagcgg

SEQ ID NO: 3989 - DNA, 25 bp, Homo sapiens
ggcggatgtgcgagctgatagtgag

SEQ ID NO: 3990 - DNA, 25 bp, Homo sapiens
gaatcaggagtaccagcggctcatg

SEQ ID NO: 3991 - DNA, 25 bp, Homo sapiens
ggctcatggacatcaagtcgcggct

SEQ ID NO: 3992 - DNA, 25 bp, Homo sapiens
gatcctgagtgacatgcgaagccaa

SEQ ID NO: 3993 - DNA, 25 bp, Homo sapiens
gaggtcatggccgagcagaaccgga

SEQ ID NO: 3994 - DNA, 25 bp, Homo sapiens
tggttcaccagccggactgaagaat

SEQ ID NO: 3995 - DNA, 25 bp, Homo sapiens
gaattgaaccgggaggtcgctggcc

SEQ ID NO: 3996 - DNA, 25 bp, Homo sapiens
aggtccgaggttactgacctgcggc

SEQ ID NO: 3997 - DNA, 25 bp, Homo sapiens
gctgagcatgaaagctgccttggaa

SEQ ID NO: 3998 - DNA, 25 bp, Homo sapiens
tccctccctcaggggctgtaaggga

SEQ ID NO: 3999 - DNA, 25 bp, Homo sapiens
tcaggggctgtaagggaaggcccac

SEQ ID NO: 4000 - DNA, 25 bp, Homo sapiens
actcctccaacagacaacggacgga

SEQ ID NO: 4001 - DNA, 25 bp, Homo sapiens
gacaacggacggacggatgccgctg

SEQ ID NO: 4002 - DNA, 25 bp, Homo sapiens
atgccgctggtgctcaggaagagct

SEQ ID NO: 4003 - DNA, 25 bp, Homo sapiens
gctcaggaagagctagtgccttagg

SEQ ID NO: 4004 - DNA, 25 bp, Homo sapiens
ggaagagctagtgccttaggtgggg

SEQ ID NO: 4005 - DNA, 25 bp, Homo sapiens
agagctagtgccttaggtgggggaa

SEQ ID NO: 4006 - DNA, 25 bp, Homo sapiens
ggaaggcaggactcacgactgagag

SEQ ID NO: 4007 - DNA, 25 bp, Homo sapiens
ggcaggactcacgactgagagagag

SEQ ID NO: 4008 - DNA, 25 bp, Homo sapiens
gcccccagactgtggggttgggacg

SEQ ID NO: 4009 - DNA, 25 bp, Homo sapiens
gtagtgccactgttgttttgggggg

SEQ ID NO: 4010 - DNA, 25 bp, Homo sapiens
gatactaaggacgttgttttggttg

SEQ ID NO: 4011 - DNA, 25 bp, Homo sapiens
ggttgtacttggaattcttagtcac

SEQ ID NO: 4012 - DNA, 25 bp, Homo sapiens
taacagtgtttaaagtctcagtttc

SEQ ID NO: 4013 - DNA, 25 bp, Homo sapiens
ggaacttgtgtccctaatgtgttag

SEQ ID NO: 4014 - DNA, 25 bp, Homo sapiens
aaggagctgatacttgacagttttt

SEQ ID NO: 4015 - DNA, 25 bp, Homo sapiens
gacagttttttagacctgtgttact

SEQ ID NO: 4016 - DNA, 25 bp, Homo sapiens
tatggtgtttagacttatggttgtt

SEQ ID NO: 4017 - DNA, 25 bp, Homo sapiens
gtcatctcaagtcaagtcactggtc

SEQ ID NO: 4018 - DNA, 25 bp, Homo sapiens
gtcactggtctgtttgcatttgata

SEQ ID NO: 4019 - DNA, 25 bp, Homo sapiens
gttcattgtttcgtaacacagcatt

SEQ ID NO: 4020 - DNA, 25 bp, Homo sapiens
gacatccttcttagcagaaacttca

SEQ ID NO: 4021 - DNA, 25 bp, Homo sapiens
taatgttctctaaagcttgcaactt

SEQ ID NO: 4022 - DNA, 25 bp, Homo sapiens
taacttacttgtttgctgctaaaat

SEQ ID NO: 4023 - DNA, 25 bp, Homo sapiens
gccatttttaaacaaccagtccctg

SEQ ID NO: 4024 - DNA, 25 bp, Homo sapiens
aaccagtccctgtgatacaactttg

SEQ ID NO: 4025 - DNA, 25 bp, Homo sapiens
aatctctgatgtatgggctcttttt

SEQ ID NO: 4026 - DNA, 25 bp, Homo sapiens
cagggggatccgcttttaaacagtg

SEQ ID NO: 4027 - DNA, 25 bp, Homo sapiens
aatgtcatatatcctttctctactt

SEQ ID NO: 4028 - DNA, 25 bp, Homo sapiens
tgtgagttcatttccgatgtgttct

SEQ ID NO: 4029 - DNA, 25 bp, Homo sapiens
gttcttggttgttgctgttttctgc

SEQ ID NO: 4030 - DNA, 25 bp, Homo sapiens
gctgttttctgcctgaagacgtgta

SEQ ID NO: 4031 - DNA, 25 bp, Homo sapiens
tctggcatcagtttgctacagtgag

SEQ ID NO: 4032 - DNA, 25 bp, Homo sapiens
gaaatgcatgtctcaagctgcaagg

SEQ ID NO: 4033 - DNA, 25 bp, Homo sapiens
aagctgcaaggcaaactccattcct

SEQ ID NO: 4034 - DNA, 25 bp, Homo sapiens
aactccattcctcatattaaactat

SEQ ID NO: 4035 - DNA, 25 bp, Homo sapiens
acttctcatgacgtcaccattttta

SEQ ID NO: 4036 - DNA, 25 bp, Homo sapiens
tgacgtcaccatttttaactgacag

SEQ ID NO: 4037 - DNA, 25 bp, Homo sapiens
agacagcaaacttgtgtctgtctct

SEQ ID NO: 4038 - DNA, 25 bp, Homo sapiens
tttaccacctatgactgtacttgtc

SEQ ID NO: 4039 - DNA, 25 bp, Homo sapiens
agcagtgattttaaaacctcaagtt

SEQ ID NO: 4040 - DNA, 25 bp, Homo sapiens
gttgctgtgtaattattgtcttgta

SEQ ID NO: 4041 - DNA, 25 bp, Homo sapiens
aattattgtcttgtatgcatttgag

SEQ ID NO: 4042 - DNA, 25 bp, Homo sapiens
ggacagtgtttcaacaagcctaggc

SEQ ID NO: 4043 - DNA, 25 bp, Homo sapiens
aagcctaggctatctcgtaagttga

SEQ ID NO: 4044 - DNA, 25 bp, Homo sapiens
aatatcccactatagttgcttcatg

SEQ ID NO: 4045 - DNA, 25 bp, Homo sapiens
gatggcctctgatttacactggttc

SEQ ID NO: 4046 - DNA, 25 bp, Homo sapiens
ggtttaccaggatgtagtcccactg

SEQ ID NO: 4047 - DNA, 25 bp, Homo sapiens
gataccttgagtaatgtttgcctat

SEQ ID NO: 4048 - DNA, 25 bp, Homo sapiens
gcgtatttttacactattggctcaa

SEQ ID NO: 4049 - DNA, 25 bp, Homo sapiens
ggaaggactttcggtattgtattag

SEQ ID NO: 4050 - DNA, 25 bp, Homo sapiens
agaagtctgccctagctgttaaatt

SEQ ID NO: 4051 - DNA, 25 bp, Homo sapiens
gagttaattgttcctttcttcagtg

SEQ ID NO: 4052 - DNA, 25 bp, Homo sapiens
cctttcttcagtgggccattgtttt

SEQ ID NO: 4053 - DNA, 25 bp, Homo sapiens
gagtggactattaaatgtgcctaaa

SEQ ID NO: 4054 - DNA, 25 bp, Homo sapiens
gcagtaactggtattcttgggtttt

SEQ ID NO: 4055 - DNA, 25 bp, Homo sapiens
gcagtcttttggagtgaccagcaac

SEQ ID NO: 4056 - DNA, 25 bp, Homo sapiens
gaggattcagtagtacacatacaac

SEQ ID NO: 4057 - DNA, 25 bp, Homo sapiens
gacatctaccagtttctccaaatgc

SEQ ID NO: 4058 - DNA, 25 bp, Homo sapiens
gccttttttaaaactcatcacagaa

SEQ ID NO: 4059 - DNA, 25 bp, Homo sapiens
gagtatgacacttttcttcttgcat

SEQ ID NO: 4060 - DNA, 25 bp, Homo sapiens
tcttcttgcatgcatgtcagctaca

SEQ ID NO: 4061 - DNA, 25 bp, Homo sapiens
gacattccatgttaaactacggtca

SEQ ID NO: 4062 - DNA, 25 bp, Homo sapiens
ctacggtcatgttcagcttcattgc

SEQ ID NO: 4063 - DNA, 25 bp, Homo sapiens
tgtaatgtagacctagtccatcaga

SEQ ID NO: 4064 - DNA, 25 bp, Homo sapiens
tctggaatgccagtttgacctttgt

SEQ ID NO: 4065 - DNA, 25 bp, Homo sapiens
gacctttgtcttctataatatttcc

SEQ ID NO: 4066 - DNA, 25 bp, Homo sapiens
ggagaagtcttgaattcggctgcaa

SEQ ID NO: 4067 - DNA, 25 bp, Homo sapiens
ggctgcaaatgctagtgccaccacc

SEQ ID NO: 4068 - DNA, 25 bp, Homo sapiens
cacggagcctcttccagaaaagaca

SEQ ID NO: 4069 - DNA, 25 bp, Homo sapiens
ggagagcctgtgagattcctacctt

SEQ ID NO: 4070 - DNA, 25 bp, Homo sapiens
gcacatcttgtcaacatgcattgcc

SEQ ID NO: 4071 - DNA, 25 bp, Homo sapiens
gcattgccatgaatttctaccagat

SEQ ID NO: 4072 - DNA, 25 bp, Homo sapiens
tagctttacatattcctttgaccaa

SEQ ID NO: 4073 - DNA, 25 bp, Homo sapiens
caccctttagtgtacatttatgttc

SEQ ID NO: 4074 - DNA, 25 bp, Homo sapiens
tgtcatagttgttttcctgctttac

SEQ ID NO: 4075 - DNA, 25 bp, Homo sapiens
aacagctgtgcatccaatttattat

SEQ ID NO: 4076 - DNA, 25 bp, Homo sapiens
agtggaacctcctatatcattattt

SEQ ID NO: 4077 - DNA, 25 bp, Homo sapiens
atatcattatttagcaccgtttgtg

SEQ ID NO: 4078 - DNA, 25 bp, Homo sapiens
agcaccgtttgtgacagtaaccatt

SEQ ID NO: 4079 - DNA, 25 bp, Homo sapiens
gacagtaaccatttcagtgtattgt

SEQ ID NO: 4080 - DNA, 25 bp, Homo sapiens
tatatcaacttatttttcaccaggt

SEQ ID NO: 4081 - DNA, 25 bp, Homo sapiens
tctgaatcaagcacactgtatgttc

SEQ ID NO: 4082 - DNA, 25 bp, Homo sapiens
aacactgtcatcaatgttcagttca

SEQ ID NO: 4083 - DNA, 25 bp, Homo sapiens
aggggaaccattgttgtcttcactt

SEQ ID NO: 4084 - DNA, 25 bp, Homo sapiens
tcacttaatccatttagcactattt

SEQ ID NO: 4085 - DNA, 25 bp, Homo sapiens
aggggttggtgataactcttgagga

SEQ ID NO: 4086 - DNA, 25 bp, Homo sapiens
cactaactgaggcctttccatagct

SEQ ID NO: 4087 - DNA, 25 bp, Homo sapiens
ggatgggggagggtattatactgcc

SEQ ID NO: 4088 - DNA, 25 bp, Homo sapiens
tattatactgcctcagtctgactcc

SEQ ID NO: 4089 - DNA, 25 bp, Homo sapiens
tcaacccagcagcaatttgagggga

SEQ ID NO: 4090 - DNA, 25 bp, Homo sapiens
ccccctcagcaacaaagctcagctg

SEQ ID NO: 4091 - DNA, 25 bp, Homo sapiens
gaatgcttgaagtcagcgtcttcca

SEQ ID NO: 4092 - DNA, 25 bp, Homo sapiens
ctttgggggtatgatgtggaagctg

SEQ ID NO: 4093 - DNA, 25 bp, Homo sapiens
gtggaagctggtttcagcccaggac

SEQ ID NO: 4094 - DNA, 25 bp, Homo sapiens
tgaggagaggatctagacaggtggg

SEQ ID NO: 4095 - DNA, 25 bp, Homo sapiens
gacaggtgggcctaattccaagggg

SEQ ID NO: 4096 - DNA, 25 bp, Homo sapiens
tggagaaggccttttacacacacac

SEQ ID NO: 4097 - DNA, 25 bp, Homo sapiens
gtaaatactgcttgaccgtactctc

SEQ ID NO: 4098 - DNA, 25 bp, Homo sapiens
gaccgtactctcacatgtggcaaaa

SEQ ID NO: 4099 - DNA, 25 bp, Homo sapiens
acgtcttggtgccttttgtgtgatg

SEQ ID NO: 4100 - DNA, 25 bp, Homo sapiens
ccttgctgatggcttgacatgtgca

SEQ ID NO: 4101 - DNA, 25 bp, Homo sapiens
tgtgagggacatgctcacctctagc

SEQ ID NO: 4102 - DNA, 25 bp, Homo sapiens
gctcacctctagccttaaggggggc

SEQ ID NO: 4103 - DNA, 25 bp, Homo sapiens
ctgagcttcggttctccagaatgta

SEQ ID NO: 4104 - DNA, 25 bp, Homo sapiens
agtaggcggcgatttttgtatgtta

SEQ ID NO: 4105 - DNA, 25 bp, Homo sapiens
gcagttcattattttgtggttctat

SEQ ID NO: 4106 - DNA, 25 bp, Homo sapiens
tttactttgtacttgtgtttgctta

SEQ ID NO: 4107 - DNA, 25 bp, Homo sapiens
tgaatgcgctttattgcccatggga

SEQ ID NO: 4108 - DNA, 25 bp, Homo sapiens
agggtgaaacttcctacatccgagt

SEQ ID NO: 4109 - DNA, 25 bp, Homo sapiens
cttcctacatccgagtttatcctga

SEQ ID NO: 4110 - DNA, 25 bp, Homo sapiens
cctacatccgagtttatcctgagag

SEQ ID NO: 4111 - DNA, 25 bp, Homo sapiens
acatccgagtttatcctgagagaag

SEQ ID NO: 4112 - DNA, 25 bp, Homo sapiens
cgagtttatcctgagagaagcacca

SEQ ID NO: 4113 - DNA, 25 bp, Homo sapiens
agaagcaccagctatggctactcac

SEQ ID NO: 4114 - DNA, 25 bp, Homo sapiens
cgtgactctccataccaaagcaggg

SEQ ID NO: 4115 - DNA, 25 bp, Homo sapiens
gactctccataccaaagcaggggtt

SEQ ID NO: 4116 - DNA, 25 bp, Homo sapiens
cataccaaagcaggggttccccaca

SEQ ID NO: 4117 - DNA, 25 bp, Homo sapiens
tcctttcaggccctactgagacagg

SEQ ID NO: 4118 - DNA, 25 bp, Homo sapiens
aggccctactgagacaggtgatggg

SEQ ID NO: 4119 - DNA, 25 bp, Homo sapiens
ctgctctcctcacacattgtgtggt

SEQ ID NO: 4120 - DNA, 25 bp, Homo sapiens
ttcatagacggcaggtgcccacctt

SEQ ID NO: 4121 - DNA, 25 bp, Homo sapiens
ccacctttcagggagtctcccagca

SEQ ID NO: 4122 - DNA, 25 bp, Homo sapiens
gcatgggcggatgccgggcatgagc

SEQ ID NO: 4123 - DNA, 25 bp, Homo sapiens
aactatttgtggctgtgctgcttga

SEQ ID NO: 4124 - DNA, 25 bp, Homo sapiens
ctgtcgtgtgggtgccaagtgcttg

SEQ ID NO: 4125 - DNA, 25 bp, Homo sapiens
gtgtcctgtgaatgtatcgctactg

SEQ ID NO: 4126 - DNA, 25 bp, Homo sapiens
tgtatcgctactgtgagctgttccc

SEQ ID NO: 4127 - DNA, 25 bp, Homo sapiens
tagccagggccatgtcttaggtgca

SEQ ID NO: 4128 - DNA, 25 bp, Homo sapiens
ttcagtgaatgtacagtgcccggca

SEQ ID NO: 4129 - DNA, 25 bp, Homo sapiens
gagctgaacctcatgtgttccactc

SEQ ID NO: 4130 - DNA, 25 bp, Homo sapiens
atcagtgtgctgctagagggttctt

SEQ ID NO: 4131 - DNA, 25 bp, Homo sapiens
gagggttctttttcacttgacatgc

SEQ ID NO: 4132 - DNA, 25 bp, Homo sapiens
aaagctgacccaacaagagctctct

SEQ ID NO: 4133 - DNA, 25 bp, Homo sapiens
actcttgctgtggtgctacgtggaa

SEQ ID NO: 4134 - DNA, 25 bp, Homo sapiens
caaatctgaactgcagctttccctc

SEQ ID NO: 4135 - DNA, 25 bp, Homo sapiens
gatagtcaactcagccttcagattg

SEQ ID NO: 4136 - DNA, 25 bp, Homo sapiens
tggtactcttcattcatttatctct

SEQ ID NO: 4137 - DNA, 25 bp, Homo sapiens
tgaaagactcttggggtctgtttct

SEQ ID NO: 4138 - DNA, 25 bp, Homo sapiens
gaattgcattatgttctctggtaac

SEQ ID NO: 4139 - DNA, 25 bp, Homo sapiens
aacacgtagagttcagacccttctg

SEQ ID NO: 4140 - DNA, 25 bp, Homo sapiens
gaactctgttgataataccacacca

SEQ ID NO: 4141 - DNA, 25 bp, Homo sapiens
acctcgtcaccacggtcaggaggag

SEQ ID NO: 4142 - DNA, 25 bp, Homo sapiens
gaggaggttcagacattctgcccag

SEQ ID NO: 4143 - DNA, 25 bp, Homo sapiens
atggagagtggcttggctgtttccc

SEQ ID NO: 4144 - DNA, 25 bp, Homo sapiens
ctgtttccccctgcatattggggtt

SEQ ID NO: 4145 - DNA, 25 bp, Homo sapiens
aatatacaagctagaccctgttccc

SEQ ID NO: 4146 - DNA, 25 bp, Homo sapiens
gtctcccctaattgacattctatca

SEQ ID NO: 4147 - DNA, 25 bp, Homo sapiens
aggtggcgggaggggtcagtgactc

SEQ ID NO: 4148 - DNA, 25 bp, Homo sapiens
ctctgggggtctcctcagtgacccc

SEQ ID NO: 4149 - DNA, 25 bp, Homo sapiens
ccatacctcatcatgaacccttggg

SEQ ID NO: 4150 - DNA, 25 bp, Homo sapiens
acccttgggtagcttgattctgcct

SEQ ID NO: 4151 - DNA, 25 bp, Homo sapiens
gattctgcctaccatccaggaaaac

SEQ ID NO: 4152 - DNA, 25 bp, Homo sapiens
ctcttcgagagaacctgtcgccagt

SEQ ID NO: 4153 - DNA, 25 bp, Homo sapiens
cgagagaacctgtcgccagtatgac

SEQ ID NO: 4154 - DNA, 25 bp, Homo sapiens
gtcgccagtatgacaagctgcgtaa

SEQ ID NO: 4155 - DNA, 25 bp, Homo sapiens
gccagtatgacaagctgcgtaagcg

SEQ ID NO: 4156 - DNA, 25 bp, Homo sapiens
ccttcctggagcagttccgcaagga

SEQ ID NO: 4157 - DNA, 25 bp, Homo sapiens
gacacatccagggagattgtgcagc

SEQ ID NO: 4158 - DNA, 25 bp, Homo sapiens
gcagctcatcgatgagtaccatgcg

SEQ ID NO: 4159 - DNA, 25 bp, Homo sapiens
accccctcagagcacagatcaggga

SEQ ID NO: 4160 - DNA, 25 bp, Homo sapiens
cctcagagcacagatcagggacctc

SEQ ID NO: 4161 - DNA, 25 bp, Homo sapiens
tctctttctcatatacatggactct

SEQ ID NO: 4162 - DNA, 25 bp, Homo sapiens
catatacatggactctctgttggcc

SEQ ID NO: 4163 - DNA, 25 bp, Homo sapiens
aaccatcacatatgagtctccacag

SEQ ID NO: 4164 - DNA, 25 bp, Homo sapiens
gattgatggcggggctggtggtgat

SEQ ID NO: 4165 - DNA, 25 bp, Homo sapiens
tgattcgggcacgttactgaccgca

SEQ ID NO: 4166 - DNA, 25 bp, Homo sapiens
aaaccatcacatctgagtccgtgtc

SEQ ID NO: 4167 - DNA, 25 bp, Homo sapiens
gagtccgtgtcaacaacgacaacca

SEQ ID NO: 4168 - DNA, 25 bp, Homo sapiens
gatattgatcatgaccaggcactgg

SEQ ID NO: 4169 - DNA, 25 bp, Homo sapiens
caacactcaactttgtgaacccctg

SEQ ID NO: 4170 - DNA, 25 bp, Homo sapiens
tgaacccctgaagattttttgaccg

SEQ ID NO: 4171 - DNA, 25 bp, Homo sapiens
caagtcttaatgccacaccactatt

SEQ ID NO: 4172 - DNA, 25 bp, Homo sapiens
ctttccttaccagctctggtctata

SEQ ID NO: 4173 - DNA, 25 bp, Homo sapiens
tctggtctatattgctcccatgcat

SEQ ID NO: 4174 - DNA, 25 bp, Homo sapiens
cattatttgaacacttgggtagaac

SEQ ID NO: 4175 - DNA, 25 bp, Homo sapiens
gttattgagcaggcctatctctttc

SEQ ID NO: 4176 - DNA, 25 bp, Homo sapiens
gcaggcctatctctttcagatagtt

SEQ ID NO: 4177 - DNA, 25 bp, Homo sapiens
gattcacacaggtttgaggatgctg

SEQ ID NO: 4178 - DNA, 25 bp, Homo sapiens
gtggtggtgttctgttggttacaag

SEQ ID NO: 4179 - DNA, 25 bp, Homo sapiens
gttataccatttaaagctggcacca

SEQ ID NO: 4180 - DNA, 25 bp, Homo sapiens
aaagctggcaccagagacccgatag

SEQ ID NO: 4181 - DNA, 25 bp, Homo sapiens
gagacccgatagggacttattaact

SEQ ID NO: 4182 - DNA, 25 bp, Homo sapiens
ctttgcctttgaccctatgtatagt

SEQ ID NO: 4183 - DNA, 25 bp, Homo sapiens
gtatagttacgatgccagattagat

SEQ ID NO: 4184 - DNA, 25 bp, Homo sapiens
agattagatttatagcagcctcaag

SEQ ID NO: 4185 - DNA, 25 bp, Homo sapiens
agaagaggatagccaggtgcccagc

SEQ ID NO: 4186 - DNA, 25 bp, Homo sapiens
ggtgcccagcattagagactgcaat

SEQ ID NO: 4187 - DNA, 25 bp, Homo sapiens
caatggaagtcggtcccagcagtgg

SEQ ID NO: 4188 - DNA, 25 bp, Homo sapiens
gcagtggcttcttcgaaacgtcacc

SEQ ID NO: 4189 - DNA, 25 bp, Homo sapiens
acgtcaccctgccagaaatattctg

SEQ ID NO: 4190 - DNA, 25 bp, Homo sapiens
ttgactgggctacctcagcatacat

SEQ ID NO: 4191 - DNA, 25 bp, Homo sapiens
catacatttctgccacattcttaag

SEQ ID NO: 4192 - DNA, 25 bp, Homo sapiens
gacttctctagcttttcactagctg

SEQ ID NO: 4193 - DNA, 25 bp, Homo sapiens
agccttcctgtccatggacgtgaaa

SEQ ID NO: 4194 - DNA, 25 bp, Homo sapiens
gagactgtgcacactgatgtttaca

SEQ ID NO: 4195 - DNA, 25 bp, Homo sapiens
ggtttgcttgcacatcagtagtttc

SEQ ID NO: 4196 - DNA, 25 bp, Homo sapiens
tgaagaagccgcgatggccatagcc

SEQ ID NO: 4197 - DNA, 25 bp, Homo sapiens
aagtcccacaaataactcgctcatg

SEQ ID NO: 4198 - DNA, 25 bp, Homo sapiens
gtgtacaactcattttgcgccaatt

SEQ ID NO: 4199 - DNA, 25 bp, Homo sapiens
agaacaaaaacgtggcactcctctc

SEQ ID NO: 4200 - DNA, 25 bp, Homo sapiens
aggcgcagagattcaggttctcccc

SEQ ID NO: 4201 - DNA, 25 bp, Homo sapiens
gtcgatcacatgagcgggctctctg

SEQ ID NO: 4202 - DNA, 25 bp, Homo sapiens
gctctctggcgtcaacgtgccagga

SEQ ID NO: 4203 - DNA, 25 bp, Homo sapiens
gcattttcatctacaacctggggca

SEQ ID NO: 4204 - DNA, 25 bp, Homo sapiens
tgccgacgaggggatcctctggcag

SEQ ID NO: 4205 - DNA, 25 bp, Homo sapiens
cagatgtttgggccgtttggtgccg

SEQ ID NO: 4206 - DNA, 25 bp, Homo sapiens
gtgaaagtgatccgcgacttcaaca

SEQ ID NO: 4207 - DNA, 25 bp, Homo sapiens
aagcattacctttctacattccaga

SEQ ID NO: 4208 - DNA, 25 bp, Homo sapiens
aagcctctttaaatcggtgtatcct

SEQ ID NO: 4209 - DNA, 25 bp, Homo sapiens
gtatccttttgaagcagtcctttct

SEQ ID NO: 4210 - DNA, 25 bp, Homo sapiens
ggagtgtttcttgtgccattaacca

SEQ ID NO: 4211 - DNA, 25 bp, Homo sapiens
taaccatgtagtttgtaccatcact

SEQ ID NO: 4212 - DNA, 25 bp, Homo sapiens
gcttggaacagtacacatgcaccac

SEQ ID NO: 4213 - DNA, 25 bp, Homo sapiens
atgcaccacaacaaaggctcatcaa

SEQ ID NO: 4214 - DNA, 25 bp, Homo sapiens
gaacgaaatctctcattgtgtgccg

SEQ ID NO: 4215 - DNA, 25 bp, Homo sapiens
gtgtgccgtgtggctcaaaaccgaa

SEQ ID NO: 4216 - DNA, 25 bp, Homo sapiens
tttgttttcctctcagactttatgg

SEQ ID NO: 4217 - DNA, 25 bp, Homo sapiens
gtgaccgggtcttatgcaaattttc

SEQ ID NO: 4218 - DNA, 25 bp, Homo sapiens
tccctgtgtgtaccttatgtcatag

SEQ ID NO: 4219 - DNA, 25 bp, Homo sapiens
tagcttctggtgttgttcctttact

SEQ ID NO: 4220 - DNA, 25 bp, Homo sapiens
tagtccatcggcggatttatccatt

SEQ ID NO: 4221 - DNA, 25 bp, Homo sapiens
caagtccgccagtttaagcgccttt

SEQ ID NO: 4222 - DNA, 25 bp, Homo sapiens
agtaccttgtgggtcaacgactcgt

SEQ ID NO: 4223 - DNA, 25 bp, Homo sapiens
tctggcaaacaaggctcatctccac

SEQ ID NO: 4224 - DNA, 25 bp, Homo sapiens
gttgtctcaacaacttgaccttccc

SEQ ID NO: 4225 - DNA, 25 bp, Homo sapiens
gtgatctctcagcgttgtttttaag

SEQ ID NO: 4226 - DNA, 25 bp, Homo sapiens
gtatttgacttgtgttctcagcatt

SEQ ID NO: 4227 - DNA, 25 bp, Homo sapiens
cggtgtaagattctgctgttctccc

SEQ ID NO: 4228 - DNA, 25 bp, Homo sapiens
tccctggatcttctgacattactgc

SEQ ID NO: 4229 - DNA, 25 bp, Homo sapiens
tttctcttggaggttggcattgtaa

SEQ ID NO: 4230 - DNA, 25 bp, Homo sapiens
acagcttaaggttcatggattctaa

SEQ ID NO: 4231 - DNA, 25 bp, Homo sapiens
ttgttctctaaacccggtttggctg

SEQ ID NO: 4232 - DNA, 25 bp, Homo sapiens
gctgccttgtgaaatgattccctgc

SEQ ID NO: 4233 - DNA, 25 bp, Homo sapiens
gattccctgcagtaaacggactttt

SEQ ID NO: 4234 - DNA, 25 bp, Homo sapiens
atcattcaaacttccattcacatct

SEQ ID NO: 4235 - DNA, 25 bp, Homo sapiens
aacttccattcacatctgcatgatt

SEQ ID NO: 4236 - DNA, 25 bp, Homo sapiens
caaaacctcatattgtctttacatg

SEQ ID NO: 4237 - DNA, 25 bp, Homo sapiens
ttgtctttacatgtttccaatggaa

SEQ ID NO: 4238 - DNA, 25 bp, Homo sapiens
tcagtttattacgtttcacttgatt

SEQ ID NO: 4239 - DNA, 25 bp, Homo sapiens
aaaccatgtacgttgcagcttaaca

SEQ ID NO: 4240 - DNA, 25 bp, Homo sapiens
acttgacagcagtggacgtcccaac

SEQ ID NO: 4241 - DNA, 25 bp, Homo sapiens
tgtctacaacctgttgtctctgcgc

SEQ ID NO: 4242 - DNA, 25 bp, Homo sapiens
acagatgagctgacgcccattgagt

SEQ ID NO: 4243 - DNA, 25 bp, Homo sapiens
ccattgagtctgctgtctctgtgtt

SEQ ID NO: 4244 - DNA, 25 bp, Homo sapiens
gtctctgtgttcaaggcagccaact

SEQ ID NO: 4245 - DNA, 25 bp, Homo sapiens
atgtttggagtcttctttgctaacc

SEQ ID NO: 4246 - DNA, 25 bp, Homo sapiens
tttgctaaccaccctgatctaagaa

SEQ ID NO: 4247 - DNA, 25 bp, Homo sapiens
ttcgagggacatcctttccggaaag

SEQ ID NO: 4248 - DNA, 25 bp, Homo sapiens
gtggcagagccggtggagttggccc

SEQ ID NO: 4249 - DNA, 25 bp, Homo sapiens
ggcccaagagttccgcaaatttgac

SEQ ID NO: 4250 - DNA, 25 bp, Homo sapiens
gaagcctgatgccaagtagctccag

SEQ ID NO: 4251 - DNA, 25 bp, Homo sapiens
tacattcccttcgtgtctttgataa

SEQ ID NO: 4252 - DNA, 25 bp, Homo sapiens
aactccatactcttcagactgtgat

SEQ ID NO: 4253 - DNA, 25 bp, Homo sapiens
attgtgtaaatgtctatctgccctg

SEQ ID NO: 4254 - DNA, 25 bp, Homo sapiens
atctgccctggtttgtgtgaactgg

SEQ ID NO: 4255 - DNA, 25 bp, Homo sapiens
gggtgtttgtggttatcttacctgg

SEQ ID NO: 4256 - DNA, 25 bp, Homo sapiens
agttcttatgtttatcttgcttttc

SEQ ID NO: 4257 - DNA, 25 bp, Homo sapiens
cttgcttttcatgtgtctttctgta

SEQ ID NO: 4258 - DNA, 25 bp, Homo sapiens
gactccaagtgctattgtcacagat

SEQ ID NO: 4259 - DNA, 25 bp, Homo sapiens
cagatctcgctctcgtacataagat

SEQ ID NO: 4260 - DNA, 25 bp, Homo sapiens
acagttttcctttattcagtacaat

SEQ ID NO: 4261 - DNA, 25 bp, Homo sapiens
attgcattcttgtaatatccccttg

SEQ ID NO: 4262 - DNA, 25 bp, Homo sapiens
gtgcctaaaggactgccagccaagc

SEQ ID NO: 4263 - DNA, 25 bp, Homo sapiens
gccaagctcagagtgctcgatctca

SEQ ID NO: 4264 - DNA, 25 bp, Homo sapiens
gcaacagactgaacagggcgccgca

SEQ ID NO: 4265 - DNA, 25 bp, Homo sapiens
tgacgagctgcccgaggtggataac

SEQ ID NO: 4266 - DNA, 25 bp, Homo sapiens
ctgacactggacgggaatcccttcc

SEQ ID NO: 4267 - DNA, 25 bp, Homo sapiens
acgagggctcaatgaactccggcgt

SEQ ID NO: 4268 - DNA, 25 bp, Homo sapiens
cccggggctttgcctaagatccaag

SEQ ID NO: 4269 - DNA, 25 bp, Homo sapiens
gggagtcccgtcaggacgttgagga

SEQ ID NO: 4270 - DNA, 25 bp, Homo sapiens
tgaggacttttcgaccaattcaacc

SEQ ID NO: 4271 - DNA, 25 bp, Homo sapiens
ccatccagaatctagcgctgcgcaa

SEQ ID NO: 4272 - DNA, 25 bp, Homo sapiens
ccctagcgctccgagatgcatgtgg

SEQ ID NO: 4273 - DNA, 25 bp, Homo sapiens
caaatgatgtgcaaaaccttttact

SEQ ID NO: 4274 - DNA, 25 bp, Homo sapiens
accttttactggttgcatggaaatc

SEQ ID NO: 4275 - DNA, 25 bp, Homo sapiens
gaaatcagccaagttttataatcct

SEQ ID NO: 4276 - DNA, 25 bp, Homo sapiens
aatccttaaatcttaatgttcctca

SEQ ID NO: 4277 - DNA, 25 bp, Homo sapiens
taatgttcctcaaagcttggattaa

SEQ ID NO: 4278 - DNA, 25 bp, Homo sapiens
atacatatggatgttactctcttgc

SEQ ID NO: 4279 - DNA, 25 bp, Homo sapiens
taggtggtagatattgaggccaaga

SEQ ID NO: 4280 - DNA, 25 bp, Homo sapiens
aatacatgaagcttcatgcacttaa

SEQ ID NO: 4281 - DNA, 25 bp, Homo sapiens
aagaatttgcatacttacctagtga

SEQ ID NO: 4282 - DNA, 25 bp, Homo sapiens
gcatacttacctagtgaaacttttc

SEQ ID NO: 4283 - DNA, 25 bp, Homo sapiens
cactctaagtcatgtatgtttctct

SEQ ID NO: 4284 - DNA, 25 bp, Homo sapiens
aataatgttgcacttgtttactaaa

SEQ ID NO: 4285 - DNA, 25 bp, Homo sapiens
ttgttccatgggtgtacacgtagac

SEQ ID NO: 4286 - DNA, 25 bp, Homo sapiens
gtacacgtagacagacacacataca

SEQ ID NO: 4287 - DNA, 25 bp, Homo sapiens
cacacatacacccaaattattgcat

SEQ ID NO: 4288 - DNA, 25 bp, Homo sapiens
gtcaggaagactacctgtcatgaag

SEQ ID NO: 4289 - DNA, 25 bp, Homo sapiens
gtaccatctatgtgcaattatactc

SEQ ID NO: 4290 - DNA, 25 bp, Homo sapiens
aaattccactacactacattaaagt

SEQ ID NO: 4291 - DNA, 25 bp, Homo sapiens
atcagtgatgcatttgttatagagt

SEQ ID NO: 4292 - DNA, 25 bp, Homo sapiens
gagtataactcatcgtttacagtat

SEQ ID NO: 4293 - DNA, 25 bp, Homo sapiens
gttggcagtatcatacctagatggt

SEQ ID NO: 4294 - DNA, 25 bp, Homo sapiens
tgaagaattacatgccttctggtgg

SEQ ID NO: 4295 - DNA, 25 bp, Homo sapiens
gatgaagttatcattcccacagctc

SEQ ID NO: 4296 - DNA, 25 bp, Homo sapiens
acagctcccttatacaaacagatcc

SEQ ID NO: 4297 - DNA, 25 bp, Homo sapiens
gacctggatgtcttcctgaagcatg

SEQ ID NO: 4298 - DNA, 25 bp, Homo sapiens
ctgaagcatgtacgtcttctgtccc

SEQ ID NO: 4299 - DNA, 25 bp, Homo sapiens
gtcttctgtcccgtaaacagttcca

SEQ ID NO: 4300 - DNA, 25 bp, Homo sapiens
aacagttccagctgagggcactaat

SEQ ID NO: 4301 - DNA, 25 bp, Homo sapiens
gaaagactgccggtctcagtgacct

SEQ ID NO: 4302 - DNA, 25 bp, Homo sapiens
gtctcagtgacctctactgacttct

SEQ ID NO: 4303 - DNA, 25 bp, Homo sapiens
actgacttctctgataccagctgga

SEQ ID NO: 4304 - DNA, 25 bp, Homo sapiens
ctcttccttttatcagtaggtgccc

SEQ ID NO: 4305 - DNA, 25 bp, Homo sapiens
attaatgcactttctatcctctgta

SEQ ID NO: 4306 - DNA, 25 bp, Homo sapiens
ggatgtattcttaaaccgcatgact

SEQ ID NO: 4307 - DNA, 25 bp, Homo sapiens
accgcatgactattcagatggctac

SEQ ID NO: 4308 - DNA, 25 bp, Homo sapiens
gatggctactgagttatcagtggcc

SEQ ID NO: 4309 - DNA, 25 bp, Homo sapiens
atcagtggccatttattagcatcat

SEQ ID NO: 4310 - DNA, 25 bp, Homo sapiens
aactgtgtttttctcgattatctaa

SEQ ID NO: 4311 - DNA, 25 bp, Homo sapiens
atgactttagctgatactcttatgt

SEQ ID NO: 4312 - DNA, 25 bp, Homo sapiens
atgtacgagatctgtctctgctgtt

SEQ ID NO: 4313 - DNA, 25 bp, Homo sapiens
tcagctggtttcaactctactgcga

SEQ ID NO: 4314 - DNA, 25 bp, Homo sapiens
gctccttaaaagtactgttctcctt

SEQ ID NO: 4315 - DNA, 25 bp, Homo sapiens
tgttctccttcagtggcatgtagtt

SEQ ID NO: 4316 - DNA, 25 bp, Homo sapiens
tatctaatcaagacacctcattcaa

SEQ ID NO: 4317 - DNA, 25 bp, Homo sapiens
taatcattttcctaagctgtccttt

SEQ ID NO: 4318 - DNA, 25 bp, Homo sapiens
gctgtccttttgaggcttagtcagt

SEQ ID NO: 4319 - DNA, 25 bp, Homo sapiens
ggattattccttgctattagtactc

SEQ ID NO: 4320 - DNA, 25 bp, Homo sapiens
gtatgttacccttcagtaagttctc

SEQ ID NO: 4321 - DNA, 25 bp, Homo sapiens
ggactgaaaggattcttttctacat

SEQ ID NO: 4322 - DNA, 25 bp, Homo sapiens
gtgtgttgtcatatttggcttttgc

SEQ ID NO: 4323 - DNA, 25 bp, Homo sapiens
gtatagtttctttggtgtatcttaa

SEQ ID NO: 4324 - DNA, 25 bp, Homo sapiens
tgataatcatttgggcagcttgggt

SEQ ID NO: 4325 - DNA, 25 bp, Homo sapiens
ggcagcttgggtaagtacgcaactt

SEQ ID NO: 4326 - DNA, 25 bp, Homo sapiens
tttccaccaaagaactgtcagcagc

SEQ ID NO: 4327 - DNA, 25 bp, Homo sapiens
tgtatgtatcctgttgacttttcca

SEQ ID NO: 4328 - DNA, 25 bp, Homo sapiens
agcagaatcagtgcctagcctgtgc

SEQ ID NO: 4329 - DNA, 25 bp, Homo sapiens
tgagtgacctgcaggccattatcag

SEQ ID NO: 4330 - DNA, 25 bp, Homo sapiens
gccattatcagtgcctcatctgtgc

SEQ ID NO: 4331 - DNA, 25 bp, Homo sapiens
gagagggaccatccaaatacctaag

SEQ ID NO: 4332 - DNA, 25 bp, Homo sapiens
tttcagctgttcccaaaggcctggg

SEQ ID NO: 4333 - DNA, 25 bp, Homo sapiens
atgtggggcttgattcacccttcat

SEQ ID NO: 4334 - DNA, 25 bp, Homo sapiens
ttcacccttcatccattggctggaa

SEQ ID NO: 4335 - DNA, 25 bp, Homo sapiens
ctacccccacgtggtgtaagcagag

SEQ ID NO: 4336 - DNA, 25 bp, Homo sapiens
gaattggttcacttaactcccagca

SEQ ID NO: 4337 - DNA, 25 bp, Homo sapiens
aaacatcctcctgccacttaggagg

SEQ ID NO: 4338 - DNA, 25 bp, Homo sapiens
aacacctccctatggtaccatttat

SEQ ID NO: 4339 - DNA, 25 bp, Homo sapiens
aagaatttgctgctggtgtcttctc

SEQ ID NO: 4340 - DNA, 25 bp, Homo sapiens
cgaaccgcagctgccaatgcagccg

SEQ ID NO: 4341 - DNA, 25 bp, Homo sapiens
tggggctgctgaaaatgccttccgg

SEQ ID NO: 4342 - DNA, 25 bp, Homo sapiens
ctggccctgctacttgagggagctg

SEQ ID NO: 4343 - DNA, 25 bp, Homo sapiens
cctatggccatgactgctgaacctg

SEQ ID NO: 4344 - DNA, 25 bp, Homo sapiens
gaacctgacaggcgtgtggggagtt

SEQ ID NO: 4345 - DNA, 25 bp, Homo sapiens
gggagttcactgtgacctagtcccc

SEQ ID NO: 4346 - DNA, 25 bp, Homo sapiens
gggattcagtggctggatctctgct

SEQ ID NO: 4347 - DNA, 25 bp, Homo sapiens
ctgctctggtggtgccgaagggcaa

SEQ ID NO: 4348 - DNA, 25 bp, Homo sapiens
acacagcagtatccgtgctcatgct

SEQ ID NO: 4349 - DNA, 25 bp, Homo sapiens
gtcatgctgaaacggatccactcct

SEQ ID NO: 4350 - DNA, 25 bp, Homo sapiens
gaagacagcttttccgctgaagctt

SEQ ID NO: 4351 - DNA, 25 bp, Homo sapiens
aggcattaacgcttctttagatctg

SEQ ID NO: 4352 - DNA, 25 bp, Homo sapiens
gttaagcttgtctggtcaacattcc

SEQ ID NO: 4353 - DNA, 25 bp, Homo sapiens
aatcagctttcatctataattcatt

SEQ ID NO: 4354 - DNA, 25 bp, Homo sapiens
gtatccagatttaaacctaccagtt

SEQ ID NO: 4355 - DNA, 25 bp, Homo sapiens
gaagcccattaattgggttccccat

SEQ ID NO: 4356 - DNA, 25 bp, Homo sapiens
ttccccattaaatcgtttacataca

SEQ ID NO: 4357 - DNA, 25 bp, Homo sapiens
cttgtaaagttcatgtctttcaccc

SEQ ID NO: 4358 - DNA, 25 bp, Homo sapiens
gtctttcacccagatatatcaaatg

SEQ ID NO: 4359 - DNA, 25 bp, Homo sapiens
gaccagtgtgacttcattagataac

SEQ ID NO: 4360 - DNA, 25 bp, Homo sapiens
tttgttgacctaatgtaacccttgt

SEQ ID NO: 4361 - DNA, 25 bp, Homo sapiens
agacctattcaagtgatgctcatga

SEQ ID NO: 4362 - DNA, 25 bp, Homo sapiens
tgctcatgatcctgttactgtgtgc

SEQ ID NO: 4363 - DNA, 25 bp, Homo sapiens
tttttagtgttgcccttgctgtgta

SEQ ID NO: 4364 - DNA, 25 bp, Homo sapiens
aaacgctctatctagtttacctagc

SEQ ID NO: 4365 - DNA, 25 bp, Homo sapiens
aactgcgctagtatggactttttgg

SEQ ID NO: 4366 - DNA, 25 bp, Homo sapiens
gacttagtttttgcacataaccttg

SEQ ID NO: 4367 - DNA, 25 bp, Homo sapiens
acaatcttgcaacagaggccagcca

SEQ ID NO: 4368 - DNA, 25 bp, Homo sapiens
agaggccagccacgtaagatatata

SEQ ID NO: 4369 - DNA, 25 bp, Homo sapiens
atatatctggactctcttgtattat

SEQ ID NO: 4370 - DNA, 25 bp, Homo sapiens
gaatatccttgacattacagctgtc

SEQ ID NO: 4371 - DNA, 25 bp, Homo sapiens
gcagctactaattttgacacctttt

SEQ ID NO: 4372 - DNA, 25 bp, Homo sapiens
gttgttccttctcaaggcgattcag

SEQ ID NO: 4373 - DNA, 25 bp, Homo sapiens
ggcgattcagactctgacacagaca

SEQ ID NO: 4374 - DNA, 25 bp, Homo sapiens
gtgacagaacatacccctttactga

SEQ ID NO: 4375 - DNA, 25 bp, Homo sapiens
tgagacctttagcttctgtcagtgc

SEQ ID NO: 4376 - DNA, 25 bp, Homo sapiens
ccagtcatttggggctttatcggaa

SEQ ID NO: 4377 - DNA, 25 bp, Homo sapiens
ttatcggaatcccgctcacatcaga

SEQ ID NO: 4378 - DNA, 25 bp, Homo sapiens
gaacatgatgtcgtggtccagttgc

SEQ ID NO: 4379 - DNA, 25 bp, Homo sapiens
gtggtccagttgcagcctaatggtg

SEQ ID NO: 4380 - DNA, 25 bp, Homo sapiens
gattttttgctcccttcaaagattt

SEQ ID NO: 4381 - DNA, 25 bp, Homo sapiens
gactggtgctgtaactcaagcatca

SEQ ID NO: 4382 - DNA, 25 bp, Homo sapiens
aaacctgtccagtgtgcaagcaaaa

SEQ ID NO: 4383 - DNA, 25 bp, Homo sapiens
gatatcatcgcaagactccgggagg

SEQ ID NO: 4384 - DNA, 25 bp, Homo sapiens
agagctcccggactttcaagatggg

SEQ ID NO: 4385 - DNA, 25 bp, Homo sapiens
cacagtgacgacgagggcaccgtgc

SEQ ID NO: 4386 - DNA, 25 bp, Homo sapiens
tgtgtgggagaccatcgtgtgcacc

SEQ ID NO: 4387 - DNA, 25 bp, Homo sapiens
agaaggggagattgcccagttcctc

SEQ ID NO: 4388 - DNA, 25 bp, Homo sapiens
ccagttcctctgtgacatcaagcat

SEQ ID NO: 4389 - DNA, 25 bp, Homo sapiens
catcaagcatgtggtcctgtacccg

SEQ ID NO: 4390 - DNA, 25 bp, Homo sapiens
gtctccgcaacatcgcggtgggcaa

SEQ ID NO: 4391 - DNA, 25 bp, Homo sapiens
actgctgcggtgttgcacagatgcg

SEQ ID NO: 4392 - DNA, 25 bp, Homo sapiens
acagatgcgtgaacacagctccctg

SEQ ID NO: 4393 - DNA, 25 bp, Homo sapiens
gaagctaccgagcgagtccggaagt

SEQ ID NO: 4394 - DNA, 25 bp, Homo sapiens
cgcttgccttgccatgagaatcggg

SEQ ID NO: 4395 - DNA, 25 bp, Homo sapiens
agaatcgggagtgctccaagctgcc

SEQ ID NO: 4396 - DNA, 25 bp, Homo sapiens
gctgcctctgagaataacctactac

SEQ ID NO: 4397 - DNA, 25 bp, Homo sapiens
ctctgagaataacctactaccacct

SEQ ID NO: 4398 - DNA, 25 bp, Homo sapiens
ctccagtgctgtccccggggacagc

SEQ ID NO: 4399 - DNA, 25 bp, Homo sapiens
ctgtccccggggacagcatgcagct

SEQ ID NO: 4400 - DNA, 25 bp, Homo sapiens
tggccatcaccggcggcaatgagga

SEQ ID NO: 4401 - DNA, 25 bp, Homo sapiens
caatgaggagggctttttcaccacc

SEQ ID NO: 4402 - DNA, 25 bp, Homo sapiens
acttgctcctgaccgtcaagatgga

SEQ ID NO: 4403 - DNA, 25 bp, Homo sapiens
gaccgtcaagatggatctctctcgc

SEQ ID NO: 4404 - DNA, 25 bp, Homo sapiens
tcctttgtggccaagcttttcatct

SEQ ID NO: 4405 - DNA, 25 bp, Homo sapiens
ttctacatcatctacatggccatcc

SEQ ID NO: 4406 - DNA, 25 bp, Homo sapiens
cctgctgcctggaatcttctaaggg

SEQ ID NO: 4407 - DNA, 25 bp, Homo sapiens
cacgccctagggagaagccctgtgg

SEQ ID NO: 4408 - DNA, 25 bp, Homo sapiens
ggctgtcaagagcgtgttctgccag

SEQ ID NO: 4409 - DNA, 25 bp, Homo sapiens
gcatcccagctccaactcgaggagc

SEQ ID NO: 4410 - DNA, 25 bp, Homo sapiens
aggtgtccagtacctaatcacgctc

SEQ ID NO: 4411 - DNA, 25 bp, Homo sapiens
tattgccagcacagacggattttct

SEQ ID NO: 4412 - DNA, 25 bp, Homo sapiens
ggattttctctaatcagtgtccctg

SEQ ID NO: 4413 - DNA, 25 bp, Homo sapiens
cctgtattaggagcccaggccacgc

SEQ ID NO: 4414 - DNA, 25 bp, Homo sapiens
actctgcccacactggtgagcagga

SEQ ID NO: 4415 - DNA, 25 bp, Homo sapiens
attaggctgcatttactcttgctaa

SEQ ID NO: 4416 - DNA, 25 bp, Homo sapiens
ctccttggtagcgtgcacggtgttg

SEQ ID NO: 4417 - DNA, 25 bp, Homo sapiens
gcgtgcacggtgttgaactgggaca

SEQ ID NO: 4418 - DNA, 25 bp, Homo sapiens
gaactgggacactggggagaaaggg

SEQ ID NO: 4419 - DNA, 25 bp, Homo sapiens
gaaaggggctttcatgtcgtttcct

SEQ ID NO: 4420 - DNA, 25 bp, Homo sapiens
gtctgcagacctcagagaggtccca

SEQ ID NO: 4421 - DNA, 25 bp, Homo sapiens
aggtgtaggcaggtgggctctgctt

SEQ ID NO: 4422 - DNA, 25 bp, Homo sapiens
tgactgtgcagactctggctcgagc

SEQ ID NO: 4423 - DNA, 25 bp, Homo sapiens
tctccagcgaggaggtctcagtccc

SEQ ID NO: 4424 - DNA, 25 bp, Homo sapiens
tcttcctcatccctagggtgttgtg

SEQ ID NO: 4425 - DNA, 25 bp, Homo sapiens
gaactctttttaaactctatgctcc

SEQ ID NO: 4426 - DNA, 25 bp, Homo sapiens
ctatgctccgagtagagttcatctt

SEQ ID NO: 4427 - DNA, 25 bp, Homo sapiens
ccaccgctggctgggaggagtcgga

SEQ ID NO: 4428 - DNA, 25 bp, Homo sapiens
gaggtggagcccgagtttgggacca

SEQ ID NO: 4429 - DNA, 25 bp, Homo sapiens
gaccaaggtggagcccgagtttgag

SEQ ID NO: 4430 - DNA, 25 bp, Homo sapiens
gagacccagttggagcctgagttcg

SEQ ID NO: 4431 - DNA, 25 bp, Homo sapiens
cccagctggaacccgagtttgagga

SEQ ID NO: 4432 - DNA, 25 bp, Homo sapiens
ggagatagccactggccaggcattc

SEQ ID NO: 4433 - DNA, 25 bp, Homo sapiens
ttctgagatcagcgtcctaccaaga

SEQ ID NO: 4434 - DNA, 25 bp, Homo sapiens
tcagcacatggaaggcccctggtat

SEQ ID NO: 4435 - DNA, 25 bp, Homo sapiens
gtcctgcccctttgagggggtgcaa

SEQ ID NO: 4436 - DNA, 25 bp, Homo sapiens
gccagaggctgtgtagaggctcctg

SEQ ID NO: 4437 - DNA, 25 bp, Homo sapiens
gagggagggagccaaggtcactcca

SEQ ID NO: 4438 - DNA, 25 bp, Homo sapiens
ctgaagcgcagaaagctcggccggt

SEQ ID NO: 4439 - DNA, 25 bp, Homo sapiens
gggcaccgtcatgtatgtaggtctc

SEQ ID NO: 4440 - DNA, 25 bp, Homo sapiens
ggtctcacagatttcaagcctggct

SEQ ID NO: 4441 - DNA, 25 bp, Homo sapiens
gcctggctactggattggtgtccgc

SEQ ID NO: 4442 - DNA, 25 bp, Homo sapiens
gtgtccgctatgatgagccactggg

SEQ ID NO: 4443 - DNA, 25 bp, Homo sapiens
aatgccaggccaagtatggcgcctt

SEQ ID NO: 4444 - DNA, 25 bp, Homo sapiens
atggcgcctttgtcaagccagcagt

SEQ ID NO: 4445 - DNA, 25 bp, Homo sapiens
gccagcagtcgtgacggtgggggac

SEQ ID NO: 4446 - DNA, 25 bp, Homo sapiens
tgacacctaaggaattcccctgctt

SEQ ID NO: 4447 - DNA, 25 bp, Homo sapiens
tctcctgaccccattttaattttat

SEQ ID NO: 4448 - DNA, 25 bp, Homo sapiens
tttattcattttttcctttgccatt

SEQ ID NO: 4449 - DNA, 25 bp, Homo sapiens
tatcactgtctgacatcctgcaggc

SEQ ID NO: 4450 - DNA, 25 bp, Homo sapiens
tgggggaaggggtcatgcagcacca

SEQ ID NO: 4451 - DNA, 25 bp, Homo sapiens
gggaattgtgactctgttccctgtt

SEQ ID NO: 4452 - DNA, 25 bp, Homo sapiens
ctgcccttctatctgggagctaggg

SEQ ID NO: 4453 - DNA, 25 bp, Homo sapiens
gaatggatttatagctacccttacc

SEQ ID NO: 4454 - DNA, 25 bp, Homo sapiens
cttaccctcacacatacacttgaaa

SEQ ID NO: 4455 - DNA, 25 bp, Homo sapiens
aactttcagcctagccagttctagc

SEQ ID NO: 4456 - DNA, 25 bp, Homo sapiens
gatatatccccctttctgggtgaac

SEQ ID NO: 4457 - DNA, 25 bp, Homo sapiens
gaactataggctctgtgcctctcag

SEQ ID NO: 4458 - DNA, 25 bp, Homo sapiens
tggccctgattcaaccctaagataa

SEQ ID NO: 4459 - DNA, 25 bp, Homo sapiens
tttattcacctgttccgtgctatat

SEQ ID NO: 4460 - DNA, 25 bp, Homo sapiens
gttttaactcactctcatttgtaag

SEQ ID NO: 4461 - DNA, 25 bp, Homo sapiens
cactctcatttgtaagcagtccaca

SEQ ID NO: 4462 - DNA, 25 bp, Homo sapiens
aagcagtccacatagtagacaatgg

SEQ ID NO: 4463 - DNA, 25 bp, Homo sapiens
gtagacaatgggttttccaagctgg

SEQ ID NO: 4464 - DNA, 25 bp, Homo sapiens
ataacaaaacaagtagctctaggaa

SEQ ID NO: 4465 - DNA, 25 bp, Homo sapiens
gtaaacgatcatttgtgacctcaga

SEQ ID NO: 4466 - DNA, 25 bp, Homo sapiens
acgatcatttgtgacctcagacact

SEQ ID NO: 4467 - DNA, 25 bp, Homo sapiens
ttgtctagctgtttgatttcatttt

SEQ ID NO: 4468 - DNA, 25 bp, Homo sapiens
taccatgtgaaagtcctgttgaaat

SEQ ID NO: 4469 - DNA, 25 bp, Homo sapiens
ctgccccacaatcaagaatgtatgt

SEQ ID NO: 4470 - DNA, 25 bp, Homo sapiens
atcaaatgtcaaacttttacatgtg

SEQ ID NO: 4471 - DNA, 25 bp, Homo sapiens
aggcaacttctcataaaattcccat

SEQ ID NO: 4472 - DNA, 25 bp, Homo sapiens
taaaattcccatggttcttctcctt

SEQ ID NO: 4473 - DNA, 25 bp, Homo sapiens
tcttctcctttggctatttttcaaa

SEQ ID NO: 4474 - DNA, 25 bp, Homo sapiens
cctcattcacgctgacattctttgg

SEQ ID NO: 4475 - DNA, 25 bp, Homo sapiens
ggatacagccaaggcactggtacag

SEQ ID NO: 4476 - DNA, 25 bp, Homo sapiens
gaccagaggctggctatgtggctac

SEQ ID NO: 4477 - DNA, 25 bp, Homo sapiens
tggctacccccatagctatggttca

SEQ ID NO: 4478 - DNA, 25 bp, Homo sapiens
tggttcaggcagccatgactcttct

SEQ ID NO: 4479 - DNA, 25 bp, Homo sapiens
ctaagtgatgcttctcatctgccta

SEQ ID NO: 4480 - DNA, 25 bp, Homo sapiens
ctcatctgcctaaggcgggcggggt

SEQ ID NO: 4481 - DNA, 25 bp, Homo sapiens
gaaattcttctgtaagcctgtctga

SEQ ID NO: 4482 - DNA, 25 bp, Homo sapiens
gtctctcattttctcttgtggacca

SEQ ID NO: 4483 - DNA, 25 bp, Homo sapiens
tgcaactgtctctctgatgtgtgcc

SEQ ID NO: 4484 - DNA, 25 bp, Homo sapiens
tcaacacagtaacccctgcattctg

SEQ ID NO: 4485 - DNA, 25 bp, Homo sapiens
ccctcccatgtacatttggacgctg

SEQ ID NO: 4486 - DNA, 25 bp, Homo sapiens
ctgccagacgactacatcattctgc

SEQ ID NO: 4487 - DNA, 25 bp, Homo sapiens
ctgctgctcctagtgatctggactc

SEQ ID NO: 4488 - DNA, 25 bp, Homo sapiens
tcacctcggaggtatctgggctggc

SEQ ID NO: 4489 - DNA, 25 bp, Homo sapiens
ggccacagtccctggacagtgatcc

SEQ ID NO: 4490 - DNA, 25 bp, Homo sapiens
ccaagggatctgtcaccttcagcga

SEQ ID NO: 4491 - DNA, 25 bp, Homo sapiens
cagaaacctcttgtgttcttgccta

SEQ ID NO: 4492 - DNA, 25 bp, Homo sapiens
caggtgttcctggcagccaaatcga

SEQ ID NO: 4493 - DNA, 25 bp, Homo sapiens
ttatctgggtccttcaacaactgga

SEQ ID NO: 4494 - DNA, 25 bp, Homo sapiens
ggatggtcagtggacgcacgaccct

SEQ ID NO: 4495 - DNA, 25 bp, Homo sapiens
gcccatagtaaccagccagcttggc

SEQ ID NO: 4496 - DNA, 25 bp, Homo sapiens
gccagcttggcacagttaacaacat

SEQ ID NO: 4497 - DNA, 25 bp, Homo sapiens
attcccaaaagtgctccgatgtgtc

SEQ ID NO: 4498 - DNA, 25 bp, Homo sapiens
gacacggggatttcctgtgatccag

SEQ ID NO: 4499 - DNA, 25 bp, Homo sapiens
tgagcccaatcacgtcatgctgaac

SEQ ID NO: 4500 - DNA, 25 bp, Homo sapiens
acgtcatgctgaaccacctatacgc

SEQ ID NO: 4501 - DNA, 25 bp, Homo sapiens
ctatacgcgctgtctatcaaggatg

SEQ ID NO: 4502 - DNA, 25 bp, Homo sapiens
gcgcaacccaccggtacaagaagaa

SEQ ID NO: 4503 - DNA, 25 bp, Homo sapiens
agtacgtcaccaccttgttatacaa

SEQ ID NO: 4504 - DNA, 25 bp, Homo sapiens
tgctgggcagtgatgtcttcgagga

SEQ ID NO: 4505 - DNA, 25 bp, Homo sapiens
gatgtcttcgaggagcctatgtcag

SEQ ID NO: 4506 - DNA, 25 bp, Homo sapiens
gagccctgatgactcagatagcagc

SEQ ID NO: 4507 - DNA, 25 bp, Homo sapiens
ctgttttcaaccagcgctgcaagaa

SEQ ID NO: 4508 - DNA, 25 bp, Homo sapiens
gggagatgttttgtccagacctact

SEQ ID NO: 4509 - DNA, 25 bp, Homo sapiens
ttgtccagacctactagacccaaca

SEQ ID NO: 4510 - DNA, 25 bp, Homo sapiens
attgatttgactcctgttcttaaac

SEQ ID NO: 4511 - DNA, 25 bp, Homo sapiens
ggaactggacgtcaccaaacaaggt

SEQ ID NO: 4512 - DNA, 25 bp, Homo sapiens
tatagttttccacaaccaagccacc

SEQ ID NO: 4513 - DNA, 25 bp, Homo sapiens
gatgctggcatggcaatcagaccaa

SEQ ID NO: 4514 - DNA, 25 bp, Homo sapiens
actgtccccaattgttgtcttaact

SEQ ID NO: 4515 - DNA, 25 bp, Homo sapiens
gctggaattgttgtgctggttattt

SEQ ID NO: 4516 - DNA, 25 bp, Homo sapiens
gtgcgtgggacgaagacatctttga

SEQ ID NO: 4517 - DNA, 25 bp, Homo sapiens
agcagcttgaaactggctttaccaa

SEQ ID NO: 4518 - DNA, 25 bp, Homo sapiens
actggctttaccaatcttgaaattt

SEQ ID NO: 4519 - DNA, 25 bp, Homo sapiens
tgaccacaagtgtcttatatatgca

SEQ ID NO: 4520 - DNA, 25 bp, Homo sapiens
acttggactccatcgttaaaattat

SEQ ID NO: 4521 - DNA, 25 bp, Homo sapiens
gtgtgcattaaatatgcttccacag

SEQ ID NO: 4522 - DNA, 25 bp, Homo sapiens
gctgcctttctatttacttgagtct

SEQ ID NO: 4523 - DNA, 25 bp, Homo sapiens
gaaaaagcacctgaattctcaatgc

SEQ ID NO: 4524 - DNA, 25 bp, Homo sapiens
agggtctaaaagctggtgttattgc

SEQ ID NO: 4525 - DNA, 25 bp, Homo sapiens
gtgttattgctgttattgtggttgt

SEQ ID NO: 4526 - DNA, 25 bp, Homo sapiens
gacggtcaagaccaaggatggcgtg

SEQ ID NO: 4527 - DNA, 25 bp, Homo sapiens
ggatggcgtggtggagatcaccggc

SEQ ID NO: 4528 - DNA, 25 bp, Homo sapiens
ggcgtggtggagatcaccggcaagc

SEQ ID NO: 4529 - DNA, 25 bp, Homo sapiens
agatcaccggcaagcacgaggagcg

SEQ ID NO: 4530 - DNA, 25 bp, Homo sapiens
caccggcaagcacgaggagcggcag

SEQ ID NO: 4531 - DNA, 25 bp, Homo sapiens
acgaggagcggcaggacgagcatgg

SEQ ID NO: 4532 - DNA, 25 bp, Homo sapiens
ggagcggcaggacgagcatggctac

SEQ ID NO: 4533 - DNA, 25 bp, Homo sapiens
gcaggacgagcatggctacatctcc

SEQ ID NO: 4534 - DNA, 25 bp, Homo sapiens
tcccggtgcttcacgcggaaataca

SEQ ID NO: 4535 - DNA, 25 bp, Homo sapiens
ggtgcttcacgcggaaatacacgct

SEQ ID NO: 4536 - DNA, 25 bp, Homo sapiens
ttcacgcggaaatacacgctgcccc

SEQ ID NO: 4537 - DNA, 25 bp, Homo sapiens
tcagcagtatagggaccttccgcac

SEQ ID NO: 4538 - DNA, 25 bp, Homo sapiens
ccttccgcacaagctctgtgttaag

SEQ ID NO: 4539 - DNA, 25 bp, Homo sapiens
tcttttctaagagtcaaccacaggc

SEQ ID NO: 4540 - DNA, 25 bp, Homo sapiens
gtcaaccacaggcatttaagtcagc

SEQ ID NO: 4541 - DNA, 25 bp, Homo sapiens
atatctagtgcatctacatctctat

SEQ ID NO: 4542 - DNA, 25 bp, Homo sapiens
tacatctctatactgtacactcacc

SEQ ID NO: 4543 - DNA, 25 bp, Homo sapiens
taatccactaaactggtcttcttca

SEQ ID NO: 4544 - DNA, 25 bp, Homo sapiens
gatgatcttctgtggtgcttaagga

SEQ ID NO: 4545 - DNA, 25 bp, Homo sapiens
ggaaacttactagagctccactaac

SEQ ID NO: 4546 - DNA, 25 bp, Homo sapiens
gagctccactaacagtctcataagg

SEQ ID NO: 4547 - DNA, 25 bp, Homo sapiens
aggaggcagccatcataaccattga

SEQ ID NO: 4548 - DNA, 25 bp, Homo sapiens
atgctggtttctgtagggtattttt

SEQ ID NO: 4549 - DNA, 25 bp, Homo sapiens
ataaattccttctaaaccacattgg

SEQ ID NO: 4550 - DNA, 25 bp, Homo sapiens
taaaccacattggaactgacctgaa

SEQ ID NO: 4551 - DNA, 25 bp, Homo sapiens
aatcctaacacttcactaatttata

SEQ ID NO: 4552 - DNA, 25 bp, Homo sapiens
aactaaaatttctcatcttcgtact

SEQ ID NO: 4553 - DNA, 25 bp, Homo sapiens
ctcatcttcgtacttgatgctcaca

SEQ ID NO: 4554 - DNA, 25 bp, Homo sapiens
atggtttttattcctggcatccaga

SEQ ID NO: 4555 - DNA, 25 bp, Homo sapiens
cagtgaacttaagcaaattaccctc

SEQ ID NO: 4556 - DNA, 25 bp, Homo sapiens
cctcctacccaattctatggaatat

SEQ ID NO: 4557 - DNA, 25 bp, Homo sapiens
gaatattttatacgtctccttgttt

SEQ ID NO: 4558 - DNA, 25 bp, Homo sapiens
actgctttactttgatgtatcatat

SEQ ID NO: 4559 - DNA, 25 bp, Homo sapiens
tggccatccgggacagtgagcgaca

SEQ ID NO: 4560 - DNA, 25 bp, Homo sapiens
gagcgacagggcaaggcccaggtgg

SEQ ID NO: 4561 - DNA, 25 bp, Homo sapiens
tgctgagatgatccaggtcctgggc

SEQ ID NO: 4562 - DNA, 25 bp, Homo sapiens
ggagggcaaccctgaggaagacctc

SEQ ID NO: 4563 - DNA, 25 bp, Homo sapiens
tgacaaggcaaatgcccaggccgca

SEQ ID NO: 4564 - DNA, 25 bp, Homo sapiens
aggccgcagctctgtataaggtctc

SEQ ID NO: 4565 - DNA, 25 bp, Homo sapiens
taaggtctctgatgccactggacag

SEQ ID NO: 4566 - DNA, 25 bp, Homo sapiens
gatgaacctgaccaaggtggctgac

SEQ ID NO: 4567 - DNA, 25 bp, Homo sapiens
cctttgcccttgaactgctgatatc

SEQ ID NO: 4568 - DNA, 25 bp, Homo sapiens
gactgctttgtgctggacaacgggc

SEQ ID NO: 4569 - DNA, 25 bp, Homo sapiens
caacgggctctgtggcaagatctat

SEQ ID NO: 4570 - DNA, 25 bp, Homo sapiens
gtgccaatcctttgaatgttccacg

SEQ ID NO: 4571 - DNA, 25 bp, Homo sapiens
ggtggttttcagtttagctacggca

SEQ ID NO: 4572 - DNA, 25 bp, Homo sapiens
tagctacggcaatcctgaacttcct

SEQ ID NO: 4573 - DNA, 25 bp, Homo sapiens
gaacttcctgaagatgtccttgatg

SEQ ID NO: 4574 - DNA, 25 bp, Homo sapiens
gtccttgatgtgcagctggcattcc

SEQ ID NO: 4575 - DNA, 25 bp, Homo sapiens
agcttcccagaacatcacatatcac

SEQ ID NO: 4576 - DNA, 25 bp, Homo sapiens
gaaggccctgaagctgatggggtca

SEQ ID NO: 4577 - DNA, 25 bp, Homo sapiens
gcaaattcacctacacagttctgga

SEQ ID NO: 4578 - DNA, 25 bp, Homo sapiens
gatggttgcacgaaacacactgggg

SEQ ID NO: 4579 - DNA, 25 bp, Homo sapiens
gtagatattgcaccctatgacattg

SEQ ID NO: 4580 - DNA, 25 bp, Homo sapiens
agaatttggtgtggacgttggccct

SEQ ID NO: 4581 - DNA, 25 bp, Homo sapiens
caaggttatcctacgcagagagcca

SEQ ID NO: 4582 - DNA, 25 bp, Homo sapiens
gccaggtaccaatgggtgcgctgca

SEQ ID NO: 4583 - DNA, 25 bp, Homo sapiens
ggtgcgctgcaatccagacagtaat

SEQ ID NO: 4584 - DNA, 25 bp, Homo sapiens
gaccaatgttcgaactacttccagg

SEQ ID NO: 4585 - DNA, 25 bp, Homo sapiens
caggtgaatccaacaagatcccccg

SEQ ID NO: 4586 - DNA, 25 bp, Homo sapiens
aggacttgaatcgtatcttcccact

SEQ ID NO: 4587 - DNA, 25 bp, Homo sapiens
gaggactactctggatcaggcttcg

SEQ ID NO: 4588 - DNA, 25 bp, Homo sapiens
gatctgggagtggcttcctaacgga

SEQ ID NO: 4589 - DNA, 25 bp, Homo sapiens
gatgctttccatgacaaccttaggt

SEQ ID NO: 4590 - DNA, 25 bp, Homo sapiens
tcttgacaggaatctgccctcagac

SEQ ID NO: 4591 - DNA, 25 bp, Homo sapiens
cctggttctggaatcctcagttcaa

SEQ ID NO: 4592 - DNA, 25 bp, Homo sapiens
gttgagtcgtcatcacttttcagtg

SEQ ID NO: 4593 - DNA, 25 bp, Homo sapiens
gaaggatggcacctaaaccaccagt

SEQ ID NO: 4594 - DNA, 25 bp, Homo sapiens
aaccaccagtgcccaaagtctgtgt

SEQ ID NO: 4595 - DNA, 25 bp, Homo sapiens
tttctcttcatactttttttcacag

SEQ ID NO: 4596 - DNA, 25 bp, Homo sapiens
ctagactttctgttggtgtatcccc

SEQ ID NO: 4597 - DNA, 25 bp, Homo sapiens
tcccccccctgtatagttaggatag

SEQ ID NO: 4598 - DNA, 25 bp, Homo sapiens
gttgtgccttttatagctattactg

SEQ ID NO: 4599 - DNA, 25 bp, Homo sapiens
gaactacgcttgctcattttttctt

SEQ ID NO: 4600 - DNA, 25 bp, Homo sapiens
gggcagctagttcgtagctttccca

SEQ ID NO: 4601 - DNA, 25 bp, Homo sapiens
gggttggtgcttctaacctgatggc

SEQ ID NO: 4602 - DNA, 25 bp, Homo sapiens
ttgactcaaatctccagtattcttg

SEQ ID NO: 4603 - DNA, 25 bp, Homo sapiens
gtgcatccatgatcttcaggctcac

SEQ ID NO: 4604 - DNA, 25 bp, Homo sapiens
gtgcttcgtttgattctacggtgcg

SEQ ID NO: 4605 - DNA, 25 bp, Homo sapiens
ggtgcgactgtgggacatagaacga

SEQ ID NO: 4606 - DNA, 25 bp, Homo sapiens
acatagaacgaggcgtctgcaccca

SEQ ID NO: 4607 - DNA, 25 bp, Homo sapiens
ccacacgctcacgaagcatcaggag

SEQ ID NO: 4608 - DNA, 25 bp, Homo sapiens
atcaggagcctgtctatagcgtagc

SEQ ID NO: 4609 - DNA, 25 bp, Homo sapiens
tatagcgtagctttcagccctgatg

SEQ ID NO: 4610 - DNA, 25 bp, Homo sapiens
agtggatccttcgacaagtgcgtcc

SEQ ID NO: 4611 - DNA, 25 bp, Homo sapiens
tggaaatcttgtccacagctaccga

SEQ ID NO: 4612 - DNA, 25 bp, Homo sapiens
gagacaaagtgggtgccagcgcgtc

SEQ ID NO: 4613 - DNA, 25 bp, Homo sapiens
gtgtgttttggatctgcggaagtaa

SEQ ID NO: 4614 - DNA, 25 bp, Homo sapiens
gaaacgcgcaactttgtaatcccaa

SEQ ID NO: 4615 - DNA, 25 bp, Homo sapiens
atcccaacactttctattttctaga

SEQ ID NO: 4616 - DNA, 25 bp, Homo sapiens
tggtttttcagtcggctggaattct

SEQ ID NO: 4617 - DNA, 25 bp, Homo sapiens
gggggccttccgtctgagatggaag

SEQ ID NO: 4618 - DNA, 25 bp, Homo sapiens
gaagctgtcttgggcttgttgtctc

SEQ ID NO: 4619 - DNA, 25 bp, Homo sapiens
ctctgctttttcagtgcaccatcaa

SEQ ID NO: 4620 - DNA, 25 bp, Homo sapiens
ccatcaagagatgcagccccgtgga

SEQ ID NO: 4621 - DNA, 25 bp, Homo sapiens
tgtacctttctcatagttgcttcag

SEQ ID NO: 4622 - DNA, 25 bp, Homo sapiens
gttgcttcagatcttaggtctcaag

SEQ ID NO: 4623 - DNA, 25 bp, Homo sapiens
tcaagggcactttggcgcgtagtaa

SEQ ID NO: 4624 - DNA, 25 bp, Homo sapiens
tttggcgcgtagtaagtgctttatg

SEQ ID NO: 4625 - DNA, 25 bp, Homo sapiens
cattcatctgcggagccaaaaccca

SEQ ID NO: 4626 - DNA, 25 bp, Homo sapiens
ggaacttggaacgtgccaggaccac

SEQ ID NO: 4627 - DNA, 25 bp, Homo sapiens
ttgggcctccacttgggtatgtgaa

SEQ ID NO: 4628 - DNA, 25 bp, Homo sapiens
tcacagtgatgtggagtcgccgcac

SEQ ID NO: 4629 - DNA, 25 bp, Homo sapiens
tttcccgtcccaaggactctgtgaa

SEQ ID NO: 4630 - DNA, 25 bp, Homo sapiens
ggtccaaaagacaccatctctaccc

SEQ ID NO: 4631 - DNA, 25 bp, Homo sapiens
aatgcactcatctctgtagaacatc

SEQ ID NO: 4632 - DNA, 25 bp, Homo sapiens
aaaggccagcctgtcgttagggcat

SEQ ID NO: 4633 - DNA, 25 bp, Homo sapiens
gatggtgggatgtgtcgcaagcaat

SEQ ID NO: 4634 - DNA, 25 bp, Homo sapiens
atgaatgtcggtagccagggtctct

SEQ ID NO: 4635 - DNA, 25 bp, Homo sapiens
ctcccgagggatggctttagtcttg

SEQ ID NO: 4636 - DNA, 25 bp, Homo sapiens
gagatccaaacaactataggccacg

SEQ ID NO: 4637 - DNA, 25 bp, Homo sapiens
tgaatcaggattttatgccccacat

SEQ ID NO: 4638 - DNA, 25 bp, Homo sapiens
gccccacatactctggaacttgaag

SEQ ID NO: 4639 - DNA, 25 bp, Homo sapiens
aagccagttgggttctaaattgtag

SEQ ID NO: 4640 - DNA, 25 bp, Homo sapiens
gaggctcttttgtgcataatattct

SEQ ID NO: 4641 - DNA, 25 bp, Homo sapiens
tattcacggtaccaaatgctgacca

SEQ ID NO: 4642 - DNA, 25 bp, Homo sapiens
aatgctgaccagtgttgctccattt

SEQ ID NO: 4643 - DNA, 25 bp, Homo sapiens
gtttctgtacttacctggtttgcca

SEQ ID NO: 4644 - DNA, 25 bp, Homo sapiens
tggtttgccaagtatgccagtgtaa

SEQ ID NO: 4645 - DNA, 25 bp, Homo sapiens
gtgtaatgaaactgcccttatttta

SEQ ID NO: 4646 - DNA, 25 bp, Homo sapiens
aagattccactgattgacatttgat

SEQ ID NO: 4647 - DNA, 25 bp, Homo sapiens
gcagcagcacaacatgtcctggatt

SEQ ID NO: 4648 - DNA, 25 bp, Homo sapiens
ggcagttgatgtcctctgccagtgt

SEQ ID NO: 4649 - DNA, 25 bp, Homo sapiens
gtgccacactcatgtacacttatgt

SEQ ID NO: 4650 - DNA, 25 bp, Homo sapiens
tgtcttcgctttctacctcaaaaag

SEQ ID NO: 4651 - DNA, 25 bp, Homo sapiens
gagaatgccacagaggtgctctcgg

SEQ ID NO: 4652 - DNA, 25 bp, Homo sapiens
tgctctcgggctaccttgaacgaga

SEQ ID NO: 4653 - DNA, 25 bp, Homo sapiens
gatatttcccaagattctctgcagg

SEQ ID NO: 4654 - DNA, 25 bp, Homo sapiens
gtcgacgaagggttttgttacagca

SEQ ID NO: 4655 - DNA, 25 bp, Homo sapiens
actttaccatctagagtgctcatgc

SEQ ID NO: 4656 - DNA, 25 bp, Homo sapiens
aggcactaagcctattctgacacca

SEQ ID NO: 4657 - DNA, 25 bp, Homo sapiens
ctgacaccactggtctgtagtacca

SEQ ID NO: 4658 - DNA, 25 bp, Homo sapiens
gtcaagtatgtggttcattcttaga

SEQ ID NO: 4659 - DNA, 25 bp, Homo sapiens
catttgctgacgtagtgctctcatg

SEQ ID NO: 4660 - DNA, 25 bp, Homo sapiens
ggcacagccagggcacagttaggcc

SEQ ID NO: 4661 - DNA, 25 bp, Homo sapiens
ttaggcctggatgtttgcctggtcc

SEQ ID NO: 4662 - DNA, 25 bp, Homo sapiens
tcctgtttccttactggggatttca

SEQ ID NO: 4663 - DNA, 25 bp, Homo sapiens
tggggatttcagggctgggggttca

SEQ ID NO: 4664 - DNA, 25 bp, Homo sapiens
ggttcagggagcatttccttttcct

SEQ ID NO: 4665 - DNA, 25 bp, Homo sapiens
gcatttccttttcctgggagttatg

SEQ ID NO: 4666 - DNA, 25 bp, Homo sapiens
tgctggtgactctgtgtgaactggc

SEQ ID NO: 4667 - DNA, 25 bp, Homo sapiens
ggtggcacaggacagtaaaggagat

SEQ ID NO: 4668 - DNA, 25 bp, Homo sapiens
gtgtattttgatttcctgtgtatgc

SEQ ID NO: 4669 - DNA, 25 bp, Homo sapiens
tttataattctactttgagtgctgt

SEQ ID NO: 4670 - DNA, 25 bp, Homo sapiens
gctgtctccatgtttgatgtatctg

SEQ ID NO: 4671 - DNA, 25 bp, Homo sapiens
gtatctgagcaggttgctccacagg

SEQ ID NO: 4672 - DNA, 25 bp, Homo sapiens
gagaattctcttatccaacatcaac

SEQ ID NO: 4673 - DNA, 25 bp, Homo sapiens
ttctcttatccaacatcaacatctt

SEQ ID NO: 4674 - DNA, 25 bp, Homo sapiens
catcttggtcagatttgaactcttc

SEQ ID NO: 4675 - DNA, 25 bp, Homo sapiens
actcttcaatctcttgcactcaaag

SEQ ID NO: 4676 - DNA, 25 bp, Homo sapiens
aatctcttgcactcaaagcttgtta

SEQ ID NO: 4677 - DNA, 25 bp, Homo sapiens
aacttccaatttacatactctgctt

SEQ ID NO: 4678 - DNA, 25 bp, Homo sapiens
gattcatatttacttcttatacatt

SEQ ID NO: 4679 - DNA, 25 bp, Homo sapiens
ggcatggttgtggttaatctggttt

SEQ ID NO: 4680 - DNA, 25 bp, Homo sapiens
tgtcagagtatgcacggcgctttgg

SEQ ID NO: 4681 - DNA, 25 bp, Homo sapiens
gtgttccggtcattgctgatggagg

SEQ ID NO: 4682 - DNA, 25 bp, Homo sapiens
tcatattgcgaaagccttggccctt

SEQ ID NO: 4683 - DNA, 25 bp, Homo sapiens
acttcttttccgatgggatccggct

SEQ ID NO: 4684 - DNA, 25 bp, Homo sapiens
aaatatcgcggtatgggttctctcg

SEQ ID NO: 4685 - DNA, 25 bp, Homo sapiens
cgatgccatggacaagcacctcagc

SEQ ID NO: 4686 - DNA, 25 bp, Homo sapiens
aatccacaaatttgtcccttacctg

SEQ ID NO: 4687 - DNA, 25 bp, Homo sapiens
ccttacctgattgctggcatccaac

SEQ ID NO: 4688 - DNA, 25 bp, Homo sapiens
acccaagtccgagccatgatgtact

SEQ ID NO: 4689 - DNA, 25 bp, Homo sapiens
gtccatagcctccattcgtatgaga

SEQ ID NO: 4690 - DNA, 25 bp, Homo sapiens
tgaaaagggatccagcacacctcct

SEQ ID NO: 4691 - DNA, 25 bp, Homo sapiens
gtacctggtgggctggcagagcata

SEQ ID NO: 4692 - DNA, 25 bp, Homo sapiens
gtacatccaggttgtctaccttcat

SEQ ID NO: 4693 - DNA, 25 bp, Homo sapiens
gttggatcaagtgacttctgcccac

SEQ ID NO: 4694 - DNA, 25 bp, Homo sapiens
aaggcttcttattcgggtgtgagtc

SEQ ID NO: 4695 - DNA, 25 bp, Homo sapiens
cagccatccaccttcagatgtgtct

SEQ ID NO: 4696 - DNA, 25 bp, Homo sapiens
gctctgccattcaactcggaaacta

SEQ ID NO: 4697 - DNA, 25 bp, Homo sapiens
gaaagccctcatttttataacctgg

SEQ ID NO: 4698 - DNA, 25 bp, Homo sapiens
tctcctacatccgcattgctgatac

SEQ ID NO: 4699 - DNA, 25 bp, Homo sapiens
tatcaccagcattcctcaaggtctt

SEQ ID NO: 4700 - DNA, 25 bp, Homo sapiens
tcctccttcccttacggaattacat

SEQ ID NO: 4701 - DNA, 25 bp, Homo sapiens
gcatctctgctgttgacaatggctc

SEQ ID NO: 4702 - DNA, 25 bp, Homo sapiens
gcaagacttcagtagcaaaccacta

SEQ ID NO: 4703 - DNA, 25 bp, Homo sapiens
actacagtcagtacctggactcgcc

SEQ ID NO: 4704 - DNA, 25 bp, Homo sapiens
gaagacttaaactctctgggttgaa

SEQ ID NO: 4705 - DNA, 25 bp, Homo sapiens
gcaagtggtttgtctttatccaccc

SEQ ID NO: 4706 - DNA, 25 bp, Homo sapiens
ctgttgtggtcagccccagagaatt

SEQ ID NO: 4707 - DNA, 25 bp, Homo sapiens
ttatcttcttccttggcattggttc

SEQ ID NO: 4708 - DNA, 25 bp, Homo sapiens
cttggcattggttcactggacattt

SEQ ID NO: 4709 - DNA, 25 bp, Homo sapiens
tctgaggagccatcttcctgaatcg

SEQ ID NO: 4710 - DNA, 25 bp, Homo sapiens
tcctgaatcgcattctctactggac

SEQ ID NO: 4711 - DNA, 25 bp, Homo sapiens
cagcaggcacctggtcttcagaaat

SEQ ID NO: 4712 - DNA, 25 bp, Homo sapiens
gaattctgtgactcctaataggcca

SEQ ID NO: 4713 - DNA, 25 bp, Homo sapiens
gggctccgtccgagaacaacataat

SEQ ID NO: 4714 - DNA, 25 bp, Homo sapiens
atggtgtggaacgcggtcattttcg

SEQ ID NO: 4715 - DNA, 25 bp, Homo sapiens
gatttgtctctaagatgttccatcc

SEQ ID NO: 4716 - DNA, 25 bp, Homo sapiens
gacatacttcagaaccgttggagtc

SEQ ID NO: 4717 - DNA, 25 bp, Homo sapiens
gagtccaacctatgatgtgtcttcc

SEQ ID NO: 4718 - DNA, 25 bp, Homo sapiens
cattctaacatccatacagtctctg

SEQ ID NO: 4719 - DNA, 25 bp, Homo sapiens
gtctctgttggatgaacccaatccc

SEQ ID NO: 4720 - DNA, 25 bp, Homo sapiens
atcccaatagtccagcaaacagcca

SEQ ID NO: 4721 - DNA, 25 bp, Homo sapiens
caaagctggcgtgattgttgacccc

SEQ ID NO: 4722 - DNA, 25 bp, Homo sapiens
tattgatgtgtttgtcacctcccta

SEQ ID NO: 4723 - DNA, 25 bp, Homo sapiens
tccctactcctgtcattacatttac

SEQ ID NO: 4724 - DNA, 25 bp, Homo sapiens
tgtacccctttaatgacccgtactg

SEQ ID NO: 4725 - DNA, 25 bp, Homo sapiens
cagctctgcagctaatgaggtcctg

SEQ ID NO: 4726 - DNA, 25 bp, Homo sapiens
gcctgtccaacttcaacagtcggca

SEQ ID NO: 4727 - DNA, 25 bp, Homo sapiens
tgatgacatactcagtgtggcctcc

SEQ ID NO: 4728 - DNA, 25 bp, Homo sapiens
gtaactgcttatagccctttgggct

SEQ ID NO: 4729 - DNA, 25 bp, Homo sapiens
cgtgcatggcgtgatcctgatgagc

SEQ ID NO: 4730 - DNA, 25 bp, Homo sapiens
gaaaagtatggccgatctccagctc

SEQ ID NO: 4731 - DNA, 25 bp, Homo sapiens
agcggaaagtgatctgcatccccaa

SEQ ID NO: 4732 - DNA, 25 bp, Homo sapiens
ctccttctcgaatccttcagaacat

SEQ ID NO: 4733 - DNA, 25 bp, Homo sapiens
ttgacttcacctttagcccagaaga

SEQ ID NO: 4734 - DNA, 25 bp, Homo sapiens
atattgtgcctatgcttacggtgga

SEQ ID NO: 4735 - DNA, 25 bp, Homo sapiens
ggtgctgtggccaacaagctatgcc

SEQ ID NO: 4736 - DNA, 25 bp, Homo sapiens
caagctatgccagagtttccagacc

SEQ ID NO: 4737 - DNA, 25 bp, Homo sapiens
atgcagagacgggcttgctgggtgc

SEQ ID NO: 4738 - DNA, 25 bp, Homo sapiens
ggtgcacactttgtctgtgaccgaa

SEQ ID NO: 4739 - DNA, 25 bp, Homo sapiens
gacatgatgttcgtcctgcaagggc

SEQ ID NO: 4740 - DNA, 25 bp, Homo sapiens
agaaatgccctggtatctcatctag

SEQ ID NO: 4741 - DNA, 25 bp, Homo sapiens
tagatggcactactcctgtgtgtga

SEQ ID NO: 4742 - DNA, 25 bp, Homo sapiens
tgtgaggacatcggacgcagcctcc

SEQ ID NO: 4743 - DNA, 25 bp, Homo sapiens
gtgtggtacgtgagatctgctccaa

SEQ ID NO: 4744 - DNA, 25 bp, Homo sapiens
agcagtggctggatatggccccatt

SEQ ID NO: 4745 - DNA, 25 bp, Homo sapiens
caaccggatccgtagcggcatgttc

SEQ ID NO: 4746 - DNA, 25 bp, Homo sapiens
accgcgctgccaccaaatggaattg

SEQ ID NO: 4747 - DNA, 25 bp, Homo sapiens
accagcggctgttacactgttcttt

SEQ ID NO: 4748 - DNA, 25 bp, Homo sapiens
tgcctatgctcagaatatgctcact

SEQ ID NO: 4749 - DNA, 25 bp, Homo sapiens
aaaaggaccacagcaccacttaggt

SEQ ID NO: 4750 - DNA, 25 bp, Homo sapiens
tctctcttgagaacctgtggcctca

SEQ ID NO: 4751 - DNA, 25 bp, Homo sapiens
caccaagctgatgtggcccaagctc

SEQ ID NO: 4752 - DNA, 25 bp, Homo sapiens
gtcttctcctttgaagcacagccta

SEQ ID NO: 4753 - DNA, 25 bp, Homo sapiens
gcacagcctatttctgagccaaggg

SEQ ID NO: 4754 - DNA, 25 bp, Homo sapiens
ggttggggaagcctgtctagatgtg

SEQ ID NO: 4755 - DNA, 25 bp, Homo sapiens
gagctcccacagggagagcccaggc

SEQ ID NO: 4756 - DNA, 25 bp, Homo sapiens
agtgccatgttccttgtttgacaac

SEQ ID NO: 4757 - DNA, 25 bp, Homo sapiens
gacaggtgaacatttccgcctggtc

SEQ ID NO: 4758 - DNA, 25 bp, Homo sapiens
tatgacaccaagggccgttttgctg

SEQ ID NO: 4759 - DNA, 25 bp, Homo sapiens
tgctgttcaccgcatcacagtggaa

SEQ ID NO: 4760 - DNA, 25 bp, Homo sapiens
gtgactcatgatgctcgaaccatcc

SEQ ID NO: 4761 - DNA, 25 bp, Homo sapiens
ccagatcctgtcatcaaggtgaacg

SEQ ID NO: 4762 - DNA, 25 bp, Homo sapiens
ggtgattggtggagccaacctcggt

SEQ ID NO: 4763 - DNA, 25 bp, Homo sapiens
acctcggtcgtgttggtgtgatcac

SEQ ID NO: 4764 - DNA, 25 bp, Homo sapiens
gacatcctggttcttttgatgtggt

SEQ ID NO: 4765 - DNA, 25 bp, Homo sapiens
ttggatttccctgcccaggggaaag

SEQ ID NO: 4766 - DNA, 25 bp, Homo sapiens
gggcattcgacttactgttgctgaa

SEQ ID NO: 4767 - DNA, 25 bp, Homo sapiens
gagataagaggctggccaccaaaca

SEQ ID NO: 4768 - DNA, 25 bp, Homo sapiens
tcagatgggtcgtttcaccttaaga

SEQ ID NO: 4769 - DNA, 25 bp, Homo sapiens
atgggtcgtttcaccttaagagatg

SEQ ID NO: 4770 - DNA, 25 bp, Homo sapiens
gtcgtttcaccttaagagatgaggg

SEQ ID NO: 4771 - DNA, 25 bp, Homo sapiens
gaaaattgactgcagaagcctactt

SEQ ID NO: 4772 - DNA, 25 bp, Homo sapiens
tgactgcagaagcctacttcacacc

SEQ ID NO: 4773 - DNA, 25 bp, Homo sapiens
tattttctgcccattgataaacctc

SEQ ID NO: 4774 - DNA, 25 bp, Homo sapiens
ttttctgcccattgataaacctctc

SEQ ID NO: 4775 - DNA, 25 bp, Homo sapiens
ggaaattcacagcaaaagtccacat

SEQ ID NO: 4776 - DNA, 25 bp, Homo sapiens
agcaaaagtccacattatgtcagct

SEQ ID NO: 4777 - DNA, 25 bp, Homo sapiens
gctatgccactgttgaatttttccc

SEQ ID NO: 4778 - DNA, 25 bp, Homo sapiens
tgaatttttcccaagattcctgtcc

SEQ ID NO: 4779 - DNA, 25 bp, Homo sapiens
tggtgctcagcaccttgtgggagcc

SEQ ID NO: 4780 - DNA, 25 bp, Homo sapiens
ttgtgggagccgcatatcacccaac

SEQ ID NO: 4781 - DNA, 25 bp, Homo sapiens
cctcttgcagaagcgcattcccaag

SEQ ID NO: 4782 - DNA, 25 bp, Homo sapiens
actcatcaggccctcgactgaaaag

SEQ ID NO: 4783 - DNA, 25 bp, Homo sapiens
agaaatgggggccttgatgctcacc

SEQ ID NO: 4784 - DNA, 25 bp, Homo sapiens
agaggtccaagctatactgtgcagg

SEQ ID NO: 4785 - DNA, 25 bp, Homo sapiens
tggtggacacaggaagcctacccaa

SEQ ID NO: 4786 - DNA, 25 bp, Homo sapiens
gcctacccaacacgctggtatttgg

SEQ ID NO: 4787 - DNA, 25 bp, Homo sapiens
tgcccatgggtgactcttacccaca

SEQ ID NO: 4788 - DNA, 25 bp, Homo sapiens
cttacccacagctgactagggccag

SEQ ID NO: 4789 - DNA, 25 bp, Homo sapiens
gctggcagaacctggtccatgaggt

SEQ ID NO: 4790 - DNA, 25 bp, Homo sapiens
gtgtccaactgaaattatcgctttt

SEQ ID NO: 4791 - DNA, 25 bp, Homo sapiens
gtagcatgctctgttgattcacagt

SEQ ID NO: 4792 - DNA, 25 bp, Homo sapiens
gattcacagtttacccatttggcct

SEQ ID NO: 4793 - DNA, 25 bp, Homo sapiens
tggattaatacccctcgaagacaag

SEQ ID NO: 4794 - DNA, 25 bp, Homo sapiens
taaggattccacttctttcagattt

SEQ ID NO: 4795 - DNA, 25 bp, Homo sapiens
gacccatcagatctcaaaggactat

SEQ ID NO: 4796 - DNA, 25 bp, Homo sapiens
aggccacactcttagaggtctcttc

SEQ ID NO: 4797 - DNA, 25 bp, Homo sapiens
tactctgaatgatcttcctgtgggt

SEQ ID NO: 4798 - DNA, 25 bp, Homo sapiens
ggatgagacactacgtttggttcaa

SEQ ID NO: 4799 - DNA, 25 bp, Homo sapiens
gtttggttcaagcattccagtacac

SEQ ID NO: 4800 - DNA, 25 bp, Homo sapiens
gaaacaataatcccagatccagctg

SEQ ID NO: 4801 - DNA, 25 bp, Homo sapiens
catcgactcacacactatgatcatg

SEQ ID NO: 4802 - DNA, 25 bp, Homo sapiens
tgttctaattgagctcacccaggct

SEQ ID NO: 4803 - DNA, 25 bp, Homo sapiens
ttaaccctaactacttgctcgaaga

SEQ ID NO: 4804 - DNA, 25 bp, Homo sapiens
ggctggagctctgctagggacagaa

SEQ ID NO: 4805 - DNA, 25 bp, Homo sapiens
gtcacattcatcacaggtttcatac

SEQ ID NO: 4806 - DNA, 25 bp, Homo sapiens
tcataccaacacaggcttcagcact

SEQ ID NO: 4807 - DNA, 25 bp, Homo sapiens
cagcacttcctttggtgtgtttcct

SEQ ID NO: 4808 - DNA, 25 bp, Homo sapiens
tgtgtttcctgtcccagtgaagttg

SEQ ID NO: 4809 - DNA, 25 bp, Homo sapiens
tagtctctataaccaatacctttgt

SEQ ID NO: 4810 - DNA, 25 bp, Homo sapiens
taaggtatgtgctgtcctattgagc

SEQ ID NO: 4811 - DNA, 25 bp, Homo sapiens
aactttttttcaattgccagctact

SEQ ID NO: 4812 - DNA, 25 bp, Homo sapiens
aaagcatggagagctacatttcata

SEQ ID NO: 4813 - DNA, 25 bp, Homo sapiens
gggaaaatttctaacagatgccaga

SEQ ID NO: 4814 - DNA, 25 bp, Homo sapiens
gaatgcttgtttatgggattgctgt

SEQ ID NO: 4815 - DNA, 25 bp, Homo sapiens
tatatgacttggcagatcaactaca

SEQ ID NO: 4816 - DNA, 25 bp, Homo sapiens
ctacatgctgcagttggtgcttccc

SEQ ID NO: 4817 - DNA, 25 bp, Homo sapiens
ctggctttgttcccaatgacatgca

SEQ ID NO: 4818 - DNA, 25 bp, Homo sapiens
gacatgcaagttggacagacgggaa

SEQ ID NO: 4819 - DNA, 25 bp, Homo sapiens
gcaccagaactttatattgctgttg

SEQ ID NO: 4820 - DNA, 25 bp, Homo sapiens
gctgttggaatatctggagccatcc

SEQ ID NO: 4821 - DNA, 25 bp, Homo sapiens
ggagccatccaacatttagctggga

SEQ ID NO: 4822 - DNA, 25 bp, Homo sapiens
gaagctccaattttccaagtggcag

SEQ ID NO: 4823 - DNA, 25 bp, Homo sapiens
ctggctggaccaggatgcagtcaca

SEQ ID NO: 4824 - DNA, 25 bp, Homo sapiens
ggctacctgccatgtggttagcgac

SEQ ID NO: 4825 - DNA, 25 bp, Homo sapiens
tggttagcgactcatggactcatcc

SEQ ID NO: 4826 - DNA, 25 bp, Homo sapiens
tcccaggccttcgcagattatgtta

SEQ ID NO: 4827 - DNA, 25 bp, Homo sapiens
cggtaccatcagcttgcaggggctg

SEQ ID NO: 4828 - DNA, 25 bp, Homo sapiens
tgcaggggctgaagcatgggctgcc

SEQ ID NO: 4829 - DNA, 25 bp, Homo sapiens
gaggcccagcaaacaggcattctca

SEQ ID NO: 4830 - DNA, 25 bp, Homo sapiens
ggcattctcacagctgggtttatag

SEQ ID NO: 4831 - DNA, 25 bp, Homo sapiens
ctcagtatcctgggaaccctgggcc

SEQ ID NO: 4832 - DNA, 25 bp, Homo sapiens
ataattgctgaagagatcccctccc

SEQ ID NO: 4833 - DNA, 25 bp, Homo sapiens
tcaaaccctttcatacctttattct

SEQ ID NO: 4834 - DNA, 25 bp, Homo sapiens
gctgcacagacgtgctcagcagggc

SEQ ID NO: 4835 - DNA, 25 bp, Homo sapiens
gctcagcagggctacaggtgctcaa

SEQ ID NO: 4836 - DNA, 25 bp, Homo sapiens
ggtgctcaagccctattggggatgg

SEQ ID NO: 4837 - DNA, 25 bp, Homo sapiens
cggcgtttgccaccttaagaattgg

SEQ ID NO: 4838 - DNA, 25 bp, Homo sapiens
gtgacactgcactgggtacttaaag

SEQ ID NO: 4839 - DNA, 25 bp, Homo sapiens
tcaagtttgccacccaaatgctacc

SEQ ID NO: 4840 - DNA, 25 bp, Homo sapiens
aaatgctaccactgttaatcttttg

SEQ ID NO: 4841 - DNA, 25 bp, Homo sapiens
gtgttaaatgttccccctagacatt

SEQ ID NO: 4842 - DNA, 25 bp, Homo sapiens
cccctagacatttctgtgcatagat

SEQ ID NO: 4843 - DNA, 25 bp, Homo sapiens
gtgtgtttacatagtcgttattctg

SEQ ID NO: 4844 - DNA, 25 bp, Homo sapiens
tatgtcccttttgtacttaacgtat

SEQ ID NO: 4845 - DNA, 25 bp, Homo sapiens
catacccaagtccttcatgatcagc

SEQ ID NO: 4846 - DNA, 25 bp, Homo sapiens
agcgcagacatggcccatgctgtgc

SEQ ID NO: 4847 - DNA, 25 bp, Homo sapiens
aagcatgaggagaaccaccggcctt

SEQ ID NO: 4848 - DNA, 25 bp, Homo sapiens
ttattccacaagggccccgtgatca

SEQ ID NO: 4849 - DNA, 25 bp, Homo sapiens
gcttcaaacgcggtgtcagaggccc

SEQ ID NO: 4850 - DNA, 25 bp, Homo sapiens
cagaggccctgatccgagaggtggc

SEQ ID NO: 4851 - DNA, 25 bp, Homo sapiens
cctgcaggatctcatggtccggaat

SEQ ID NO: 4852 - DNA, 25 bp, Homo sapiens
gaaccaccattggacctatcttggc

SEQ ID NO: 4853 - DNA, 25 bp, Homo sapiens
cgggtgctggatttaggcagccccc

SEQ ID NO: 4854 - DNA, 25 bp, Homo sapiens
gcactctatccgggagatggcctgc

SEQ ID NO: 4855 - DNA, 25 bp, Homo sapiens
tcaccctcttcaagggcttctttga

SEQ ID NO: 4856 - DNA, 25 bp, Homo sapiens
taccttttacatgtacttctctctt

SEQ ID NO: 4857 - DNA, 25 bp, Homo sapiens
aattctgctataagtcttgatcttc

SEQ ID NO: 4858 - DNA, 25 bp, Homo sapiens
actaagactatattctcagccctgc

SEQ ID NO: 4859 - DNA, 25 bp, Homo sapiens
cctgccctgtcttttatttgcgggt

SEQ ID NO: 4860 - DNA, 25 bp, Homo sapiens
ttcttcagtgtttctccgagagact

SEQ ID NO: 4861 - DNA, 25 bp, Homo sapiens
tccgagagactttccatttccttgg

SEQ ID NO: 4862 - DNA, 25 bp, Homo sapiens
catttccttggagttatggcggcaa

SEQ ID NO: 4863 - DNA, 25 bp, Homo sapiens
gcctaaatctgagttgtgcctttct

SEQ ID NO: 4864 - DNA, 25 bp, Homo sapiens
gtgcctttctttactcacaaggcat

SEQ ID NO: 4865 - DNA, 25 bp, Homo sapiens
cacaaggcatgggctttgtcctggt

SEQ ID NO: 4866 - DNA, 25 bp, Homo sapiens
gtgatcagtttgtaagccttcttcc

SEQ ID NO: 4867 - DNA, 25 bp, Homo sapiens
cttagcgccaggtgtccataacatt

SEQ ID NO: 4868 - DNA, 25 bp, Homo sapiens
tccataacattattgccatcgctga

SEQ ID NO: 4869 - DNA, 25 bp, Homo sapiens
tgggtaccagcaacaacattcacag

SEQ ID NO: 4870 - DNA, 25 bp, Homo sapiens
gggagcttgtggtaactgtatcagg

SEQ ID NO: 4871 - DNA, 25 bp, Homo sapiens
gtatcaggtgctactatgtcggcat

SEQ ID NO: 4872 - DNA, 25 bp, Homo sapiens
atgtcggcattgatcctaacagctt

SEQ ID NO: 4873 - DNA, 25 bp, Homo sapiens
atttggtgcatctgctcaatcaagt

SEQ ID NO: 4874 - DNA, 25 bp, Homo sapiens
tttcatcggctcaggcagcatcatg

SEQ ID NO: 4875 - DNA, 25 bp, Homo sapiens
gaaattcgcatgatgtctaccggct

SEQ ID NO: 4876 - DNA, 25 bp, Homo sapiens
aaaacacattttgcatatctcccag

SEQ ID NO: 4877 - DNA, 25 bp, Homo sapiens
atatctcccagcataagtaccaagc

SEQ ID NO: 4878 - DNA, 25 bp, Homo sapiens
tgaaatcgcttgaccggtcttgttc

SEQ ID NO: 4879 - DNA, 25 bp, Homo sapiens
ttgttcacataggcctctgggagtg

SEQ ID NO: 4880 - DNA, 25 bp, Homo sapiens
tctgggagtgatttggttctttgcc

SEQ ID NO: 4881 - DNA, 25 bp, Homo sapiens
tggttctttgccctaatgtttcatt

SEQ ID NO: 4882 - DNA, 25 bp, Homo sapiens
gtttcatttgacggtctctttttga

SEQ ID NO: 4883 - DNA, 25 bp, Homo sapiens
ttaagtatagcttcctcccttgaaa

SEQ ID NO: 4884 - DNA, 25 bp, Homo sapiens
tatgtctgtcttatcatgcaatgga

SEQ ID NO: 4885 - DNA, 25 bp, Homo sapiens
ccaaaaaacttgctcttatcttctc

SEQ ID NO: 4886 - DNA, 25 bp, Homo sapiens
tgctcttatcttctcaaattgtatt

SEQ ID NO: 4887 - DNA, 25 bp, Homo sapiens
cagttatcccaaagccttcaggtgg

SEQ ID NO: 4888 - DNA, 25 bp, Homo sapiens
tcctaggtcgttcaaccaggttttg

SEQ ID NO: 4889 - DNA, 25 bp, Homo sapiens
agggatccattgtctggcaggaggt

SEQ ID NO: 4890 - DNA, 25 bp, Homo sapiens
aaagcttgcgccgggcacaatagtt

SEQ ID NO: 4891 - DNA, 25 bp, Homo sapiens
agacagcgcatatcctgaggaactc

SEQ ID NO: 4892 - DNA, 25 bp, Homo sapiens
ctttctgctccttggtacttagatt

SEQ ID NO: 4893 - DNA, 25 bp, Homo sapiens
gaacctcttgattttggcggtactc

SEQ ID NO: 4894 - DNA, 25 bp, Homo sapiens
tggatgcaactaacctcactccaag

SEQ ID NO: 4895 - DNA, 25 bp, Homo sapiens
cactccaagattatggcctcgggca

SEQ ID NO: 4896 - DNA, 25 bp, Homo sapiens
gcctcgggcaagtgctgttggtgag

SEQ ID NO: 4897 - DNA, 25 bp, Homo sapiens
ggatgacgcctatgacagactgaca

SEQ ID NO: 4898 - DNA, 25 bp, Homo sapiens
ccgctgcaggatggtcgaacgtgga

SEQ ID NO: 4899 - DNA, 25 bp, Homo sapiens
agctgcacaacctctttatgctgga

SEQ ID NO: 4900 - DNA, 25 bp, Homo sapiens
ggtgttgacaatccagcagctaaag

SEQ ID NO: 4901 - DNA, 25 bp, Homo sapiens
ttggtgatggcactacctctgttac

SEQ ID NO: 4902 - DNA, 25 bp, Homo sapiens
acctctgttaccgttttagcagcag

SEQ ID NO: 4903 - DNA, 25 bp, Homo sapiens
ttcatccacagaccatcatagcggg

SEQ ID NO: 4904 - DNA, 25 bp, Homo sapiens
acgaaggctgcaagagaggcgctgt

SEQ ID NO: 4905 - DNA, 25 bp, Homo sapiens
agaggcgctgttgagttctgcagtt

SEQ ID NO: 4906 - DNA, 25 bp, Homo sapiens
gttctgcagttgatcatggttccga

SEQ ID NO: 4907 - DNA, 25 bp, Homo sapiens
attgcgggcacaacattatcctcaa

SEQ ID NO: 4908 - DNA, 25 bp, Homo sapiens
ctcaaaacttcttactcatcacaaa

SEQ ID NO: 4909 - DNA, 25 bp, Homo sapiens
tggttcccgggtaagagttgactct

SEQ ID NO: 4910 - DNA, 25 bp, Homo sapiens
gagttgactctacagcaaaggttgc

SEQ ID NO: 4911 - DNA, 25 bp, Homo sapiens
gaagctgttgcaatggagtcttatg

SEQ ID NO: 4912 - DNA, 25 bp, Homo sapiens
atgttgccaaccatcatagctgaca

SEQ ID NO: 4913 - DNA, 25 bp, Homo sapiens
gctatgacagtgcagacctggtggc

SEQ ID NO: 4914 - DNA, 25 bp, Homo sapiens
gctcagggctgctcacagtgaaggc

SEQ ID NO: 4915 - DNA, 25 bp, Homo sapiens
gaaggcaataccactgctggattgg

SEQ ID NO: 4916 - DNA, 25 bp, Homo sapiens
agatatggctatcctgggtataaca

SEQ ID NO: 4917 - DNA, 25 bp, Homo sapiens
aggtgattctgcgtgtggacaacat

SEQ ID NO: 4918 - DNA, 25 bp, Homo sapiens
ggacaacatcatcaaagcggcaccc

SEQ ID NO: 4919 - DNA, 25 bp, Homo sapiens
acgtgctgtcgatctttggaccagt

SEQ ID NO: 4920 - DNA, 25 bp, Homo sapiens
gaccagtttctagcaaagttgtgtt

SEQ ID NO: 4921 - DNA, 25 bp, Homo sapiens
atttagctgaccttcgctttaacat

SEQ ID NO: 4922 - DNA, 25 bp, Homo sapiens
gacagccttagctttgaggacttcc

SEQ ID NO: 4923 - DNA, 25 bp, Homo sapiens
gtgtgttcagtgacacagccacgcc

SEQ ID NO: 4924 - DNA, 25 bp, Homo sapiens
agacatcaagtcccattatgccttc

SEQ ID NO: 4925 - DNA, 25 bp, Homo sapiens
gaacagagaagacctgagccggctg

SEQ ID NO: 4926 - DNA, 25 bp, Homo sapiens
ggtgaactgcctcacgggagagggc

SEQ ID NO: 4927 - DNA, 25 bp, Homo sapiens
gacacacggcttagtgcgtctgaga

SEQ ID NO: 4928 - DNA, 25 bp, Homo sapiens
atgaagcagctcatcgacaacatcc

SEQ ID NO: 4929 - DNA, 25 bp, Homo sapiens
actttgccagctcctttaagattgt

SEQ ID NO: 4930 - DNA, 25 bp, Homo sapiens
taagattgtcctgtgacagcagccc

SEQ ID NO: 4931 - DNA, 25 bp, Homo sapiens
caagaacctttctactgctgagctg

SEQ ID NO: 4932 - DNA, 25 bp, Homo sapiens
gtcattgctccgtttgtgtttgtac

SEQ ID NO: 4933 - DNA, 25 bp, Homo sapiens
tggaagatactagcccagcctagca

SEQ ID NO: 4934 - DNA, 25 bp, Homo sapiens
agcccagcctagcagaaaagtgcaa

SEQ ID NO: 4935 - DNA, 25 bp, Homo sapiens
aaacatgatagtccataaccatttt

SEQ ID NO: 4936 - DNA, 25 bp, Homo sapiens
aattcacagctaatcaggcattttg

SEQ ID NO: 4937 - DNA, 25 bp, Homo sapiens
aagatatacacaccctagtttaatg

SEQ ID NO: 4938 - DNA, 25 bp, Homo sapiens
atgttgtgtcttggtgtggatttac

SEQ ID NO: 4939 - DNA, 25 bp, Homo sapiens
acaggtattctgaaccaggaacaca

SEQ ID NO: 4940 - DNA, 25 bp, Homo sapiens
acacaatcaggtttcaggccagttt

SEQ ID NO: 4941 - DNA, 25 bp, Homo sapiens
gatactggctgtccttaattctaat

SEQ ID NO: 4942 - DNA, 25 bp, Homo sapiens
gactgtactgtctgtggaacttagc

SEQ ID NO: 4943 - DNA, 25 bp, Homo sapiens
gttgacttcctagtataaaactgca

SEQ ID NO: 4944 - DNA, 25 bp, Homo sapiens
gttgtgcctaccactggctggcaca

SEQ ID NO: 4945 - DNA, 25 bp, Homo sapiens
actggctggcacaccagggcaatga

SEQ ID NO: 4946 - DNA, 25 bp, Homo sapiens
gggcaatgatttccctgcagaagga

SEQ ID NO: 4947 - DNA, 25 bp, Homo sapiens
gaaagaatgtttcacccttgcatcc

SEQ ID NO: 4948 - DNA, 25 bp, Homo sapiens
agctacagcctgtgctcagttgagt

SEQ ID NO: 4949 - DNA, 25 bp, Homo sapiens
gttcacactcagactttggctttat

SEQ ID NO: 4950 - DNA, 25 bp, Homo sapiens
aagaaccaccctgaggtttccatgc

SEQ ID NO: 4951 - DNA, 25 bp, Homo sapiens
atgcctctcccattttagtggtagc

SEQ ID NO: 4952 - DNA, 25 bp, Homo sapiens
ggtagcattttgtgtctttactcca

SEQ ID NO: 4953 - DNA, 25 bp, Homo sapiens
tagttccaccaaggttcacacacca

SEQ ID NO: 4954 - DNA, 25 bp, Homo sapiens
tttgagtggcctttcaaccctaaga

SEQ ID NO: 4955 - DNA, 25 bp, Homo sapiens
tggaaggacacttctttctatcacc

SEQ ID NO: 4956 - DNA, 25 bp, Homo sapiens
tatacactctacattttctctgcac

SEQ ID NO: 4957 - DNA, 25 bp, Homo sapiens
acccctatcccaagttttatgacag

SEQ ID NO: 4958 - DNA, 25 bp, Homo sapiens
tgctctggggagtacaccaggctca

SEQ ID NO: 4959 - DNA, 25 bp, Homo sapiens
ctcagctactttgtccacattggat

SEQ ID NO: 4960 - DNA, 25 bp, Homo sapiens
accctaatcagtatccttcagcttt

SEQ ID NO: 4961 - DNA, 25 bp, Homo sapiens
ttttacattaacccagtgtcctctg

SEQ ID NO: 4962 - DNA, 25 bp, Homo sapiens
gagtcttgtggtagccactccagga

SEQ ID NO: 4963 - DNA, 25 bp, Homo sapiens
ctccaggatcctgattggggtgcca

SEQ ID NO: 4964 - DNA, 25 bp, Homo sapiens
tgcattgaggcgctctattcttctt

SEQ ID NO: 4965 - DNA, 25 bp, Homo sapiens
tcttcttcacctctcaggaactgac

SEQ ID NO: 4966 - DNA, 25 bp, Homo sapiens
gttgactctaagcagcagacatcct

SEQ ID NO: 4967 - DNA, 25 bp, Homo sapiens
gtgaggccgttaattggccatcact

SEQ ID NO: 4968 - DNA, 25 bp, Homo sapiens
ccatcactgatggcccttagggaaa

SEQ ID NO: 4969 - DNA, 25 bp, Homo sapiens
agggaaagactggacctctgtgcca

SEQ ID NO: 4970 - DNA, 25 bp, Homo sapiens
tgtaggcacccactgggtctaccag

SEQ ID NO: 4971 - DNA, 25 bp, Homo sapiens
aatttccagatgagctcttctttcc

SEQ ID NO: 4972 - DNA, 25 bp, Homo sapiens
gctcttctttcctacaagttttcat

SEQ ID NO: 4973 - DNA, 25 bp, Homo sapiens
tgcctcttgtggcacaggccataat

SEQ ID NO: 4974 - DNA, 25 bp, Homo sapiens
ggccataattgttccatagacccct

SEQ ID NO: 4975 - DNA, 25 bp, Homo sapiens
tatatttcacaaactccacctactg

SEQ ID NO: 4976 - DNA, 25 bp, Homo sapiens
ggcctgatcatggctatctcagcca

SEQ ID NO: 4977 - DNA, 25 bp, Homo sapiens
aaatgttcttataatgctacctgat

SEQ ID NO: 4978 - DNA, 25 bp, Homo sapiens
taatgctacctgatttctatgaaat

SEQ ID NO: 4979 - DNA, 25 bp, Homo sapiens
gttcatttcctgggattcacttctc

SEQ ID NO: 4980 - DNA, 25 bp, Homo sapiens
ggattcacttctccagggatttttt

SEQ ID NO: 4981 - DNA, 25 bp, Homo sapiens
gggaaattaacagcagttcacttta

SEQ ID NO: 4982 - DNA, 25 bp, Homo sapiens
ctttattgtgagtctttgccacatt

SEQ ID NO: 4983 - DNA, 25 bp, Homo sapiens
tgaattgagctgtcatttgtacatt

SEQ ID NO: 4984 - DNA, 25 bp, Homo sapiens
agcacaacagggcttgcactaaaga

SEQ ID NO: 4985 - DNA, 25 bp, Homo sapiens
cactacttggtagcctaacttcata

SEQ ID NO: 4986 - DNA, 25 bp, Homo sapiens
aaagtcaataatttgtcaccttggg

SEQ ID NO: 4987 - DNA, 25 bp, Homo sapiens
ttaagtgttggctatttctatgttt

SEQ ID NO: 4988 - DNA, 25 bp, Homo sapiens
cggacccatccaagtcatctgattg

SEQ ID NO: 4989 - DNA, 25 bp, Homo sapiens
gactttttcactaaccagttgacga

SEQ ID NO: 4990 - DNA, 25 bp, Homo sapiens
acaagatgcccttgggagctgtgag

SEQ ID NO: 4991 - DNA, 25 bp, Homo sapiens
ggacctgcgggcttagatcaatctc

SEQ ID NO: 4992 - DNA, 25 bp, Homo sapiens
gatcaatctcaattccttttcatgc

SEQ ID NO: 4993 - DNA, 25 bp, Homo sapiens
ctgcgtgggtatttgtctccttagc

SEQ ID NO: 4994 - DNA, 25 bp, Homo sapiens
tgagtgaggccattcttcatcctta

SEQ ID NO: 4995 - DNA, 25 bp, Homo sapiens
atgatggtgcaagttcctttctctt

SEQ ID NO: 4996 - DNA, 25 bp, Homo sapiens
tgcaatttctagtgccttctgtcca

SEQ ID NO: 4997 - DNA, 25 bp, Homo sapiens
gacgtacttggctacagatttctgc

SEQ ID NO: 4998 - DNA, 25 bp, Homo sapiens
ttctgccttgttttgcgacattgtc

SEQ ID NO: 4999 - DNA, 25 bp, Homo sapiens
tagctcaacgtaagcatttcccctc

SEQ ID NO: 5000 - DNA, 25 bp, Homo sapiens
gtcaattggctcatcagctacagca

SEQ ID NO: 5001 - DNA, 25 bp, Homo sapiens
gctacagcaagtatatgcgtgcctt

SEQ ID NO: 5002 - DNA, 25 bp, Homo sapiens
gcgtgccttggatgaatactatgac

SEQ ID NO: 5003 - DNA, 25 bp, Homo sapiens
aaacacttcacagagttcgttcctc

SEQ ID NO: 5004 - DNA, 25 bp, Homo sapiens
ttatgacaggttctgcccattctac

SEQ ID NO: 5005 - DNA, 25 bp, Homo sapiens
gtagagctgttgaaaccactgccca

SEQ ID NO: 5006 - DNA, 25 bp, Homo sapiens
acatggtccattattcgtgagcaca

SEQ ID NO: 5007 - DNA, 25 bp, Homo sapiens
gtgagcacatgggagacatcctcta

SEQ ID NO: 5008 - DNA, 25 bp, Homo sapiens
ggagacatcctctataaactttcct

SEQ ID NO: 5009 - DNA, 25 bp, Homo sapiens
gcagaatgcattccgtagccttgaa

SEQ ID NO: 5010 - DNA, 25 bp, Homo sapiens
tgcctcttaggggccagagcgggca

SEQ ID NO: 5011 - DNA, 25 bp, Homo sapiens
catcagcaaccctttccaggtagaa

SEQ ID NO: 5012 - DNA, 25 bp, Homo sapiens
ccagcgggagttcaggttcccaagc

SEQ ID NO: 5013 - DNA, 25 bp, Homo sapiens
gttcccaagcaatttcacgtacatg

SEQ ID NO: 5014 - DNA, 25 bp, Homo sapiens
ctggtaagtgactgatctttccccc

SEQ ID NO: 5015 - DNA, 25 bp, Homo sapiens
gagtcttggatgcattcacagtcat

SEQ ID NO: 5016 - DNA, 25 bp, Homo sapiens
acagtcatttctggtctgtgcacca

SEQ ID NO: 5017 - DNA, 25 bp, Homo sapiens
gtgacctatgaaaaaccctactgaa

SEQ ID NO: 5018 - DNA, 25 bp, Homo sapiens
gagcaaataacttaccttcttcctt

SEQ ID NO: 5019 - DNA, 25 bp, Homo sapiens
actgtttgccaatgtctgatgtgtg

SEQ ID NO: 5020 - DNA, 25 bp, Homo sapiens
gatgtgtgtatccctggttcacaag

SEQ ID NO: 5021 - DNA, 25 bp, Homo sapiens
cttaccttttagattcttttgctag

SEQ ID NO: 5022 - DNA, 25 bp, Homo sapiens
tataaggtctttaaaccatttccat

SEQ ID NO: 5023 - DNA, 25 bp, Homo sapiens
ggaacaaagctcttattcaactgcg

SEQ ID NO: 5024 - DNA, 25 bp, Homo sapiens
ttcaactgcgaattccatagtgggc

SEQ ID NO: 5025 - DNA, 25 bp, Homo sapiens
ccatagtgggctctggcttttcttg

SEQ ID NO: 5026 - DNA, 25 bp, Homo sapiens
gattcacctaactcattattttgct

SEQ ID NO: 5027 - DNA, 25 bp, Homo sapiens
ttccttcaccaccgagatatgctaa

SEQ ID NO: 5028 - DNA, 25 bp, Homo sapiens
gagtttgtatcacatgttacttatt

SEQ ID NO: 5029 - DNA, 25 bp, Homo sapiens
gaaaaagatcagccggaaacccctg

SEQ ID NO: 5030 - DNA, 25 bp, Homo sapiens
ggaagggattggcatcggctggcct

SEQ ID NO: 5031 - DNA, 25 bp, Homo sapiens
aacccaatgctgcgtgtgaggcctt

SEQ ID NO: 5032 - DNA, 25 bp, Homo sapiens
acacttttcttgcgtactcaactaa

SEQ ID NO: 5033 - DNA, 25 bp, Homo sapiens
tgactgtagccatcaccagaacact

SEQ ID NO: 5034 - DNA, 25 bp, Homo sapiens
cagaacacttagtttcttcccagac

SEQ ID NO: 5035 - DNA, 25 bp, Homo sapiens
aacacactgtgggcgtgcatctggt

SEQ ID NO: 5036 - DNA, 25 bp, Homo sapiens
atctggttcagccctggatatgcct

SEQ ID NO: 5037 - DNA, 25 bp, Homo sapiens
ctggagttgtgcacagcaccgcagc

SEQ ID NO: 5038 - DNA, 25 bp, Homo sapiens
aatatgatacacccagacagaccca

SEQ ID NO: 5039 - DNA, 25 bp, Homo sapiens
aatcttttgatttccccagcgagat

SEQ ID NO: 5040 - DNA, 25 bp, Homo sapiens
cagcgagatacttaccactctctct

SEQ ID NO: 5041 - DNA, 25 bp, Homo sapiens
tcttctctttcccatggttaaaaca

SEQ ID NO: 5042 - DNA, 25 bp, Homo sapiens
tgtgttctctgtcgctgctaaatta

SEQ ID NO: 5043 - DNA, 25 bp, Homo sapiens
ttctccaactcacccaagtgcaatt

SEQ ID NO: 5044 - DNA, 25 bp, Homo sapiens
tcgtggaggaggtgcatttgttcag

SEQ ID NO: 5045 - DNA, 25 bp, Homo sapiens
atttgttcagaacagccagccagtg

SEQ ID NO: 5046 - DNA, 25 bp, Homo sapiens
gccagccagtggcagtgcgaggtgg

SEQ ID NO: 5047 - DNA, 25 bp, Homo sapiens
aatcgtttatacatacccacaggtg

SEQ ID NO: 5048 - DNA, 25 bp, Homo sapiens
ttcaatgactataacctctactccc

SEQ ID NO: 5049 - DNA, 25 bp, Homo sapiens
ttcctacctactcttcttgtaaact

SEQ ID NO: 5050 - DNA, 25 bp, Homo sapiens
tactcttcttgtaaactctgctgct

SEQ ID NO: 5051 - DNA, 25 bp, Homo sapiens
gtttacaactgtggccctatttatt

SEQ ID NO: 5052 - DNA, 25 bp, Homo sapiens
acagtttgtctatcgtgtcttaaat

SEQ ID NO: 5053 - DNA, 25 bp, Homo sapiens
tagtctttactgtgccaagctaact

SEQ ID NO: 5054 - DNA, 25 bp, Homo sapiens
ggatatgcagactacagtggccaac

SEQ ID NO: 5055 - DNA, 25 bp, Homo sapiens
gagcacttatggcaaggcatctcga

SEQ ID NO: 5056 - DNA, 25 bp, Homo sapiens
gcatctcgagggggtggcaatcacc

SEQ ID NO: 5057 - DNA, 25 bp, Homo sapiens
tcaccaaaacaattaccagccatac

SEQ ID NO: 5058 - DNA, 25 bp, Homo sapiens
aacagcgggaacttcattgcaggcc

SEQ ID NO: 5059 - DNA, 25 bp, Homo sapiens
ggcagagcgcaaggcatacaccaga

SEQ ID NO: 5060 - DNA, 25 bp, Homo sapiens
acaccagaaaacgctgtcctgtgga

SEQ ID NO: 5061 - DNA, 25 bp, Homo sapiens
taacccatcttgcaggacgacattg

SEQ ID NO: 5062 - DNA, 25 bp, Homo sapiens
gtgtccaactgtatatagctgccaa

SEQ ID NO: 5063 - DNA, 25 bp, Homo sapiens
agctgccaattagttttctttgttt

SEQ ID NO: 5064 - DNA, 25 bp, Homo sapiens
ttactttgtcctttgctatctgtgt

SEQ ID NO: 5065 - DNA, 25 bp, Homo sapiens
aattgcctccaatcaaagtgaccca

SEQ ID NO: 5066 - DNA, 25 bp, Homo sapiens
atgatgggacagacttctcgggctt

SEQ ID NO: 5067 - DNA, 25 bp, Homo sapiens
tttgcccagcgacagagctgcatga

SEQ ID NO: 5068 - DNA, 25 bp, Homo sapiens
catgaatacgtttgccagctggttt

SEQ ID NO: 5069 - DNA, 25 bp, Homo sapiens
ataccgagacattgagcgactttga

SEQ ID NO: 5070 - DNA, 25 bp, Homo sapiens
gcgactttgaggaatccggctgagt

SEQ ID NO: 5071 - DNA, 25 bp, Homo sapiens
aagaagggatgggggtcaagctgct

SEQ ID NO: 5072 - DNA, 25 bp, Homo sapiens
gatccactcatcagcagagccagat

SEQ ID NO: 5073 - DNA, 25 bp, Homo sapiens
agagccagattgtgccaactatcca

SEQ ID NO: 5074 - DNA, 25 bp, Homo sapiens
ggccaatgagaactcaactcctggc

SEQ ID NO: 5075 - DNA, 25 bp, Homo sapiens
ggcttctgtgtcccaagactaggtt

SEQ ID NO: 5076 - DNA, 25 bp, Homo sapiens
gatgaaccaattttctgcagcctct

SEQ ID NO: 5077 - DNA, 25 bp, Homo sapiens
tggtatacacatcacctgttctttc

SEQ ID NO: 5078 - DNA, 25 bp, Homo sapiens
tttttctcagagccttgcatgtcag

SEQ ID NO: 5079 - DNA, 25 bp, Homo sapiens
ggcatgaggctggacgacttgttaa

SEQ ID NO: 5080 - DNA, 25 bp, Homo sapiens
tgtagttgtttctatagcccctatg

SEQ ID NO: 5081 - DNA, 25 bp, Homo sapiens
agctcttcctgtcagggatcagggc

SEQ ID NO: 5082 - DNA, 25 bp, Homo sapiens
ggatcagggcagcactaacaggcgc

SEQ ID NO: 5083 - DNA, 25 bp, Homo sapiens
ttggctccgctacttgtaacaagct

SEQ ID NO: 5084 - DNA, 25 bp, Homo sapiens
gtaacaagctccagcccttaaaatg

SEQ ID NO: 5085 - DNA, 25 bp, Homo sapiens
aggcaccctgcttaggtgcacagct

SEQ ID NO: 5086 - DNA, 25 bp, Homo sapiens
tttggaaaccctggtgtacctctca

SEQ ID NO: 5087 - DNA, 25 bp, Homo sapiens
aggtgaatgaagcttttgctcccca

SEQ ID NO: 5088 - DNA, 25 bp, Homo sapiens
ccattgctttgggtcacccactggg

SEQ ID NO: 5089 - DNA, 25 bp, Homo sapiens
tcacccactgggaggatctggatca

SEQ ID NO: 5090 - DNA, 25 bp, Homo sapiens
gaattactgcacacctggttcacga

SEQ ID NO: 5091 - DNA, 25 bp, Homo sapiens
aaaatatgccgttggatcagcttgc

SEQ ID NO: 5092 - DNA, 25 bp, Homo sapiens
gatcagcttgcattggaggtggcca

SEQ ID NO: 5093 - DNA, 25 bp, Homo sapiens
gccaaggtattgctgtcatcattca

SEQ ID NO: 5094 - DNA, 25 bp, Homo sapiens
gagaccagtgagctcactgtgaccc

SEQ ID NO: 5095 - DNA, 25 bp, Homo sapiens
ttcagagcagctgccacaactggcc

SEQ ID NO: 5096 - DNA, 25 bp, Homo sapiens
ccatgccctgccattgaaacagtga

SEQ ID NO: 5097 - DNA, 25 bp, Homo sapiens
gtacattctctcagatttgaaccag

SEQ ID NO: 5098 - DNA, 25 bp, Homo sapiens
caatctccagggctccaaatctgcc

SEQ ID NO: 5099 - DNA, 25 bp, Homo sapiens
tccagggctccaaatctgcctagaa

SEQ ID NO: 5100 - DNA, 25 bp, Homo sapiens
cagggctccaaatctgcctagaaaa

SEQ ID NO: 5101 - DNA, 25 bp, Homo sapiens
ggctccaaatctgcctagaaaacct

SEQ ID NO: 5102 - DNA, 25 bp, Homo sapiens
gggaggtagaaggggaggacactgg

SEQ ID NO: 5103 - DNA, 25 bp, Homo sapiens
gggggcaaaggtttgaagacacagc

SEQ ID NO: 5104 - DNA, 25 bp, Homo sapiens
ccgaggcgcgtttgtgtatatctgc

SEQ ID NO: 5105 - DNA, 25 bp, Homo sapiens
ggcgcgtttgtgtatatctgcctcc

SEQ ID NO: 5106 - DNA, 25 bp, Homo sapiens
cccctgtctgtaaggagcagcggga

SEQ ID NO: 5107 - DNA, 25 bp, Homo sapiens
aaggagcagcgggaacggagcttcg

SEQ ID NO: 5108 - DNA, 25 bp, Homo sapiens
agcagcgggaacggagcttcggagc

SEQ ID NO: 5109 - DNA, 25 bp, Homo sapiens
tggcgatggggcagagctgacggca

SEQ ID NO: 5110 - DNA, 25 bp, Homo sapiens
aagcaacacgccttcaagcaggcct

SEQ ID NO: 5111 - DNA, 25 bp, Homo sapiens
tcatccgcggcccgggtgaaaatgg

SEQ ID NO: 5112 - DNA, 25 bp, Homo sapiens
aaatggggatgacagctaggaggct

SEQ ID NO: 5113 - DNA, 25 bp, Homo sapiens
ccggccacgtgtggactgtggggct

SEQ ID NO: 5114 - DNA, 25 bp, Homo sapiens
gcagctgaacgcacttgcagcgtcc

SEQ ID NO: 5115 - DNA, 25 bp, Homo sapiens
ccctgcctggctggcttaagggggc

SEQ ID NO: 5116 - DNA, 25 bp, Homo sapiens
tcaggggcctggcatgaacctggcc

SEQ ID NO: 5117 - DNA, 25 bp, Homo sapiens
tcccggggagctgagactagggtcc

SEQ ID NO: 5118 - DNA, 25 bp, Homo sapiens
gcccagaaacctttggccacaagaa

SEQ ID NO: 5119 - DNA, 25 bp, Homo sapiens
caggggtcactgcagtttgggatgg

SEQ ID NO: 5120 - DNA, 25 bp, Homo sapiens
gacctacttggatcttggcatgcac

SEQ ID NO: 5121 - DNA, 25 bp, Homo sapiens
cctaacccactttctcaagaacaag

SEQ ID NO: 5122 - DNA, 25 bp, Homo sapiens
tccaagcacctcgagctatgcaacc

SEQ ID NO: 5123 - DNA, 25 bp, Homo sapiens
ctatgcaacctctgttcttgtattt

SEQ ID NO: 5124 - DNA, 25 bp, Homo sapiens
tgatctctgatgggttcttctcgaa

SEQ ID NO: 5125 - DNA, 25 bp, Homo sapiens
gaagcgtgttagcccatttgaggtc

SEQ ID NO: 5126 - DNA, 25 bp, Homo sapiens
tacccagacctcacttttagttatt

SEQ ID NO: 5127 - DNA, 25 bp, Homo sapiens
tgctgggcttgtgcacaggaagagc

SEQ ID NO: 5128 - DNA, 25 bp, Homo sapiens
gagcaccagccgctgagtcaggatc

SEQ ID NO: 5129 - DNA, 25 bp, Homo sapiens
gtcaggatcctgtcagttccatgag

SEQ ID NO: 5130 - DNA, 25 bp, Homo sapiens
tgagctattcctctttggtttggct

SEQ ID NO: 5131 - DNA, 25 bp, Homo sapiens
cgctgctgtgcctcgatggcaaacg

SEQ ID NO: 5132 - DNA, 25 bp, Homo sapiens
gaatcatgccgtggtgtctcggatg

SEQ ID NO: 5133 - DNA, 25 bp, Homo sapiens
agaaatggatctgactgcccggaca

SEQ ID NO: 5134 - DNA, 25 bp, Homo sapiens
gactgcccggacaagttttgcttat

SEQ ID NO: 5135 - DNA, 25 bp, Homo sapiens
caagttttgcttattccagtctgaa

SEQ ID NO: 5136 - DNA, 25 bp, Homo sapiens
aaaccttctgttcaatgacaacact

SEQ ID NO: 5137 - DNA, 25 bp, Homo sapiens
gtgtctggccagactccatggcaaa

SEQ ID NO: 5138 - DNA, 25 bp, Homo sapiens
gggaccacagtatgtcgcaggcatt

SEQ ID NO: 5139 - DNA, 25 bp, Homo sapiens
tcctggaagcctgtgaattcctcag

SEQ ID NO: 5140 - DNA, 25 bp, Homo sapiens
caagaaagcctcagccattcactgc

SEQ ID NO: 5141 - DNA, 25 bp, Homo sapiens
ttccctgctgtcgtcttagcaagaa

SEQ ID NO: 5142 - DNA, 25 bp, Homo sapiens
gccctcttaccgctagcgaggtgat

SEQ ID NO: 5143 - DNA, 25 bp, Homo sapiens
gtgataggacatctggcttgccaca

SEQ ID NO: 5144 - DNA, 25 bp, Homo sapiens
gcttgccacaaaggtctgttcgacc

SEQ ID NO: 5145 - DNA, 25 bp, Homo sapiens
gttcgaccagacatatcctagctaa

SEQ ID NO: 5146 - DNA, 25 bp, Homo sapiens
gaatgtgaggccaaccttctatcag

SEQ ID NO: 5147 - DNA, 25 bp, Homo sapiens
cagctgcccaatgccatgtgaagta

SEQ ID NO: 5148 - DNA, 25 bp, Homo sapiens
agcaataccgtcatgtttcagccaa

SEQ ID NO: 5149 - DNA, 25 bp, Homo sapiens
caagcccagagccctaagattacaa

SEQ ID NO: 5150 - DNA, 25 bp, Homo sapiens
gttaccacctgaacagtcctcggtg

SEQ ID NO: 5151 - DNA, 25 bp, Homo sapiens
ggcagaagcaccagctgtactacta

SEQ ID NO: 5152 - DNA, 25 bp, Homo sapiens
ggtgtctccaacctgactaggtgga

SEQ ID NO: 5153 - DNA, 25 bp, Homo sapiens
gctgccactgaggagttcatcaagc

SEQ ID NO: 5154 - DNA, 25 bp, Homo sapiens
agcagcacagtcactctacattgcc

SEQ ID NO: 5155 - DNA, 25 bp, Homo sapiens
ccaaccatgcctactgagtatccac

SEQ ID NO: 5156 - DNA, 25 bp, Homo sapiens
tactgagtatccactccataccaca

SEQ ID NO: 5157 - DNA, 25 bp, Homo sapiens
tgcacccacttttgcttgtagtcat

SEQ ID NO: 5158 - DNA, 25 bp, Homo sapiens
ggccagggccaaatagctatgcaga

SEQ ID NO: 5159 - DNA, 25 bp, Homo sapiens
agagcagagatgccttcacctggca

SEQ ID NO: 5160 - DNA, 25 bp, Homo sapiens
cattgctgcacctgggaccatagga

SEQ ID NO: 5161 - DNA, 25 bp, Homo sapiens
ggaggatagggagcccctcatgact

SEQ ID NO: 5162 - DNA, 25 bp, Homo sapiens
tcccacaattttcccatgatgaggt

SEQ ID NO: 5163 - DNA, 25 bp, Homo sapiens
ctgcactcaatgcctggcgagggca

SEQ ID NO: 5164 - DNA, 25 bp, Homo sapiens
gctggaaggggccacgtggatgggc

SEQ ID NO: 5165 - DNA, 25 bp, Homo sapiens
agaggcagcatgcttgggctgaccc

SEQ ID NO: 5166 - DNA, 25 bp, Homo sapiens
ctgtgccaacctgttcttagagtgt

SEQ ID NO: 5167 - DNA, 25 bp, Homo sapiens
gagtgtagctgtaagggcagtgccc

SEQ ID NO: 5168 - DNA, 25 bp, Homo sapiens
gcagtgcccatgtgtacattctgcc

SEQ ID NO: 5169 - DNA, 25 bp, Homo sapiens
acattctgcctagagtgtagcctaa

SEQ ID NO: 5170 - DNA, 25 bp, Homo sapiens
gtgtagcctaaagggcagggcccac

SEQ ID NO: 5171 - DNA, 25 bp, Homo sapiens
agggcccacgtgtatagtatctgta

SEQ ID NO: 5172 - DNA, 25 bp, Homo sapiens
ccaccttcacctcggagggacggag

SEQ ID NO: 5173 - DNA, 25 bp, Homo sapiens
gaagtggagacagtcctttcccacc

SEQ ID NO: 5174 - DNA, 25 bp, Homo sapiens
ggcatggtcccttaaggcacagtgg

SEQ ID NO: 5175 - DNA, 25 bp, Homo sapiens
aaacgcttggagtgcttctgaatat

SEQ ID NO: 5176 - DNA, 25 bp, Homo sapiens
acagaagttccatttaagggcaagt

SEQ ID NO: 5177 - DNA, 25 bp, Homo sapiens
gcaagtttccccgtagatgtatcaa

SEQ ID NO: 5178 - DNA, 25 bp, Homo sapiens
gcctcccagcttcttataagactca

SEQ ID NO: 5179 - DNA, 25 bp, Homo sapiens
aaacatgatatatcagcttttgcct

SEQ ID NO: 5180 - DNA, 25 bp, Homo sapiens
tgcctttcaatttatcaatctctta

SEQ ID NO: 5181 - DNA, 25 bp, Homo sapiens
gagaatccaactttattacgattag

SEQ ID NO: 5182 - DNA, 25 bp, Homo sapiens
tcaaacttccatatttgccttggga

SEQ ID NO: 5183 - DNA, 25 bp, Homo sapiens
aaacttccctctctagacagtagat

SEQ ID NO: 5184 - DNA, 25 bp, Homo sapiens
gtagataccacctactgatggttac

SEQ ID NO: 5185 - DNA, 25 bp, Homo sapiens
gatggttacatatactagggaaatt

SEQ ID NO: 5186 - DNA, 25 bp, Homo sapiens
tgatttgtcctgcagtgctcattca

SEQ ID NO: 5187 - DNA, 25 bp, Homo sapiens
aacagcaggccatctttttatgcaa

SEQ ID NO: 5188 - DNA, 25 bp, Homo sapiens
acttcactggtgtacatcgtttact

SEQ ID NO: 5189 - DNA, 25 bp, Homo sapiens
tcgtttactttttaactggcttcat

SEQ ID NO: 5190 - DNA, 25 bp, Homo sapiens
agaaatgcggaccaaactacttcat

SEQ ID NO: 5191 - DNA, 25 bp, Homo sapiens
actacttcattttctcaaagggcat

SEQ ID NO: 5192 - DNA, 25 bp, Homo sapiens
gcataccttgtgcattgtggcttat

SEQ ID NO: 5193 - DNA, 25 bp, Homo sapiens
gatgagccatattaattgcctgtta

SEQ ID NO: 5194 - DNA, 25 bp, Homo sapiens
gttattattaccagcatttgtcctt

SEQ ID NO: 5195 - DNA, 25 bp, Homo sapiens
atacttgcactctttaacacattct

SEQ ID NO: 5196 - DNA, 25 bp, Homo sapiens
agaggagtgttattgcatgctgata

SEQ ID NO: 5197 - DNA, 25 bp, Homo sapiens
gacaaaccatttccaacagcaacac

SEQ ID NO: 5198 - DNA, 25 bp, Homo sapiens
cttgttggtgtggatctattggctg

SEQ ID NO: 5199 - DNA, 25 bp, Homo sapiens
attggctgatctatgcctttcaact

SEQ ID NO: 5200 - DNA, 25 bp, Homo sapiens
aagtcacgttgttttcaggtccaga

SEQ ID NO: 5201 - DNA, 25 bp, Homo sapiens
tagtttctttctgtctgctttaaat

SEQ ID NO: 5202 - DNA, 25 bp, Homo sapiens
gactcataccacacttacaattaag

SEQ ID NO: 5203 - DNA, 25 bp, Homo sapiens
aggggagaggcattgccttctctgc

SEQ ID NO: 5204 - DNA, 25 bp, Homo sapiens
cagtctttccgtgtgattgtctttg

SEQ ID NO: 5205 - DNA, 25 bp, Homo sapiens
tctcagatgccccaaagtttcggtt

SEQ ID NO: 5206 - DNA, 25 bp, Homo sapiens
ggttcctatgagcccggggcatgat

SEQ ID NO: 5207 - DNA, 25 bp, Homo sapiens
ggcatgatctgatccccaagacatg

SEQ ID NO: 5208 - DNA, 25 bp, Homo sapiens
taacacttggctcttggtacctgtg

SEQ ID NO: 5209 - DNA, 25 bp, Homo sapiens
gtacctgtgggttagcatcaagttc

SEQ ID NO: 5210 - DNA, 25 bp, Homo sapiens
catcaagttctccccagggtagaat

SEQ ID NO: 5211 - DNA, 25 bp, Homo sapiens
caatcagagctccagtttgcatttg

SEQ ID NO: 5212 - DNA, 25 bp, Homo sapiens
tcccatttcccaaacctaaaatctg

SEQ ID NO: 5213 - DNA, 25 bp, Homo sapiens
atctgtttttctcatcagactctga

SEQ ID NO: 5214 - DNA, 25 bp, Homo sapiens
gactctgagtaactggttgctgtgt

SEQ ID NO: 5215 - DNA, 25 bp, Homo sapiens
tttgaggagagcaccctaggcagcc

SEQ ID NO: 5216 - DNA, 25 bp, Homo sapiens
aataacatactggccgttctgacct

SEQ ID NO: 5217 - DNA, 25 bp, Homo sapiens
gttctgacctgttgccagcagatac

SEQ ID NO: 5218 - DNA, 25 bp, Homo sapiens
cctgtagtactcctcttttagatcc

SEQ ID NO: 5219 - DNA, 25 bp, Homo sapiens
tcctgcgcctgtatcatgactgagg

SEQ ID NO: 5220 - DNA, 25 bp, Homo sapiens
tatcatgactgaggtgcctcccaac

SEQ ID NO: 5221 - DNA, 25 bp, Homo sapiens
tcttctttgctaacaaccgctttga

SEQ ID NO: 5222 - DNA, 25 bp, Homo sapiens
gtatctgagcttcggtgactttgcc

SEQ ID NO: 5223 - DNA, 25 bp, Homo sapiens
tccaaaactggacccttggagccgt

SEQ ID NO: 5224 - DNA, 25 bp, Homo sapiens
ggagctcaaggtgctagtggctgac

SEQ ID NO: 5225 - DNA, 25 bp, Homo sapiens
gctagtggctgacaaggaccttctg

SEQ ID NO: 5226 - DNA, 25 bp, Homo sapiens
caagagcctggtgtgcactgctctc

SEQ ID NO: 5227 - DNA, 25 bp, Homo sapiens
gggcgtcttctctgagatggaagcc

SEQ ID NO: 5228 - DNA, 25 bp, Homo sapiens
cgccaagctgacccacaataaagat

SEQ ID NO: 5229 - DNA, 25 bp, Homo sapiens
tgcggttcttcctgaatcagtattc

SEQ ID NO: 5230 - DNA, 25 bp, Homo sapiens
gttccaggcgtggctggagctggct

SEQ ID NO: 5231 - DNA, 25 bp, Homo sapiens
ctccctcagaagcacgttggcagga

SEQ ID NO: 5232 - DNA, 25 bp, Homo sapiens
gttggcaggaggccgatcagaaccc

SEQ ID NO: 5233 - DNA, 25 bp, Homo sapiens
cctagcgcctttggtcctaagaatg

SEQ ID NO: 5234 - DNA, 25 bp, Homo sapiens
gggatgtagaacggggaccctcgca

SEQ ID NO: 5235 - DNA, 25 bp, Homo sapiens
ctttgtggccgtccaagtgccaatt

SEQ ID NO: 5236 - DNA, 25 bp, Homo sapiens
gccaattggcttttcgcccaaataa

SEQ ID NO: 5237 - DNA, 25 bp, Homo sapiens
tctgtccttggaggtgatttccccc

SEQ ID NO: 5238 - DNA, 25 bp, Homo sapiens
tgagtgaccacctgggtgccagtta

SEQ ID NO: 5239 - DNA, 25 bp, Homo sapiens
gtgccagttacaggtgtttccagag

SEQ ID NO: 5240 - DNA, 25 bp, Homo sapiens
gtgttttcctgagagttcgtgtcat

SEQ ID NO: 5241 - DNA, 25 bp, Homo sapiens
tgcccttgctgctgggtggagtgga

SEQ ID NO: 5242 - DNA, 25 bp, Homo sapiens
gttgttgcctttgtatgtggttcaa

SEQ ID NO: 5243 - DNA, 25 bp, Homo sapiens
gtatgtggttcaaccatccagctcc

SEQ ID NO: 5244 - DNA, 25 bp, Homo sapiens
catccagctcccagctggctaaact

SEQ ID NO: 5245 - DNA, 25 bp, Homo sapiens
tcccagctggctaaactttgcctcc

SEQ ID NO: 5246 - DNA, 25 bp, Homo sapiens
aactttgcctccagtggtcaaagat

SEQ ID NO: 5247 - DNA, 25 bp, Homo sapiens
gagtggggttggcaggagatggaaa

SEQ ID NO: 5248 - DNA, 25 bp, Homo sapiens
gatggaaaacggaggtgccgcccca

SEQ ID NO: 5249 - DNA, 25 bp, Homo sapiens
ccattctggattcggcggttccggg

SEQ ID NO: 5250 - DNA, 25 bp, Homo sapiens
gattactctgtcttgtacgtttgtt

SEQ ID NO: 5251 - DNA, 25 bp, Homo sapiens
tgttctgctgctcttcaatattgta

SEQ ID NO: 5252 - DNA, 25 bp, Homo sapiens
tgtttctaacacgcttgcaacttcc

SEQ ID NO: 5253 - DNA, 25 bp, Homo sapiens
gcaacttcccttatggcattaatct

SEQ ID NO: 5254 - DNA, 25 bp, Homo sapiens
gagacagaatcctggactctccaaa

SEQ ID NO: 5255 - DNA, 25 bp, Homo sapiens
gtagggcctgctctgacagggccca

SEQ ID NO: 5256 - DNA, 25 bp, Homo sapiens
gataaggaccaatgacagcaaagca

SEQ ID NO: 5257 - DNA, 25 bp, Homo sapiens
tgaaaggaccttttgtcacagcact

SEQ ID NO: 5258 - DNA, 25 bp, Homo sapiens
ctgcccccgcacagaaatgctgcag

SEQ ID NO: 5259 - DNA, 25 bp, Homo sapiens
gagacatttttgtaggatgcctgac

SEQ ID NO: 5260 - DNA, 25 bp, Homo sapiens
ggatgcctgacgaggtgtagccttt

SEQ ID NO: 5261 - DNA, 25 bp, Homo sapiens
tgtagccttttatcttgtttccgga

SEQ ID NO: 5262 - DNA, 25 bp, Homo sapiens
gtttccggatgcatatttattacga

SEQ ID NO: 5263 - DNA, 25 bp, Homo sapiens
aagttgcccctgacaagctattata

SEQ ID NO: 5264 - DNA, 25 bp, Homo sapiens
acatctctggtaaatcctgctgaat

SEQ ID NO: 5265 - DNA, 25 bp, Homo sapiens
tattcagagcttttcatacctcatc

SEQ ID NO: 5266 - DNA, 25 bp, Homo sapiens
aagcagccaacttatgtgacctgat

SEQ ID NO: 5267 - DNA, 25 bp, Homo sapiens
aagagtgtgacgcattcttcgcatc

SEQ ID NO: 5268 - DNA, 25 bp, Homo sapiens
gtgtctgtgctctgggatggatacc

SEQ ID NO: 5269 - DNA, 25 bp, Homo sapiens
ggataccgtctgatgtctgtttgtt

SEQ ID NO: 5270 - DNA, 25 bp, Homo sapiens
gttattgatggcgcagccactgcaa

SEQ ID NO: 5271 - DNA, 25 bp, Homo sapiens
gccactgcaaaactagtcaactccc

SEQ ID NO: 5272 - DNA, 25 bp, Homo sapiens
gtcaactcccatctataactgttac

SEQ ID NO: 5273 - DNA, 25 bp, Homo sapiens
gttactttttctagtgctgctttgt

SEQ ID NO: 5274 - DNA, 25 bp, Homo sapiens
gaactgggttgtatcaagccgctct

SEQ ID NO: 5275 - DNA, 25 bp, Homo sapiens
tctcctcacggtcatggactctaag

SEQ ID NO: 5276 - DNA, 25 bp, Homo sapiens
gattgtacaggttgccctaaatggc

SEQ ID NO: 5277 - DNA, 25 bp, Homo sapiens
aacccttactgtgctttgattgaag

SEQ ID NO: 5278 - DNA, 25 bp, Homo sapiens
aggcctttgatcttattgagcatta

SEQ ID NO: 5279 - DNA, 25 bp, Homo sapiens
gttgaccttaaccagcagcagtaca

SEQ ID NO: 5280 - DNA, 25 bp, Homo sapiens
gcagcagtacatcttccaacagtgt

SEQ ID NO: 5281 - DNA, 25 bp, Homo sapiens
gtgaggctcctatggaaggtttcca

SEQ ID NO: 5282 - DNA, 25 bp, Homo sapiens
agtcctcatggagctaacttctcaa

SEQ ID NO: 5283 - DNA, 25 bp, Homo sapiens
atactgtttgcgctcatttgcttgc

SEQ ID NO: 5284 - DNA, 25 bp, Homo sapiens
tgctctcttacacacatctggaaaa

SEQ ID NO: 5285 - DNA, 25 bp, Homo sapiens
ttctctttggtctgggcacatttaa

SEQ ID NO: 5286 - DNA, 25 bp, Homo sapiens
ctttggtctgggcacatttaatttg

SEQ ID NO: 5287 - DNA, 25 bp, Homo sapiens
catcttctcaacatgacctgcttaa

SEQ ID NO: 5288 - DNA, 25 bp, Homo sapiens
ttctcaacatgacctgcttaaccca

SEQ ID NO: 5289 - DNA, 25 bp, Homo sapiens
caacatgacctgcttaacccaaata

SEQ ID NO: 5290 - DNA, 25 bp, Homo sapiens
catgacctgcttaacccaaataaga

SEQ ID NO: 5291 - DNA, 25 bp, Homo sapiens
taagaacagtgatcttataacctca

SEQ ID NO: 5292 - DNA, 25 bp, Homo sapiens
aacctcattgtttcctaatctattt

SEQ ID NO: 5293 - DNA, 25 bp, Homo sapiens
ttttatttcatctcctgctagtact

SEQ ID NO: 5294 - DNA, 25 bp, Homo sapiens
ttatttcatctcctgctagtactgt

SEQ ID NO: 5295 - DNA, 25 bp, Homo sapiens
atttcatctcctgctagtactgtgc

SEQ ID NO: 5296 - DNA, 25 bp, Homo sapiens
tcatgaaaacagcccctttacctgc

SEQ ID NO: 5297 - DNA, 25 bp, Homo sapiens
agacaagcagggctatatttcagtg

SEQ ID NO: 5298 - DNA, 25 bp, Homo sapiens
tttcatcagtcatcactctcaaata

SEQ ID NO: 5299 - DNA, 25 bp, Homo sapiens
aaatataacactcctgaatgcctga

SEQ ID NO: 5300 - DNA, 25 bp, Homo sapiens
atgcctgaggcacgatctggatttt

SEQ ID NO: 5301 - DNA, 25 bp, Homo sapiens
attgaaaagaagctctccacccact

SEQ ID NO: 5302 - DNA, 25 bp, Homo sapiens
ctctccacccacttggtatttcaag

SEQ ID NO: 5303 - DNA, 25 bp, Homo sapiens
aaaaggattccttggttatgtgcag

SEQ ID NO: 5304 - DNA, 25 bp, Homo sapiens
ggttatgtgcagggaatcatctcac

SEQ ID NO: 5305 - DNA, 25 bp, Homo sapiens
ggaatcatctcacatgctgtttttc

SEQ ID NO: 5306 - DNA, 25 bp, Homo sapiens
gagaaacaggctgacactattctct

SEQ ID NO: 5307 - DNA, 25 bp, Homo sapiens
gggaggtttcttattggtgattgtc

SEQ ID NO: 5308 - DNA, 25 bp, Homo sapiens
tgtcacacggtataccatactcctc

SEQ ID NO: 5309 - DNA, 25 bp, Homo sapiens
ccatactcctctccttcaaagaatg

SEQ ID NO: 5310 - DNA, 25 bp, Homo sapiens
gtgagctttacttctttggaatgga

SEQ ID NO: 5311 - DNA, 25 bp, Homo sapiens
ggaatatacttatgcaaaaccttgt

SEQ ID NO: 5312 - DNA, 25 bp, Homo sapiens
aaaaccttgtgaactgactccttgc

SEQ ID NO: 5313 - DNA, 25 bp, Homo sapiens
gactccttgcactaacgcgagtttg

SEQ ID NO: 5314 - DNA, 25 bp, Homo sapiens
cccacctactctgtaatttgcttgt

SEQ ID NO: 5315 - DNA, 25 bp, Homo sapiens
gaactctggttggggtactacgatc

SEQ ID NO: 5316 - DNA, 25 bp, Homo sapiens
gggtactacgatcacagacacagac

SEQ ID NO: 5317 - DNA, 25 bp, Homo sapiens
gttgaagcatttgttcccaggattt

SEQ ID NO: 5318 - DNA, 25 bp, Homo sapiens
cagtcactctaaatggacaccacat

SEQ ID NO: 5319 - DNA, 25 bp, Homo sapiens
tggacaccacatgaacctctgttta

SEQ ID NO: 5320 - DNA, 25 bp, Homo sapiens
acctctgtttagaatacctacgtat

SEQ ID NO: 5321 - DNA, 25 bp, Homo sapiens
gtatgcattggtttgcttgtttctt

SEQ ID NO: 5322 - DNA, 25 bp, Homo sapiens
ttgcttgtttcttgacagtacattt

SEQ ID NO: 5323 - DNA, 25 bp, Homo sapiens
ttagatctggccttttcttaacaaa

SEQ ID NO: 5324 - DNA, 25 bp, Homo sapiens
gatgcaggtggatgtccctaggtct

SEQ ID NO: 5325 - DNA, 25 bp, Homo sapiens
caaagaactttttccaagtgcttgt

SEQ ID NO: 5326 - DNA, 25 bp, Homo sapiens
gagtggactgtatcatttgctattc

SEQ ID NO: 5327 - DNA, 25 bp, Homo sapiens
gcacaaaatgacactcttctaaaac

SEQ ID NO: 5328 - DNA, 25 bp, Homo sapiens
tgggcacaagagaattttcctggga

SEQ ID NO: 5329 - DNA, 25 bp, Homo sapiens
ggagaacttctttgagatctgcgat

SEQ ID NO: 5330 - DNA, 25 bp, Homo sapiens
gagctgggagtgaagcggccatctt

SEQ ID NO: 5331 - DNA, 25 bp, Homo sapiens
gaagcggccatcttctgtgaaagta

SEQ ID NO: 5332 - DNA, 25 bp, Homo sapiens
gcaaaagtgagcgcagctcctctgg

SEQ ID NO: 5333 - DNA, 25 bp, Homo sapiens
tgggaatccaagagcgatgccctgg

SEQ ID NO: 5334 - DNA, 25 bp, Homo sapiens
gatgccctggagactctgggcttcc

SEQ ID NO: 5335 - DNA, 25 bp, Homo sapiens
cccaaatggtccatacccttacact

SEQ ID NO: 5336 - DNA, 25 bp, Homo sapiens
agcacgcctcctaattaggtgccta

SEQ ID NO: 5337 - DNA, 25 bp, Homo sapiens
ggtgcctaggaagagtcccatctga

SEQ ID NO: 5338 - DNA, 25 bp, Homo sapiens
atctcccaagattaaccttcacttt

SEQ ID NO: 5339 - DNA, 25 bp, Homo sapiens
tgctgcccatgtactcttggcacat

SEQ ID NO: 5340 - DNA, 25 bp, Homo sapiens
ggcagttagcctttacttaatatca

SEQ ID NO: 5341 - DNA, 25 bp, Homo sapiens
gaaaccgataacattggcctcattg

SEQ ID NO: 5342 - DNA, 25 bp, Homo sapiens
ttggcctcattggatttctttaccc

SEQ ID NO: 5343 - DNA, 25 bp, Homo sapiens
tggatttctttacccattcacagtg

SEQ ID NO: 5344 - DNA, 25 bp, Homo sapiens
agaagttaccttcatgctttcattg

SEQ ID NO: 5345 - DNA, 25 bp, Homo sapiens
catgctttcattgtacctgcaggcc

SEQ ID NO: 5346 - DNA, 25 bp, Homo sapiens
gctgcctattttcttcctaggttag

SEQ ID NO: 5347 - DNA, 25 bp, Homo sapiens
attttctgtattaagctcatttggc

SEQ ID NO: 5348 - DNA, 25 bp, Homo sapiens
gctcatttggcttcatttaagctgt

SEQ ID NO: 5349 - DNA, 25 bp, Homo sapiens
atgagcagatccctttactggagcc

SEQ ID NO: 5350 - DNA, 25 bp, Homo sapiens
ataggtagggatttgccttgttttg

SEQ ID NO: 5351 - DNA, 25 bp, Homo sapiens
agagaaggctctggcttccaaacag

SEQ ID NO: 5352 - DNA, 25 bp, Homo sapiens
ggcattgcagctggcagttctgctg

SEQ ID NO: 5353 - DNA, 25 bp, Homo sapiens
aagacggaggcaggcagtccttgat

SEQ ID NO: 5354 - DNA, 25 bp, Homo sapiens
ggagatgcagagtcgtcatggggcg

SEQ ID NO: 5355 - DNA, 25 bp, Homo sapiens
gaacaagtgactctgaccagcaggc

SEQ ID NO: 5356 - DNA, 25 bp, Homo sapiens
gaccagcaggcttaccttgttcaaa

SEQ ID NO: 5357 - DNA, 25 bp, Homo sapiens
agggactggcggcaacagcggaata

SEQ ID NO: 5358 - DNA, 25 bp, Homo sapiens
ggaatattccgattcattcctgccc

SEQ ID NO: 5359 - DNA, 25 bp, Homo sapiens
attcctgccccaagtgtggagaggt

SEQ ID NO: 5360 - DNA, 25 bp, Homo sapiens
gaggttctgcctgacatagacacgt

SEQ ID NO: 5361 - DNA, 25 bp, Homo sapiens
taagtgttgatgtatcacctcccca

SEQ ID NO: 5362 - DNA, 25 bp, Homo sapiens
gtccagcatgactatggacgcccgt

SEQ ID NO: 5363 - DNA, 25 bp, Homo sapiens
tgcgcaggttccgaatctattccaa

SEQ ID NO: 5364 - DNA, 25 bp, Homo sapiens
caaccattctgcactggagtcgctg

SEQ ID NO: 5365 - DNA, 25 bp, Homo sapiens
atgctcaatgagcggacctggcgtg

SEQ ID NO: 5366 - DNA, 25 bp, Homo sapiens
cagatcccactacctgagggcatca

SEQ ID NO: 5367 - DNA, 25 bp, Homo sapiens
gagggcatcaactttgtgcatgagg

SEQ ID NO: 5368 - DNA, 25 bp, Homo sapiens
tggtgacgaaccatgcgggattcct

SEQ ID NO: 5369 - DNA, 25 bp, Homo sapiens
gtgattgagaagaaccggcctgctg

SEQ ID NO: 5370 - DNA, 25 bp, Homo sapiens
aaccggcctgctgatgtcagggcgt

SEQ ID NO: 5371 - DNA, 25 bp, Homo sapiens
cacattcatagcctgtagtgccccc

SEQ ID NO: 5372 - DNA, 25 bp, Homo sapiens
gaagctgtacccaatttaattccat

SEQ ID NO: 5373 - DNA, 25 bp, Homo sapiens
agacgaggctcgggactttgcagcc

SEQ ID NO: 5374 - DNA, 25 bp, Homo sapiens
tgctcgcgcaggttcctggtagagt

SEQ ID NO: 5375 - DNA, 25 bp, Homo sapiens
tacacagttgtgccgccagtatagc

SEQ ID NO: 5376 - DNA, 25 bp, Homo sapiens
gacatgcctcctttgacgttagagg

SEQ ID NO: 5377 - DNA, 25 bp, Homo sapiens
catccaggaccgtgttctttacgta

SEQ ID NO: 5378 - DNA, 25 bp, Homo sapiens
agattgacccagagaagctttcagt

SEQ ID NO: 5379 - DNA, 25 bp, Homo sapiens
gacctgggcttagacagtttggacc

SEQ ID NO: 5380 - DNA, 25 bp, Homo sapiens
gaataaagtatcagaccctttggct

SEQ ID NO: 5381 - DNA, 25 bp, Homo sapiens
gatagtgacgaatgtctggcagtga

SEQ ID NO: 5382 - DNA, 25 bp, Homo sapiens
gaggacacattttggcattcttgct

SEQ ID NO: 5383 - DNA, 25 bp, Homo sapiens
ggcattcttgctgactctgacagag

SEQ ID NO: 5384 - DNA, 25 bp, Homo sapiens
gcgtttccaacctcggagaattcca

SEQ ID NO: 5385 - DNA, 25 bp, Homo sapiens
gtataagcggtcatcgttgcgtcat

SEQ ID NO: 5386 - DNA, 25 bp, Homo sapiens
gggtgtgggcctggaggaaggtcct

SEQ ID NO: 5387 - DNA, 25 bp, Homo sapiens
gagagtggcctgagttacttcaccc

SEQ ID NO: 5388 - DNA, 25 bp, Homo sapiens
cgcgtgctgctggttaatgtcccgc

SEQ ID NO: 5389 - DNA, 25 bp, Homo sapiens
ggactgatctactttcacattctca

SEQ ID NO: 5390 - DNA, 25 bp, Homo sapiens
gcattagaggtccccagtaggttcc

SEQ ID NO: 5391 - DNA, 25 bp, Homo sapiens
cagccgagaagttcctggtctgaat

SEQ ID NO: 5392 - DNA, 25 bp, Homo sapiens
gtttctgagggtctgctttgtttac

SEQ ID NO: 5393 - DNA, 25 bp, Homo sapiens
gtttacctttcgtgcggtggattct

SEQ ID NO: 5394 - DNA, 25 bp, Homo sapiens
tccgtctacctggcgttttgttaga

SEQ ID NO: 5395 - DNA, 25 bp, Homo sapiens
aggacaaggacacctacagctggct

SEQ ID NO: 5396 - DNA, 25 bp, Homo sapiens
ctgaaggagcggagcgacaccagcg

SEQ ID NO: 5397 - DNA, 25 bp, Homo sapiens
gacaccagcgacaagcggaagttcc

SEQ ID NO: 5398 - DNA, 25 bp, Homo sapiens
cgtagacgtgcacgcacactgtctg

SEQ ID NO: 5399 - DNA, 25 bp, Homo sapiens
tagccactggactgacgacttgagt

SEQ ID NO: 5400 - DNA, 25 bp, Homo sapiens
gtcagactggatagtccgtctctgc

SEQ ID NO: 5401 - DNA, 25 bp, Homo sapiens
tctgcttatccgttagccgtggtga

SEQ ID NO: 5402 - DNA, 25 bp, Homo sapiens
cccaccctcagatgcacatgagctg

SEQ ID NO: 5403 - DNA, 25 bp, Homo sapiens
gatgctgtcttcgtactgggaaagg

SEQ ID NO: 5404 - DNA, 25 bp, Homo sapiens
aacatcacagcttatttcctcattt

SEQ ID NO: 5405 - DNA, 25 bp, Homo sapiens
ttataatgtcccttcacaaacccag

SEQ ID NO: 5406 - DNA, 25 bp, Homo sapiens
tgcacttactgctggcttattcatg

SEQ ID NO: 5407 - DNA, 25 bp, Homo sapiens
ggcttattcatgtatgttgctctgg

SEQ ID NO: 5408 - DNA, 25 bp, Homo sapiens
gttgctctggttgatatggtacctg

SEQ ID NO: 5409 - DNA, 25 bp, Homo sapiens
gctgcacaatgatgctagtgaccat

SEQ ID NO: 5410 - DNA, 25 bp, Homo sapiens
agtgaccatggatgtagccgctggg

SEQ ID NO: 5411 - DNA, 25 bp, Homo sapiens
tgtagccgctgggggtatttctttt

SEQ ID NO: 5412 - DNA, 25 bp, Homo sapiens
tgctgggatgcttttgggttttgga

SEQ ID NO: 5413 - DNA, 25 bp, Homo sapiens
gtcatagtttcagtaggtcataggg

SEQ ID NO: 5414 - DNA, 25 bp, Homo sapiens
gtatgctgtactatgcagcgtttaa

SEQ ID NO: 5415 - DNA, 25 bp, Homo sapiens
gaatattgctgtctgttacaaagtc

SEQ ID NO: 5416 - DNA, 25 bp, Homo sapiens
tgtgcaattcaccggtattaccagt

SEQ ID NO: 5417 - DNA, 25 bp, Homo sapiens
gggccacagtttcagtacttcagcc

SEQ ID NO: 5418 - DNA, 25 bp, Homo sapiens
cttcagcctcagtggggttcctgat

SEQ ID NO: 5419 - DNA, 25 bp, Homo sapiens
tttggagtctcctgtgatcacatct

SEQ ID NO: 5420 - DNA, 25 bp, Homo sapiens
tcacatcttgtctcggctgtaggaa

SEQ ID NO: 5421 - DNA, 25 bp, Homo sapiens
gacgtcctctacataaaagctccat

SEQ ID NO: 5422 - DNA, 25 bp, Homo sapiens
gctactcctagtcttaacatttgca

SEQ ID NO: 5423 - DNA, 25 bp, Homo sapiens
tgtcttctggtcctgatgtagtccc

SEQ ID NO: 5424 - DNA, 25 bp, Homo sapiens
ccctcctggacctatttatcctgaa

SEQ ID NO: 5425 - DNA, 25 bp, Homo sapiens
attcattaaccatagtactcctccc

SEQ ID NO: 5426 - DNA, 25 bp, Homo sapiens
gacacctctctcaggagcttctgag

SEQ ID NO: 5427 - DNA, 25 bp, Homo sapiens
ctctggagcgagccctatgtcaggc

SEQ ID NO: 5428 - DNA, 25 bp, Homo sapiens
gctcctctactgtttaacaacatgg

SEQ ID NO: 5429 - DNA, 25 bp, Homo sapiens
aagcacaaagccattctaagtcatt

SEQ ID NO: 5430 - DNA, 25 bp, Homo sapiens
ggaagcgtctggcagatactccttt

SEQ ID NO: 5431 - DNA, 25 bp, Homo sapiens
tggcagatactccttttgccactgc

SEQ ID NO: 5432 - DNA, 25 bp, Homo sapiens
tgattagacaggcccagtgagccgc

SEQ ID NO: 5433 - DNA, 25 bp, Homo sapiens
aatgacttggctcgatgctgtgggg

SEQ ID NO: 5434 - DNA, 25 bp, Homo sapiens
tcacgttctccacacgggggagaga

SEQ ID NO: 5435 - DNA, 25 bp, Homo sapiens
tcccgcagggctgaagtctggcgta

SEQ ID NO: 5436 - DNA, 25 bp, Homo sapiens
gatgatggatttgattcgccctcct

SEQ ID NO: 5437 - DNA, 25 bp, Homo sapiens
tacagcttcgctggaaacctctgga

SEQ ID NO: 5438 - DNA, 25 bp, Homo sapiens
ggaaacctctggaggtcatctcggc

SEQ ID NO: 5439 - DNA, 25 bp, Homo sapiens
ggctcctacctggtctggaaagagc

SEQ ID NO: 5440 - DNA, 25 bp, Homo sapiens
ggaaagagctgggaggcttcacaga

SEQ ID NO: 5441 - DNA, 25 bp, Homo sapiens
catcttctttggtgcccgacaaatg

SEQ ID NO: 5442 - DNA, 25 bp, Homo sapiens
ccgacaaatgggctgggccttggtg

SEQ ID NO: 5443 - DNA, 25 bp, Homo sapiens
cgtggcctggtaccaggtgagcccg

SEQ ID NO: 5444 - DNA, 25 bp, Homo sapiens
gaccacactcaactactgcgtatgg

SEQ ID NO: 5445 - DNA, 25 bp, Homo sapiens
aactactgcgtatggcgggacaacc

SEQ ID NO: 5446 - DNA, 25 bp, Homo sapiens
atggcgggacaaccatggctggcat

SEQ ID NO: 5447 - DNA, 25 bp, Homo sapiens
tgcaccagcaggtgccatcacgctt

SEQ ID NO: 5448 - DNA, 25 bp, Homo sapiens
tcacgcttgtgatgtggtggccgtc

SEQ ID NO: 5449 - DNA, 25 bp, Homo sapiens
gtgctttctgcatgcttagagcatg

SEQ ID NO: 5450 - DNA, 25 bp, Homo sapiens
gtctgtctgatcagcatcactgcac

SEQ ID NO: 5451 - DNA, 25 bp, Homo sapiens
tcagcatcactgcacacggaggtct

SEQ ID NO: 5452 - DNA, 25 bp, Homo sapiens
acggaggtctagtgagcctcttgct

SEQ ID NO: 5453 - DNA, 25 bp, Homo sapiens
gcctcttgctaagtgtcacacacac

SEQ ID NO: 5454 - DNA, 25 bp, Homo sapiens
cacacactcttcccaaagacgtgat

SEQ ID NO: 5455 - DNA, 25 bp, Homo sapiens
tagagagagataagccatcgcccct

SEQ ID NO: 5456 - DNA, 25 bp, Homo sapiens
cgcccctttgcctctgagaattggc

SEQ ID NO: 5457 - DNA, 25 bp, Homo sapiens
gaattggctgctgtttctaatataa

SEQ ID NO: 5458 - DNA, 25 bp, Homo sapiens
atatctttaaactttcttgcatcag

SEQ ID NO: 5459 - DNA, 25 bp, Homo sapiens
aagagcccagtattcacattttttc

SEQ ID NO: 5460 - DNA, 25 bp, Homo sapiens
tggaaaacaatcctgtatcccctcc

SEQ ID NO: 5461 - DNA, 25 bp, Homo sapiens
gtcaggaggttgtggaatttctttc

SEQ ID NO: 5462 - DNA, 25 bp, Homo sapiens
ttccctcccaaaagcttagctatgt

SEQ ID NO: 5463 - DNA, 25 bp, Homo sapiens
gcatcttattttgttcctagtttta

SEQ ID NO: 5464 - DNA, 25 bp, Homo sapiens
ataacattaccatccttcgttttga

SEQ ID NO: 5465 - DNA, 25 bp, Homo sapiens
agtggagtaagatgccctcccactt

SEQ ID NO: 5466 - DNA, 25 bp, Homo sapiens
cctcccacttttatcagtttagtag

SEQ ID NO: 5467 - DNA, 25 bp, Homo sapiens
gagaaaaatcccttcagctctaaga

SEQ ID NO: 5468 - DNA, 25 bp, Homo sapiens
caaggtgacggatgaagccagctgc

SEQ ID NO: 5469 - DNA, 25 bp, Homo sapiens
agctgctcctaaggacacagggctg

SEQ ID NO: 5470 - DNA, 25 bp, Homo sapiens
gacttcattcactcaaacttcttta

SEQ ID NO: 5471 - DNA, 25 bp, Homo sapiens
tgcaagtggaagggctgctttgtca

SEQ ID NO: 5472 - DNA, 25 bp, Homo sapiens
gaacatgggctgatcttcccacaac

SEQ ID NO: 5473 - DNA, 25 bp, Homo sapiens
tgcagggtgcacaactccctgccaa

SEQ ID NO: 5474 - DNA, 25 bp, Homo sapiens
tcctgcttcagctctgtacaacgag

SEQ ID NO: 5475 - DNA, 25 bp, Homo sapiens
gcagtcttgttttggcatcatcctc

SEQ ID NO: 5476 - DNA, 25 bp, Homo sapiens
catcctcatcatgttgtattccagc

SEQ ID NO: 5477 - DNA, 25 bp, Homo sapiens
ctcactcggaacatggctcaagcca

SEQ ID NO: 5478 - DNA, 25 bp, Homo sapiens
ggttatccaagtctgccaactatga

SEQ ID NO: 5479 - DNA, 25 bp, Homo sapiens
ggagcattaccggatcagggaatag

SEQ ID NO: 5480 - DNA, 25 bp, Homo sapiens
gggaatagccaaggcagcaccagag

SEQ ID NO: 5481 - DNA, 25 bp, Homo sapiens
agagcccgggagtgggatgactgga

SEQ ID NO: 5482 - DNA, 25 bp, Homo sapiens
gacacccatcctaggggctatggga

SEQ ID NO: 5483 - DNA, 25 bp, Homo sapiens
gagaaaccctcctggctagaggagc

SEQ ID NO: 5484 - DNA, 25 bp, Homo sapiens
acatggtacatcctttgtcacttgc

SEQ ID NO: 5485 - DNA, 25 bp, Homo sapiens
ttccacttcacagccaacggctatg

SEQ ID NO: 5486 - DNA, 25 bp, Homo sapiens
aacggctatgacaaaaccactccct

SEQ ID NO: 5487 - DNA, 25 bp, Homo sapiens
gccaatggcatcactcttcaggctg

SEQ ID NO: 5488 - DNA, 25 bp, Homo sapiens
ctccctgaccaatgacagagcctga

SEQ ID NO: 5489 - DNA, 25 bp, Homo sapiens
aatgccctgtcagccaatggcagct

SEQ ID NO: 5490 - DNA, 25 bp, Homo sapiens
ctcccctgggccaatgatgttgcgt

SEQ ID NO: 5491 - DNA, 25 bp, Homo sapiens
tgatgttgcgtctaataccctttgt

SEQ ID NO: 5492 - DNA, 25 bp, Homo sapiens
cctctatgcgtgcccattgcagaga

SEQ ID NO: 5493 - DNA, 25 bp, Homo sapiens
ttgcatctgaataggcctaccctca

SEQ ID NO: 5494 - DNA, 25 bp, Homo sapiens
cggtcggtctccagtgactgaagca

SEQ ID NO: 5495 - DNA, 25 bp, Homo sapiens
cagctcgggggccacaaggagatgg

SEQ ID NO: 5496 - DNA, 25 bp, Homo sapiens
ggagatggataatgtgcctgttttt

SEQ ID NO: 5497 - DNA, 25 bp, Homo sapiens
cttaactgaattgggagcctctgcc

SEQ ID NO: 5498 - DNA, 25 bp, Homo sapiens
cacgctcgctagcagctggtaaggt

SEQ ID NO: 5499 - DNA, 25 bp, Homo sapiens
gctagcagctggtaaggtcttcaca

SEQ ID NO: 5500 - DNA, 25 bp, Homo sapiens
cctgattcctcaagttttctgctta

SEQ ID NO: 5501 - DNA, 25 bp, Homo sapiens
agttttctgcttagtggcactgaca

SEQ ID NO: 5502 - DNA, 25 bp, Homo sapiens
tagtggggggacagtccatgccagg

SEQ ID NO: 5503 - DNA, 25 bp, Homo sapiens
ccctaactcactgtcgctttggagt

SEQ ID NO: 5504 - DNA, 25 bp, Homo sapiens
gtcgctttggagttgaggtgtcttt

SEQ ID NO: 5505 - DNA, 25 bp, Homo sapiens
ccccagtgatggctgatctcactcc

SEQ ID NO: 5506 - DNA, 25 bp, Homo sapiens
actcccactgtctcgtagaattaca

SEQ ID NO: 5507 - DNA, 25 bp, Homo sapiens
tagaattacactccttcctggggat

SEQ ID NO: 5508 - DNA, 25 bp, Homo sapiens
ccagagcccgtactgtggggatcct

SEQ ID NO: 5509 - DNA, 25 bp, Homo sapiens
tgtgtatcaagtgtcgctcacagcc

SEQ ID NO: 5510 - DNA, 25 bp, Homo sapiens
gggagcctttcggatctatttggtc

SEQ ID NO: 5511 - DNA, 25 bp, Homo sapiens
gtaccccagggagcgggtgcttgta

SEQ ID NO: 5512 - DNA, 25 bp, Homo sapiens
cgggtgcttgtactgtgtgaatcca

SEQ ID NO: 5513 - DNA, 25 bp, Homo sapiens
cacttaatgacttccttggcaccaa

SEQ ID NO: 5514 - DNA, 25 bp, Homo sapiens
ggcaccaatcatgtatttcaccgtt

SEQ ID NO: 5515 - DNA, 25 bp, Homo sapiens
atttcaccgtttgcactttttgtat

SEQ ID NO: 5516 - DNA, 25 bp, Homo sapiens
actttaagatcatttaccgccgcta

SEQ ID NO: 5517 - DNA, 25 bp, Homo sapiens
acaaactggcttacctggagggcat

SEQ ID NO: 5518 - DNA, 25 bp, Homo sapiens
ggagggcattcacaacttcgtggag

SEQ ID NO: 5519 - DNA, 25 bp, Homo sapiens
tggacctggtgttcaacttctacaa

SEQ ID NO: 5520 - DNA, 25 bp, Homo sapiens
ggtcgtggacgagatgttcctggct

SEQ ID NO: 5521 - DNA, 25 bp, Homo sapiens
gaaatccgagagaccagccagacga

SEQ ID NO: 5522 - DNA, 25 bp, Homo sapiens
aaacagctgctgatgctacagtccc

SEQ ID NO: 5523 - DNA, 25 bp, Homo sapiens
tccttccctcaactgcctaggagga

SEQ ID NO: 5524 - DNA, 25 bp, Homo sapiens
gaagggacccagctgggtctgggcc

SEQ ID NO: 5525 - DNA, 25 bp, Homo sapiens
caagggaggagacttcaccccactt

SEQ ID NO: 5526 - DNA, 25 bp, Homo sapiens
gccgttgtcgtgtgattccataagc

SEQ ID NO: 5527 - DNA, 25 bp, Homo sapiens
gcaaaagacttggtgcgcacccggc

SEQ ID NO: 5528 - DNA, 25 bp, Homo sapiens
tattgatgcgggccaacatccaggc

SEQ ID NO: 5529 - DNA, 25 bp, Homo sapiens
tccctcaagatccagacactcaagt

SEQ ID NO: 5530 - DNA, 25 bp, Homo sapiens
gtccaacaactcgatggcacaagcc

SEQ ID NO: 5531 - DNA, 25 bp, Homo sapiens
ggcacaagccatgaagggtgtcacc

SEQ ID NO: 5532 - DNA, 25 bp, Homo sapiens
gggcaccatgaacagacagctgaag

SEQ ID NO: 5533 - DNA, 25 bp, Homo sapiens
catgatggagtttgagcggcaggca

SEQ ID NO: 5534 - DNA, 25 bp, Homo sapiens
gagcggcaggcagagatcatggata

SEQ ID NO: 5535 - DNA, 25 bp, Homo sapiens
gatgccattgatgatgccatgggtg

SEQ ID NO: 5536 - DNA, 25 bp, Homo sapiens
taacagatgagctgtcgaacctccc

SEQ ID NO: 5537 - DNA, 25 bp, Homo sapiens
gaggaacggcttaagaacctgcgga

SEQ ID NO: 5538 - DNA, 25 bp, Homo sapiens
ccccgtctctataatgcagctgtgc

SEQ ID NO: 5539 - DNA, 25 bp, Homo sapiens
cgtctctataatgcagctgtgctct

SEQ ID NO: 5540 - DNA, 25 bp, Homo sapiens
ggggctcatttcaaacttattttct

SEQ ID NO: 5541 - DNA, 25 bp, Homo sapiens
tgtgctgtccacttgggaagctaag

SEQ ID NO: 5542 - DNA, 25 bp, Homo sapiens
gaagctaaggctctcaaaacgggca

SEQ ID NO: 5543 - DNA, 25 bp, Homo sapiens
taaggctctcaaaacgggcatcacc

SEQ ID NO: 5544 - DNA, 25 bp, Homo sapiens
caaaacgggcatcacccagttgacc

SEQ ID NO: 5545 - DNA, 25 bp, Homo sapiens
gcttggaagaagcctgttctgagcc

SEQ ID NO: 5546 - DNA, 25 bp, Homo sapiens
atggtagcaggtgtctgttatccca

SEQ ID NO: 5547 - DNA, 25 bp, Homo sapiens
gcaggtgtctgttatcccagttagg

SEQ ID NO: 5548 - DNA, 25 bp, Homo sapiens
gtgtctgttatcccagttaggaggc

SEQ ID NO: 5549 - DNA, 25 bp, Homo sapiens
gtctcctggaccttgacagagcagc

SEQ ID NO: 5550 - DNA, 25 bp, Homo sapiens
acgctcatcacctaaacttgtactt

SEQ ID NO: 5551 - DNA, 25 bp, Homo sapiens
gtttcctctggatcgttttatgcgg

SEQ ID NO: 5552 - DNA, 25 bp, Homo sapiens
tatgcggttcttacagcacatcacc

SEQ ID NO: 5553 - DNA, 25 bp, Homo sapiens
gcggagaggcactagtcaccgacag

SEQ ID NO: 5554 - DNA, 25 bp, Homo sapiens
caccgacagcggccttgaagacaga

SEQ ID NO: 5555 - DNA, 25 bp, Homo sapiens
tgcctgtctccatgaggtactggtc

SEQ ID NO: 5556 - DNA, 25 bp, Homo sapiens
tcccttccttttgttaacgtgatgt

SEQ ID NO: 5557 - DNA, 25 bp, Homo sapiens
acacgtatctcttggtatgcatctt

SEQ ID NO: 5558 - DNA, 25 bp, Homo sapiens
taagtggcgtgtgcatagcgtcctg

SEQ ID NO: 5559 - DNA, 25 bp, Homo sapiens
ggggtccagtgcattttgtttctgt

SEQ ID NO: 5560 - DNA, 25 bp, Homo sapiens
tgaatgtacgcttgtccatgctgac

SEQ ID NO: 5561 - DNA, 25 bp, Homo sapiens
atgctgtggcatgctggaaaggtct

SEQ ID NO: 5562 - DNA, 25 bp, Homo sapiens
ggaaaggtctggttgatcgatgtca

SEQ ID NO: 5563 - DNA, 25 bp, Homo sapiens
gtcagtcagtcagtagaacctaccc

SEQ ID NO: 5564 - DNA, 25 bp, Homo sapiens
gaatgtctcgcagtttttccagaaa

SEQ ID NO: 5565 - DNA, 25 bp, Homo sapiens
ggaagcccttagtgaacgagaactc

SEQ ID NO: 5566 - DNA, 25 bp, Homo sapiens
acgagaactcttcaatgctgtttca

SEQ ID NO: 5567 - DNA, 25 bp, Homo sapiens
gagacccaccactactatatgatga

SEQ ID NO: 5568 - DNA, 25 bp, Homo sapiens
gcactaatacccactgcttcagtgt

SEQ ID NO: 5569 - DNA, 25 bp, Homo sapiens
cagtgattgtcagctgccaatagca

SEQ ID NO: 5570 - DNA, 25 bp, Homo sapiens
aggagtgggcaatggtgcttctgtg

SEQ ID NO: 5571 - DNA, 25 bp, Homo sapiens
atttgagctatctggccttactctt

SEQ ID NO: 5572 - DNA, 25 bp, Homo sapiens
gctatctggccttactcttagtagt

SEQ ID NO: 5573 - DNA, 25 bp, Homo sapiens
tagtacgtgctggacaccactttta

SEQ ID NO: 5574 - DNA, 25 bp, Homo sapiens
attaacttcaatgtaatcatgcctc

SEQ ID NO: 5575 - DNA, 25 bp, Homo sapiens
catgcctcctattactgaagtcaga

SEQ ID NO: 5576 - DNA, 25 bp, Homo sapiens
aagatccaaactttctgtctggtaa

SEQ ID NO: 5577 - DNA, 25 bp, Homo sapiens
gagaggtgtaattttgggtagatgc

SEQ ID NO: 5578 - DNA, 25 bp, Homo sapiens
gggtagatgctcattacatttttga

SEQ ID NO: 5579 - DNA, 25 bp, Homo sapiens
tatgactggtgatactggctttaca

SEQ ID NO: 5580 - DNA, 25 bp, Homo sapiens
gcaaaccactgctgtgtggcattct

SEQ ID NO: 5581 - DNA, 25 bp, Homo sapiens
gtgtggcattcttggagtgtgctgt

SEQ ID NO: 5582 - DNA, 25 bp, Homo sapiens
tgggggacttatttgttggggatct

SEQ ID NO: 5583 - DNA, 25 bp, Homo sapiens
ataagattccttttgatctaccgga

SEQ ID NO: 5584 - DNA, 25 bp, Homo sapiens
gacaagttatagtaccccaaaagca

SEQ ID NO: 5585 - DNA, 25 bp, Homo sapiens
gttgccacctttataccggaagact

SEQ ID NO: 5586 - DNA, 25 bp, Homo sapiens
aggctttggtgcaccttatgtggga

SEQ ID NO: 5587 - DNA, 25 bp, Homo sapiens
aggaggggcagggcatgctgatgct

SEQ ID NO: 5588 - DNA, 25 bp, Homo sapiens
atgctgatgctgagcgtacaggcag

SEQ ID NO: 5589 - DNA, 25 bp, Homo sapiens
gcgtacaggcagacaagagcgtagc

SEQ ID NO: 5590 - DNA, 25 bp, Homo sapiens
ctgttgcctccatcactatgaaatg

SEQ ID NO: 5591 - DNA, 25 bp, Homo sapiens
ctgaaggacccatggtttatgttcc

SEQ ID NO: 5592 - DNA, 25 bp, Homo sapiens
ctccctaagccctctgagagagatg

SEQ ID NO: 5593 - DNA, 25 bp, Homo sapiens
gtcaaaacctaattgcaattctgtt

SEQ ID NO: 5594 - DNA, 25 bp, Homo sapiens
tagacagtgtttcaccgtattattt

SEQ ID NO: 5595 - DNA, 25 bp, Homo sapiens
ccatttctttcactgattacaccat

SEQ ID NO: 5596 - DNA, 25 bp, Homo sapiens
aaactttattgtgctggttgatgcc

SEQ ID NO: 5597 - DNA, 25 bp, Homo sapiens
gtgctggttgatgccaacttggttg

SEQ ID NO: 5598 - DNA, 25 bp, Homo sapiens
aacttggttgaaaagctctctgcag

SEQ ID NO: 5599 - DNA, 25 bp, Homo sapiens
acaagttgtgttctcatgacgtaat

SEQ ID NO: 5600 - DNA, 25 bp, Homo sapiens
atatgtgctagtactttaacttttt

SEQ ID NO: 5601 - DNA, 25 bp, Homo sapiens
tacgtaccgaaagtatgcagccaaa

SEQ ID NO: 5602 - DNA, 25 bp, Homo sapiens
agtatgcagccaaatcgatcagatc

SEQ ID NO: 5603 - DNA, 25 bp, Homo sapiens
agatcaaaccattttacctggagtt

SEQ ID NO: 5604 - DNA, 25 bp, Homo sapiens
accttgttgagctggttttgttcag

SEQ ID NO: 5605 - DNA, 25 bp, Homo sapiens
gttcagcttaatttactgttcaaag

SEQ ID NO: 5606 - DNA, 25 bp, Homo sapiens
gttggtcacaccagtgggtatatga

SEQ ID NO: 5607 - DNA, 25 bp, Homo sapiens
acagggttgacacagcagggctagt

SEQ ID NO: 5608 - DNA, 25 bp, Homo sapiens
agggctagtcctgcatattttttct

SEQ ID NO: 5609 - DNA, 25 bp, Homo sapiens
aatatttcccaattgtgtttttcat

SEQ ID NO: 5610 - DNA, 25 bp, Homo sapiens
ttattagctttgatcttgtagttta

SEQ ID NO: 5611 - DNA, 25 bp, Homo sapiens
tgcagggaactggggtaatctttta

SEQ ID NO: 5612 - DNA, 25 bp, Homo sapiens
gtaatcttttactgagctggatctt

SEQ ID NO: 5613 - DNA, 25 bp, Homo sapiens
ttttaaagtttgccacatttcatct

SEQ ID NO: 5614 - DNA, 25 bp, Homo sapiens
cacatttcatctttgtcctaacatg

SEQ ID NO: 5615 - DNA, 25 bp, Homo sapiens
tgaaaacctggctccttttaacacg

SEQ ID NO: 5616 - DNA, 25 bp, Homo sapiens
tgctctttcatgcctattatcagta

SEQ ID NO: 5617 - DNA, 25 bp, Homo sapiens
cagaataaaaaacagccccgccaag

SEQ ID NO: 5618 - DNA, 25 bp, Homo sapiens
ccccgccaagactatcagctgggat

SEQ ID NO: 5619 - DNA, 25 bp, Homo sapiens
ttcagcatccagacgatgtgcccca

SEQ ID NO: 5620 - DNA, 25 bp, Homo sapiens
aacattgcacgtttcttgttctctc

SEQ ID NO: 5621 - DNA, 25 bp, Homo sapiens
ataatgctgtcaacgcaacccttat

SEQ ID NO: 5622 - DNA, 25 bp, Homo sapiens
ctccatgaactctgctcttgggaag

SEQ ID NO: 5623 - DNA, 25 bp, Homo sapiens
tggctcgctgggaatgaactcaccg

SEQ ID NO: 5624 - DNA, 25 bp, Homo sapiens
gctgtggtctgtactccagcagatc

SEQ ID NO: 5625 - DNA, 25 bp, Homo sapiens
ggaggctgcagtgtgacagtgccag

SEQ ID NO: 5626 - DNA, 25 bp, Homo sapiens
actgaccagtcttggccttaagctg

SEQ ID NO: 5627 - DNA, 25 bp, Homo sapiens
gaccagtcttggccttaagctgact

SEQ ID NO: 5628 - DNA, 25 bp, Homo sapiens
tgggaatagctgggctgagacctac

SEQ ID NO: 5629 - DNA, 25 bp, Homo sapiens
ctgagacctacaggaatcgcttctg

SEQ ID NO: 5630 - DNA, 25 bp, Homo sapiens
gagacctacaggaatcgcttctgga

SEQ ID NO: 5631 - DNA, 25 bp, Homo sapiens
gacctacaggaatcgcttctggaag

SEQ ID NO: 5632 - DNA, 25 bp, Homo sapiens
accacttcgaggccattgcgttggt

SEQ ID NO: 5633 - DNA, 25 bp, Homo sapiens
acttcgaggccattgcgttggtgga

SEQ ID NO: 5634 - DNA, 25 bp, Homo sapiens
ttcgaggccattgcgttggtggaga

SEQ ID NO: 5635 - DNA, 25 bp, Homo sapiens
gaggccattgcgttggtggagaagg

SEQ ID NO: 5636 - DNA, 25 bp, Homo sapiens
gccattgcgttggtggagaaggccc

SEQ ID NO: 5637 - DNA, 25 bp, Homo sapiens
ggggattatgattcaccctctttgg

SEQ ID NO: 5638 - DNA, 25 bp, Homo sapiens
gattatgattcaccctctttggaga

SEQ ID NO: 5639 - DNA, 25 bp, Homo sapiens
tatgattcaccctctttggagaaca

SEQ ID NO: 5640 - DNA, 25 bp, Homo sapiens
ccacctcctgagagccactaatgta

SEQ ID NO: 5641 - DNA, 25 bp, Homo sapiens
acctcctgagagccactaatgtaag

SEQ ID NO: 5642 - DNA, 25 bp, Homo sapiens
tgagagccactaatgtaagatacag

SEQ ID NO: 5643 - DNA, 25 bp, Homo sapiens
tccatactaaaccagtttgttaact

SEQ ID NO: 5644 - DNA, 25 bp, Homo sapiens
gagggcttgccatgaaaatgcaact

SEQ ID NO: 5645 - DNA, 25 bp, Homo sapiens
atattaacttgtgctgtcgcctttt

SEQ ID NO: 5646 - DNA, 25 bp, Homo sapiens
acttgtgctgtcgccttttagaagg

SEQ ID NO: 5647 - DNA, 25 bp, Homo sapiens
gtgctgtcgccttttagaaggagaa

SEQ ID NO: 5648 - DNA, 25 bp, Homo sapiens
tagccgccaggattgccatgagaaa

SEQ ID NO: 5649 - DNA, 25 bp, Homo sapiens
gccgccaggattgccatgagaaaat

SEQ ID NO: 5650 - DNA, 25 bp, Homo sapiens
atcagagtgctttctcagcaggcag

SEQ ID NO: 5651 - DNA, 25 bp, Homo sapiens
gcagcttctgtggttaagcaggaag

SEQ ID NO: 5652 - DNA, 25 bp, Homo sapiens
ggaagggggtgacaatgacctcata

SEQ ID NO: 5653 - DNA, 25 bp, Homo sapiens
aatgacctcatagagcgtatccagg

SEQ ID NO: 5654 - DNA, 25 bp, Homo sapiens
gagcgtatccaggttgatgcctact

SEQ ID NO: 5655 - DNA, 25 bp, Homo sapiens
tccaggttgatgcctacttcagtcc

SEQ ID NO: 5656 - DNA, 25 bp, Homo sapiens
cccattcactcccagttggatcatt

SEQ ID NO: 5657 - DNA, 25 bp, Homo sapiens
ttcactcccagttggatcatttact

SEQ ID NO: 5658 - DNA, 25 bp, Homo sapiens
tcatttactggatccttcttctttc

SEQ ID NO: 5659 - DNA, 25 bp, Homo sapiens
ctagagctcgggagcccggagggtc

SEQ ID NO: 5660 - DNA, 25 bp, Homo sapiens
ccactcctactccagtatcagctgg

SEQ ID NO: 5661 - DNA, 25 bp, Homo sapiens
agagcaaaggtcaaggaccccctct

SEQ ID NO: 5662 - DNA, 25 bp, Homo sapiens
acctctccttcccgtgtgagaaggg

SEQ ID NO: 5663 - DNA, 25 bp, Homo sapiens
agaagggccagagggtccaggcatc

SEQ ID NO: 5664 - DNA, 25 bp, Homo sapiens
tttggggaaagggctccttgggctg

SEQ ID NO: 5665 - DNA, 25 bp, Homo sapiens
gctggtgaacttctgtggccaccac

SEQ ID NO: 5666 - DNA, 25 bp, Homo sapiens
ctcctgacctccctgggagggtgct

SEQ ID NO: 5667 - DNA, 25 bp, Homo sapiens
tgggagggtgctatcagttctgtcc

SEQ ID NO: 5668 - DNA, 25 bp, Homo sapiens
ggaatagtggaggccttcaactgat

SEQ ID NO: 5669 - DNA, 25 bp, Homo sapiens
ttcaactgattagacaaggcccgcc

SEQ ID NO: 5670 - DNA, 25 bp, Homo sapiens
acagcacggccatccaggagctgtt

SEQ ID NO: 5671 - DNA, 25 bp, Homo sapiens
caggagctgttcaagcgcatctccg

SEQ ID NO: 5672 - DNA, 25 bp, Homo sapiens
tgcactggtacacgggcgagggcat

SEQ ID NO: 5673 - DNA, 25 bp, Homo sapiens
acgagatggagttcaccgaggccga

SEQ ID NO: 5674 - DNA, 25 bp, Homo sapiens
gaggccgagagcaacatgaacgacc

SEQ ID NO: 5675 - DNA, 25 bp, Homo sapiens
atgaacgacctggtgtccgagtacc

SEQ ID NO: 5676 - DNA, 25 bp, Homo sapiens
cgagtaccagcagtaccaggacgcc

SEQ ID NO: 5677 - DNA, 25 bp, Homo sapiens
gacgccacggccgaggaagagggcg

SEQ ID NO: 5678 - DNA, 25 bp, Homo sapiens
ccccaagtgaaactgctcgcagctg

SEQ ID NO: 5679 - DNA, 25 bp, Homo sapiens
ggccgaagccagcagtgtctaaacc

SEQ ID NO: 5680 - DNA, 25 bp, Homo sapiens
gccctcctgcagtatttatggcctc

SEQ ID NO: 5681 - DNA, 25 bp, Homo sapiens
atttctaagaccatttcattctgaa

SEQ ID NO: 5682 - DNA, 25 bp, Homo sapiens
tctgaaacttcttatcaattaccta

SEQ ID NO: 5683 - DNA, 25 bp, Homo sapiens
tttcttcttcacaagtcaccaagag

SEQ ID NO: 5684 - DNA, 25 bp, Homo sapiens
ttctccaaaaaataaccttccacag

SEQ ID NO: 5685 - DNA, 25 bp, Homo sapiens
agagacaaactgtccttctatccac

SEQ ID NO: 5686 - DNA, 25 bp, Homo sapiens
cttctatccacttttatcttttaat

SEQ ID NO: 5687 - DNA, 25 bp, Homo sapiens
gcaagggtgcaaagggcctgtgcca

SEQ ID NO: 5688 - DNA, 25 bp, Homo sapiens
gatacaatggcagtcctcaaaggcg

SEQ ID NO: 5689 - DNA, 25 bp, Homo sapiens
aaggcgtaacgagttcatctttctt

SEQ ID NO: 5690 - DNA, 25 bp, Homo sapiens
tcatctttctttcaccataggggtt

SEQ ID NO: 5691 - DNA, 25 bp, Homo sapiens
atagttggcttgtgctactctggaa

SEQ ID NO: 5692 - DNA, 25 bp, Homo sapiens
tgtggcaaaaacgtttctttcttat

SEQ ID NO: 5693 - DNA, 25 bp, Homo sapiens
acagggattggcattcttcccggtc

SEQ ID NO: 5694 - DNA, 25 bp, Homo sapiens
cttcccggtcactggtaacaatagc

SEQ ID NO: 5695 - DNA, 25 bp, Homo sapiens
gttggtttctaacagactacttcca

SEQ ID NO: 5696 - DNA, 25 bp, Homo sapiens
taggtggctcactttctcattaaga

SEQ ID NO: 5697 - DNA, 25 bp, Homo sapiens
tatttaccctgttttggggcaaatg

SEQ ID NO: 5698 - DNA, 25 bp, Homo sapiens
atgctacctatttgtgtcacctttt

SEQ ID NO: 5699 - DNA, 25 bp, Homo sapiens
gtcaccttttgctgaactcacagtt

SEQ ID NO: 5700 - DNA, 25 bp, Homo sapiens
aactcacagttagacaatccatggt

SEQ ID NO: 5701 - DNA, 25 bp, Homo sapiens
ctgtgttatgttggtgcttctgtga

SEQ ID NO: 5702 - DNA, 25 bp, Homo sapiens
ttaagttgtggtttcatcatgagtc

SEQ ID NO: 5703 - DNA, 25 bp, Homo sapiens
gacatgggccactctaggacaggtc

SEQ ID NO: 5704 - DNA, 25 bp, Homo sapiens
cctggccagtgaccttgtatttatg

SEQ ID NO: 5705 - DNA, 25 bp, Homo sapiens
gaccttgtatttatgaggctctgtg

SEQ ID NO: 5706 - DNA, 25 bp, Homo sapiens
atttatgaggctctgtgaggccagc

SEQ ID NO: 5707 - DNA, 25 bp, Homo sapiens
ccaggaccagaatcccagggacaga

SEQ ID NO: 5708 - DNA, 25 bp, Homo sapiens
agggacagaggactgggtagcaggt

SEQ ID NO: 5709 - DNA, 25 bp, Homo sapiens
aggactgggtagcaggttccttctg

SEQ ID NO: 5710 - DNA, 25 bp, Homo sapiens
tctgttgtcctgtgtggtgtgtcta

SEQ ID NO: 5711 - DNA, 25 bp, Homo sapiens
tcctgtgtggtgtgtctactgtgag

SEQ ID NO: 5712 - DNA, 25 bp, Homo sapiens
tggtgtgtctactgtgagggtgggc

SEQ ID NO: 5713 - DNA, 25 bp, Homo sapiens
gtgggccctgaggagacctgtgggc

SEQ ID NO: 5714 - DNA, 25 bp, Homo sapiens
aggtgctgacggacacgtcgtacac

SEQ ID NO: 5715 - DNA, 25 bp, Homo sapiens
cgtcgtacacgcgagctgtggactg

SEQ ID NO: 5716 - DNA, 25 bp, Homo sapiens
aggaggaggtcttcgacagcatcgt

SEQ ID NO: 5717 - DNA, 25 bp, Homo sapiens
ctgtcggccgaagccatcggcatca

SEQ ID NO: 5718 - DNA, 25 bp, Homo sapiens
gagaaggctgcttcggaggaaccca

SEQ ID NO: 5719 - DNA, 25 bp, Homo sapiens
agagcggaggctgggatctagcgag

SEQ ID NO: 5720 - DNA, 25 bp, Homo sapiens
gcccttcttcaggactctgggctgg

SEQ ID NO: 5721 - DNA, 25 bp, Homo sapiens
tctgggctgggaagccctgttggcc

SEQ ID NO: 5722 - DNA, 25 bp, Homo sapiens
caccgacgtcagcaacttcgacgag

SEQ ID NO: 5723 - DNA, 25 bp, Homo sapiens
tcgacgaggagttcaccggggaggc

SEQ ID NO: 5724 - DNA, 25 bp, Homo sapiens
ctgcccgagagctcttagtttttaa

SEQ ID NO: 5725 - DNA, 25 bp, Homo sapiens
ggcttaggcacaggagtggcccaga

SEQ ID NO: 5726 - DNA, 25 bp, Homo sapiens
gaagatgagcatcctggcgattatc

SEQ ID NO: 5727 - DNA, 25 bp, Homo sapiens
ggcgattatcaacaacatgcagcag

SEQ ID NO: 5728 - DNA, 25 bp, Homo sapiens
gcctgatcccagagtggtgcttact

SEQ ID NO: 5729 - DNA, 25 bp, Homo sapiens
ggtgcttactgtgctgactgtgtac

SEQ ID NO: 5730 - DNA, 25 bp, Homo sapiens
tgtgtacttatcttccccaagagaa

SEQ ID NO: 5731 - DNA, 25 bp, Homo sapiens
tcttttgagcacactgtacctacca

SEQ ID NO: 5732 - DNA, 25 bp, Homo sapiens
atggctcatttgacacctttttaaa

SEQ ID NO: 5733 - DNA, 25 bp, Homo sapiens
gaggattggaaggcagcaccaggca

SEQ ID NO: 5734 - DNA, 25 bp, Homo sapiens
gctcagactcactgctgacaggaat

SEQ ID NO: 5735 - DNA, 25 bp, Homo sapiens
gacaggaatggctttctttaggatg

SEQ ID NO: 5736 - DNA, 25 bp, Homo sapiens
gtaccaaaatgcataccagttatta

SEQ ID NO: 5737 - DNA, 25 bp, Homo sapiens
tattcttgtgcctagtactttacca

SEQ ID NO: 5738 - DNA, 25 bp, Homo sapiens
gcctagtactttaccacaaatacag

SEQ ID NO: 5739 - DNA, 25 bp, Homo sapiens
tacagtgtaatatcatcagtccaaa

SEQ ID NO: 5740 - DNA, 25 bp, Homo sapiens
atcagtccaaaactgcattactttt

SEQ ID NO: 5741 - DNA, 25 bp, Homo sapiens
gaaatgtggtagctcttacaaagtt

SEQ ID NO: 5742 - DNA, 25 bp, Homo sapiens
ggatctactccaagtgaccaacagc

SEQ ID NO: 5743 - DNA, 25 bp, Homo sapiens
atagacgagatttgttcaacactgc

SEQ ID NO: 5744 - DNA, 25 bp, Homo sapiens
agatgtaaaccctgtgactatagta

SEQ ID NO: 5745 - DNA, 25 bp, Homo sapiens
gactatagtacgttgcttcttgttc

SEQ ID NO: 5746 - DNA, 25 bp, Homo sapiens
gcttcttgttcttcacaattcatga

SEQ ID NO: 5747 - DNA, 25 bp, Homo sapiens
aacacagttaccatacttttcaatt

SEQ ID NO: 5748 - DNA, 25 bp, Homo sapiens
aaaaggcatcaacttctgcgggaag

SEQ ID NO: 5749 - DNA, 25 bp, Homo sapiens
gtcccgcggttaagtgttggttcag

SEQ ID NO: 5750 - DNA, 25 bp, Homo sapiens
tactagcagaccaagtactcccaca

SEQ ID NO: 5751 - DNA, 25 bp, Homo sapiens
aaagtagggactcccatgtccctca

SEQ ID NO: 5752 - DNA, 25 bp, Homo sapiens
agtacagatgcctacttctcagtct

SEQ ID NO: 5753 - DNA, 25 bp, Homo sapiens
ctacttctcagtctccagctgtaaa

SEQ ID NO: 5754 - DNA, 25 bp, Homo sapiens
gtaaaagcttcaattcctgcaacct

SEQ ID NO: 5755 - DNA, 25 bp, Homo sapiens
aatccatcattaatcgggtccaaaa

SEQ ID NO: 5756 - DNA, 25 bp, Homo sapiens
gtccaaaaacattcttattaccact

SEQ ID NO: 5757 - DNA, 25 bp, Homo sapiens
gataatctgtaatctagccttgctg

SEQ ID NO: 5758 - DNA, 25 bp, Homo sapiens
gagacttcattgtatgacttcagtt

SEQ ID NO: 5759 - DNA, 25 bp, Homo sapiens
ttgtatgcattctttattcacttaa

SEQ ID NO: 5760 - DNA, 25 bp, Homo sapiens
aataaagccacgtcatgtcttcttt

SEQ ID NO: 5761 - DNA, 25 bp, Homo sapiens
gagagtcgatggcaggagggggttt

SEQ ID NO: 5762 - DNA, 25 bp, Homo sapiens
accaggtgttgaaggcacgacagcc

SEQ ID NO: 5763 - DNA, 25 bp, Homo sapiens
cagccactgctctacgaaaaggcag

SEQ ID NO: 5764 - DNA, 25 bp, Homo sapiens
gcttcccctttatcagattggcagc

SEQ ID NO: 5765 - DNA, 25 bp, Homo sapiens
ttgctttttattgtgtatccgttcc

SEQ ID NO: 5766 - DNA, 25 bp, Homo sapiens
tcctacggtgtgctcctgaatgaag

SEQ ID NO: 5767 - DNA, 25 bp, Homo sapiens
gattttacctgtcaataccagcact

SEQ ID NO: 5768 - DNA, 25 bp, Homo sapiens
accagcactgtattactaacatgca

SEQ ID NO: 5769 - DNA, 25 bp, Homo sapiens
ggtcaccgtctcgctgagggacggt

SEQ ID NO: 5770 - DNA, 25 bp, Homo sapiens
ctgccagatgtgccggtgacttcag

SEQ ID NO: 5771 - DNA, 25 bp, Homo sapiens
cggtgacttcagcgccagtcaccgc

SEQ ID NO: 5772 - DNA, 25 bp, Homo sapiens
cgcggctgcatgacactggaggtca

SEQ ID NO: 5773 - DNA, 25 bp, Homo sapiens
acactggaggtcaaccggaggctgc

SEQ ID NO: 5774 - DNA, 25 bp, Homo sapiens
ctggacgaggcggcgtacaagcaca

SEQ ID NO: 5775 - DNA, 25 bp, Homo sapiens
cgtacaagcacagcgacatcacggc

SEQ ID NO: 5776 - DNA, 25 bp, Homo sapiens
tctcagtctctgtccgagacagccg

SEQ ID NO: 5777 - DNA, 25 bp, Homo sapiens
tccgagacagccgggaggagcctgg

SEQ ID NO: 5778 - DNA, 25 bp, Homo sapiens
atcccggcctgtaacatatctgtaa

SEQ ID NO: 5779 - DNA, 25 bp, Homo sapiens
cgcagcgcagagcgggctcgaagaa

SEQ ID NO: 5780 - DNA, 25 bp, Homo sapiens
tgagcatggccgtggagagcaccgg

SEQ ID NO: 5781 - DNA, 25 bp, Homo sapiens
tgcggaggcagcccggattgaggga

SEQ ID NO: 5782 - DNA, 25 bp, Homo sapiens
agctaaaagcacaggccttggccat

SEQ ID NO: 5783 - DNA, 25 bp, Homo sapiens
gagctccagagggtccagaaggtcc

SEQ ID NO: 5784 - DNA, 25 bp, Homo sapiens
cgagagctggaactggtctatgccc

SEQ ID NO: 5785 - DNA, 25 bp, Homo sapiens
tgacagaggccataggccccagcac

SEQ ID NO: 5786 - DNA, 25 bp, Homo sapiens
caccatcagggaccttgctgtggct

SEQ ID NO: 5787 - DNA, 25 bp, Homo sapiens
gcaggtaaaactgctccagtccctg

SEQ ID NO: 5788 - DNA, 25 bp, Homo sapiens
cctcttcaacacagcctttgggctg

SEQ ID NO: 5789 - DNA, 25 bp, Homo sapiens
agacaaccacgtggtgcctgtactg

SEQ ID NO: 5790 - DNA, 25 bp, Homo sapiens
gtactgcgctaactcctgattaata

SEQ ID NO: 5791 - DNA, 25 bp, Homo sapiens
gacattcaaagggacgccagccatc

SEQ ID NO: 5792 - DNA, 25 bp, Homo sapiens
aggagatgaccggaagcaacccctt

SEQ ID NO: 5793 - DNA, 25 bp, Homo sapiens
acagacacgagcacatcggcaaacc

SEQ ID NO: 5794 - DNA, 25 bp, Homo sapiens
catgttaaagagccgtgtctcccgc

SEQ ID NO: 5795 - DNA, 25 bp, Homo sapiens
actcctcaccccggtatgaatgtgt

SEQ ID NO: 5796 - DNA, 25 bp, Homo sapiens
gtgtttcctccacattgtatatcct

SEQ ID NO: 5797 - DNA, 25 bp, Homo sapiens
accctctggctgcctagatcagtaa

SEQ ID NO: 5798 - DNA, 25 bp, Homo sapiens
gtaacactgttgaaaccctgatccc

SEQ ID NO: 5799 - DNA, 25 bp, Homo sapiens
aaccctgatcccagtggaggctgta

SEQ ID NO: 5800 - DNA, 25 bp, Homo sapiens
cccctgttaccgcatttgtgtgtat

SEQ ID NO: 5801 - DNA, 25 bp, Homo sapiens
aggcgtttgctatatacagttgtcc

SEQ ID NO: 5802 - DNA, 25 bp, Homo sapiens
gtgtggtggttgtattggagcaggg

SEQ ID NO: 5803 - DNA, 25 bp, Homo sapiens
gagtggttgctgttaatattatctt

SEQ ID NO: 5804 - DNA, 25 bp, Homo sapiens
attatcttatctattgggtggtatg

SEQ ID NO: 5805 - DNA, 25 bp, Homo sapiens
gagttgtgggaccagatgtcatctc

SEQ ID NO: 5806 - DNA, 25 bp, Homo sapiens
gatgtcatctctggtcagagtttac

SEQ ID NO: 5807 - DNA, 25 bp, Homo sapiens
gtttacttgctatatagactgtact

SEQ ID NO: 5808 - DNA, 25 bp, Homo sapiens
atgtgtgaagtttgcaagcttgctt

SEQ ID NO: 5809 - DNA, 25 bp, Homo sapiens
gcagcagcacagttcagcattgtgt

SEQ ID NO: 5810 - DNA, 25 bp, Homo sapiens
gcattgtgtggctggttgtttcctg

SEQ ID NO: 5811 - DNA, 25 bp, Homo sapiens
ggctgtccccagcaagtgtaggagt

SEQ ID NO: 5812 - DNA, 25 bp, Homo sapiens
ggcctgaactgggccattgatcaga

SEQ ID NO: 5813 - DNA, 25 bp, Homo sapiens
tttcttttgaggcatgcacatctgg

SEQ ID NO: 5814 - DNA, 25 bp, Homo sapiens
ggcatgcacatctggaattaaggtc

SEQ ID NO: 5815 - DNA, 25 bp, Homo sapiens
gcacatctggaattaaggtcaaact

SEQ ID NO: 5816 - DNA, 25 bp, Homo sapiens
aaggtcaaactaattctcacatccc

SEQ ID NO: 5817 - DNA, 25 bp, Homo sapiens
cacatccctctaaaagtaaactact

SEQ ID NO: 5818 - DNA, 25 bp, Homo sapiens
gtaaactactgttaggaacagcagt

SEQ ID NO: 5819 - DNA, 25 bp, Homo sapiens
gaacagcagtgttctcacagtgtgg

SEQ ID NO: 5820 - DNA, 25 bp, Homo sapiens
cagcagtgttctcacagtgtggggc

SEQ ID NO: 5821 - DNA, 25 bp, Homo sapiens
tgttctcacagtgtggggcagccgt

SEQ ID NO: 5822 - DNA, 25 bp, Homo sapiens
gaagacaatgatattgacactgtcc

SEQ ID NO: 5823 - DNA, 25 bp, Homo sapiens
ttggcagttgcattagtaactttga

SEQ ID NO: 5824 - DNA, 25 bp, Homo sapiens
atgtggacaagaccgtggctggcca

SEQ ID NO: 5825 - DNA, 25 bp, Homo sapiens
acctcagtcccacgacagttatgtc

SEQ ID NO: 5826 - DNA, 25 bp, Homo sapiens
gactgatgaccacatccggatgcac

SEQ ID NO: 5827 - DNA, 25 bp, Homo sapiens
gtacgtggctgtgatgccgccacac

SEQ ID NO: 5828 - DNA, 25 bp, Homo sapiens
gagaccagccactaactggggcgta

SEQ ID NO: 5829 - DNA, 25 bp, Homo sapiens
gcgtacacagtgaccctggatggac

SEQ ID NO: 5830 - DNA, 25 bp, Homo sapiens
tggacgagggccctcaagggtcatc

SEQ ID NO: 5831 - DNA, 25 bp, Homo sapiens
tctccaaacatgacctgggccattt

SEQ ID NO: 5832 - DNA, 25 bp, Homo sapiens
gcctcaccaccgatgagtacgacgg

SEQ ID NO: 5833 - DNA, 25 bp, Homo sapiens
ccaccagtaccagtagcactctgtc

SEQ ID NO: 5834 - DNA, 25 bp, Homo sapiens
tctgtccccatctgggagggtggca

SEQ ID NO: 5835 - DNA, 25 bp, Homo sapiens
gacagagcacagctgcccaaataca

SEQ ID NO: 5836 - DNA, 25 bp, Homo sapiens
acagctgcccaaatacaaagttctt

SEQ ID NO: 5837 - DNA, 25 bp, Homo sapiens
gaggaacagtaactcttccttcggg

SEQ ID NO: 5838 - DNA, 25 bp, Homo sapiens
cgggtggaagctttcatcgagttga

SEQ ID NO: 5839 - DNA, 25 bp, Homo sapiens
ggacttaaacgaatcatcagggacc

SEQ ID NO: 5840 - DNA, 25 bp, Homo sapiens
gggaccggatatttcttatttctca

SEQ ID NO: 5841 - DNA, 25 bp, Homo sapiens
taaccttgaatccaaagtgtctgca

SEQ ID NO: 5842 - DNA, 25 bp, Homo sapiens
acttacttgtattgagagcacacgc

SEQ ID NO: 5843 - DNA, 25 bp, Homo sapiens
agcacacgcaattcctactggtgaa

SEQ ID NO: 5844 - DNA, 25 bp, Homo sapiens
gcggctagattctcagattcacctt

SEQ ID NO: 5845 - DNA, 25 bp, Homo sapiens
agcccttttgtttggtctatcagta

SEQ ID NO: 5846 - DNA, 25 bp, Homo sapiens
cctctgctggggatgcaccaatgaa

SEQ ID NO: 5847 - DNA, 25 bp, Homo sapiens
ggggatgcaccaatgaaccccacag

SEQ ID NO: 5848 - DNA, 25 bp, Homo sapiens
gcaccaatgaaccccacaggaaggg

SEQ ID NO: 5849 - DNA, 25 bp, Homo sapiens
ggaatttcacattcccttgttctag

SEQ ID NO: 5850 - DNA, 25 bp, Homo sapiens
acattcccttgttctagattcactt

SEQ ID NO: 5851 - DNA, 25 bp, Homo sapiens
ttcccttgttctagattcactttaa

SEQ ID NO: 5852 - DNA, 25 bp, Homo sapiens
gattcactttaacgcttaatgcctt

SEQ ID NO: 5853 - DNA, 25 bp, Homo sapiens
aacgcttaatgccttcaaagttttg

SEQ ID NO: 5854 - DNA, 25 bp, Homo sapiens
gggcttgccccatttggggcagcta

SEQ ID NO: 5855 - DNA, 25 bp, Homo sapiens
ccccatttggggcagctatttaagg

SEQ ID NO: 5856 - DNA, 25 bp, Homo sapiens
taaggggaggggatgtctcaccggg

SEQ ID NO: 5857 - DNA, 25 bp, Homo sapiens
gaaatgaccgagagcttcgaggcag

SEQ ID NO: 5858 - DNA, 25 bp, Homo sapiens
gaatattccaatgctctttgtccgg

SEQ ID NO: 5859 - DNA, 25 bp, Homo sapiens
tttgtccggggagatggcgttgtcc

SEQ ID NO: 5860 - DNA, 25 bp, Homo sapiens
gggtttgaaacatggcggacgacgt

SEQ ID NO: 5861 - DNA, 25 bp, Homo sapiens
cccctccactgagagttggctgaaa

SEQ ID NO: 5862 - DNA, 25 bp, Homo sapiens
acgggagactttgtacagtggcctc

SEQ ID NO: 5863 - DNA, 25 bp, Homo sapiens
acagtggcctctctaaaagtacaaa

SEQ ID NO: 5864 - DNA, 25 bp, Homo sapiens
ggattcttccactcctgaaatgagt

SEQ ID NO: 5865 - DNA, 25 bp, Homo sapiens
ggacgacgtagaccagcaacaaact

SEQ ID NO: 5866 - DNA, 25 bp, Homo sapiens
taccaacactgtagaggagcccctg

SEQ ID NO: 5867 - DNA, 25 bp, Homo sapiens
gcccctggatcttatcaggctcagc

SEQ ID NO: 5868 - DNA, 25 bp, Homo sapiens
tgcatgggggatgtttcttcctggg

SEQ ID NO: 5869 - DNA, 25 bp, Homo sapiens
gctgctctcacatacagaggccgag

SEQ ID NO: 5870 - DNA, 25 bp, Homo sapiens
gaggccgaggggccaattcgttctc

SEQ ID NO: 5871 - DNA, 25 bp, Homo sapiens
ccacagggacttgcctcactgtgtc

SEQ ID NO: 5872 - DNA, 25 bp, Homo sapiens
tctgccgtctgaggttttatacttc

SEQ ID NO: 5873 - DNA, 25 bp, Homo sapiens
ttaggtttgcaagcctcctgatcag

SEQ ID NO: 5874 - DNA, 25 bp, Homo sapiens
ggcaatccctgtagccgcagagaat

SEQ ID NO: 5875 - DNA, 25 bp, Homo sapiens
caaaatggcaacttcccacagccac

SEQ ID NO: 5876 - DNA, 25 bp, Homo sapiens
ccacagccacatttcagacctgctg

SEQ ID NO: 5877 - DNA, 25 bp, Homo sapiens
gtttcttcaattagtctcagttctc

SEQ ID NO: 5878 - DNA, 25 bp, Homo sapiens
gtgatggtagcgttggtgccaggcc

SEQ ID NO: 5879 - DNA, 25 bp, Homo sapiens
agctgtgagccttggctgttggcag

SEQ ID NO: 5880 - DNA, 25 bp, Homo sapiens
gtgagccttggctgttggcagtgag

SEQ ID NO: 5881 - DNA, 25 bp, Homo sapiens
gagccttggctgttggcagtgagtg

SEQ ID NO: 5882 - DNA, 25 bp, Homo sapiens
ccttggctgttggcagtgagtgagc

SEQ ID NO: 5883 - DNA, 25 bp, Homo sapiens
gcctggctcttgtgctggatggagc

SEQ ID NO: 5884 - DNA, 25 bp, Homo sapiens
agccccagagcagggtgttgggata

SEQ ID NO: 5885 - DNA, 25 bp, Homo sapiens
agggtgttgggatactgcagggcca

SEQ ID NO: 5886 - DNA, 25 bp, Homo sapiens
gtgttgggatactgcagggccagga

SEQ ID NO: 5887 - DNA, 25 bp, Homo sapiens
gttgggatactgcagggccaggact

SEQ ID NO: 5888 - DNA, 25 bp, Homo sapiens
ggatactgcagggccaggactgagc

SEQ ID NO: 5889 - DNA, 25 bp, Homo sapiens
tactgcagggccaggactgagcccc

SEQ ID NO: 5890 - DNA, 25 bp, Homo sapiens
aagctgctgatattcattccttatt

SEQ ID NO: 5891 - DNA, 25 bp, Homo sapiens
taagggcttaacctgtgactttaat

SEQ ID NO: 5892 - DNA, 25 bp, Homo sapiens
aagctggaacagtccactgaatggg

SEQ ID NO: 5893 - DNA, 25 bp, Homo sapiens
gtatatacgtatgattgctttttaa

SEQ ID NO: 5894 - DNA, 25 bp, Homo sapiens
tatcttttcttctgttaagtcatgt

SEQ ID NO: 5895 - DNA, 25 bp, Homo sapiens
ataaatccttttgcactgatgtgtt

SEQ ID NO: 5896 - DNA, 25 bp, Homo sapiens
gcactgatgtgttgaaccttattct

SEQ ID NO: 5897 - DNA, 25 bp, Homo sapiens
accttattcttgtacattcattcaa

SEQ ID NO: 5898 - DNA, 25 bp, Homo sapiens
taacctaacggttctcatgcggtgc

SEQ ID NO: 5899 - DNA, 25 bp, Homo sapiens
ggttctcatgcggtgcgtaattgta

SEQ ID NO: 5900 - DNA, 25 bp, Homo sapiens
gtagatgcatgtacttgtgtgtttt

SEQ ID NO: 5901 - DNA, 25 bp, Homo sapiens
aacaggcagtcatctttaagggcta

SEQ ID NO: 5902 - DNA, 25 bp, Homo sapiens
gaatgccgtgtatacctcacgtact

SEQ ID NO: 5903 - DNA, 25 bp, Homo sapiens
acctcacgtactgtgtactttgtac

SEQ ID NO: 5904 - DNA, 25 bp, Homo sapiens
tttaccttttatacctatgttcgat

SEQ ID NO: 5905 - DNA, 25 bp, Homo sapiens
tctgtctgaataacctgcgtgtcta

SEQ ID NO: 5906 - DNA, 25 bp, Homo sapiens
ggaggacagaggcctctgtcgcact

SEQ ID NO: 5907 - DNA, 25 bp, Homo sapiens
tctcgtggttgctcgactgttgtat

SEQ ID NO: 5908 - DNA, 25 bp, Homo sapiens
ttatccgactaaggactctgggctg

SEQ ID NO: 5909 - DNA, 25 bp, Homo sapiens
ggccttctgccgggaaagctagaaa

SEQ ID NO: 5910 - DNA, 25 bp, Homo sapiens
gaaacactaggttcttcctgtacat

SEQ ID NO: 5911 - DNA, 25 bp, Homo sapiens
cagtgagatggccgtttctgacttg

SEQ ID NO: 5912 - DNA, 25 bp, Homo sapiens
ctgttagctcctcactgtggtaaat

SEQ ID NO: 5913 - DNA, 25 bp, Homo sapiens
gtggtaaatgccacacacctttaag

SEQ ID NO: 5914 - DNA, 25 bp, Homo sapiens
gttatctgttcttttgacttaatct

SEQ ID NO: 5915 - DNA, 25 bp, Homo sapiens
tgattttccctctactaaggctttc

SEQ ID NO: 5916 - DNA, 25 bp, Homo sapiens
ctaccttcttcaggctgcctaagac

SEQ ID NO: 5917 - DNA, 25 bp, Homo sapiens
gaaactgaacttgaggtggcctcct

SEQ ID NO: 5918 - DNA, 25 bp, Homo sapiens
tcagttgaaacctgtataaccctgt

SEQ ID NO: 5919 - DNA, 25 bp, Homo sapiens
ataaccctgttacaaagctgtgttg

SEQ ID NO: 5920 - DNA, 25 bp, Homo sapiens
gctgtgttgttgcttcttgtgaagg

SEQ ID NO: 5921 - DNA, 25 bp, Homo sapiens
gtgttattttactaacttctctctg

SEQ ID NO: 5922 - DNA, 25 bp, Homo sapiens
taatgcctctgtctagcatgccaac

SEQ ID NO: 5923 - DNA, 25 bp, Homo sapiens
cccagtgcagtcggtggtacctgag

SEQ ID NO: 5924 - DNA, 25 bp, Homo sapiens
tgctgacttttaacccacacaagcg

SEQ ID NO: 5925 - DNA, 25 bp, Homo sapiens
cacaagcgaatctctgcctttcgag

SEQ ID NO: 5926 - DNA, 25 bp, Homo sapiens
ctctgcagcactcttatctacataa

SEQ ID NO: 5927 - DNA, 25 bp, Homo sapiens
ggaagaaaagctgccatttcccttc

SEQ ID NO: 5928 - DNA, 25 bp, Homo sapiens
ccatttcccttctggacactgagag

SEQ ID NO: 5929 - DNA, 25 bp, Homo sapiens
tccttcccatttctctacactaagg

SEQ ID NO: 5930 - DNA, 25 bp, Homo sapiens
gatgtttcgtcgaaagcctctcttc

SEQ ID NO: 5931 - DNA, 25 bp, Homo sapiens
gaaactctgaagccgaccagttggg

SEQ ID NO: 5932 - DNA, 25 bp, Homo sapiens
aatctttgacctgattgggctgcct

SEQ ID NO: 5933 - DNA, 25 bp, Homo sapiens
aggatgactggcctcgagatgtatc

SEQ ID NO: 5934 - DNA, 25 bp, Homo sapiens
cgctggaagccgtgcttcggtatct

SEQ ID NO: 5935 - DNA, 25 bp, Homo sapiens
cgtgcttcggtatcttgagacccac

SEQ ID NO: 5936 - DNA, 25 bp, Homo sapiens
cctgaccccgtgaaaagcgtgtcca

SEQ ID NO: 5937 - DNA, 25 bp, Homo sapiens
tgaaaagcgtgtccagcgtgctcag

SEQ ID NO: 5938 - DNA, 25 bp, Homo sapiens
cagcacaacggggtggacggcaaca

SEQ ID NO: 5939 - DNA, 25 bp, Homo sapiens
cggggtggacggcaacatgaagaag

SEQ ID NO: 5940 - DNA, 25 bp, Homo sapiens
catgaagaagcgcctcttgatgccc

SEQ ID NO: 5941 - DNA, 25 bp, Homo sapiens
gacagaccaggcacatgggaccaag

SEQ ID NO: 5942 - DNA, 25 bp, Homo sapiens
ccagtcaagcggcggcggatgaact

SEQ ID NO: 5943 - DNA, 25 bp, Homo sapiens
ggcggatgaactggatcgacgcccc

SEQ ID NO: 5944 - DNA, 25 bp, Homo sapiens
catcctcggaaaccaagcgtgctgc

SEQ ID NO: 5945 - DNA, 25 bp, Homo sapiens
gagagatgcctcaggcttcagacct

SEQ ID NO: 5946 - DNA, 25 bp, Homo sapiens
cttcagaccttacctgggttttcag

SEQ ID NO: 5947 - DNA, 25 bp, Homo sapiens
agggtcctgcaaaaggctagctcgg

SEQ ID NO: 5948 - DNA, 25 bp, Homo sapiens
gctagctcggcactacactagggaa

SEQ ID NO: 5949 - DNA, 25 bp, Homo sapiens
actagggaatttgctcctgttctgt

SEQ ID NO: 5950 - DNA, 25 bp, Homo sapiens
tcacttgtcatggtctttcttggta

SEQ ID NO: 5951 - DNA, 25 bp, Homo sapiens
ggtattaaaggccaccatttgcaca

SEQ ID NO: 5952 - DNA, 25 bp, Homo sapiens
caggaaacggcaacaagcctcccag

SEQ ID NO: 5953 - DNA, 25 bp, Homo sapiens
gcctcccagtactgacctgaaaact

SEQ ID NO: 5954 - DNA, 25 bp, Homo sapiens
gaagaacaccaacaagtgctccctg

SEQ ID NO: 5955 - DNA, 25 bp, Homo sapiens
caccccggaagctgaacctgaggga

SEQ ID NO: 5956 - DNA, 25 bp, Homo sapiens
gtggcaactctggtctaagggaaca

SEQ ID NO: 5957 - DNA, 25 bp, Homo sapiens
aagggaacattcagcactctagcgg

SEQ ID NO: 5958 - DNA, 25 bp, Homo sapiens
gcggcatctgattggaagttccctc

SEQ ID NO: 5959 - DNA, 25 bp, Homo sapiens
tccctcacccaagtaatctcaattc

SEQ ID NO: 5960 - DNA, 25 bp, Homo sapiens
aacaggatggattttcctctcttct

SEQ ID NO: 5961 - DNA, 25 bp, Homo sapiens
ttcttgattgtgatttctccatgga

SEQ ID NO: 5962 - DNA, 25 bp, Homo sapiens
agatttcaattgtctgtctctttct

SEQ ID NO: 5963 - DNA, 25 bp, Homo sapiens
ctctttctctctttgacttgtatga

SEQ ID NO: 5964 - DNA, 25 bp, Homo sapiens
attgtacattgcctgatatctcttt

SEQ ID NO: 5965 - DNA, 25 bp, Homo sapiens
gaagtcttgcttatccttctgagtt

SEQ ID NO: 5966 - DNA, 25 bp, Homo sapiens
gaagcctctaaagactacctgtaaa

SEQ ID NO: 5967 - DNA, 25 bp, Homo sapiens
gaagtacattactgcccatggactg

SEQ ID NO: 5968 - DNA, 25 bp, Homo sapiens
ccgagccttgcgccagaaaattgtc

SEQ ID NO: 5969 - DNA, 25 bp, Homo sapiens
tagtcctcagaaacttctttcctgc

SEQ ID NO: 5970 - DNA, 25 bp, Homo sapiens
gccctgattggggctcttgctgttc

SEQ ID NO: 5971 - DNA, 25 bp, Homo sapiens
ttgtcatctctgatctttgcctaat

SEQ ID NO: 5972 - DNA, 25 bp, Homo sapiens
atagaaggacttgatcctgctccct

SEQ ID NO: 5973 - DNA, 25 bp, Homo sapiens
tctgcattgactcctcatgctggga

SEQ ID NO: 5974 - DNA, 25 bp, Homo sapiens
tcacgtaccttcatcacttttagtg

SEQ ID NO: 5975 - DNA, 25 bp, Homo sapiens
aaaagtccctgttcgtgaggtctgt

SEQ ID NO: 5976 - DNA, 25 bp, Homo sapiens
gggaccctgttacagacatacccta

SEQ ID NO: 5977 - DNA, 25 bp, Homo sapiens
actgctcgagccttcaagatcattc

SEQ ID NO: 5978 - DNA, 25 bp, Homo sapiens
atctgcccaacagccaggaggcact

SEQ ID NO: 5979 - DNA, 25 bp, Homo sapiens
tgcagaagctctctgatgtcaccct

SEQ ID NO: 5980 - DNA, 25 bp, Homo sapiens
tacctgtgtcctgctcagaactgga

SEQ ID NO: 5981 - DNA, 25 bp, Homo sapiens
gaactggagaaggctggcgccgggc

SEQ ID NO: 5982 - DNA, 25 bp, Homo sapiens
tggccttggggtactgctggccagg

SEQ ID NO: 5983 - DNA, 25 bp, Homo sapiens
aaggatccactgggtgaatcctccc

SEQ ID NO: 5984 - DNA, 25 bp, Homo sapiens
ctcgcactgttgtggcaggcagcag

SEQ ID NO: 5985 - DNA, 25 bp, Homo sapiens
ctgtccgggcaatggcagtgctgac

SEQ ID NO: 5986 - DNA, 25 bp, Homo sapiens
agtgctgacagatcacccatatgcc

SEQ ID NO: 5987 - DNA, 25 bp, Homo sapiens
cagatgacgcagctgctgactgcct

SEQ ID NO: 5988 - DNA, 25 bp, Homo sapiens
tttcctcctgcaccgtggaggtggg

SEQ ID NO: 5989 - DNA, 25 bp, Homo sapiens
tgtcagagttttcaacggtgcttat

SEQ ID NO: 5990 - DNA, 25 bp, Homo sapiens
caacggtgcttatagctgccagctg

SEQ ID NO: 5991 - DNA, 25 bp, Homo sapiens
gctggattccaaacaggtaccccat

SEQ ID NO: 5992 - DNA, 25 bp, Homo sapiens
taccccattgtctctgagctaatgt

SEQ ID NO: 5993 - DNA, 25 bp, Homo sapiens
atatttttccattcaggcaccgaaa

SEQ ID NO: 5994 - DNA, 25 bp, Homo sapiens
gagttcttgggactggatcctttat

SEQ ID NO: 5995 - DNA, 25 bp, Homo sapiens
gaaaatgccatgattatctgcagtt

SEQ ID NO: 5996 - DNA, 25 bp, Homo sapiens
gatgacagctattctacatcagact

SEQ ID NO: 5997 - DNA, 25 bp, Homo sapiens
gacttgatttttgtcagctaattac

SEQ ID NO: 5998 - DNA, 25 bp, Homo sapiens
aatcggtttgatagcaccatgggac

SEQ ID NO: 5999 - DNA, 25 bp, Homo sapiens
agagacatagccttttagttttgct

SEQ ID NO: 6000 - DNA, 25 bp, Homo sapiens
agtctatgactgatgcaattctcca

SEQ ID NO: 6001 - DNA, 25 bp, Homo sapiens
gcaattctccagacagaccagactc

SEQ ID NO: 6002 - DNA, 25 bp, Homo sapiens
ggaacgtgtgaaagctgagtctgca

SEQ ID NO: 6003 - DNA, 25 bp, Homo sapiens
tgagtctgcacaggcttcagcaaaa

SEQ ID NO: 6004 - DNA, 25 bp, Homo sapiens
gagaacgacagggtccagttgctga

SEQ ID NO: 6005 - DNA, 25 bp, Homo sapiens
gcaagagaggaccctcgctcttaaa

SEQ ID NO: 6006 - DNA, 25 bp, Homo sapiens
ctcgctcttaaacttcaggaacagg

SEQ ID NO: 6007 - DNA, 25 bp, Homo sapiens
ggcatgtaccataagctaaagacca

SEQ ID NO: 6008 - DNA, 25 bp, Homo sapiens
ctaaagaccagagccttcctgtcac

SEQ ID NO: 6009 - DNA, 25 bp, Homo sapiens
tgtcacccctaaccaaggcataatt

SEQ ID NO: 6010 - DNA, 25 bp, Homo sapiens
ggaacaagcgtcactacatttgata

SEQ ID NO: 6011 - DNA, 25 bp, Homo sapiens
gtttgcactcctattttgagcttgt

SEQ ID NO: 6012 - DNA, 25 bp, Homo sapiens
aagcatgtcttgcactgttcaacct

SEQ ID NO: 6013 - DNA, 25 bp, Homo sapiens
caacctcctgagtggtcgctttaac

SEQ ID NO: 6014 - DNA, 25 bp, Homo sapiens
tgagtggtcgctttaacaacctcca

SEQ ID NO: 6015 - DNA, 25 bp, Homo sapiens
gtgtacagtggttattttccccagt

SEQ ID NO: 6016 - DNA, 25 bp, Homo sapiens
ttttccccagttgtatagttttgag

SEQ ID NO: 6017 - DNA, 25 bp, Homo sapiens
aactgtccctttccaggtgggagct

SEQ ID NO: 6018 - DNA, 25 bp, Homo sapiens
ggagcttaacacctgtataaaacct

SEQ ID NO: 6019 - DNA, 25 bp, Homo sapiens
ccgtgacatggttatgcatccttta

SEQ ID NO: 6020 - DNA, 25 bp, Homo sapiens
gcatcctttagattaacctcaccaa

SEQ ID NO: 6021 - DNA, 25 bp, Homo sapiens
attgtccttacataatattgtcctt

SEQ ID NO: 6022 - DNA, 25 bp, Homo sapiens
agggcaaatgagatcacctcctgca

SEQ ID NO: 6023 - DNA, 25 bp, Homo sapiens
tgtgccgaggtctgcgtcgaagaca

SEQ ID NO: 6024 - DNA, 25 bp, Homo sapiens
gaagcttcagatggtaccccaagaa

SEQ ID NO: 6025 - DNA, 25 bp, Homo sapiens
atgtgagaggtggccgcttggagtt

SEQ ID NO: 6026 - DNA, 25 bp, Homo sapiens
gcagcgctccatgggggtatggttt

SEQ ID NO: 6027 - DNA, 25 bp, Homo sapiens
gggggtatggttttgtcactgccca

SEQ ID NO: 6028 - DNA, 25 bp, Homo sapiens
tagcagtgacatctcattgtcccca

SEQ ID NO: 6029 - DNA, 25 bp, Homo sapiens
cagcccagtgggcattggaggtgcc

SEQ ID NO: 6030 - DNA, 25 bp, Homo sapiens
ggagtcagggttgtagccaagacgc

SEQ ID NO: 6031 - DNA, 25 bp, Homo sapiens
gagtgggttctcaatacggtaccaa

SEQ ID NO: 6032 - DNA, 25 bp, Homo sapiens
taggactcacgttaactcacattta

SEQ ID NO: 6033 - DNA, 25 bp, Homo sapiens
ttgctcccccagagcggaagtactc

SEQ ID NO: 6034 - DNA, 25 bp, Homo sapiens
agtactcagtctggatcgggggctc

SEQ ID NO: 6035 - DNA, 25 bp, Homo sapiens
tgagtatgatgaggcagggccctcc

SEQ ID NO: 6036 - DNA, 25 bp, Homo sapiens
gccctccattgtccacaggaagtgc

SEQ ID NO: 6037 - DNA, 25 bp, Homo sapiens
cagaacaggttctccaaggatcccc

SEQ ID NO: 6038 - DNA, 25 bp, Homo sapiens
aagagctatgagctgccagatgggc

SEQ ID NO: 6039 - DNA, 25 bp, Homo sapiens
cctttattggcatggagtccgctgg

SEQ ID NO: 6040 - DNA, 25 bp, Homo sapiens
tggagtccgctggaattcatgagac

SEQ ID NO: 6041 - DNA, 25 bp, Homo sapiens
tcatgagacaacctacaattccatc

SEQ ID NO: 6042 - DNA, 25 bp, Homo sapiens
gtgacattgacatccgtaaggactt

SEQ ID NO: 6043 - DNA, 25 bp, Homo sapiens
atatgccaacaatgtcctctctggg

SEQ ID NO: 6044 - DNA, 25 bp, Homo sapiens
ggcccctaatatcccagtttaatat

SEQ ID NO: 6045 - DNA, 25 bp, Homo sapiens
acccgagggacagcagattccacag

SEQ ID NO: 6046 - DNA, 25 bp, Homo sapiens
caactgcccttgaccggaagcatga

SEQ ID NO: 6047 - DNA, 25 bp, Homo sapiens
agcatgagtatcatcttcttcctgc

SEQ ID NO: 6048 - DNA, 25 bp, Homo sapiens
agtgacccagaatttgaccttgata

SEQ ID NO: 6049 - DNA, 25 bp, Homo sapiens
tgatagaggagagcctcacctccga

SEQ ID NO: 6050 - DNA, 25 bp, Homo sapiens
tcacctccgagttcattcatgacat

SEQ ID NO: 6051 - DNA, 25 bp, Homo sapiens
ggagatgaagctgcaatccttgttt

SEQ ID NO: 6052 - DNA, 25 bp, Homo sapiens
atccttgtttgattcaccagacttt

SEQ ID NO: 6053 - DNA, 25 bp, Homo sapiens
gcaaacccatcaagctgactcaggt

SEQ ID NO: 6054 - DNA, 25 bp, Homo sapiens
aacaccgggctggctttgagtggaa

SEQ ID NO: 6055 - DNA, 25 bp, Homo sapiens
gtatgacaacccgggatcgtttgca

SEQ ID NO: 6056 - DNA, 25 bp, Homo sapiens
gtaactgaatccattgcgacattgt

SEQ ID NO: 6057 - DNA, 25 bp, Homo sapiens
atagcgttgttatcgccttgggttt

SEQ ID NO: 6058 - DNA, 25 bp, Homo sapiens
gtatcatggcctacccgaggagaag

SEQ ID NO: 6059 - DNA, 25 bp, Homo sapiens
actgggcctatgtagtagcctcatt

SEQ ID NO: 6060 - DNA, 25 bp, Homo sapiens
tagcctcatttaccatcgtttgtat

SEQ ID NO: 6061 - DNA, 25 bp, Homo sapiens
gaccacatatgcttgtcactgggaa

SEQ ID NO: 6062 - DNA, 25 bp, Homo sapiens
aaagaagcctgtttcagctgcctga

SEQ ID NO: 6063 - DNA, 25 bp, Homo sapiens
tgcctgaacgcagtttggatgtctt

SEQ ID NO: 6064 - DNA, 25 bp, Homo sapiens
acattgcccggaaactcagtctatt

SEQ ID NO: 6065 - DNA, 25 bp, Homo sapiens
agtctatttattcttcagcttgccc

SEQ ID NO: 6066 - DNA, 25 bp, Homo sapiens
agggctcatcgacatcgagaacccc

SEQ ID NO: 6067 - DNA, 25 bp, Homo sapiens
ggtcacacaactggatctggacggg

SEQ ID NO: 6068 - DNA, 25 bp, Homo sapiens
ggacgggccaaaggagctttcgagg

SEQ ID NO: 6069 - DNA, 25 bp, Homo sapiens
atgcacttggccgggaagacagagc

SEQ ID NO: 6070 - DNA, 25 bp, Homo sapiens
ggctggccatcatccggaaacagcg

SEQ ID NO: 6071 - DNA, 25 bp, Homo sapiens
gaggaggctgcccggaagaaggaag

SEQ ID NO: 6072 - DNA, 25 bp, Homo sapiens
aaagacgatgccacattgtcaggaa

SEQ ID NO: 6073 - DNA, 25 bp, Homo sapiens
ggaaaacgaatgcagtcactctccc

SEQ ID NO: 6074 - DNA, 25 bp, Homo sapiens
gcagtcactctccctgaataagtaa

SEQ ID NO: 6075 - DNA, 25 bp, Homo sapiens
taagtaactgcgacccgtgggagga

SEQ ID NO: 6076 - DNA, 25 bp, Homo sapiens
ggggtagctgctatctttgagacag

SEQ ID NO: 6077 - DNA, 25 bp, Homo sapiens
agaggatccgagaacgctctaagcc

SEQ ID NO: 6078 - DNA, 25 bp, Homo sapiens
ctaagcctgtccacgagctcaatag

SEQ ID NO: 6079 - DNA, 25 bp, Homo sapiens
gatgactacagactttgcgaacgct

SEQ ID NO: 6080 - DNA, 25 bp, Homo sapiens
actttgcgaacgctacgccatggtt

SEQ ID NO: 6081 - DNA, 25 bp, Homo sapiens
ggtttatggatacaatgctgcctat

SEQ ID NO: 6082 - DNA, 25 bp, Homo sapiens
aatcgctacttcaggaagcgccgag

SEQ ID NO: 6083 - DNA, 25 bp, Homo sapiens
gcgccgaggggccaaatgagactga

SEQ ID NO: 6084 - DNA, 25 bp, Homo sapiens
ctgacctgcaggacgaaaccatgaa

SEQ ID NO: 6085 - DNA, 25 bp, Homo sapiens
ggcttatatacaatgcttctttcct

SEQ ID NO: 6086 - DNA, 25 bp, Homo sapiens
catgaagagcctgatccttcttgcc

SEQ ID NO: 6087 - DNA, 25 bp, Homo sapiens
cctggccgccttagcggtagtaact

SEQ ID NO: 6088 - DNA, 25 bp, Homo sapiens
agtcctggctagacaagtccacacc

SEQ ID NO: 6089 - DNA, 25 bp, Homo sapiens
caccctacacggctgtgcgatgggt

SEQ ID NO: 6090 - DNA, 25 bp, Homo sapiens
tgacactgggcctgagctttgtcta

SEQ ID NO: 6091 - DNA, 25 bp, Homo sapiens
catgattcgagtttacctgctgcag

SEQ ID NO: 6092 - DNA, 25 bp, Homo sapiens
tgtgacctatgccttggggatctac

SEQ ID NO: 6093 - DNA, 25 bp, Homo sapiens
ttctcccaaagtggatccttcctta

SEQ ID NO: 6094 - DNA, 25 bp, Homo sapiens
aagactcagatgacggtccttcgct

SEQ ID NO: 6095 - DNA, 25 bp, Homo sapiens
tatggtctgtactttcttcgacgct

SEQ ID NO: 6096 - DNA, 25 bp, Homo sapiens
gttctggccgattctggtgatgtac

SEQ ID NO: 6097 - DNA, 25 bp, Homo sapiens
ttcatcatgctcttctgtatcacga

SEQ ID NO: 6098 - DNA, 25 bp, Homo sapiens
taagtaccggtacatcccgttcaca

SEQ ID NO: 6099 - DNA, 25 bp, Homo sapiens
ggcctgcgagggaggaacgggccgc

SEQ ID NO: 6100 - DNA, 25 bp, Homo sapiens
gagcccgagggatgatctagcctga

SEQ ID NO: 6101 - DNA, 25 bp, Homo sapiens
gattcctgcgtgtccgaaagaactt

SEQ ID NO: 6102 - DNA, 25 bp, Homo sapiens
gtggggttctaatgccagtttccta

SEQ ID NO: 6103 - DNA, 25 bp, Homo sapiens
cagtttcctaattccatctcactgg

SEQ ID NO: 6104 - DNA, 25 bp, Homo sapiens
aaagttggcctctatcctaatgact

SEQ ID NO: 6105 - DNA, 25 bp, Homo sapiens
gttcttaactaccatgattgctttt

SEQ ID NO: 6106 - DNA, 25 bp, Homo sapiens
attgcttttgagggcccggaattat

SEQ ID NO: 6107 - DNA, 25 bp, Homo sapiens
gaaactggcgcttaaaccaaatcgc

SEQ ID NO: 6108 - DNA, 25 bp, Homo sapiens
aagtgtttctcacggatggaattct

SEQ ID NO: 6109 - DNA, 25 bp, Homo sapiens
gaattctagtcagctgcaggcggga

SEQ ID NO: 6110 - DNA, 25 bp, Homo sapiens
tctgtcctgcgtcgaagctttgaag

SEQ ID NO: 6111 - DNA, 25 bp, Homo sapiens
cgaagctttgaaggccgaaggcagt

SEQ ID NO: 6112 - DNA, 25 bp, Homo sapiens
ggcagtgcaagagactctggcctcc

SEQ ID NO: 6113 - DNA, 25 bp, Homo sapiens
gtgtgccttcgcggtggaaggcccg

SEQ ID NO: 6114 - DNA, 25 bp, Homo sapiens
ccctaagaccggcggccatgatggt

SEQ ID NO: 6115 - DNA, 25 bp, Homo sapiens
ccatgatggtgctgacctctggtgg

SEQ ID NO: 6116 - DNA, 25 bp, Homo sapiens
tgcaggcaccttagtggcttttttc

SEQ ID NO: 6117 - DNA, 25 bp, Homo sapiens
gagaggggtacatttccctgtgctg

SEQ ID NO: 6118 - DNA, 25 bp, Homo sapiens
atttccctgtgctgacggaagccaa

SEQ ID NO: 6119 - DNA, 25 bp, Homo sapiens
gacggaagccaacttggctttcccg

SEQ ID NO: 6120 - DNA, 25 bp, Homo sapiens
agtgtaggtcagcgtgcttagcctc

SEQ ID NO: 6121 - DNA, 25 bp, Homo sapiens
ccccgattggctgcaatgctgaact

SEQ ID NO: 6122 - DNA, 25 bp, Homo sapiens
taatcttcagcaactttgtggcccc

SEQ ID NO: 6123 - DNA, 25 bp, Homo sapiens
cccaagtgccgtgacctgaaagttg

SEQ ID NO: 6124 - DNA, 25 bp, Homo sapiens
ggaccaactgacggatatttactta

SEQ ID NO: 6125 - DNA, 25 bp, Homo sapiens
cttacagctggactgtgctcggttc

SEQ ID NO: 6126 - DNA, 25 bp, Homo sapiens
tgctcggttcgcgaaagccattgct

SEQ ID NO: 6127 - DNA, 25 bp, Homo sapiens
gccattgctgacgaccagagatcct

SEQ ID NO: 6128 - DNA, 25 bp, Homo sapiens
gaacgcacgcgcagaaatcgactac

SEQ ID NO: 6129 - DNA, 25 bp, Homo sapiens
ctacagcgacgctcctgatgagttc

SEQ ID NO: 6130 - DNA, 25 bp, Homo sapiens
tctgatggacaccctcatgacagac

SEQ ID NO: 6131 - DNA, 25 bp, Homo sapiens
cttcaaccggcagacgctgacagag

SEQ ID NO: 6132 - DNA, 25 bp, Homo sapiens
gatgcgctccatggcatctggaggt

SEQ ID NO: 6133 - DNA, 25 bp, Homo sapiens
gtggtgttcccactgatgaagagca

SEQ ID NO: 6134 - DNA, 25 bp, Homo sapiens
gagagggagatcatgctggctgcaa

SEQ ID NO: 6135 - DNA, 25 bp, Homo sapiens
tttttttccaatgcaatggcttcaa

SEQ ID NO: 6136 - DNA, 25 bp, Homo sapiens
tggacccatacaatgtactggcccc

SEQ ID NO: 6137 - DNA, 25 bp, Homo sapiens
ggccccaaagggagcttcaggcacc

SEQ ID NO: 6138 - DNA, 25 bp, Homo sapiens
accagcgtcgtctggttttggctgc

SEQ ID NO: 6139 - DNA, 25 bp, Homo sapiens
atggcttcaaggttacttcgcggag

SEQ ID NO: 6140 - DNA, 25 bp, Homo sapiens
tggagcccattacaagctggtgccc

SEQ ID NO: 6141 - DNA, 25 bp, Homo sapiens
gcacactgagcacctgcactaaatt

SEQ ID NO: 6142 - DNA, 25 bp, Homo sapiens
ttcgcggagctggaacgctggccgc

SEQ ID NO: 6143 - DNA, 25 bp, Homo sapiens
gtcagctgtttgcagtttttagcct

SEQ ID NO: 6144 - DNA, 25 bp, Homo sapiens
gatacttcaagtcattcttgcttgc

SEQ ID NO: 6145 - DNA, 25 bp, Homo sapiens
gcacttcccctattgacacatgaaa

SEQ ID NO: 6146 - DNA, 25 bp, Homo sapiens
gaaagctgtgttggtgttttattgt

SEQ ID NO: 6147 - DNA, 25 bp, Homo sapiens
attgtacatacttcagatgcacata

SEQ ID NO: 6148 - DNA, 25 bp, Homo sapiens
tctagctttctttatgatgtttctg

SEQ ID NO: 6149 - DNA, 25 bp, Homo sapiens
gaaaactttaccttctcttgtacat

SEQ ID NO: 6150 - DNA, 25 bp, Homo sapiens
ttacatttcattctaagttccaaaa

SEQ ID NO: 6151 - DNA, 25 bp, Homo sapiens
gttttgcaagatcacacactaatgt

SEQ ID NO: 6152 - DNA, 25 bp, Homo sapiens
gaagtggatttatgcaggcagttct

SEQ ID NO: 6153 - DNA, 25 bp, Homo sapiens
cataacgtcagcataacttcatttg

SEQ ID NO: 6154 - DNA, 25 bp, Homo sapiens
gaagccctggaaaatcgcctgagat

SEQ ID NO: 6155 - DNA, 25 bp, Homo sapiens
gaaatcgcgacacatttgtagtcat

SEQ ID NO: 6156 - DNA, 25 bp, Homo sapiens
atttgtagtcattgtatcacggatt

SEQ ID NO: 6157 - DNA, 25 bp, Homo sapiens
caatgaacgcagtgcagagccccaa

SEQ ID NO: 6158 - DNA, 25 bp, Homo sapiens
gagaaacctggtttgccacagaaca

SEQ ID NO: 6159 - DNA, 25 bp, Homo sapiens
cctcatcctgccttagtgtgcaatc

SEQ ID NO: 6160 - DNA, 25 bp, Homo sapiens
gtgtgcaatctcatttgactatacg

SEQ ID NO: 6161 - DNA, 25 bp, Homo sapiens
tacttctgtagaacactggccatag

SEQ ID NO: 6162 - DNA, 25 bp, Homo sapiens
gaacactggccataggaaatgctgt

SEQ ID NO: 6163 - DNA, 25 bp, Homo sapiens
aatgctgtttttttgtactggactt

SEQ ID NO: 6164 - DNA, 25 bp, Homo sapiens
tactggactttaccttgatatatgt

SEQ ID NO: 6165 - DNA, 25 bp, Homo sapiens
cagactatcaggcccatttgtctcc

SEQ ID NO: 6166 - DNA, 25 bp, Homo sapiens
tcccctgcaccgagggaacaactcg

SEQ ID NO: 6167 - DNA, 25 bp, Homo sapiens
gaacaactcgagctttgaggcttcc

SEQ ID NO: 6168 - DNA, 25 bp, Homo sapiens
caactaccacttgccagcaacaaaa

SEQ ID NO: 6169 - DNA, 25 bp, Homo sapiens
ccctgcacaggatatcaaagctctg

SEQ ID NO: 6170 - DNA, 25 bp, Homo sapiens
gctctgtttgtgtctgaggaggaga

SEQ ID NO: 6171 - DNA, 25 bp, Homo sapiens
actcggaaggaggtctacatcaaga

SEQ ID NO: 6172 - DNA, 25 bp, Homo sapiens
gaagtcgtttcattcaagttggtgt

SEQ ID NO: 6173 - DNA, 25 bp, Homo sapiens
aagttggtgtaatcagctggggagt

SEQ ID NO: 6174 - DNA, 25 bp, Homo sapiens
gctggggagtagtggatgtctgcaa

SEQ ID NO: 6175 - DNA, 25 bp, Homo sapiens
actttcacatcaacctctttcaagt

SEQ ID NO: 6176 - DNA, 25 bp, Homo sapiens
tatattggtttgcacaagttccctg

SEQ ID NO: 6177 - DNA, 25 bp, Homo sapiens
gacaatagtatttctcctttgcaat

SEQ ID NO: 6178 - DNA, 25 bp, Homo sapiens
atctttttatcatgatcctacctat

SEQ ID NO: 6179 - DNA, 25 bp, Homo sapiens
gatcctacctatcaagcactaaaaa

SEQ ID NO: 6180 - DNA, 25 bp, Homo sapiens
gatactgattatgaaatgtcccctg

SEQ ID NO: 6181 - DNA, 25 bp, Homo sapiens
atgtcccctgaaactcattgcagca

SEQ ID NO: 6182 - DNA, 25 bp, Homo sapiens
tgagtcattgacttcattttatatt

SEQ ID NO: 6183 - DNA, 25 bp, Homo sapiens
atatcatctgtcattatattctaat

SEQ ID NO: 6184 - DNA, 25 bp, Homo sapiens
gggataactgatttctatggctttc

SEQ ID NO: 6185 - DNA, 25 bp, Homo sapiens
actctaatattgcttcttgtgtttt

SEQ ID NO: 6186 - DNA, 25 bp, Homo sapiens
gcttcttgtgttttactgtcagatt

SEQ ID NO: 6187 - DNA, 25 bp, Homo sapiens
gtgttctcagtaggaaatgttcatc

SEQ ID NO: 6188 - DNA, 25 bp, Homo sapiens
gaaaaactaataaggggctggctca

SEQ ID NO: 6189 - DNA, 25 bp, Homo sapiens
tggctcattacctcaaggagtataa

SEQ ID NO: 6190 - DNA, 25 bp, Homo sapiens
aagaggccatacacgatatgaattt

SEQ ID NO: 6191 - DNA, 25 bp, Homo sapiens
gctaaggtgcaggatgagaagagaa

SEQ ID NO: 6192 - DNA, 25 bp, Homo sapiens
ggccatgtgctttaacgttacggta

SEQ ID NO: 6193 - DNA, 25 bp, Homo sapiens
tgtgctttaacgttacggtaatact

SEQ ID NO: 6194 - DNA, 25 bp, Homo sapiens
taatactttactttaggcatccctc

SEQ ID NO: 6195 - DNA, 25 bp, Homo sapiens
agcagccttttgacctatctgcaat

SEQ ID NO: 6196 - DNA, 25 bp, Homo sapiens
gccttttgacctatctgcaatgcag

SEQ ID NO: 6197 - DNA, 25 bp, Homo sapiens
gacctatctgcaatgcagtgttctc

SEQ ID NO: 6198 - DNA, 25 bp, Homo sapiens
ataatcataacttctacattacagg

SEQ ID NO: 6199 - DNA, 25 bp, Homo sapiens
gatgcagaactagaggggccagggt

SEQ ID NO: 6200 - DNA, 25 bp, Homo sapiens
tatatagcaccatgcttcttaatgc

SEQ ID NO: 6201 - DNA, 25 bp, Homo sapiens
gaagttgctgtggtccacttcattt

SEQ ID NO: 6202 - DNA, 25 bp, Homo sapiens
gctgtggtccacttcatttataagg

SEQ ID NO: 6203 - DNA, 25 bp, Homo sapiens
ttacagtacactatagcaacagcaa

SEQ ID NO: 6204 - DNA, 25 bp, Homo sapiens
tagcaacagcaaaagccctctctca

SEQ ID NO: 6205 - DNA, 25 bp, Homo sapiens
ccctctctcaccctgataggaatgg

SEQ ID NO: 6206 - DNA, 25 bp, Homo sapiens
aggaatgggtttgctgggtgtctag

SEQ ID NO: 6207 - DNA, 25 bp, Homo sapiens
gggtttgctgggtgtctagaagtta

SEQ ID NO: 6208 - DNA, 25 bp, Homo sapiens
gaagttagattcctgctgaatagaa

SEQ ID NO: 6209 - DNA, 25 bp, Homo sapiens
gatctgggattatgtggccttaggt

SEQ ID NO: 6210 - DNA, 25 bp, Homo sapiens
aggtagctggttgtacatctttccc

SEQ ID NO: 6211 - DNA, 25 bp, Homo sapiens
acatctttccctaaatcgatccatg

SEQ ID NO: 6212 - DNA, 25 bp, Homo sapiens
gaagttcttatgaccacagatcatc

SEQ ID NO: 6213 - DNA, 25 bp, Homo sapiens
gatcatcagtactgttgtctcatgt

SEQ ID NO: 6214 - DNA, 25 bp, Homo sapiens
aatggtccgtgtttgcattgttaaa

SEQ ID NO: 6215 - DNA, 25 bp, Homo sapiens
actgcagtgtccgttatgagtgcca

SEQ ID NO: 6216 - DNA, 25 bp, Homo sapiens
atctgtcttgaaggcagctacactt

SEQ ID NO: 6217 - DNA, 25 bp, Homo sapiens
gctggtatcagaacagcttccctca

SEQ ID NO: 6218 - DNA, 25 bp, Homo sapiens
gcttccctcactgtgtacagaacgc

SEQ ID NO: 6219 - DNA, 25 bp, Homo sapiens
tggtctgaacgtggtgtctcactct

SEQ ID NO: 6220 - DNA, 25 bp, Homo sapiens
agcacccgttgagtccttttgaggg

SEQ ID NO: 6221 - DNA, 25 bp, Homo sapiens
gatgagacttatggagtgtgcctct

SEQ ID NO: 6222 - DNA, 25 bp, Homo sapiens
gaagccatcctaaggtgcttacctc

SEQ ID NO: 6223 - DNA, 25 bp, Homo sapiens
acacgccacccatgaggcttgtggc

SEQ ID NO: 6224 - DNA, 25 bp, Homo sapiens
tgaggcttgtggccacagtggcact

SEQ ID NO: 6225 - DNA, 25 bp, Homo sapiens
agatcatctccaaatcttgccattt

SEQ ID NO: 6226 - DNA, 25 bp, Homo sapiens
ggatgtcatatcttctttgttttgg

SEQ ID NO: 6227 - DNA, 25 bp, Homo sapiens
tttcttccctagcttattttgtggc

SEQ ID NO: 6228 - DNA, 25 bp, Homo sapiens
gtattgtgagatcctgtgattcctg

SEQ ID NO: 6229 - DNA, 25 bp, Homo sapiens
gtgattcctggtggccagtatcctg

SEQ ID NO: 6230 - DNA, 25 bp, Homo sapiens
gtatcctggattcctctaagatctt

SEQ ID NO: 6231 - DNA, 25 bp, Homo sapiens
ccggccaccagaatcctttggtata

SEQ ID NO: 6232 - DNA, 25 bp, Homo sapiens
tatagccaagccttttggttaccgc

SEQ ID NO: 6233 - DNA, 25 bp, Homo sapiens
tttggttaccgcctcatgaagaata

SEQ ID NO: 6234 - DNA, 25 bp, Homo sapiens
aagaatatgcttcccgcattgtcct

SEQ ID NO: 6235 - DNA, 25 bp, Homo sapiens
cctagtcccagttgtattctcacag

SEQ ID NO: 6236 - DNA, 25 bp, Homo sapiens
ggtgttatgtgcaggacacaatcca

SEQ ID NO: 6237 - DNA, 25 bp, Homo sapiens
atcataaacctggctcatgcccaac

SEQ ID NO: 6238 - DNA, 25 bp, Homo sapiens
tcatgcccaacacatttctgctaat

SEQ ID NO: 6239 - DNA, 25 bp, Homo sapiens
aggagagggcctgtgtctgtagaag

SEQ ID NO: 6240 - DNA, 25 bp, Homo sapiens
acatcccagaattatgactcttccc

SEQ ID NO: 6241 - DNA, 25 bp, Homo sapiens
gaattatgactcttcccaagtttaa

SEQ ID NO: 6242 - DNA, 25 bp, Homo sapiens
gtgccaagatggaagtcacctttct

SEQ ID NO: 6243 - DNA, 25 bp, Homo sapiens
tttctcctggagactagctggggct

SEQ ID NO: 6244 - DNA, 25 bp, Homo sapiens
ttatgggtggctttcaaggctgggg

SEQ ID NO: 6245 - DNA, 25 bp, Homo sapiens
gcaggggagcttgggactcaggtct

SEQ ID NO: 6246 - DNA, 25 bp, Homo sapiens
ttgggactcaggtctgtaactgccc

SEQ ID NO: 6247 - DNA, 25 bp, Homo sapiens
ctctccttcccacaaaagacagacc

SEQ ID NO: 6248 - DNA, 25 bp, Homo sapiens
gacagacccagtgagtgaatcaggc

SEQ ID NO: 6249 - DNA, 25 bp, Homo sapiens
aatgtgtgttgtgtgagcgtggcct

SEQ ID NO: 6250 - DNA, 25 bp, Homo sapiens
agcgtggccttgggaggacatgcgt

SEQ ID NO: 6251 - DNA, 25 bp, Homo sapiens
atttttatgtgcagcgacccttggt

SEQ ID NO: 6252 - DNA, 25 bp, Homo sapiens
ggatgctgacccaggaatagtggac

SEQ ID NO: 6253 - DNA, 25 bp, Homo sapiens
aacctgaaaacatcccagccaagaa

SEQ ID NO: 6254 - DNA, 25 bp, Homo sapiens
gagaaactatcaatgctggcagcca

SEQ ID NO: 6255 - DNA, 25 bp, Homo sapiens
ggaaatggctacccaacttgccttc

SEQ ID NO: 6256 - DNA, 25 bp, Homo sapiens
aactatgcctctcagaacatcacct

SEQ ID NO: 6257 - DNA, 25 bp, Homo sapiens
aaggctgtcattctacagggctcta

SEQ ID NO: 6258 - DNA, 25 bp, Homo sapiens
gagggcaacagcaggttcacttaca

SEQ ID NO: 6259 - DNA, 25 bp, Homo sapiens
gcaggttcacttacactgttcttgt

SEQ ID NO: 6260 - DNA, 25 bp, Homo sapiens
aaacaaataagccatcacgcctgcc

SEQ ID NO: 6261 - DNA, 25 bp, Homo sapiens
cccttccttgatattgcacctttgg

SEQ ID NO: 6262 - DNA, 25 bp, Homo sapiens
ctttggacatcggtggtgctgacca

SEQ ID NO: 6263 - DNA, 25 bp, Homo sapiens
tttgtggacattggcccagtctgtt

SEQ ID NO: 6264 - DNA, 25 bp, Homo sapiens
actttcccatgagtgtgatccacat

SEQ ID NO: 6265 - DNA, 25 bp, Homo sapiens
gatccacattgttaggtgctgacct

SEQ ID NO: 6266 - DNA, 25 bp, Homo sapiens
ggtgctgacctagacagagatgaac

SEQ ID NO: 6267 - DNA, 25 bp, Homo sapiens
gatgaactgaggtccttgttttgtt

SEQ ID NO: 6268 - DNA, 25 bp, Homo sapiens
gaagaatgttgatggtgctagaaga

SEQ ID NO: 6269 - DNA, 25 bp, Homo sapiens
tcctgtattgagttgtatcgtgtgg

SEQ ID NO: 6270 - DNA, 25 bp, Homo sapiens
gttgtatcgtgtggtgtatttttta

SEQ ID NO: 6271 - DNA, 25 bp, Homo sapiens
gattatttgcccaaagttgtcctct

SEQ ID NO: 6272 - DNA, 25 bp, Homo sapiens
agcatttgttctttgccagtctcat

SEQ ID NO: 6273 - DNA, 25 bp, Homo sapiens
tcttcttccatggttccacagaagc

SEQ ID NO: 6274 - DNA, 25 bp, Homo sapiens
ccacagaagctttgtttcttgggca

SEQ ID NO: 6275 - DNA, 25 bp, Homo sapiens
gtaccgccttatggagtatacgggc

SEQ ID NO: 6276 - DNA, 25 bp, Homo sapiens
gtatacgggcaaccatggaatcaac

SEQ ID NO: 6277 - DNA, 25 bp, Homo sapiens
ttggagtagatcaatcaccttctgc

SEQ ID NO: 6278 - DNA, 25 bp, Homo sapiens
gatgggtggatttggtgctcagcct

SEQ ID NO: 6279 - DNA, 25 bp, Homo sapiens
ctcctcctaaccaagccggatatgg

SEQ ID NO: 6280 - DNA, 25 bp, Homo sapiens
ccaaacacagtgagccgggactcta

SEQ ID NO: 6281 - DNA, 25 bp, Homo sapiens
taggcttcgatttcctgtgacactc

SEQ ID NO: 6282 - DNA, 25 bp, Homo sapiens
gtttggaacctttagcacagatttg

SEQ ID NO: 6283 - DNA, 25 bp, Homo sapiens
aaggacacgtgtcttctagttctgc

SEQ ID NO: 6284 - DNA, 25 bp, Homo sapiens
ggggccaatggagccaagtgtatgg

SEQ ID NO: 6285 - DNA, 25 bp, Homo sapiens
atgggtggcaagtaccgccttatgg

SEQ ID NO: 6286 - DNA, 25 bp, Homo sapiens
gcccagcgcaagacgctgtcgggct

SEQ ID NO: 6287 - DNA, 25 bp, Homo sapiens
cagcgcaagacgctgtcgggcttct

SEQ ID NO: 6288 - DNA, 25 bp, Homo sapiens
ccaccggatctgcggcggaaagcgg

SEQ ID NO: 6289 - DNA, 25 bp, Homo sapiens
caccggatctgcggcggaaagcggc

SEQ ID NO: 6290 - DNA, 25 bp, Homo sapiens
cacactggcagcccgtgtggacagt

SEQ ID NO: 6291 - DNA, 25 bp, Homo sapiens
cagcccgtgtggacagtttccacga

SEQ ID NO: 6292 - DNA, 25 bp, Homo sapiens
gcccgtgtggacagtttccacgaga

SEQ ID NO: 6293 - DNA, 25 bp, Homo sapiens
ggacagtttccacgagagcacagaa

SEQ ID NO: 6294 - DNA, 25 bp, Homo sapiens
cagtttccacgagagcacagaaggg

SEQ ID NO: 6295 - DNA, 25 bp, Homo sapiens
ccaagcaccgcatctacgagtatgt

SEQ ID NO: 6296 - DNA, 25 bp, Homo sapiens
gcaccgcatctacgagtatgtggag

SEQ ID NO: 6297 - DNA, 25 bp, Homo sapiens
cctgtgagtgggccattcggaacat

SEQ ID NO: 6298 - DNA, 25 bp, Homo sapiens
gggccattcggaacattggacagaa

SEQ ID NO: 6299 - DNA, 25 bp, Homo sapiens
gcccaaagagccaaattgtcacaat

SEQ ID NO: 6300 - DNA, 25 bp, Homo sapiens
tggaacccacattggcctgagatcc

SEQ ID NO: 6301 - DNA, 25 bp, Homo sapiens
gagatccaaaacgcttcgaggcacc

SEQ ID NO: 6302 - DNA, 25 bp, Homo sapiens
attacctgcccattcgtcaggacac

SEQ ID NO: 6303 - DNA, 25 bp, Homo sapiens
ccacccacccagtgttatattctgc

SEQ ID NO: 6304 - DNA, 25 bp, Homo sapiens
cacccagtgttatattctgcctcgc

SEQ ID NO: 6305 - DNA, 25 bp, Homo sapiens
caactcagctcctttaacgctaata

SEQ ID NO: 6306 - DNA, 25 bp, Homo sapiens
taacgctaatatttccggcaaaatc

SEQ ID NO: 6307 - DNA, 25 bp, Homo sapiens
aaatcccatgcttgggttttgtctt

SEQ ID NO: 6308 - DNA, 25 bp, Homo sapiens
cccccagagatggccagcaatcgga

SEQ ID NO: 6309 - DNA, 25 bp, Homo sapiens
caaaactgccgcaagtctgcagccc

SEQ ID NO: 6310 - DNA, 25 bp, Homo sapiens
cctgaccacggacgtttccatcagg

SEQ ID NO: 6311 - DNA, 25 bp, Homo sapiens
caggttccatcccgaaaatctctcg

SEQ ID NO: 6312 - DNA, 25 bp, Homo sapiens
cccctccatcgggctgaggaagcac

SEQ ID NO: 6313 - DNA, 25 bp, Homo sapiens
agcacagcagcatcttcaaacatgt

SEQ ID NO: 6314 - DNA, 25 bp, Homo sapiens
tccgagagggacgtgtcgacccctc

SEQ ID NO: 6315 - DNA, 25 bp, Homo sapiens
cagataccccgtgggcaagttcttc

SEQ ID NO: 6316 - DNA, 25 bp, Homo sapiens
gcaagttcttccaatatgacacctg

SEQ ID NO: 6317 - DNA, 25 bp, Homo sapiens
tatgacacctggaagcagtccaccc

SEQ ID NO: 6318 - DNA, 25 bp, Homo sapiens
ggagctcgaggcgttcagggaggcc

SEQ ID NO: 6319 - DNA, 25 bp, Homo sapiens
ccaaagtggtcagggtggcctctgg

SEQ ID NO: 6320 - DNA, 25 bp, Homo sapiens
ccctggccaggattgctacagttgt

SEQ ID NO: 6321 - DNA, 25 bp, Homo sapiens
ttggaggagttgtggccatggcggc

SEQ ID NO: 6322 - DNA, 25 bp, Homo sapiens
gttgaggatctcttactctctaagc

SEQ ID NO: 6323 - DNA, 25 bp, Homo sapiens
caagatgatgtccgcggcggccatt

SEQ ID NO: 6324 - DNA, 25 bp, Homo sapiens
ccaatgggggtggagttgcctcggg

SEQ ID NO: 6325 - DNA, 25 bp, Homo sapiens
gactctccggattgaccaagttcat

SEQ ID NO: 6326 - DNA, 25 bp, Homo sapiens
tctgccattgcggctgtcattgcga

SEQ ID NO: 6327 - DNA, 25 bp, Homo sapiens
gccacggaattaacccgagcaggca

SEQ ID NO: 6328 - DNA, 25 bp, Homo sapiens
gagccaactatcccaaatatacctg

SEQ ID NO: 6329 - DNA, 25 bp, Homo sapiens
tctcacctcatcagcagtgaccagt

SEQ ID NO: 6330 - DNA, 25 bp, Homo sapiens
tatatccccacgaaggccttcatta

SEQ ID NO: 6331 - DNA, 25 bp, Homo sapiens
cgaaggccttcattacttacgtgct

SEQ ID NO: 6332 - DNA, 25 bp, Homo sapiens
tgggatggcactgggcattcagaaa

SEQ ID NO: 6333 - DNA, 25 bp, Homo sapiens
gtgcaagcacagcgctggtgtgggt

SEQ ID NO: 6334 - DNA, 25 bp, Homo sapiens
cctgctggcctacagtggctacaaa

SEQ ID NO: 6335 - DNA, 25 bp, Homo sapiens
tgggaatgatcctcagtgtgctcac

SEQ ID NO: 6336 - DNA, 25 bp, Homo sapiens
ggctgctgttcggcagcgatggcta

SEQ ID NO: 6337 - DNA, 25 bp, Homo sapiens
ggcagcgatggctactacgtggcgc

SEQ ID NO: 6338 - DNA, 25 bp, Homo sapiens
tcatgtacttcattgtgcgctcttt

SEQ ID NO: 6339 - DNA, 25 bp, Homo sapiens
tcattgtgcgctctttgcggacagc

SEQ ID NO: 6340 - DNA, 25 bp, Homo sapiens
tccagcccctcatcatatactggct

SEQ ID NO: 6341 - DNA, 25 bp, Homo sapiens
gtcacgggatggatagccggcctgc

SEQ ID NO: 6342 - DNA, 25 bp, Homo sapiens
atattgtgaacgagccacctcctaa

SEQ ID NO: 6343 - DNA, 25 bp, Homo sapiens
catcaagaacccagcggagcgggcg

SEQ ID NO: 6344 - DNA, 25 bp, Homo sapiens
gacctgaagatgctcacaaaccaca

SEQ ID NO: 6345 - DNA, 25 bp, Homo sapiens
acaaaccacaccttcatcaagcggt

SEQ ID NO: 6346 - DNA, 25 bp, Homo sapiens
ccttcatcaagcggtccgaggtgga

SEQ ID NO: 6347 - DNA, 25 bp, Homo sapiens
gaagtggattttgccggctggttgt

SEQ ID NO: 6348 - DNA, 25 bp, Homo sapiens
tgtgtaaaaccctgcggctgaacca

SEQ ID NO: 6349 - DNA, 25 bp, Homo sapiens
acagcgcatgcaggaacgggggtct

SEQ ID NO: 6350 - DNA, 25 bp, Homo sapiens
tgctgtgtgtggtctcagaggctct

SEQ ID NO: 6351 - DNA, 25 bp, Homo sapiens
ctctgcttccttaggttacaaaaca

SEQ ID NO: 6352 - DNA, 25 bp, Homo sapiens
gagctgatgctgcccgagaaattga

SEQ ID NO: 6353 - DNA, 25 bp, Homo sapiens
aattgaggccgttgtacaaccatcc

SEQ ID NO: 6354 - DNA, 25 bp, Homo sapiens
tccagcaggtcccagaacagttttc

SEQ ID NO: 6355 - DNA, 25 bp, Homo sapiens
cagttttcttctgggctccaattat

SEQ ID NO: 6356 - DNA, 25 bp, Homo sapiens
ggttggtgtgtgctggattggctga

SEQ ID NO: 6357 - DNA, 25 bp, Homo sapiens
gattggctgatatggccagacctgc

SEQ ID NO: 6358 - DNA, 25 bp, Homo sapiens
gctcaatctgctgttttgatggcta

SEQ ID NO: 6359 - DNA, 25 bp, Homo sapiens
cctctcagctttttcgtatttggag

SEQ ID NO: 6360 - DNA, 25 bp, Homo sapiens
agaaggcactgtaactggtagctag

SEQ ID NO: 6361 - DNA, 25 bp, Homo sapiens
ctggtagctagttcttgattcaata

SEQ ID NO: 6362 - DNA, 25 bp, Homo sapiens
gtaacatttttctaccatttgtccg

SEQ ID NO: 6363 - DNA, 25 bp, Homo sapiens
ggcaccttaagaccaagccatcgga

SEQ ID NO: 6364 - DNA, 25 bp, Homo sapiens
tgctgttcatctatggccactacaa

SEQ ID NO: 6365 - DNA, 25 bp, Homo sapiens
acagaacggcccgggatgttggact

SEQ ID NO: 6366 - DNA, 25 bp, Homo sapiens
atgttggacttcacgggcaaggcca

SEQ ID NO: 6367 - DNA, 25 bp, Homo sapiens
gagagactggatttggttactgtgc

SEQ ID NO: 6368 - DNA, 25 bp, Homo sapiens
gttactgtgccatgtgtttatccta

SEQ ID NO: 6369 - DNA, 25 bp, Homo sapiens
tgccttgtttttttctaataccgtg

SEQ ID NO: 6370 - DNA, 25 bp, Homo sapiens
aaaccagctactcaaggctgctcac

SEQ ID NO: 6371 - DNA, 25 bp, Homo sapiens
ctcaccatacggctctaacagatta

SEQ ID NO: 6372 - DNA, 25 bp, Homo sapiens
tctgccaatccgggcactgggacag

SEQ ID NO: 6373 - DNA, 25 bp, Homo sapiens
aaaacgattactgactttccttgag

SEQ ID NO: 6374 - DNA, 25 bp, Homo sapiens
gatgccctatctatctgctaaagca

SEQ ID NO: 6375 - DNA, 25 bp, Homo sapiens
taggctactaagtgcattttcatca

SEQ ID NO: 6376 - DNA, 25 bp, Homo sapiens
agaaatttgtatacccacgcttcag

SEQ ID NO: 6377 - DNA, 25 bp, Homo sapiens
ccacgcttcagctactatctaatca

SEQ ID NO: 6378 - DNA, 25 bp, Homo sapiens
gctactatctaatcatcacccgaag

SEQ ID NO: 6379 - DNA, 25 bp, Homo sapiens
acattgttcatctttagtgcacttt

SEQ ID NO: 6380 - DNA, 25 bp, Homo sapiens
ggcaattagcgatatagcataccca

SEQ ID NO: 6381 - DNA, 25 bp, Homo sapiens
agatgttctcgatacagtctggcaa

SEQ ID NO: 6382 - DNA, 25 bp, Homo sapiens
ggcaaagactatcccaaggttattt

SEQ ID NO: 6383 - DNA, 25 bp, Homo sapiens
tgtggatatttctccatcctaaaaa

SEQ ID NO: 6384 - DNA, 25 bp, Homo sapiens
aattgtgctgaggcaactatggcat

SEQ ID NO: 6385 - DNA, 25 bp, Homo sapiens
caagttgcttagagagccaccaggg

SEQ ID NO: 6386 - DNA, 25 bp, Homo sapiens
gccaccagggtgatttgctgctggc

SEQ ID NO: 6387 - DNA, 25 bp, Homo sapiens
gcaatggttctgttcaatcattcag

SEQ ID NO: 6388 - DNA, 25 bp, Homo sapiens
agactgcatgttgaaacctttcttt

SEQ ID NO: 6389 - DNA, 25 bp, Homo sapiens
tgacctgtattgattgccactgtag

SEQ ID NO: 6390 - DNA, 25 bp, Homo sapiens
gccactgtagtttggtatttccctt

SEQ ID NO: 6391 - DNA, 25 bp, Homo sapiens
ttccctcatgccctggaatacaact

SEQ ID NO: 6392 - DNA, 25 bp, Homo sapiens
ggaatacaactcagagctccaggca

SEQ ID NO: 6393 - DNA, 25 bp, Homo sapiens
ggcagcggaaccatctattgttttg

SEQ ID NO: 6394 - DNA, 25 bp, Homo sapiens
agaaagtgcaccctgtatggtctcc

SEQ ID NO: 6395 - DNA, 25 bp, Homo sapiens
gtatggtctcctgtctaagttggaa

SEQ ID NO: 6396 - DNA, 25 bp, Homo sapiens
ttcctgggtcttggtcttgatgcca

SEQ ID NO: 6397 - DNA, 25 bp, Homo sapiens
agagactacctccacatcaagaata

SEQ ID NO: 6398 - DNA, 25 bp, Homo sapiens
tactcttgctattatcgctgaccct

SEQ ID NO: 6399 - DNA, 25 bp, Homo sapiens
tgcgggctcattaccaaacaggctc

SEQ ID NO: 6400 - DNA, 25 bp, Homo sapiens
aacctttggtcgacattgctgctgg

SEQ ID NO: 6401 - DNA, 25 bp, Homo sapiens
tgggaatcctgttcactggggagct

SEQ ID NO: 6402 - DNA, 25 bp, Homo sapiens
tctgggagttcttgagctttgctga

SEQ ID NO: 6403 - DNA, 25 bp, Homo sapiens
ttgctgaaaggtaccctgccatcat

SEQ ID NO: 6404 - DNA, 25 bp, Homo sapiens
atcatctataacatcctgctctttg

SEQ ID NO: 6405 - DNA, 25 bp, Homo sapiens
agttcttcacaattttggcctctgt

SEQ ID NO: 6406 - DNA, 25 bp, Homo sapiens
ccatcagccccatgcagtgggtggg

SEQ ID NO: 6407 - DNA, 25 bp, Homo sapiens
ggattctgacccattgcaggatcac

SEQ ID NO: 6408 - DNA, 25 bp, Homo sapiens
gatcttttccagttgttgatgcctt

SEQ ID NO: 6409 - DNA, 25 bp, Homo sapiens
ttgatgccttgagttttgccaacca

SEQ ID NO: 6410 - DNA, 25 bp, Homo sapiens
tggcaaatgtgatgtgctcccttcc

SEQ ID NO: 6411 - DNA, 25 bp, Homo sapiens
cccttccagctggtgagaggaggag

SEQ ID NO: 6412 - DNA, 25 bp, Homo sapiens
gagctggtcgttttgtgattaccca

SEQ ID NO: 6413 - DNA, 25 bp, Homo sapiens
agcctgagggctagttaatccaaac

SEQ ID NO: 6414 - DNA, 25 bp, Homo sapiens
aatatgtaacagccaaaccttttcg

SEQ ID NO: 6415 - DNA, 25 bp, Homo sapiens
aactcaagttatgtcatacctttgg

SEQ ID NO: 6416 - DNA, 25 bp, Homo sapiens
tcatatatcaaactaggcaccacac

SEQ ID NO: 6417 - DNA, 25 bp, Homo sapiens
accacactaagttcctgattatttt

SEQ ID NO: 6418 - DNA, 25 bp, Homo sapiens
gtatattcccaaggggccgggtgct

SEQ ID NO: 6419 - DNA, 25 bp, Homo sapiens
tggatgaagtttcgctgggtgctcg

SEQ ID NO: 6420 - DNA, 25 bp, Homo sapiens
gctcgtgactggccagttttgtgca

SEQ ID NO: 6421 - DNA, 25 bp, Homo sapiens
tttgtgcagctgactgtctcagcca

SEQ ID NO: 6422 - DNA, 25 bp, Homo sapiens
gagcagatgctgtcttgttatgtac

SEQ ID NO: 6423 - DNA, 25 bp, Homo sapiens
tttgctggtagtccgcatacccata

SEQ ID NO: 6424 - DNA, 25 bp, Homo sapiens
ccaatcagtccccatttgtagcatg

SEQ ID NO: 6425 - DNA, 25 bp, Homo sapiens
ccaccctccgagatggtcagtgtgt

SEQ ID NO: 6426 - DNA, 25 bp, Homo sapiens
gtcagtgtgtcatgggaagcccacc

SEQ ID NO: 6427 - DNA, 25 bp, Homo sapiens
tggtggccacgatgcggtacagggc

SEQ ID NO: 6428 - DNA, 25 bp, Homo sapiens
tccttcccatctacgggtgttgtca

SEQ ID NO: 6429 - DNA, 25 bp, Homo sapiens
aagtgcagcattccttaattccttc

SEQ ID NO: 6430 - DNA, 25 bp, Homo sapiens
aattccttctgctatatgtcacaca

SEQ ID NO: 6431 - DNA, 25 bp, Homo sapiens
gtaactggacttctaaagcaccttt

SEQ ID NO: 6432 - DNA, 25 bp, Homo sapiens
taaagcacctttctgtttgcctgat

SEQ ID NO: 6433 - DNA, 25 bp, Homo sapiens
ctgtttgcctgatatctactttagc

SEQ ID NO: 6434 - DNA, 25 bp, Homo sapiens
tttttacaaccctctgactcaacaa

SEQ ID NO: 6435 - DNA, 25 bp, Homo sapiens
ggccactcccaggtaaaatccaggg

SEQ ID NO: 6436 - DNA, 25 bp, Homo sapiens
agtttaccatgcagttgtttaccaa

SEQ ID NO: 6437 - DNA, 25 bp, Homo sapiens
gagtcttaacttttgctcttggatt

SEQ ID NO: 6438 - DNA, 25 bp, Homo sapiens
cacctacggcatgcctctatgtatt

SEQ ID NO: 6439 - DNA, 25 bp, Homo sapiens
gcctctatgtattggctactacagt

SEQ ID NO: 6440 - DNA, 25 bp, Homo sapiens
gaacaacgcctgtggcattgccaac

SEQ ID NO: 6441 - DNA, 25 bp, Homo sapiens
ttccatttcttccacgatggtgcag

SEQ ID NO: 6442 - DNA, 25 bp, Homo sapiens
tgagattgtctgttcagtttcccca

SEQ ID NO: 6443 - DNA, 25 bp, Homo sapiens
gtgcttcaaatgatccttcctactt

SEQ ID NO: 6444 - DNA, 25 bp, Homo sapiens
ccacccatgacctttttcactgtgg

SEQ ID NO: 6445 - DNA, 25 bp, Homo sapiens
atcaggactttccctgacagctgtg

SEQ ID NO: 6446 - DNA, 25 bp, Homo sapiens
gacagctgtgtactcttaggctaag

SEQ ID NO: 6447 - DNA, 25 bp, Homo sapiens
tgactgtgttgtcccagggctgatg

SEQ ID NO: 6448 - DNA, 25 bp, Homo sapiens
aggttagattctcattcacgggact

SEQ ID NO: 6449 - DNA, 25 bp, Homo sapiens
aagttcccttctatatcctcaaggt

SEQ ID NO: 6450 - DNA, 25 bp, Homo sapiens
atgtctatgttttctactccaattc

SEQ ID NO: 6451 - DNA, 25 bp, Homo sapiens
tcatgtttgatggacccgaggcctg

SEQ ID NO: 6452 - DNA, 25 bp, Homo sapiens
gtggaggaacgcatgtgggctgcca

SEQ ID NO: 6453 - DNA, 25 bp, Homo sapiens
ggctgccatccagagctgggacata

SEQ ID NO: 6454 - DNA, 25 bp, Homo sapiens
ttaagatggcgaccgcacggcagga

SEQ ID NO: 6455 - DNA, 25 bp, Homo sapiens
ggagaccaaggaaatggcccgcaag

SEQ ID NO: 6456 - DNA, 25 bp, Homo sapiens
ggcccgcaaggtgattgagcactgc

SEQ ID NO: 6457 - DNA, 25 bp, Homo sapiens
gacacgtctagatagaggcctccgt

SEQ ID NO: 6458 - DNA, 25 bp, Homo sapiens
ccgctctggaccacaggcggggagg

SEQ ID NO: 6459 - DNA, 25 bp, Homo sapiens
gaggaagcatgctcaagcagcccag

SEQ ID NO: 6460 - DNA, 25 bp, Homo sapiens
gacatgggggacttttgcacaaccg

SEQ ID NO: 6461 - DNA, 25 bp, Homo sapiens
ccgacgcttttccttaatgttagtg

SEQ ID NO: 6462 - DNA, 25 bp, Homo sapiens
aaatggctgtatcggcctgtatggg

SEQ ID NO: 6463 - DNA, 25 bp, Homo sapiens
ggcctgtatgggactgtaatgcgct

SEQ ID NO: 6464 - DNA, 25 bp, Homo sapiens
gtaatgcgcttagtggtctgacata

SEQ ID NO: 6465 - DNA, 25 bp, Homo sapiens
atactggcgtactttatattctcta

SEQ ID NO: 6466 - DNA, 25 bp, Homo sapiens
ttctgttctgtcatgtgccacaaaa

SEQ ID NO: 6467 - DNA, 25 bp, Homo sapiens
acgggttacaactggttcattctga

SEQ ID NO: 6468 - DNA, 25 bp, Homo sapiens
gtgcccaagtaattcactacagcct

SEQ ID NO: 6469 - DNA, 25 bp, Homo sapiens
tcactacagcctaaagccttgcctt

SEQ ID NO: 6470 - DNA, 25 bp, Homo sapiens
agccttgcctttgtaatttgacttc

SEQ ID NO: 6471 - DNA, 25 bp, Homo sapiens
taatttgacttctgacatgttggca

SEQ ID NO: 6472 - DNA, 25 bp, Homo sapiens
gttggcaatcaaagcatgcacttgt

SEQ ID NO: 6473 - DNA, 25 bp, Homo sapiens
ccagcgggtctggggtctatgtgag

SEQ ID NO: 6474 - DNA, 25 bp, Homo sapiens
gggtggacatgaatggttccccaca

SEQ ID NO: 6475 - DNA, 25 bp, Homo sapiens
gttccccacaggatttcaacgtggc

SEQ ID NO: 6476 - DNA, 25 bp, Homo sapiens
aacgtggctgtcagaatcactcctc

SEQ ID NO: 6477 - DNA, 25 bp, Homo sapiens
agaatcactcctctcaaatatgccc

SEQ ID NO: 6478 - DNA, 25 bp, Homo sapiens
gaggggtgacacagtgttccctcct

SEQ ID NO: 6479 - DNA, 25 bp, Homo sapiens
gcagcaattaagggtcttcatgttc

SEQ ID NO: 6480 - DNA, 25 bp, Homo sapiens
gttttttgtcattggcgtgcacacg

SEQ ID NO: 6481 - DNA, 25 bp, Homo sapiens
taatcttttacctatttcttacaat

SEQ ID NO: 6482 - DNA, 25 bp, Homo sapiens
gcaagatgactggctttactatttg

SEQ ID NO: 6483 - DNA, 25 bp, Homo sapiens
taagttaatcttcacgtttttgcaa

SEQ ID NO: 6484 - DNA, 25 bp, Homo sapiens
caaagcagtgccgccggacaggcac

SEQ ID NO: 6485 - DNA, 25 bp, Homo sapiens
gacaggcaccttgcagagcaacttc

SEQ ID NO: 6486 - DNA, 25 bp, Homo sapiens
agtccatggttcgggagccagggga

SEQ ID NO: 6487 - DNA, 25 bp, Homo sapiens
gactgtcagtcttattggtgcttat

SEQ ID NO: 6488 - DNA, 25 bp, Homo sapiens
tccctgaagttttacgtgccttgca

SEQ ID NO: 6489 - DNA, 25 bp, Homo sapiens
gttatctgctgatgggccaggtaga

SEQ ID NO: 6490 - DNA, 25 bp, Homo sapiens
agaagagaacagaggccccgtcctt

SEQ ID NO: 6491 - DNA, 25 bp, Homo sapiens
cagagagctttgtggttctccaccg

SEQ ID NO: 6492 - DNA, 25 bp, Homo sapiens
agcaagaggaagtgcccctctcaac

SEQ ID NO: 6493 - DNA, 25 bp, Homo sapiens
ctgctgcgtcccaggactgagacgc

SEQ ID NO: 6494 - DNA, 25 bp, Homo sapiens
actgagcctaaagtcaagctgcccc

SEQ ID NO: 6495 - DNA, 25 bp, Homo sapiens
aaggcggcatctatgacttcattgg

SEQ ID NO: 6496 - DNA, 25 bp, Homo sapiens
ccttgtcatgtcccggaatgccggc

SEQ ID NO: 6497 - DNA, 25 bp, Homo sapiens
tgctgagcttattatgtcccgctgc

SEQ ID NO: 6498 - DNA, 25 bp, Homo sapiens
agcccggggcattgagtttgactgg

SEQ ID NO: 6499 - DNA, 25 bp, Homo sapiens
atcagtctgggtccatacatcgtcg

SEQ ID NO: 6500 - DNA, 25 bp, Homo sapiens
cgcgtctgctcaggtctggatgata

SEQ ID NO: 6501 - DNA, 25 bp, Homo sapiens
taacacgctatgatctgtaccacac

SEQ ID NO: 6502 - DNA, 25 bp, Homo sapiens
ctcctgctgatgttcctcagagttt

SEQ ID NO: 6503 - DNA, 25 bp, Homo sapiens
tatggagacgtttgtccacctatgc

SEQ ID NO: 6504 - DNA, 25 bp, Homo sapiens
ttgccgttgtcaatgtgcactccta

SEQ ID NO: 6505 - DNA, 25 bp, Homo sapiens
tcctaggcttggtgtctcagacatt

SEQ ID NO: 6506 - DNA, 25 bp, Homo sapiens
tggacacctgcctgaaggactgcat

SEQ ID NO: 6507 - DNA, 25 bp, Homo sapiens
tctgtgtgcgtcatgttcaccaact

SEQ ID NO: 6508 - DNA, 25 bp, Homo sapiens
ggagctcgccaggaagcacctggct

SEQ ID NO: 6509 - DNA, 25 bp, Homo sapiens
gcacgcagacactgtgcagctggtg

SEQ ID NO: 6510 - DNA, 25 bp, Homo sapiens
cccggctgagcatctatagcaccag

SEQ ID NO: 6511 - DNA, 25 bp, Homo sapiens
gcaccagtgactgtgagcacggcat

SEQ ID NO: 6512 - DNA, 25 bp, Homo sapiens
tcatctccaggcttgacttcaatgg

SEQ ID NO: 6513 - DNA, 25 bp, Homo sapiens
ttcaatggtttctacacggagcgcc

SEQ ID NO: 6514 - DNA, 25 bp, Homo sapiens
cagagaggagccagaaggccacccc

SEQ ID NO: 6515 - DNA, 25 bp, Homo sapiens
cgcacagtgagccctggctgtgaca

SEQ ID NO: 6516 - DNA, 25 bp, Homo sapiens
gaaggaagggtgtggggtcagcagg

SEQ ID NO: 6517 - DNA, 25 bp, Homo sapiens
tccctcttctcactttggggactgt

SEQ ID NO: 6518 - DNA, 25 bp, Homo sapiens
tctcactttggggactgttcccatc

SEQ ID NO: 6519 - DNA, 25 bp, Homo sapiens
cctctggagcttacactgttctggg

SEQ ID NO: 6520 - DNA, 25 bp, Homo sapiens
gagcttacactgttctggggtttgt

SEQ ID NO: 6521 - DNA, 25 bp, Homo sapiens
tgttctggggtttgttctctaccct

SEQ ID NO: 6522 - DNA, 25 bp, Homo sapiens
cagacatgtgacatcagactgcggg

SEQ ID NO: 6523 - DNA, 25 bp, Homo sapiens
caagctgctggtaaatgtagacgag

SEQ ID NO: 6524 - DNA, 25 bp, Homo sapiens
aggactatgagctgggccgacagaa

SEQ ID NO: 6525 - DNA, 25 bp, Homo sapiens
atgagctgggccgacagaaactcct

SEQ ID NO: 6526 - DNA, 25 bp, Homo sapiens
ggaacttgatgctgcaagcattgcc

SEQ ID NO: 6527 - DNA, 25 bp, Homo sapiens
tgatgctgcaagcattgccctgacc

SEQ ID NO: 6528 - DNA, 25 bp, Homo sapiens
ggtgagcaggacagctcctgtcccc

SEQ ID NO: 6529 - DNA, 25 bp, Homo sapiens
tgtccccagcgaagaatccggctgc

SEQ ID NO: 6530 - DNA, 25 bp, Homo sapiens
tgatgggtgtaactgacccccacag

SEQ ID NO: 6531 - DNA, 25 bp, Homo sapiens
tgcttctcaagtctaaccagcctca

SEQ ID NO: 6532 - DNA, 25 bp, Homo sapiens
cagcagtgtgcatagaccatttcca

SEQ ID NO: 6533 - DNA, 25 bp, Homo sapiens
ccatggacaatgcatgccctcgtta

SEQ ID NO: 6534 - DNA, 25 bp, Homo sapiens
gcatgccctcgttatcttgaaaagc

SEQ ID NO: 6535 - DNA, 25 bp, Homo sapiens
cttccacaggctgcactcgaggaga

SEQ ID NO: 6536 - DNA, 25 bp, Homo sapiens
gatccacaaattctcaggaacctac

SEQ ID NO: 6537 - DNA, 25 bp, Homo sapiens
aggaacctacacctgcatgaacact

SEQ ID NO: 6538 - DNA, 25 bp, Homo sapiens
tgaggagccacggagtttgggggcc

SEQ ID NO: 6539 - DNA, 25 bp, Homo sapiens
tttcctgtgggccgcatccacagac

SEQ ID NO: 6540 - DNA, 25 bp, Homo sapiens
gacacttgaagactcgcaccacaag

SEQ ID NO: 6541 - DNA, 25 bp, Homo sapiens
actcgcaccacaagccatggaaggg

SEQ ID NO: 6542 - DNA, 25 bp, Homo sapiens
catggaagggtgggtgccactgctg

SEQ ID NO: 6543 - DNA, 25 bp, Homo sapiens
gtgctgcgattctggagtacctcac

SEQ ID NO: 6544 - DNA, 25 bp, Homo sapiens
gagtacctcactgcagaggtgctgg

SEQ ID NO: 6545 - DNA, 25 bp, Homo sapiens
gctggagctggcaggtaatgcttct

SEQ ID NO: 6546 - DNA, 25 bp, Homo sapiens
agtaaagcgtatcactccgcgtcac

SEQ ID NO: 6547 - DNA, 25 bp, Homo sapiens
gttggattctcttatcaaggctacc

SEQ ID NO: 6548 - DNA, 25 bp, Homo sapiens
atcaaggctaccatagctgggggtg

SEQ ID NO: 6549 - DNA, 25 bp, Homo sapiens
ctaaggcagtatctcgctcacagag

SEQ ID NO: 6550 - DNA, 25 bp, Homo sapiens
ttttcctcccttgggttctgatatt

SEQ ID NO: 6551 - DNA, 25 bp, Homo sapiens
ggttctgatattgccgcactagggg

SEQ ID NO: 6552 - DNA, 25 bp, Homo sapiens
ccccaacctcagacttaccaggaag

SEQ ID NO: 6553 - DNA, 25 bp, Homo sapiens
gagtgtggaagccggagggtgttta

SEQ ID NO: 6554 - DNA, 25 bp, Homo sapiens
ttatgtaagagcaccttcctcactt

SEQ ID NO: 6555 - DNA, 25 bp, Homo sapiens
ctcacttccatacagctctacgtgg

SEQ ID NO: 6556 - DNA, 25 bp, Homo sapiens
gatacatgtgccgaatgtgcaggtt

SEQ ID NO: 6557 - DNA, 25 bp, Homo sapiens
gatgtggtgcctgaggtctgtacgt

SEQ ID NO: 6558 - DNA, 25 bp, Homo sapiens
ggtctgtacgttacctcttaacaat

SEQ ID NO: 6559 - DNA, 25 bp, Homo sapiens
acctcttaacaatttctgtccttca

SEQ ID NO: 6560 - DNA, 25 bp, Homo sapiens
gatggaaactctttaacttctcgta

SEQ ID NO: 6561 - DNA, 25 bp, Homo sapiens
aaaaatgcacatagctatcgagtgt

SEQ ID NO: 6562 - DNA, 25 bp, Homo sapiens
gctatcgagtgtgctttagcttgaa

SEQ ID NO: 6563 - DNA, 25 bp, Homo sapiens
gctttagcttgaaaaggtgaccttg

SEQ ID NO: 6564 - DNA, 25 bp, Homo sapiens
ccttgcaacttcatgtcaactttct

SEQ ID NO: 6565 - DNA, 25 bp, Homo sapiens
caacttcatgtcaactttctggctc

SEQ ID NO: 6566 - DNA, 25 bp, Homo sapiens
tggctcctcaaacagtaggttggca

SEQ ID NO: 6567 - DNA, 25 bp, Homo sapiens
aaacagtaggttggcagtaaggcag

SEQ ID NO: 6568 - DNA, 25 bp, Homo sapiens
gcagtaaggcagggtcccatttctc

SEQ ID NO: 6569 - DNA, 25 bp, Homo sapiens
agtaaggcagggtcccatttctcac

SEQ ID NO: 6570 - DNA, 25 bp, Homo sapiens
tccatatggattttctattgttact

SEQ ID NO: 6571 - DNA, 25 bp, Homo sapiens
ggattttctattgttactctggttc

SEQ ID NO: 6572 - DNA, 25 bp, Homo sapiens
cagccacaaaactgtcattcactct

SEQ ID NO: 6573 - DNA, 25 bp, Homo sapiens
tcattcactctaggggacccctact

SEQ ID NO: 6574 - DNA, 25 bp, Homo sapiens
acttcaggtgtgcagccctgagctc

SEQ ID NO: 6575 - DNA, 25 bp, Homo sapiens
catgccacacacttgctgtaaggct

SEQ ID NO: 6576 - DNA, 25 bp, Homo sapiens
gaatcatggttctgcagtctggtgt

SEQ ID NO: 6577 - DNA, 25 bp, Homo sapiens
aatctatgactcccaatatcttcta

SEQ ID NO: 6578 - DNA, 25 bp, Homo sapiens
aacacaagggccctccttgtcattg

SEQ ID NO: 6579 - DNA, 25 bp, Homo sapiens
ccctccttgtcattgaccttagcta

SEQ ID NO: 6580 - DNA, 25 bp, Homo sapiens
gaccttagctaaaccatggcaattc

SEQ ID NO: 6581 - DNA, 25 bp, Homo sapiens
ttgacagatggtatcccttcctgga

SEQ ID NO: 6582 - DNA, 25 bp, Homo sapiens
ctggatcattcatttcaccttggtt

SEQ ID NO: 6583 - DNA, 25 bp, Homo sapiens
ggaaacctctcagtgtcttgacatc

SEQ ID NO: 6584 - DNA, 25 bp, Homo sapiens
ttagccaagatattcctctgttccc

SEQ ID NO: 6585 - DNA, 25 bp, Homo sapiens
ctctgttccctctgctgagataaag

SEQ ID NO: 6586 - DNA, 25 bp, Homo sapiens
taatccacccatgcaaatagctact

SEQ ID NO: 6587 - DNA, 25 bp, Homo sapiens
aaatagctactggcccagctaccat

SEQ ID NO: 6588 - DNA, 25 bp, Homo sapiens
ctaccatttaccatttgcctacaga

SEQ ID NO: 6589 - DNA, 25 bp, Homo sapiens
ttcagtctacactttggcattctct

SEQ ID NO: 6590 - DNA, 25 bp, Homo sapiens
ggcattctctctggcgatggagtgt

SEQ ID NO: 6591 - DNA, 25 bp, Homo sapiens
ggctgggctgaccgcaaaaggtgcc

SEQ ID NO: 6592 - DNA, 25 bp, Homo sapiens
gcaaaaggtgccttacacactgccc

SEQ ID NO: 6593 - DNA, 25 bp, Homo sapiens
ttaccccccatgttgcatatcaggg

SEQ ID NO: 6594 - DNA, 25 bp, Homo sapiens
tttactgtgcaataactgattcatt

SEQ ID NO: 6595 - DNA, 25 bp, Homo sapiens
cagagcttgaagcatccaatgattt

SEQ ID NO: 6596 - DNA, 25 bp, Homo sapiens
ccctccactgctgttaattaatgtc

SEQ ID NO: 6597 - DNA, 25 bp, Homo sapiens
acaactacttaatgtacttacactg

SEQ ID NO: 6598 - DNA, 25 bp, Homo sapiens
acttacactgtaagccttgttgctt

SEQ ID NO: 6599 - DNA, 25 bp, Homo sapiens
gccttgttgctttacccaagacaaa

SEQ ID NO: 6600 - DNA, 25 bp, Homo sapiens
ggaaatgtgccttatgttaaacact

SEQ ID NO: 6601 - DNA, 25 bp, Homo sapiens
ttactttttgcattgtccagacttc

SEQ ID NO: 6602 - DNA, 25 bp, Homo sapiens
gcattgtccagacttctttattaga

SEQ ID NO: 6603 - DNA, 25 bp, Homo sapiens
taatggggcctatgacttgaatgaa

SEQ ID NO: 6604 - DNA, 25 bp, Homo sapiens
atttagatttgttctcctcatacat

SEQ ID NO: 6605 - DNA, 25 bp, Homo sapiens
gtcgtctttctattttcaggtcagc

SEQ ID NO: 6606 - DNA, 25 bp, Homo sapiens
ggtcagctgattagccaccttagtt

SEQ ID NO: 6607 - DNA, 25 bp, Homo sapiens
caactttagttcccactggctgtgt

SEQ ID NO: 6608 - DNA, 25 bp, Homo sapiens
gtcacgtggacatctttgggaggcc

SEQ ID NO: 6609 - DNA, 25 bp, Homo sapiens
tttgggaggccgttattctgcccac

SEQ ID NO: 6610 - DNA, 25 bp, Homo sapiens
cctcgctctaccccaggaaaatgtg

SEQ ID NO: 6611 - DNA, 25 bp, Homo sapiens
aaatgtgagctcgttttcctgctcg

SEQ ID NO: 6612 - DNA, 25 bp, Homo sapiens
ctgaaagttccttctcagcctgaga

SEQ ID NO: 6613 - DNA, 25 bp, Homo sapiens
tgagtcaggatttggggccggctct

SEQ ID NO: 6614 - DNA, 25 bp, Homo sapiens
ttttcccaggtactgccttacaaag

SEQ ID NO: 6615 - DNA, 25 bp, Homo sapiens
gatgcccaaggtctttgtacgtgtg

SEQ ID NO: 6616 - DNA, 25 bp, Homo sapiens
ctttgagcaactgtgcacgcttcag

SEQ ID NO: 6617 - DNA, 25 bp, Homo sapiens
ggtttggccagtgtattactctcaa

SEQ ID NO: 6618 - DNA, 25 bp, Homo sapiens
tgtattactctcaagtccttttctc

SEQ ID NO: 6619 - DNA, 25 bp, Homo sapiens
tttctcaatcaacttctatcatcaa

SEQ ID NO: 6620 - DNA, 25 bp, Homo sapiens
ttcattttttcctcaacattcttaa

SEQ ID NO: 6621 - DNA, 25 bp, Homo sapiens
ttttttcccaggacatttgctagga

SEQ ID NO: 6622 - DNA, 25 bp, Homo sapiens
tctacttgagcaacactatcgtgtc

SEQ ID NO: 6623 - DNA, 25 bp, Homo sapiens
tgaggccatgttcaggtgctaagga

SEQ ID NO: 6624 - DNA, 25 bp, Homo sapiens
ggaagttcgccttttacacagaaga

SEQ ID NO: 6625 - DNA, 25 bp, Homo sapiens
ggagtccaattcatagcctaaaact

SEQ ID NO: 6626 - DNA, 25 bp, Homo sapiens
tttacccacaatagctgcctatttt

SEQ ID NO: 6627 - DNA, 25 bp, Homo sapiens
gcttgcagactatttctctttggaa

SEQ ID NO: 6628 - DNA, 25 bp, Homo sapiens
attaccccttctgattgacaactat

SEQ ID NO: 6629 - DNA, 25 bp, Homo sapiens
actatgtgccccctttggagggact

SEQ ID NO: 6630 - DNA, 25 bp, Homo sapiens
ttggagggactgcctatcttcattc

SEQ ID NO: 6631 - DNA, 25 bp, Homo sapiens
attcttcgactagccactgaggtga

SEQ ID NO: 6632 - DNA, 25 bp, Homo sapiens
gaatgcgctatgttctattccatcc

SEQ ID NO: 6633 - DNA, 25 bp, Homo sapiens
gtctataaagccttgcgctcacaca

SEQ ID NO: 6634 - DNA, 25 bp, Homo sapiens
aaatatcctgcagcttgctaacctg

SEQ ID NO: 6635 - DNA, 25 bp, Homo sapiens
tgctaacctgcctgatctatacaaa

SEQ ID NO: 6636 - DNA, 25 bp, Homo sapiens
gcactgtgggatgtgttcttctttc

SEQ ID NO: 6637 - DNA, 25 bp, Homo sapiens
aagacttatacttgccttctgatag

SEQ ID NO: 6638 - DNA, 25 bp, Homo sapiens
cctcccccactggagtgatttcagt

SEQ ID NO: 6639 - DNA, 25 bp, Homo sapiens
gtaggatcactactgcattgcaata

SEQ ID NO: 6640 - DNA, 25 bp, Homo sapiens
ttgcaataccctgttatcctcagca

SEQ ID NO: 6641 - DNA, 25 bp, Homo sapiens
caaaacccacatttcatacatcctt

SEQ ID NO: 6642 - DNA, 25 bp, Homo sapiens
ctctctgggcactgttgtaagatag

SEQ ID NO: 6643 - DNA, 25 bp, Homo sapiens
aataaagagtctagccctctccttt

SEQ ID NO: 6644 - DNA, 25 bp, Homo sapiens
ctagccctctccttttaatgaactt

SEQ ID NO: 6645 - DNA, 25 bp, Homo sapiens
taatgaacttaactctcgctggcat

SEQ ID NO: 6646 - DNA, 25 bp, Homo sapiens
ctctcgctggcatctgtagtatcat

SEQ ID NO: 6647 - DNA, 25 bp, Homo sapiens
ttgggagcttaggcgcacatggaaa

SEQ ID NO: 6648 - DNA, 25 bp, Homo sapiens
tacctagtttacttgccagtctctt

SEQ ID NO: 6649 - DNA, 25 bp, Homo sapiens
ctcagcgagcactgagctggcccta

SEQ ID NO: 6650 - DNA, 25 bp, Homo sapiens
tggccctacttccaggatggatgca

SEQ ID NO: 6651 - DNA, 25 bp, Homo sapiens
gatggatgcatcacactcaaggaca

SEQ ID NO: 6652 - DNA, 25 bp, Homo sapiens
ttgagcccattcttctgggtgtgct

SEQ ID NO: 6653 - DNA, 25 bp, Homo sapiens
gtgctttttgggaccatcactgaga

SEQ ID NO: 6654 - DNA, 25 bp, Homo sapiens
gagagtcaggagttttactgcctgt

SEQ ID NO: 6655 - DNA, 25 bp, Homo sapiens
tactgcctgtagcaatggccagagc

SEQ ID NO: 6656 - DNA, 25 bp, Homo sapiens
ttggccgagctcctggggagctcct

SEQ ID NO: 6657 - DNA, 25 bp, Homo sapiens
gcctgcccagactgatgagcacatc

SEQ ID NO: 6658 - DNA, 25 bp, Homo sapiens
agactgatgagcacatctctctgcc

SEQ ID NO: 6659 - DNA, 25 bp, Homo sapiens
acctttgtgcagcttcgaggacagg

SEQ ID NO: 6660 - DNA, 25 bp, Homo sapiens
aagtcacttccagtgttggctgtgt

SEQ ID NO: 6661 - DNA, 25 bp, Homo sapiens
accccctgagtcaactggagcaaga

SEQ ID NO: 6662 - DNA, 25 bp, Homo sapiens
ggaggcagactgatggcgattccct

SEQ ID NO: 6663 - DNA, 25 bp, Homo sapiens
gactctccccctttcaaggaaagtg

SEQ ID NO: 6664 - DNA, 25 bp, Homo sapiens
tattgcagttcaaatcctcaccatc

SEQ ID NO: 6665 - DNA, 25 bp, Homo sapiens
aatgctcgtgtgatttcctacagaa

SEQ ID NO: 6666 - DNA, 25 bp, Homo sapiens
gtgttaggaggctgcatgctctgga

SEQ ID NO: 6667 - DNA, 25 bp, Homo sapiens
catgctctggaagcctggactctaa

SEQ ID NO: 6668 - DNA, 25 bp, Homo sapiens
tggactctaagctggagctcttgga

SEQ ID NO: 6669 - DNA, 25 bp, Homo sapiens
ggaagagctcttcggtttctgagca

SEQ ID NO: 6670 - DNA, 25 bp, Homo sapiens
ccatctcctgatttctctgaacaga

SEQ ID NO: 6671 - DNA, 25 bp, Homo sapiens
agcataatacactgtttttctcaac

SEQ ID NO: 6672 - DNA, 25 bp, Homo sapiens
ataatgatgtgactgcttagcccct

SEQ ID NO: 6673 - DNA, 25 bp, Homo sapiens
gtgactgcttagcccctaaatatgg

SEQ ID NO: 6674 - DNA, 25 bp, Homo sapiens
agcccctaaatatggtaactactct

SEQ ID NO: 6675 - DNA, 25 bp, Homo sapiens
gtaactactctgggacaatatggga

SEQ ID NO: 6676 - DNA, 25 bp, Homo sapiens
gctaatcctcatctgtcatatccag

SEQ ID NO: 6677 - DNA, 25 bp, Homo sapiens
taggagggatggggcaggggactgt

SEQ ID NO: 6678 - DNA, 25 bp, Homo sapiens
gaatgaaaagtatttgcctctggaa

SEQ ID NO: 6679 - DNA, 25 bp, Homo sapiens
ctggcaggactgttgttttcattgt

SEQ ID NO: 6680 - DNA, 25 bp, Homo sapiens
attgtaagacttttggagccattta

SEQ ID NO: 6681 - DNA, 25 bp, Homo sapiens
gtacttaaccattttcatctatttc

SEQ ID NO: 6682 - DNA, 25 bp, Homo sapiens
aaatgcttccactaccaaaagacat

SEQ ID NO: 6683 - DNA, 25 bp, Homo sapiens
agctggaagtgccgactctaagcca

SEQ ID NO: 6684 - DNA, 25 bp, Homo sapiens
taagccaatagatgtttcccgtctg

SEQ ID NO: 6685 - DNA, 25 bp, Homo sapiens
tcccgtctggatcttcgaattggtt

SEQ ID NO: 6686 - DNA, 25 bp, Homo sapiens
ggacagttgtcagtggcctggtgaa

SEQ ID NO: 6687 - DNA, 25 bp, Homo sapiens
cctggtgaatcatgttcctcttgaa

SEQ ID NO: 6688 - DNA, 25 bp, Homo sapiens
gaaaattgaaatcttggctcctcca

SEQ ID NO: 6689 - DNA, 25 bp, Homo sapiens
tcctccaaatgggtctgttcctgga

SEQ ID NO: 6690 - DNA, 25 bp, Homo sapiens
atgctttcccaggagagcctgacaa

SEQ ID NO: 6691 - DNA, 25 bp, Homo sapiens
cagcctgatcttcacactaatgatg

SEQ ID NO: 6692 - DNA, 25 bp, Homo sapiens
gtggctacatacaaaggagttccct

SEQ ID NO: 6693 - DNA, 25 bp, Homo sapiens
gtatcttctttggtttcctgtatct

SEQ ID NO: 6694 - DNA, 25 bp, Homo sapiens
gaaactatgttcatcagtcactcat

SEQ ID NO: 6695 - DNA, 25 bp, Homo sapiens
aattatgactgttagcttttctcct

SEQ ID NO: 6696 - DNA, 25 bp, Homo sapiens
cttttctccttatagcatcttagtc

SEQ ID NO: 6697 - DNA, 25 bp, Homo sapiens
cacctcaatgtcctgtgaacactaa

SEQ ID NO: 6698 - DNA, 25 bp, Homo sapiens
aaatgtgttaatactgtgcctttga

SEQ ID NO: 6699 - DNA, 25 bp, Homo sapiens
tgtgcctttgatttgttagctttaa

SEQ ID NO: 6700 - DNA, 25 bp, Homo sapiens
taagacttttacactgccagtattc

SEQ ID NO: 6701 - DNA, 25 bp, Homo sapiens
cactgccagtattccacatttggtg

SEQ ID NO: 6702 - DNA, 25 bp, Homo sapiens
atagcgtattatcacttgtcaaatc

SEQ ID NO: 6703 - DNA, 25 bp, Homo sapiens
ttgagtgacccagtattgagccatg

SEQ ID NO: 6704 - DNA, 25 bp, Homo sapiens
atcgcccctgagatcctacagggcc

SEQ ID NO: 6705 - DNA, 25 bp, Homo sapiens
agggcctgaagtacacattctctgt

SEQ ID NO: 6706 - DNA, 25 bp, Homo sapiens
gtacgagatgctcattggccagtcc

SEQ ID NO: 6707 - DNA, 25 bp, Homo sapiens
ggatgaactcttcgagtccatccgt

SEQ ID NO: 6708 - DNA, 25 bp, Homo sapiens
ccatccgtgtggacacgccacatta

SEQ ID NO: 6709 - DNA, 25 bp, Homo sapiens
cccgctggatcaccaaggagtccaa

SEQ ID NO: 6710 - DNA, 25 bp, Homo sapiens
gaaaagcggaggttggagccaccct

SEQ ID NO: 6711 - DNA, 25 bp, Homo sapiens
gagttcctgaacgagaaggcgcgcc

SEQ ID NO: 6712 - DNA, 25 bp, Homo sapiens
ctcctacagcgacaagaacctcatc

SEQ ID NO: 6713 - DNA, 25 bp, Homo sapiens
tcatcgactccatggaccagtctgc

SEQ ID NO: 6714 - DNA, 25 bp, Homo sapiens
atggaccagtctgcattcgctggct

SEQ ID NO: 6715 - DNA, 25 bp, Homo sapiens
gttacggcattgccttttctttctg

SEQ ID NO: 6716 - DNA, 25 bp, Homo sapiens
ttctgtggatccagtatcttcctcg

SEQ ID NO: 6717 - DNA, 25 bp, Homo sapiens
atcttcctcggctttttagggagca

SEQ ID NO: 6718 - DNA, 25 bp, Homo sapiens
aaacctgccctgttgtatataactg

SEQ ID NO: 6719 - DNA, 25 bp, Homo sapiens
aactgtgtctgtttcaccgtgtgac

SEQ ID NO: 6720 - DNA, 25 bp, Homo sapiens
gccacgatttgcccgagggttactc

SEQ ID NO: 6721 - DNA, 25 bp, Homo sapiens
cctttgctctcaccttgtatggatg

SEQ ID NO: 6722 - DNA, 25 bp, Homo sapiens
gatgaagccatttcttatcctgtag

SEQ ID NO: 6723 - DNA, 25 bp, Homo sapiens
gtagcatcagaagctcgttccttca

SEQ ID NO: 6724 - DNA, 25 bp, Homo sapiens
cacactcagtggcgtctgtgcttgt

SEQ ID NO: 6725 - DNA, 25 bp, Homo sapiens
cacccagggcgcctgttgacaagtg

SEQ ID NO: 6726 - DNA, 25 bp, Homo sapiens
ttaatgctgcgtgctgctgaactct

SEQ ID NO: 6727 - DNA, 25 bp, Homo sapiens
tgggtgaactggtattgctgctgga

SEQ ID NO: 6728 - DNA, 25 bp, Homo sapiens
cctctgtctctggagagtctggtca

SEQ ID NO: 6729 - DNA, 25 bp, Homo sapiens
gacagtcaactctaggttacctttt

SEQ ID NO: 6730 - DNA, 25 bp, Homo sapiens
gagtagtcagtcttctagattgttc

SEQ ID NO: 6731 - DNA, 25 bp, Homo sapiens
tagattgttcttataccacctctca

SEQ ID NO: 6732 - DNA, 25 bp, Homo sapiens
ttggggacctagcctggagtcagga

SEQ ID NO: 6733 - DNA, 25 bp, Homo sapiens
tagaagcgagggcaccagcagttgt

SEQ ID NO: 6734 - DNA, 25 bp, Homo sapiens
gagagaaactcttcagcgaatcctt

SEQ ID NO: 6735 - DNA, 25 bp, Homo sapiens
cagcgaatccttctagtactagttg

SEQ ID NO: 6736 - DNA, 25 bp, Homo sapiens
agaccaacccagttctgtttgacta

SEQ ID NO: 6737 - DNA, 25 bp, Homo sapiens
catcctgtccgtaaggggtcagcgc

SEQ ID NO: 6738 - DNA, 25 bp, Homo sapiens
ctacatcgctcgcaagcacaacatg

SEQ ID NO: 6739 - DNA, 25 bp, Homo sapiens
tccgcacacaactgataaggctctg

SEQ ID NO: 6740 - DNA, 25 bp, Homo sapiens
tctgttacagctctgaccacgaaaa

SEQ ID NO: 6741 - DNA, 25 bp, Homo sapiens
tgccggggaaaagctcacctttgtg

SEQ ID NO: 6742 - DNA, 25 bp, Homo sapiens
cagaaccgtatatttgaccccaagt

SEQ ID NO: 6743 - DNA, 25 bp, Homo sapiens
gaccccaagtgcctggatgagttcc

SEQ ID NO: 6744 - DNA, 25 bp, Homo sapiens
aacctgaaggctttcatgtgccgtt

SEQ ID NO: 6745 - DNA, 25 bp, Homo sapiens
atcgctgcctacttacagtctgatc

SEQ ID NO: 6746 - DNA, 25 bp, Homo sapiens
gcccagtggggcaacaagcctgtat

SEQ ID NO: 6747 - DNA, 25 bp, Homo sapiens
tgcagagcttgttttgtttcatcct

SEQ ID NO: 6748 - DNA, 25 bp, Homo sapiens
gagccattggaagactgtcctctat

SEQ ID NO: 6749 - DNA, 25 bp, Homo sapiens
ggcaatgatctcagggctcagtggc

SEQ ID NO: 6750 - DNA, 25 bp, Homo sapiens
accagcccgctcaatgcagaaaaac

SEQ ID NO: 6751 - DNA, 25 bp, Homo sapiens
atttctctaagaccattcgcgattt

SEQ ID NO: 6752 - DNA, 25 bp, Homo sapiens
cagaccccgaggttgtctggttcaa

SEQ ID NO: 6753 - DNA, 25 bp, Homo sapiens
tgaccagtcaatcagggagtcccgc

SEQ ID NO: 6754 - DNA, 25 bp, Homo sapiens
ccgccacttccagatagactacgat

SEQ ID NO: 6755 - DNA, 25 bp, Homo sapiens
ggacgggaactgctctttaattatt

SEQ ID NO: 6756 - DNA, 25 bp, Homo sapiens
gggatgacgatgccaagtacacctg

SEQ ID NO: 6757 - DNA, 25 bp, Homo sapiens
gtacacctgcaaggctgtcaacagt

SEQ ID NO: 6758 - DNA, 25 bp, Homo sapiens
acagtcttggagaagccacctgcac

SEQ ID NO: 6759 - DNA, 25 bp, Homo sapiens
gcatgcaggactgccagcgggagct

SEQ ID NO: 6760 - DNA, 25 bp, Homo sapiens
agctccagagcctgctggtggagga

SEQ ID NO: 6761 - DNA, 25 bp, Homo sapiens
ccctcctcatctttgctaataagca

SEQ ID NO: 6762 - DNA, 25 bp, Homo sapiens
taagcaggacctgcctggagcactg

SEQ ID NO: 6763 - DNA, 25 bp, Homo sapiens
cgactggctcctggatgacatttcc

SEQ ID NO: 6764 - DNA, 25 bp, Homo sapiens
tttccagccgcattttcacagctga

SEQ ID NO: 6765 - DNA, 25 bp, Homo sapiens
ttttcacagctgactgaaccactcc

SEQ ID NO: 6766 - DNA, 25 bp, Homo sapiens
cttcaccaaacactacccatggggg

SEQ ID NO: 6767 - DNA, 25 bp, Homo sapiens
ttgggagtcagccggccaaactaac

SEQ ID NO: 6768 - DNA, 25 bp, Homo sapiens
tggcctttggctaccataccaagaa

SEQ ID NO: 6769 - DNA, 25 bp, Homo sapiens
gcctcatccttcactcagttgtgaa

SEQ ID NO: 6770 - DNA, 25 bp, Homo sapiens
atatgtattcattcactttcaagat

SEQ ID NO: 6771 - DNA, 25 bp, Homo sapiens
cttctgttgaattagctctgccacc

SEQ ID NO: 6772 - DNA, 25 bp, Homo sapiens
agctctgccaccaatatgtatcttc

SEQ ID NO: 6773 - DNA, 25 bp, Homo sapiens
gtatcttcatacacgtttggaaatg

SEQ ID NO: 6774 - DNA, 25 bp, Homo sapiens
ggaaatgtttcctgcagcattaggt

SEQ ID NO: 6775 - DNA, 25 bp, Homo sapiens
gcattaggtatgacttgttctgagt

SEQ ID NO: 6776 - DNA, 25 bp, Homo sapiens
tgagtactgcttccggtgctaaaat

SEQ ID NO: 6777 - DNA, 25 bp, Homo sapiens
ttaatggcatggactctggagaatc

SEQ ID NO: 6778 - DNA, 25 bp, Homo sapiens
tatgcgaatcaacctttctacctta

SEQ ID NO: 6779 - DNA, 25 bp, Homo sapiens
tctaccttaatatctccccaaaaat

SEQ ID NO: 6780 - DNA, 25 bp, Homo sapiens
gtttgctctgcatttttgatgatgg

SEQ ID NO: 6781 - DNA, 25 bp, Homo sapiens
gcccctgacattcaccaatatgttt

SEQ ID NO: 6782 - DNA, 25 bp, Homo sapiens
acggaagtttccaatcagatcaccc

SEQ ID NO: 6783 - DNA, 25 bp, Homo sapiens
agatcaccctcgtggaagacgtctt

SEQ ID NO: 6784 - DNA, 25 bp, Homo sapiens
tagccaagctctgtaaaaccattta

SEQ ID NO: 6785 - DNA, 25 bp, Homo sapiens
gagatctatctcaccgacgaagact

SEQ ID NO: 6786 - DNA, 25 bp, Homo sapiens
gaagacttcgagtttgcactagaca

SEQ ID NO: 6787 - DNA, 25 bp, Homo sapiens
gagggatgaatacaacgccctgccc

SEQ ID NO: 6788 - DNA, 25 bp, Homo sapiens
ggcctgttctgagtggggagacgcc

SEQ ID NO: 6789 - DNA, 25 bp, Homo sapiens
aacaacaccactgcaccagggaaat

SEQ ID NO: 6790 - DNA, 25 bp, Homo sapiens
taaagatactgcttgtcccggagtt

SEQ ID NO: 6791 - DNA, 25 bp, Homo sapiens
ttgtcccggagttgtgtattttgta

SEQ ID NO: 6792 - DNA, 25 bp, Homo sapiens
gtcacacggggccgagagctgagca

SEQ ID NO: 6793 - DNA, 25 bp, Homo sapiens
gaagttatgaccaagggaattatgc

SEQ ID NO: 6794 - DNA, 25 bp, Homo sapiens
agggaattatgctgttcatttataa

SEQ ID NO: 6795 - DNA, 25 bp, Homo sapiens
tagtggacattatggagagctctga

SEQ ID NO: 6796 - DNA, 25 bp, Homo sapiens
gagagctctgattcctacataatat

SEQ ID NO: 6797 - DNA, 25 bp, Homo sapiens
ataaggatggataggccgggcgtgg

SEQ ID NO: 6798 - DNA, 25 bp, Homo sapiens
gagcgagaccccgactcaataaata

SEQ ID NO: 6799 - DNA, 25 bp, Homo sapiens
taaattgtagcgtatgcaccattca

SEQ ID NO: 6800 - DNA, 25 bp, Homo sapiens
agcgtatgcaccattcattatgcta

SEQ ID NO: 6801 - DNA, 25 bp, Homo sapiens
gcaccattcattatgctaagacatt

SEQ ID NO: 6802 - DNA, 25 bp, Homo sapiens
gagaaacgctctactaatgatttgt

SEQ ID NO: 6803 - DNA, 25 bp, Homo sapiens
ctggtcacagtggtagtcgctggcc

SEQ ID NO: 6804 - DNA, 25 bp, Homo sapiens
ccctcctgattttggctaggcatcg

SEQ ID NO: 6805 - DNA, 25 bp, Homo sapiens
ctaggcatcgtggaaccagctccag

SEQ ID NO: 6806 - DNA, 25 bp, Homo sapiens
gtgcaggttgtgcggaagaggctga

SEQ ID NO: 6807 - DNA, 25 bp, Homo sapiens
cccaccgctgtgcatcgaatgaggg

SEQ ID NO: 6808 - DNA, 25 bp, Homo sapiens
atggacccttcacaagtgtttctcc

SEQ ID NO: 6809 - DNA, 25 bp, Homo sapiens
cttccttctcctgaaatccagagac

SEQ ID NO: 6810 - DNA, 25 bp, Homo sapiens
aatccagagactttcttgctcatcc

SEQ ID NO: 6811 - DNA, 25 bp, Homo sapiens
gaaagcagacttgcatatccctgat

SEQ ID NO: 6812 - DNA, 25 bp, Homo sapiens
tatccctgatgagcagctcggctac

SEQ ID NO: 6813 - DNA, 25 bp, Homo sapiens
gcagctcggctacttttgtaaactt

SEQ ID NO: 6814 - DNA, 25 bp, Homo sapiens
agagccaagattcctgttttcagtt

SEQ ID NO: 6815 - DNA, 25 bp, Homo sapiens
tcctgctggttttactttagtccct

SEQ ID NO: 6816 - DNA, 25 bp, Homo sapiens
agtccctccatgtcaaagtgggcct

SEQ ID NO: 6817 - DNA, 25 bp, Homo sapiens
atgcctcatgtgaagtgtccaccct

SEQ ID NO: 6818 - DNA, 25 bp, Homo sapiens
ccaccctctctgaaaatctttcttg

SEQ ID NO: 6819 - DNA, 25 bp, Homo sapiens
tagattgttgcctatttcctgctga

SEQ ID NO: 6820 - DNA, 25 bp, Homo sapiens
aatatattctttactgccttgtgga

SEQ ID NO: 6821 - DNA, 25 bp, Homo sapiens
tagttttgcctttcacatttgtctt

SEQ ID NO: 6822 - DNA, 25 bp, Homo sapiens
catttgtctttagtctgtcctgaac

SEQ ID NO: 6823 - DNA, 25 bp, Homo sapiens
ggttgtctctgcactatttactgaa

SEQ ID NO: 6824 - DNA, 25 bp, Homo sapiens
tcatcctttccccagtgatttgtaa

SEQ ID NO: 6825 - DNA, 25 bp, Homo sapiens
atcagcttgacccgattcagagaga

SEQ ID NO: 6826 - DNA, 25 bp, Homo sapiens
gtgtgctcagctcttaacagtgcaa

SEQ ID NO: 6827 - DNA, 25 bp, Homo sapiens
acccacaatctgccaaagcaacctc

SEQ ID NO: 6828 - DNA, 25 bp, Homo sapiens
ttgccctagcaatgggacaggccac

SEQ ID NO: 6829 - DNA, 25 bp, Homo sapiens
gacaggccacacaatgtctaggact

SEQ ID NO: 6830 - DNA, 25 bp, Homo sapiens
aatgtctaggactgatggctcgatc

SEQ ID NO: 6831 - DNA, 25 bp, Homo sapiens
ggaattggatcctgcgcatttgcca

SEQ ID NO: 6832 - DNA, 25 bp, Homo sapiens
ggaagactacctacattagctatgc

SEQ ID NO: 6833 - DNA, 25 bp, Homo sapiens
atggaagtagaccagctctgctgat

SEQ ID NO: 6834 - DNA, 25 bp, Homo sapiens
ggtttttgtcgctttacattgcttc

SEQ ID NO: 6835 - DNA, 25 bp, Homo sapiens
acattgcttcctagtttacagcatg

SEQ ID NO: 6836 - DNA, 25 bp, Homo sapiens
gacagtgttggacatgctccgggat

SEQ ID NO: 6837 - DNA, 25 bp, Homo sapiens
aaaggcttcctgattgatggctacc

SEQ ID NO: 6838 - DNA, 25 bp, Homo sapiens
ttgagcgacggattggacagcccac

SEQ ID NO: 6839 - DNA, 25 bp, Homo sapiens
acccagcggctcttgaaacgtggag

SEQ ID NO: 6840 - DNA, 25 bp, Homo sapiens
aacgtggagagaccagcgggcgtgt

SEQ ID NO: 6841 - DNA, 25 bp, Homo sapiens
aaagcggctggagacctattacaag

SEQ ID NO: 6842 - DNA, 25 bp, Homo sapiens
attacaaggccacagaacccgtcat

SEQ ID NO: 6843 - DNA, 25 bp, Homo sapiens
gaaacgtggcattgtgcgcaaggtc

SEQ ID NO: 6844 - DNA, 25 bp, Homo sapiens
gcgcaaggtcaacgctgagggctcc

SEQ ID NO: 6845 - DNA, 25 bp, Homo sapiens
gacgccctaaagtagcaacgctgga

SEQ ID NO: 6846 - DNA, 25 bp, Homo sapiens
gacggaggaagccgcttatcctgtt

SEQ ID NO: 6847 - DNA, 25 bp, Homo sapiens
gtattacaggtacttcgtcagtttg

SEQ ID NO: 6848 - DNA, 25 bp, Homo sapiens
gacatgagtccgaaacaactaccag

SEQ ID NO: 6849 - DNA, 25 bp, Homo sapiens
gaaagatccctgaatcgtgtgcact

SEQ ID NO: 6850 - DNA, 25 bp, Homo sapiens
atcgtgtgcacttacttgggcgagt

SEQ ID NO: 6851 - DNA, 25 bp, Homo sapiens
cagtcacaatattttctctagcaac

SEQ ID NO: 6852 - DNA, 25 bp, Homo sapiens
tagcaactaatgagatgtggcgatc

SEQ ID NO: 6853 - DNA, 25 bp, Homo sapiens
ttaccaactgggtgatgtcagtcaa

SEQ ID NO: 6854 - DNA, 25 bp, Homo sapiens
gacaacatggcacagaatatcagta

SEQ ID NO: 6855 - DNA, 25 bp, Homo sapiens
ggcctcagagacgtggcatatcaat

SEQ ID NO: 6856 - DNA, 25 bp, Homo sapiens
tgtgaggcgacaagcaacaacaatc

SEQ ID NO: 6857 - DNA, 25 bp, Homo sapiens
aagccatgtttcgaagacctgtatt

SEQ ID NO: 6858 - DNA, 25 bp, Homo sapiens
agttactacgaatcccatcttggtt

SEQ ID NO: 6859 - DNA, 25 bp, Homo sapiens
ggttccagctatatcactgacagca

SEQ ID NO: 6860 - DNA, 25 bp, Homo sapiens
agaagactgcgaacctcacttctag

SEQ ID NO: 6861 - DNA, 25 bp, Homo sapiens
gcagagtgcctaaaccataacctca

SEQ ID NO: 6862 - DNA, 25 bp, Homo sapiens
ataacctcacaatcttctttgatgt

SEQ ID NO: 6863 - DNA, 25 bp, Homo sapiens
tgcacacaaggctactgaggctcta

SEQ ID NO: 6864 - DNA, 25 bp, Homo sapiens
aacagcattaactcacagaccttgg

SEQ ID NO: 6865 - DNA, 25 bp, Homo sapiens
gaccttggagcctaagccatacagg

SEQ ID NO: 6866 - DNA, 25 bp, Homo sapiens
gaaaccacgctatgatactttctgg

SEQ ID NO: 6867 - DNA, 25 bp, Homo sapiens
atgatggacattttgctcgattgga

SEQ ID NO: 6868 - DNA, 25 bp, Homo sapiens
atccccggcctacttgaagaagtgg

SEQ ID NO: 6869 - DNA, 25 bp, Homo sapiens
tattgcctaacttaagccatgactt

SEQ ID NO: 6870 - DNA, 25 bp, Homo sapiens
aatatcggcgtgtggctggagcctt

SEQ ID NO: 6871 - DNA, 25 bp, Homo sapiens
agttgggaactctttgtgcttgtga

SEQ ID NO: 6872 - DNA, 25 bp, Homo sapiens
gtgcttgtgatctactggacttttt

SEQ ID NO: 6873 - DNA, 25 bp, Homo sapiens
caggaagtgcattctctggtccttc

SEQ ID NO: 6874 - DNA, 25 bp, Homo sapiens
tccctattttctgttctggatgtca

SEQ ID NO: 6875 - DNA, 25 bp, Homo sapiens
agtgcactgctactgttttatccac

SEQ ID NO: 6876 - DNA, 25 bp, Homo sapiens
gttttatccacttggccacagactt

SEQ ID NO: 6877 - DNA, 25 bp, Homo sapiens
agactttttctaacagctgcgtatt

SEQ ID NO: 6878 - DNA, 25 bp, Homo sapiens
gcattggcagcattgtgtctttgac

SEQ ID NO: 6879 - DNA, 25 bp, Homo sapiens
gtgtctttgaccttgtatactagct

SEQ ID NO: 6880 - DNA, 25 bp, Homo sapiens
ttccttgttttggcttcttttcaga

SEQ ID NO: 6881 - DNA, 25 bp, Homo sapiens
gcagggattccatctaatcaccctc

SEQ ID NO: 6882 - DNA, 25 bp, Homo sapiens
tctttctctggtcctgctggataga

SEQ ID NO: 6883 - DNA, 25 bp, Homo sapiens
tttttagggcctcagtctgctatct

SEQ ID NO: 6884 - DNA, 25 bp, Homo sapiens
ttgccttcaccttgcttaagactga

SEQ ID NO: 6885 - DNA, 25 bp, Homo sapiens
agattttgtcactagctcttctttt

SEQ ID NO: 6886 - DNA, 25 bp, Homo sapiens
ttaggtccctggttgtatgttccca

SEQ ID NO: 6887 - DNA, 25 bp, Homo sapiens
cccatacttcctctctcagaataat

SEQ ID NO: 6888 - DNA, 25 bp, Homo sapiens
gcatcctgcttgactgcaaacttgc

SEQ ID NO: 6889 - DNA, 25 bp, Homo sapiens
agggactgtttgtcttggacttcgc

SEQ ID NO: 6890 - DNA, 25 bp, Homo sapiens
ttcgctgccagtccttagaacagtg

SEQ ID NO: 6891 - DNA, 25 bp, Homo sapiens
gagtccattgagaccgtggtcacca

SEQ ID NO: 6892 - DNA, 25 bp, Homo sapiens
agggccggaaggatagcctcagcgt

SEQ ID NO: 6893 - DNA, 25 bp, Homo sapiens
gatagcctcagcgtcaacgagttca

SEQ ID NO: 6894 - DNA, 25 bp, Homo sapiens
tgccgggtcagccctgacaaaggtc

SEQ ID NO: 6895 - DNA, 25 bp, Homo sapiens
agagctggttacccagcagttgccc

SEQ ID NO: 6896 - DNA, 25 bp, Homo sapiens
ttgccccatctgctcaaggatgtgg

SEQ ID NO: 6897 - DNA, 25 bp, Homo sapiens
aaggatgtgggctctcttgatgaga

SEQ ID NO: 6898 - DNA, 25 bp, Homo sapiens
ggatgtgaatcaggactcggagctc

SEQ ID NO: 6899 - DNA, 25 bp, Homo sapiens
gccgcctggctgagatggggtgggc

SEQ ID NO: 6900 - DNA, 25 bp, Homo sapiens
tggcctcagggtcctaatggcagca

SEQ ID NO: 6901 - DNA, 25 bp, Homo sapiens
gcagcagaaccactgacagagctag

SEQ ID NO: 6902 - DNA, 25 bp, Homo sapiens
atttaagttgtgattacctgctgca

SEQ ID NO: 6903 - DNA, 25 bp, Homo sapiens
aagtggcatgggggaccctgtgcat

SEQ ID NO: 6904 - DNA, 25 bp, Homo sapiens
gaccctgtgcatctgtgcatttggc

SEQ ID NO: 6905 - DNA, 25 bp, Homo sapiens
tccatttctggacatgacgtctgtg

SEQ ID NO: 6906 - DNA, 25 bp, Homo sapiens
gacgtctgtggtttaagctttgtga

SEQ ID NO: 6907 - DNA, 25 bp, Homo sapiens
aatgtgctttgattcgaagggtctt

SEQ ID NO: 6908 - DNA, 25 bp, Homo sapiens
taatcgtcaaccacttttaaacata

SEQ ID NO: 6909 - DNA, 25 bp, Homo sapiens
agaattcacacaactactttcatga

SEQ ID NO: 6910 - DNA, 25 bp, Homo sapiens
attccaagagtatcccagtattagc

SEQ ID NO: 6911 - DNA, 25 bp, Homo sapiens
atataggcacattaccattcatagt

SEQ ID NO: 6912 - DNA, 25 bp, Homo sapiens
aatttgatgcgatctgctcagtaat

SEQ ID NO: 6913 - DNA, 25 bp, Homo sapiens
gtatcagaagcccattattcagagc

SEQ ID NO: 6914 - DNA, 25 bp, Homo sapiens
gaacagtcaccgacgagagtgctgg

SEQ ID NO: 6915 - DNA, 25 bp, Homo sapiens
ggatcttcactcggcagagacaacc

SEQ ID NO: 6916 - DNA, 25 bp, Homo sapiens
tgcagcgttccttttgcgagagaga

SEQ ID NO: 6917 - DNA, 25 bp, Homo sapiens
caatgaaaccaggtatccccactca

SEQ ID NO: 6918 - DNA, 25 bp, Homo sapiens
cccactcagtagccaagtcacaatg

SEQ ID NO: 6919 - DNA, 25 bp, Homo sapiens
gaaaacagcccgtttacttgagcaa

SEQ ID NO: 6920 - DNA, 25 bp, Homo sapiens
tgagcaagactgataccacctgcgt

SEQ ID NO: 6921 - DNA, 25 bp, Homo sapiens
tcctggactgttcacggcagaccag

SEQ ID NO: 6922 - DNA, 25 bp, Homo sapiens
tttctggcctgggttttgtggtcat

SEQ ID NO: 6923 - DNA, 25 bp, Homo sapiens
gtggtcatctattctagcagggaac

SEQ ID NO: 6924 - DNA, 25 bp, Homo sapiens
aatcagtttattgggttctagggct

SEQ ID NO: 6925 - DNA, 25 bp, Homo sapiens
gttcatggttattctacatttctag

SEQ ID NO: 6926 - DNA, 25 bp, Homo sapiens
gttcttatcagcaagatggtcccat

SEQ ID NO: 6927 - DNA, 25 bp, Homo sapiens
gtgaacgttttctaactgcctcgta

SEQ ID NO: 6928 - DNA, 25 bp, Homo sapiens
actgcctcgtagggtagaaaccaat

SEQ ID NO: 6929 - DNA, 25 bp, Homo sapiens
aaccaatatttttcaggatgctgta

SEQ ID NO: 6930 - DNA, 25 bp, Homo sapiens
gtatttcactcctgtaaggactttt

SEQ ID NO: 6931 - DNA, 25 bp, Homo sapiens
ggttatacgtaccacggattctctt

SEQ ID NO: 6932 - DNA, 25 bp, Homo sapiens
gtaccacggattctctttaatattg

SEQ ID NO: 6933 - DNA, 25 bp, Homo sapiens
actgtatttctgatgttgcaagcca

SEQ ID NO: 6934 - DNA, 25 bp, Homo sapiens
gacacattgtctctttaaaatgctg

SEQ ID NO: 6935 - DNA, 25 bp, Homo sapiens
ggagcattctcaagacagtttgtca

SEQ ID NO: 6936 - DNA, 25 bp, Homo sapiens
gtttgtcatggctctgttgattgca

SEQ ID NO: 6937 - DNA, 25 bp, Homo sapiens
ggctctgttgattgcaactccttgt

SEQ ID NO: 6938 - DNA, 25 bp, Homo sapiens
gcaactccttgtatagcttgtattt

SEQ ID NO: 6939 - DNA, 25 bp, Homo sapiens
gcgaaagaggtcatgtcttctcaaa

SEQ ID NO: 6940 - DNA, 25 bp, Homo sapiens
aaggaagtagtctgcattggtgtgc

SEQ ID NO: 6941 - DNA, 25 bp, Homo sapiens
gaaagcctcagttctgaatgttgat

SEQ ID NO: 6942 - DNA, 25 bp, Homo sapiens
atctgtgtcaagtatttctggtaat

SEQ ID NO: 6943 - DNA, 25 bp, Homo sapiens
gaaagatacctaaccttcaacaaat

SEQ ID NO: 6944 - DNA, 25 bp, Homo sapiens
gattcattaattttcatagtgcctt

SEQ ID NO: 6945 - DNA, 25 bp, Homo sapiens
agtgcctttttcacatgagtcagct

SEQ ID NO: 6946 - DNA, 25 bp, Homo sapiens
cattgcagatcgtagcgcgttgcct

SEQ ID NO: 6947 - DNA, 25 bp, Homo sapiens
tcccttggatacctagaccgttata

SEQ ID NO: 6948 - DNA, 25 bp, Homo sapiens
agtgtgccacatggacttaccgagc

SEQ ID NO: 6949 - DNA, 25 bp, Homo sapiens
ggaacctcagggtattgcttgccac

SEQ ID NO: 6950 - DNA, 25 bp, Homo sapiens
gagacaaaatctctatactgccctg

SEQ ID NO: 6951 - DNA, 25 bp, Homo sapiens
ctcagtgccaactgtggctggtcct

SEQ ID NO: 6952 - DNA, 25 bp, Homo sapiens
gaaacaccaagatgtctgtctctga

SEQ ID NO: 6953 - DNA, 25 bp, Homo sapiens
gcgcttcctatttctagggctggga

SEQ ID NO: 6954 - DNA, 25 bp, Homo sapiens
ctgggaaacactccttgcatcaagg

SEQ ID NO: 6955 - DNA, 25 bp, Homo sapiens
gggtccatttttcttccaggatggt

SEQ ID NO: 6956 - DNA, 25 bp, Homo sapiens
tattctggccagactcgatgtgtac

SEQ ID NO: 6957 - DNA, 25 bp, Homo sapiens
tttatcctcttggtgtctggtttct

SEQ ID NO: 6958 - DNA, 25 bp, Homo sapiens
ccttcgctccatgtttttggggaca

SEQ ID NO: 6959 - DNA, 25 bp, Homo sapiens
atcccctctcaggagagtgtgcaac

SEQ ID NO: 6960 - DNA, 25 bp, Homo sapiens
tgtgcaactggccagccaatttccc

SEQ ID NO: 6961 - DNA, 25 bp, Homo sapiens
caggcctacctcaagttcttggacc

SEQ ID NO: 6962 - DNA, 25 bp, Homo sapiens
gttcttggaccagtttgcagagtga

SEQ ID NO: 6963 - DNA, 25 bp, Homo sapiens
gatcaagaaatgtctctgctcctac

SEQ ID NO: 6964 - DNA, 25 bp, Homo sapiens
cactcactgctgtgagtgcgcctca

SEQ ID NO: 6965 - DNA, 25 bp, Homo sapiens
gcgcctcaccagaaccagttaagag

SEQ ID NO: 6966 - DNA, 25 bp, Homo sapiens
ttataagggccctgcctgtactgaa

SEQ ID NO: 6967 - DNA, 25 bp, Homo sapiens
ggggagcacaaggccttaatggaca

SEQ ID NO: 6968 - DNA, 25 bp, Homo sapiens
aagacatatgccatgcagctacacc

SEQ ID NO: 6969 - DNA, 25 bp, Homo sapiens
cagggcattgtcctcagtcagatac

SEQ ID NO: 6970 - DNA, 25 bp, Homo sapiens
cagcatttggggccatggtacctgc

SEQ ID NO: 6971 - DNA, 25 bp, Homo sapiens
ggtacctgcacacctaaaacactag

SEQ ID NO: 6972 - DNA, 25 bp, Homo sapiens
gccacgcatctgatctgtagtcaca

SEQ ID NO: 6973 - DNA, 25 bp, Homo sapiens
atagccccaccatgaggacatacaa

SEQ ID NO: 6974 - DNA, 25 bp, Homo sapiens
gaaacttgctgcctattgggtatgc

SEQ ID NO: 6975 - DNA, 25 bp, Homo sapiens
tggccctccatagacatgtgtagca

SEQ ID NO: 6976 - DNA, 25 bp, Homo sapiens
caaaacacaaaggcccacacttcct

SEQ ID NO: 6977 - DNA, 25 bp, Homo sapiens
cagcttgggcactgctgtctactga

SEQ ID NO: 6978 - DNA, 25 bp, Homo sapiens
gaccccaacccttgatgatatgtat

SEQ ID NO: 6979 - DNA, 25 bp, Homo sapiens
ataagtagccgcctggttactgtgt

SEQ ID NO: 6980 - DNA, 25 bp, Homo sapiens
cgcctggttactgtgtcctgtaaaa

SEQ ID NO: 6981 - DNA, 25 bp, Homo sapiens
aaaatacagacacttgacccttggt

SEQ ID NO: 6982 - DNA, 25 bp, Homo sapiens
ccttggtgtagcttctgttcaactt

SEQ ID NO: 6983 - DNA, 25 bp, Homo sapiens
tggatgggtctgatttcttggccct

SEQ ID NO: 6984 - DNA, 25 bp, Homo sapiens
ttcttggccctcttcttgaattggc

SEQ ID NO: 6985 - DNA, 25 bp, Homo sapiens
gaattggccatatacagggtccctg

SEQ ID NO: 6986 - DNA, 25 bp, Homo sapiens
ccagtggactgaaggctttgtctaa

SEQ ID NO: 6987 - DNA, 25 bp, Homo sapiens
gatgtgggggagggcggttttatct

SEQ ID NO: 6988 - DNA, 25 bp, Homo sapiens
ttgaggttttgatctctgggtaaag

SEQ ID NO: 6989 - DNA, 25 bp, Homo sapiens
gaggccgtttatctttgtaaacacg

SEQ ID NO: 6990 - DNA, 25 bp, Homo sapiens
gtgcatgcttcgctaccagaagtgt

SEQ ID NO: 6991 - DNA, 25 bp, Homo sapiens
ccagaagtgtctggatgcccgttcc

SEQ ID NO: 6992 - DNA, 25 bp, Homo sapiens
ggcacggcgtgtagggtggactgtc

SEQ ID NO: 6993 - DNA, 25 bp, Homo sapiens
tgaagcccaaacggctgggggccca

SEQ ID NO: 6994 - DNA, 25 bp, Homo sapiens
ggggcccataccccatgaagaagcc

SEQ ID NO: 6995 - DNA, 25 bp, Homo sapiens
cacctgattgtgttgggccccaggg

SEQ ID NO: 6996 - DNA, 25 bp, Homo sapiens
gggtcagggaggggtctagaggcta

SEQ ID NO: 6997 - DNA, 25 bp, Homo sapiens
agaggctattcctaggcctcaggcc

SEQ ID NO: 6998 - DNA, 25 bp, Homo sapiens
ttccctgcctaggagctggggaggg

SEQ ID NO: 6999 - DNA, 25 bp, Homo sapiens
ggagagatctaatcccttcaaggaa

SEQ ID NO: 7000 - DNA, 25 bp, Homo sapiens
ggcacctctgctgtattgatatcac

SEQ ID NO: 7001 - DNA, 25 bp, Homo sapiens
cagtacccccatgaggggattccct

SEQ ID NO: 7002 - DNA, 25 bp, Homo sapiens
gttgctggtgtactctaggacttca

SEQ ID NO: 7003 - DNA, 25 bp, Homo sapiens
ggttgtgctactatatcggggccac

SEQ ID NO: 7004 - DNA, 25 bp, Homo sapiens
ggggccacagatgatgcagccacca

SEQ ID NO: 7005 - DNA, 25 bp, Homo sapiens
tgaggtatcaaagcctctggcccac

SEQ ID NO: 7006 - DNA, 25 bp, Homo sapiens
agcagatcgacctgagcacagtgga

SEQ ID NO: 7007 - DNA, 25 bp, Homo sapiens
gtgcaccgaccgatttgtagtctgc

SEQ ID NO: 7008 - DNA, 25 bp, Homo sapiens
tgtagtctgctcaatctctgttgca

SEQ ID NO: 7009 - DNA, 25 bp, Homo sapiens
caatctctgttgcacctgaggggga

SEQ ID NO: 7010 - DNA, 25 bp, Homo sapiens
gttcaactgcttactcccaaaacag

SEQ ID NO: 7011 - DNA, 25 bp, Homo sapiens
tcctgatgatgctggccctacagta

SEQ ID NO: 7012 - DNA, 25 bp, Homo sapiens
gtctgcctgtattttcgggattctt

SEQ ID NO: 7013 - DNA, 25 bp, Homo sapiens
ggtactttattcttgctgggcatac

SEQ ID NO: 7014 - DNA, 25 bp, Homo sapiens
gcatactttctctctaggagggagc

SEQ ID NO: 7015 - DNA, 25 bp, Homo sapiens
gagccttgtgagatccttcacaggc

SEQ ID NO: 7016 - DNA, 25 bp, Homo sapiens
atgtgaagcatgctttgctgctatg

SEQ ID NO: 7017 - DNA, 25 bp, Homo sapiens
gttgacatccaaatctagccagagc

SEQ ID NO: 7018 - DNA, 25 bp, Homo sapiens
tgccatgatagctggggcttcacca

SEQ ID NO: 7019 - DNA, 25 bp, Homo sapiens
agtctgtctactgtggtgatctgta

SEQ ID NO: 7020 - DNA, 25 bp, Homo sapiens
ggtgatctgtagacttctggttgta

SEQ ID NO: 7021 - DNA, 25 bp, Homo sapiens
aaatgtcggatttatctttccccat

SEQ ID NO: 7022 - DNA, 25 bp, Homo sapiens
ctttccccatatccaagtaccaatg

SEQ ID NO: 7023 - DNA, 25 bp, Homo sapiens
gtgggacggcgaaggctcgatgtac

SEQ ID NO: 7024 - DNA, 25 bp, Homo sapiens
tgccgcttgcagacattatcacgcc

SEQ ID NO: 7025 - DNA, 25 bp, Homo sapiens
atcacgcccaaccagtttgaggccg

SEQ ID NO: 7026 - DNA, 25 bp, Homo sapiens
gaagccttgcgggtgatggacatgc

SEQ ID NO: 7027 - DNA, 25 bp, Homo sapiens
gatggacatgctgcactctatgggc

SEQ ID NO: 7028 - DNA, 25 bp, Homo sapiens
agggcagcaactacctgattgtgct

SEQ ID NO: 7029 - DNA, 25 bp, Homo sapiens
ctggctccgtggtgatggaacgcat

SEQ ID NO: 7030 - DNA, 25 bp, Homo sapiens
ggaacgcatccggatggacattcgc

SEQ ID NO: 7031 - DNA, 25 bp, Homo sapiens
gacattcgcaaagtggacgccgtct

SEQ ID NO: 7032 - DNA, 25 bp, Homo sapiens
tgcaccacgttctgcagaggaccat

SEQ ID NO: 7033 - DNA, 25 bp, Homo sapiens
cgaggacccagagatcgtcgtccag

SEQ ID NO: 7034 - DNA, 25 bp, Homo sapiens
tgcccgctgcaagtacagtcacaag

SEQ ID NO: 7035 - DNA, 25 bp, Homo sapiens
gtagctgaggggttgcgccagctgc

SEQ ID NO: 7036 - DNA, 25 bp, Homo sapiens
aaataccgccaggacctgactgtgc

SEQ ID NO: 7037 - DNA, 25 bp, Homo sapiens
ccaggctactgcacagacttcctgc

SEQ ID NO: 7038 - DNA, 25 bp, Homo sapiens
agaccctgcccagagggtggtgctg

SEQ ID NO: 7039 - DNA, 25 bp, Homo sapiens
gttgcgggaacgctggcatttctgc

SEQ ID NO: 7040 - DNA, 25 bp, Homo sapiens
aactggagtcccagagaggcctgcc

SEQ ID NO: 7041 - DNA, 25 bp, Homo sapiens
acctgaggcagaagctccaagccct

SEQ ID NO: 7042 - DNA, 25 bp, Homo sapiens
gatgtggggttcaggatggcccccc

SEQ ID NO: 7043 - DNA, 25 bp, Homo sapiens
gatggcccccccatggggggtggat

SEQ ID NO: 7044 - DNA, 25 bp, Homo sapiens
ggatgatttgcactttggttccctg

SEQ ID NO: 7045 - DNA, 25 bp, Homo sapiens
ccagccagaccctaaggattcctgt

SEQ ID NO: 7046 - DNA, 25 bp, Homo sapiens
cctaaggattcctgtagctgcctca

SEQ ID NO: 7047 - DNA, 25 bp, Homo sapiens
cccgctcagcctgctgataggggct

SEQ ID NO: 7048 - DNA, 25 bp, Homo sapiens
ggaggatggtgcctgagacaaccct

SEQ ID NO: 7049 - DNA, 25 bp, Homo sapiens
ctccctctcaggatccaagctaagc

SEQ ID NO: 7050 - DNA, 25 bp, Homo sapiens
aggatccaagctaagcactgccact

SEQ ID NO: 7051 - DNA, 25 bp, Homo sapiens
gaaagcagtagcatcaccatctgta

SEQ ID NO: 7052 - DNA, 25 bp, Homo sapiens
ggattgcaatatctgaagccctccc

SEQ ID NO: 7053 - DNA, 25 bp, Homo sapiens
tgaagccctcccaggtgttaacatt

SEQ ID NO: 7054 - DNA, 25 bp, Homo sapiens
ggtgttaacattccaagactctaga

SEQ ID NO: 7055 - DNA, 25 bp, Homo sapiens
gagtctttggttctaaggacctgaa

SEQ ID NO: 7056 - DNA, 25 bp, Homo sapiens
agattctaacggtctgttctgtttc

SEQ ID NO: 7057 - DNA, 25 bp, Homo sapiens
tctgttctgtttcaaggcactctag

SEQ ID NO: 7058 - DNA, 25 bp, Homo sapiens
ggcactctagattccattggtccaa

SEQ ID NO: 7059 - DNA, 25 bp, Homo sapiens
attggtccaagattccggatcctaa

SEQ ID NO: 7060 - DNA, 25 bp, Homo sapiens
agactctcacactcagttgtgacta

SEQ ID NO: 7061 - DNA, 25 bp, Homo sapiens
gttggacacctttaggttctttgct

SEQ ID NO: 7062 - DNA, 25 bp, Homo sapiens
tctgcctctctaggaccatggttaa

SEQ ID NO: 7063 - DNA, 25 bp, Homo sapiens
aaaggtccacaggtctagactatta

SEQ ID NO: 7064 - DNA, 25 bp, Homo sapiens
tactgtagtattctttggggtgccc

SEQ ID NO: 7065 - DNA, 25 bp, Homo sapiens
ccgcaggggatggacgatctcccac

SEQ ID NO: 7066 - DNA, 25 bp, Homo sapiens
cagagtgtggactctggtgcctcca

SEQ ID NO: 7067 - DNA, 25 bp, Homo sapiens
ctctacctcatatcagtttgctagc

SEQ ID NO: 7068 - DNA, 25 bp, Homo sapiens
aagactgtcagcttccaaacattaa

SEQ ID NO: 7069 - DNA, 25 bp, Homo sapiens
atgcaatggttaacatcttctgtct

SEQ ID NO: 7070 - DNA, 25 bp, Homo sapiens
tctgtctttataatctactccttgt

SEQ ID NO: 7071 - DNA, 25 bp, Homo sapiens
taatctactccttgtaaagactgta

SEQ ID NO: 7072 - DNA, 25 bp, Homo sapiens
agaaagcgcaacaatccatctctca

SEQ ID NO: 7073 - DNA, 25 bp, Homo sapiens
atccatctctcaagtagtgtatcac

SEQ ID NO: 7074 - DNA, 25 bp, Homo sapiens
agtgtatcacagtagtagcctccag

SEQ ID NO: 7075 - DNA, 25 bp, Homo sapiens
tcacagtagtagcctccaggtttcc

SEQ ID NO: 7076 - DNA, 25 bp, Homo sapiens
gaggcaccactaaaagatcgcagtt

SEQ ID NO: 7077 - DNA, 25 bp, Homo sapiens
atcgcagtttgcctggtgcagtggc

SEQ ID NO: 7078 - DNA, 25 bp, Homo sapiens
agaaggacagctctgttgcagccag

SEQ ID NO: 7079 - DNA, 25 bp, Homo sapiens
gttgcagccagatttcagcgcatga

SEQ ID NO: 7080 - DNA, 25 bp, Homo sapiens
gttctgattgtacatgagcaccggc

SEQ ID NO: 7081 - DNA, 25 bp, Homo sapiens
caactttcttcaaactacctggtgg

SEQ ID NO: 7082 - DNA, 25 bp, Homo sapiens
gggtcgtcaggatggagttttgcaa

SEQ ID NO: 7083 - DNA, 25 bp, Homo sapiens
gggtcattgacgattgcattggtaa

SEQ ID NO: 7084 - DNA, 25 bp, Homo sapiens
gagaccaaattttgaacctcctcag

SEQ ID NO: 7085 - DNA, 25 bp, Homo sapiens
aacctcctcagtatccatatattcc

SEQ ID NO: 7086 - DNA, 25 bp, Homo sapiens
acaagctggtagctgcaccattgtt

SEQ ID NO: 7087 - DNA, 25 bp, Homo sapiens
tatggacccatcatttctagtctcc

SEQ ID NO: 7088 - DNA, 25 bp, Homo sapiens
acaactgaattcctgcgcagtggag

SEQ ID NO: 7089 - DNA, 25 bp, Homo sapiens
ggcaatggtagatccacccttatgc

SEQ ID NO: 7090 - DNA, 25 bp, Homo sapiens
aaattcagcgtgttggtcactggaa

SEQ ID NO: 7091 - DNA, 25 bp, Homo sapiens
cactggaaagagccttttccttctc

SEQ ID NO: 7092 - DNA, 25 bp, Homo sapiens
tcatggtgttcccctcttaaaggag

SEQ ID NO: 7093 - DNA, 25 bp, Homo sapiens
taatttacacttaccacctcatttg

SEQ ID NO: 7094 - DNA, 25 bp, Homo sapiens
acctcatttgcttttctggaggcca

SEQ ID NO: 7095 - DNA, 25 bp, Homo sapiens
caagagaagcctcattggttcacag

SEQ ID NO: 7096 - DNA, 25 bp, Homo sapiens
cagtcatgcagctcatactgtccac

SEQ ID NO: 7097 - DNA, 25 bp, Homo sapiens
ccacccttgtattctcagatgcagg

SEQ ID NO: 7098 - DNA, 25 bp, Homo sapiens
aacccttgattctgccgaggaagac

SEQ ID NO: 7099 - DNA, 25 bp, Homo sapiens
agatcttaactgtctcctacatgtg

SEQ ID NO: 7100 - DNA, 25 bp, Homo sapiens
caccgggaagctgatccagggagcc

SEQ ID NO: 7101 - DNA, 25 bp, Homo sapiens
catccggggggaccccgagtgtcat

SEQ ID NO: 7102 - DNA, 25 bp, Homo sapiens
gagtgtcatctcttctacaatgagc

SEQ ID NO: 7103 - DNA, 25 bp, Homo sapiens
gcacacccagcggatgcagtagacc

SEQ ID NO: 7104 - DNA, 25 bp, Homo sapiens
gaaaacggagagtgcttgggtggtg

SEQ ID NO: 7105 - DNA, 25 bp, Homo sapiens
atccccaactgtgacaagcatggcc

SEQ ID NO: 7106 - DNA, 25 bp, Homo sapiens
tgacaagcatggcctgtacaacctc

SEQ ID NO: 7107 - DNA, 25 bp, Homo sapiens
gtacaacctcaaacagtgcaagatg

SEQ ID NO: 7108 - DNA, 25 bp, Homo sapiens
gcaagatgtctctgaacgggcagcg

SEQ ID NO: 7109 - DNA, 25 bp, Homo sapiens
acgggcagcgtggggagtgctggtg

SEQ ID NO: 7110 - DNA, 25 bp, Homo sapiens
gaaccccaacaccgggaagctgatc

SEQ ID NO: 7111 - DNA, 25 bp, Homo sapiens
tgacagcgagaaaccccgatgtgct

SEQ ID NO: 7112 - DNA, 25 bp, Homo sapiens
gatgtgctggctgtgacgagctgat

SEQ ID NO: 7113 - DNA, 25 bp, Homo sapiens
ttggcacctgaaacacttctgctgc

SEQ ID NO: 7114 - DNA, 25 bp, Homo sapiens
gcaagccctgctatgtgaagaatca

SEQ ID NO: 7115 - DNA, 25 bp, Homo sapiens
gaatcacgctgtggtgtgtcaagga

SEQ ID NO: 7116 - DNA, 25 bp, Homo sapiens
gccatcgacccagaagtgcagcggg

SEQ ID NO: 7117 - DNA, 25 bp, Homo sapiens
tgctgcagcaaatgcctcattgggc

SEQ ID NO: 7118 - DNA, 25 bp, Homo sapiens
aagggatggttttctgttcagtgga

SEQ ID NO: 7119 - DNA, 25 bp, Homo sapiens
gcacccagaagtatcgagccatagc

SEQ ID NO: 7120 - DNA, 25 bp, Homo sapiens
tatccaaagtggtctgcatttctac

SEQ ID NO: 7121 - DNA, 25 bp, Homo sapiens
ttgtctgcagcacctgccatgaact

SEQ ID NO: 7122 - DNA, 25 bp, Homo sapiens
gggacgaggctatcattatgctact

SEQ ID NO: 7123 - DNA, 25 bp, Homo sapiens
gcactctgaaggcatccttgctggt

SEQ ID NO: 7124 - DNA, 25 bp, Homo sapiens
atggccctctggctttggtggataa

SEQ ID NO: 7125 - DNA, 25 bp, Homo sapiens
caggggcggcctgtggtaatttgtg

SEQ ID NO: 7126 - DNA, 25 bp, Homo sapiens
tcaaggtgccccactcagtggactg

SEQ ID NO: 7127 - DNA, 25 bp, Homo sapiens
gtggactgcttgcagggcattctca

SEQ ID NO: 7128 - DNA, 25 bp, Homo sapiens
tcagcgtgatccctttacagttgct

SEQ ID NO: 7129 - DNA, 25 bp, Homo sapiens
caccttgctgtgctgagaggctatg

SEQ ID NO: 7130 - DNA, 25 bp, Homo sapiens
gaggctatgatgttgatttcccacg

SEQ ID NO: 7131 - DNA, 25 bp, Homo sapiens
atttcccacggaatcttgccaaatc

SEQ ID NO: 7132 - DNA, 25 bp, Homo sapiens
ttaaaatatcaccccttgaagcctt

SEQ ID NO: 7133 - DNA, 25 bp, Homo sapiens
gtttcaccatacttcattcagacca

SEQ ID NO: 7134 - DNA, 25 bp, Homo sapiens
aaagccagtggcagtgtatgctcat

SEQ ID NO: 7135 - DNA, 25 bp, Homo sapiens
gtatgctcatacttggacagttagg

SEQ ID NO: 7136 - DNA, 25 bp, Homo sapiens
ggttagccttagtttctcagacttg

SEQ ID NO: 7137 - DNA, 25 bp, Homo sapiens
gacttgttgtctattatctgtaggt

SEQ ID NO: 7138 - DNA, 25 bp, Homo sapiens
tacagtagtgcattggtgggtctca

SEQ ID NO: 7139 - DNA, 25 bp, Homo sapiens
tggtgggtctcaatccttaacatat

SEQ ID NO: 7140 - DNA, 25 bp, Homo sapiens
ttcaagctgctttggacaactgaca

SEQ ID NO: 7141 - DNA, 25 bp, Homo sapiens
gttgggtatcctactactttgtgtt

SEQ ID NO: 7142 - DNA, 25 bp, Homo sapiens
tttgtgttttcatctcctaaaagtg

SEQ ID NO: 7143 - DNA, 25 bp, Homo sapiens
tatttccttgtatctgtagtctttt

SEQ ID NO: 7144 - DNA, 25 bp, Homo sapiens
gtgtgaccagggttacagagcatct

SEQ ID NO: 7145 - DNA, 25 bp, Homo sapiens
cagagcatctgggcttggagaccac

SEQ ID NO: 7146 - DNA, 25 bp, Homo sapiens
gggtcctatgattgtacttgtccgg

SEQ ID NO: 7147 - DNA, 25 bp, Homo sapiens
tgtccggatggatttcagctagatg

SEQ ID NO: 7148 - DNA, 25 bp, Homo sapiens
tttccattgtgtctgccagcagggt

SEQ ID NO: 7149 - DNA, 25 bp, Homo sapiens
caatctctgcagatggccgtacgtg

SEQ ID NO: 7150 - DNA, 25 bp, Homo sapiens
gctgcctctgttatcagggctttca

SEQ ID NO: 7151 - DNA, 25 bp, Homo sapiens
gaactgctcagtggggtgtgtggtg

SEQ ID NO: 7152 - DNA, 25 bp, Homo sapiens
gggtgtgtggtgaagccttctgtga

SEQ ID NO: 7153 - DNA, 25 bp, Homo sapiens
gtgcgtgtgtgctgatgaaaaccaa

SEQ ID NO: 7154 - DNA, 25 bp, Homo sapiens
accaagagtacagccccatgactgg

SEQ ID NO: 7155 - DNA, 25 bp, Homo sapiens
ggaagagaggtggaacagtgctgtt

SEQ ID NO: 7156 - DNA, 25 bp, Homo sapiens
tttggttgtgcagttccttggctac

SEQ ID NO: 7157 - DNA, 25 bp, Homo sapiens
cacagggttatgcaattcccggcct

SEQ ID NO: 7158 - DNA, 25 bp, Homo sapiens
aattcccggcctggagcatttttga

SEQ ID NO: 7159 - DNA, 25 bp, Homo sapiens
attcaaattgtctgtcctgtggagc

SEQ ID NO: 7160 - DNA, 25 bp, Homo sapiens
gagcaggcagtgattttgttccaaa

SEQ ID NO: 7161 - DNA, 25 bp, Homo sapiens
tgtctgattttaatgtccgttctta

SEQ ID NO: 7162 - DNA, 25 bp, Homo sapiens
tgtccgttcttagccaagctgctag

SEQ ID NO: 7163 - DNA, 25 bp, Homo sapiens
agctgctagcaggtgttaattggat

SEQ ID NO: 7164 - DNA, 25 bp, Homo sapiens
gtgttaattggatccctttccttca

SEQ ID NO: 7165 - DNA, 25 bp, Homo sapiens
gatccctttccttcactgaaatgga

SEQ ID NO: 7166 - DNA, 25 bp, Homo sapiens
gctccatgtcccagataaaccaggc

SEQ ID NO: 7167 - DNA, 25 bp, Homo sapiens
ccaggccagactgagaaggctcccc

SEQ ID NO: 7168 - DNA, 25 bp, Homo sapiens
gtgcccaggtacactttcaagacac

SEQ ID NO: 7169 - DNA, 25 bp, Homo sapiens
tatttattgagctggcgccgggact

SEQ ID NO: 7170 - DNA, 25 bp, Homo sapiens
caatcttctgggtccagacctgctt

SEQ ID NO: 7171 - DNA, 25 bp, Homo sapiens
aaaccttttttcagcagatatggag

SEQ ID NO: 7172 - DNA, 25 bp, Homo sapiens
gagagctgacaatcaattcacattt

SEQ ID NO: 7173 - DNA, 25 bp, Homo sapiens
gctaaactgtcattgtgcatctctg

SEQ ID NO: 7174 - DNA, 25 bp, Homo sapiens
tcattgtgcatctctgaggttccct

SEQ ID NO: 7175 - DNA, 25 bp, Homo sapiens
ttttggctcaaaacgatctgaccac

SEQ ID NO: 7176 - DNA, 25 bp, Homo sapiens
ggataagtgacacctaggacccagg

SEQ ID NO: 7177 - DNA, 25 bp, Homo sapiens
gaagagcctccctcagaagagagcc

SEQ ID NO: 7178 - DNA, 25 bp, Homo sapiens
cacccccatttacacggagtttgat

SEQ ID NO: 7179 - DNA, 25 bp, Homo sapiens
gatttcgaggaggaacccacatccc

SEQ ID NO: 7180 - DNA, 25 bp, Homo sapiens
ggccatctaccactttgaagggtcc

SEQ ID NO: 7181 - DNA, 25 bp, Homo sapiens
tgaagggtccagcgagggcactatc

SEQ ID NO: 7182 - DNA, 25 bp, Homo sapiens
gcactatctctatggccgagggtga

SEQ ID NO: 7183 - DNA, 25 bp, Homo sapiens
gctggacccgggtcaggcggaaaga

SEQ ID NO: 7184 - DNA, 25 bp, Homo sapiens
ctccgagtcacgctcaattgaaccc

SEQ ID NO: 7185 - DNA, 25 bp, Homo sapiens
gaaccctgccagagacgggaagagg

SEQ ID NO: 7186 - DNA, 25 bp, Homo sapiens
ttctaccatcgttccaccattgatg

SEQ ID NO: 7187 - DNA, 25 bp, Homo sapiens
gctccggccattttgttttatacaa

SEQ ID NO: 7188 - DNA, 25 bp, Homo sapiens
gctgaagacggctcagaatcacccc

SEQ ID NO: 7189 - DNA, 25 bp, Homo sapiens
ggctcagaatcaccccatgttggtg

SEQ ID NO: 7190 - DNA, 25 bp, Homo sapiens
atcaccccatgttggtggagctgaa

SEQ ID NO: 7191 - DNA, 25 bp, Homo sapiens
atggggagacgtacaatggacacct

SEQ ID NO: 7192 - DNA, 25 bp, Homo sapiens
gacgtacaatggacacctggtgagc

SEQ ID NO: 7193 - DNA, 25 bp, Homo sapiens
acctggtgagctgcgacaactggat

SEQ ID NO: 7194 - DNA, 25 bp, Homo sapiens
gagctgcgacaactggatgaacatt

SEQ ID NO: 7195 - DNA, 25 bp, Homo sapiens
ctggatgaacattaacctgcgagaa

SEQ ID NO: 7196 - DNA, 25 bp, Homo sapiens
cctgcgagaagtcatctgcacgtcc

SEQ ID NO: 7197 - DNA, 25 bp, Homo sapiens
cagggacggggacaagttctggcgg

SEQ ID NO: 7198 - DNA, 25 bp, Homo sapiens
cggggacaagttctggcggatgccc

SEQ ID NO: 7199 - DNA, 25 bp, Homo sapiens
gaagaagcctggcagacaggcgggc

SEQ ID NO: 7200 - DNA, 25 bp, Homo sapiens
ggcgggcaaacagtgagcgcccacc

SEQ ID NO: 7201 - DNA, 25 bp, Homo sapiens
tctcggacggatctgctcagaaagg

SEQ ID NO: 7202 - DNA, 25 bp, Homo sapiens
tcttgctaaaaccggcaattctccg

SEQ ID NO: 7203 - DNA, 25 bp, Homo sapiens
gtcccaaagctggctggattcctag

SEQ ID NO: 7204 - DNA, 25 bp, Homo sapiens
ggattcctagaagagtctgtgttga

SEQ ID NO: 7205 - DNA, 25 bp, Homo sapiens
tctggttctcagggcagcattttcc

SEQ ID NO: 7206 - DNA, 25 bp, Homo sapiens
ttgttttgcatttcttggagcctct

SEQ ID NO: 7207 - DNA, 25 bp, Homo sapiens
ctctccgagcagcaaccagacggga

SEQ ID NO: 7208 - DNA, 25 bp, Homo sapiens
taagctgttcatgctgggactgaca

SEQ ID NO: 7209 - DNA, 25 bp, Homo sapiens
cggttgaaagccttcgaaccgtgca

SEQ ID NO: 7210 - DNA, 25 bp, Homo sapiens
gacatgacttccttttacaacactc

SEQ ID NO: 7211 - DNA, 25 bp, Homo sapiens
gtgatgaatctgctgctggaaggag

SEQ ID NO: 7212 - DNA, 25 bp, Homo sapiens
atgacccgtgtctgattagctagtg

SEQ ID NO: 7213 - DNA, 25 bp, Homo sapiens
gaagctctgttgagacacatgttct

SEQ ID NO: 7214 - DNA, 25 bp, Homo sapiens
tgtgtttcatgttcaagcttaatca

SEQ ID NO: 7215 - DNA, 25 bp, Homo sapiens
aatatacgaactgagcatgctgggg

SEQ ID NO: 7216 - DNA, 25 bp, Homo sapiens
ggaggtgaatgccacatccttggcg

SEQ ID NO: 7217 - DNA, 25 bp, Homo sapiens
atccttggcggggttatggacctct

SEQ ID NO: 7218 - DNA, 25 bp, Homo sapiens
gacctcttgcatgtcatagccaatc

SEQ ID NO: 7219 - DNA, 25 bp, Homo sapiens
tgaattgaaaatttgccgctgcatg

SEQ ID NO: 7220 - DNA, 25 bp, Homo sapiens
actgaattcttaccatactgccatt

SEQ ID NO: 7221 - DNA, 25 bp, Homo sapiens
acacctactgatgactcaaaccctt

SEQ ID NO: 7222 - DNA, 25 bp, Homo sapiens
agcttttagccgggtctgcaaggat

SEQ ID NO: 7223 - DNA, 25 bp, Homo sapiens
ggatatgaacctcactctggagcct

SEQ ID NO: 7224 - DNA, 25 bp, Homo sapiens
tgacaaccgctatatccgcgcggtg

SEQ ID NO: 7225 - DNA, 25 bp, Homo sapiens
gaacggctgcatgaggctgtgttcc

SEQ ID NO: 7226 - DNA, 25 bp, Homo sapiens
gtggacatatatacacgcctgctgc

SEQ ID NO: 7227 - DNA, 25 bp, Homo sapiens
gagggtggcgtggcctataacgtga

SEQ ID NO: 7228 - DNA, 25 bp, Homo sapiens
tataacgtgatacctgccaccatga

SEQ ID NO: 7229 - DNA, 25 bp, Homo sapiens
gacttccgtgtggcaccggatgtgg

SEQ ID NO: 7230 - DNA, 25 bp, Homo sapiens
gagggggtcaccctagagtttgctc

SEQ ID NO: 7231 - DNA, 25 bp, Homo sapiens
ttgctcagaagtggatgcaccccca

SEQ ID NO: 7232 - DNA, 25 bp, Homo sapiens
gtaagattcctcctaactttcacag

SEQ ID NO: 7233 - DNA, 25 bp, Homo sapiens
ctttcttcttatctctgacagtgtt

SEQ ID NO: 7234 - DNA, 25 bp, Homo sapiens
ataagagccttggtgtctgtcctaa

SEQ ID NO: 7235 - DNA, 25 bp, Homo sapiens
ctttctcactcaccgatgctgaata

SEQ ID NO: 7236 - DNA, 25 bp, Homo sapiens
gaatcaaactgtcaacctaccaaaa

SEQ ID NO: 7237 - DNA, 25 bp, Homo sapiens
ttgtggcttatgggtattgctgtct

SEQ ID NO: 7238 - DNA, 25 bp, Homo sapiens
attcttgtgttaactgcccattggc

SEQ ID NO: 7239 - DNA, 25 bp, Homo sapiens
gcccattggcctgaaaatactcatt

SEQ ID NO: 7240 - DNA, 25 bp, Homo sapiens
ccactgttttttctgcttgttgtaa

SEQ ID NO: 7241 - DNA, 25 bp, Homo sapiens
agcaccttgtaaactgtaacctatc

SEQ ID NO: 7242 - DNA, 25 bp, Homo sapiens
ggaatttcctatgcactactgtagc

SEQ ID NO: 7243 - DNA, 25 bp, Homo sapiens
tacacttttttttgccaactgactt

SEQ ID NO: 7244 - DNA, 25 bp, Homo sapiens
gacttaacaacattgctgtcaggtg

SEQ ID NO: 7245 - DNA, 25 bp, Homo sapiens
aaatttcaagcacttttgcacattt

SEQ ID NO: 7246 - DNA, 25 bp, Homo sapiens
gaatccatggcttaacccacttgtt

SEQ ID NO: 7247 - DNA, 25 bp, Homo sapiens
tatctctgcgtttcagtgacctacc

SEQ ID NO: 7248 - DNA, 25 bp, Homo sapiens
cattctatttgctttattatcggtg

SEQ ID NO: 7249 - DNA, 25 bp, Homo sapiens
gcaggtaggtcattaacaccacttc

SEQ ID NO: 7250 - DNA, 25 bp, Homo sapiens
taacaccacttcttttcatctgtac

SEQ ID NO: 7251 - DNA, 25 bp, Homo sapiens
acctgtctgagatgttctttctacc

SEQ ID NO: 7252 - DNA, 25 bp, Homo sapiens
ttctaccaatctatatgtctttcgg

SEQ ID NO: 7253 - DNA, 25 bp, Homo sapiens
tcaagtgtttctgcatggtaatgtc

SEQ ID NO: 7254 - DNA, 25 bp, Homo sapiens
aaggggatacaggccaaagaggtgc

SEQ ID NO: 7255 - DNA, 25 bp, Homo sapiens
ggatgtggctgatgcacttctacag

SEQ ID NO: 7256 - DNA, 25 bp, Homo sapiens
cagactgatcagtcactctcagaaa

SEQ ID NO: 7257 - DNA, 25 bp, Homo sapiens
acagggcccagttaatggcagagca

SEQ ID NO: 7258 - DNA, 25 bp, Homo sapiens
ttcaggaacaggaacgccttctcaa

SEQ ID NO: 7259 - DNA, 25 bp, Homo sapiens
gaacgccttctcaaggagggattcg

SEQ ID NO: 7260 - DNA, 25 bp, Homo sapiens
gagcaaaatttgcctgtccagctcc

SEQ ID NO: 7261 - DNA, 25 bp, Homo sapiens
ccctctccccaagaaacaacatgaa

SEQ ID NO: 7262 - DNA, 25 bp, Homo sapiens
gaatgagcaacttcagagtgtcaaa

SEQ ID NO: 7263 - DNA, 25 bp, Homo sapiens
gtgtcaaacaactgccattaaactt

SEQ ID NO: 7264 - DNA, 25 bp, Homo sapiens
gcatgcatttttgttgaaccataaa

SEQ ID NO: 7265 - DNA, 25 bp, Homo sapiens
ctgtgcgcgggaaccacgtgaaatg

SEQ ID NO: 7266 - DNA, 25 bp, Homo sapiens
acgtgaaatgcgttgaggccttgct

SEQ ID NO: 7267 - DNA, 25 bp, Homo sapiens
tggccctgggataccggaaagtgca

SEQ ID NO: 7268 - DNA, 25 bp, Homo sapiens
gtgacaacctcgtcaacaagccaga

SEQ ID NO: 7269 - DNA, 25 bp, Homo sapiens
aacaagccagacgagcgcggcttca

SEQ ID NO: 7270 - DNA, 25 bp, Homo sapiens
ggagagattgagaccgttcgcttcc

SEQ ID NO: 7271 - DNA, 25 bp, Homo sapiens
aaagagcgagagagcgccctgtcgc

SEQ ID NO: 7272 - DNA, 25 bp, Homo sapiens
agcacaggcggctacacagacattg

SEQ ID NO: 7273 - DNA, 25 bp, Homo sapiens
tacacagacattgtggggctgctgc

SEQ ID NO: 7274 - DNA, 25 bp, Homo sapiens
gtggacatcaacatctatgattgga

SEQ ID NO: 7275 - DNA, 25 bp, Homo sapiens
ttggaatggagggacgccactgctg

SEQ ID NO: 7276 - DNA, 25 bp, Homo sapiens
aagtattgcattctgccgtgtttat

SEQ ID NO: 7277 - DNA, 25 bp, Homo sapiens
gcattctgccgtgtttataggtgtt

SEQ ID NO: 7278 - DNA, 25 bp, Homo sapiens
ttataggtgttcactttcctccaga

SEQ ID NO: 7279 - DNA, 25 bp, Homo sapiens
gttcactttcctccagagctgatta

SEQ ID NO: 7280 - DNA, 25 bp, Homo sapiens
gagctgattaactactgacatgact

SEQ ID NO: 7281 - DNA, 25 bp, Homo sapiens
tatggaaacagggtctgtcagtggc

SEQ ID NO: 7282 - DNA, 25 bp, Homo sapiens
gccgtgctgtgttttacttggatga

SEQ ID NO: 7283 - DNA, 25 bp, Homo sapiens
acaatgcagtttacttgcctcttca

SEQ ID NO: 7284 - DNA, 25 bp, Homo sapiens
gctcaccctagacaatgacatataa

SEQ ID NO: 7285 - DNA, 25 bp, Homo sapiens
gccgtatatagatcaatgtccacat

SEQ ID NO: 7286 - DNA, 25 bp, Homo sapiens
aacagtgttgattcttgtctctgaa

SEQ ID NO: 7287 - DNA, 25 bp, Homo sapiens
gagatactatttttgctgagcaacc

SEQ ID NO: 7288 - DNA, 25 bp, Homo sapiens
caaccagtgtgtttcaggatgatac

SEQ ID NO: 7289 - DNA, 25 bp, Homo sapiens
agtgcaggcttggaatcagctacaa

SEQ ID NO: 7290 - DNA, 25 bp, Homo sapiens
aattccagagtgaccgtggcacttg

SEQ ID NO: 7291 - DNA, 25 bp, Homo sapiens
gaccgtggcacttgggtgtacaggt

SEQ ID NO: 7292 - DNA, 25 bp, Homo sapiens
ggtgtacaggtaattcctccagagc

SEQ ID NO: 7293 - DNA, 25 bp, Homo sapiens
cctccagagctgtttgctggcttca

SEQ ID NO: 7294 - DNA, 25 bp, Homo sapiens
aaggcaccgagctgatgcagtattt

SEQ ID NO: 7295 - DNA, 25 bp, Homo sapiens
ggtatttgcatgagtcacaattaca

SEQ ID NO: 7296 - DNA, 25 bp, Homo sapiens
gaaagtctcctatttattctcatac

SEQ ID NO: 7297 - DNA, 25 bp, Homo sapiens
gaggatgccagctttaatctttctg

SEQ ID NO: 7298 - DNA, 25 bp, Homo sapiens
gaaatactctaggttgccacaccac

SEQ ID NO: 7299 - DNA, 25 bp, Homo sapiens
ggttgccacaccacagttttaagaa

SEQ ID NO: 7300 - DNA, 25 bp, Homo sapiens
taagaagttatgctgctgctgttac

SEQ ID NO: 7301 - DNA, 25 bp, Homo sapiens
gttactctcttctaggattctggtg

SEQ ID NO: 7302 - DNA, 25 bp, Homo sapiens
ctcggacactatattaaccttactg

SEQ ID NO: 7303 - DNA, 25 bp, Homo sapiens
gatttgagcaagtcactgccgagct

SEQ ID NO: 7304 - DNA, 25 bp, Homo sapiens
tgccgagcttctgagtctgcattga

SEQ ID NO: 7305 - DNA, 25 bp, Homo sapiens
tgcattgacactgctactgactcac

SEQ ID NO: 7306 - DNA, 25 bp, Homo sapiens
tctccttccctggaataaggcttca

SEQ ID NO: 7307 - DNA, 25 bp, Homo sapiens
gaagacaccatttgtaagcactttg

SEQ ID NO: 7308 - DNA, 25 bp, Homo sapiens
aaaattttgttgcatcttcgtagta

SEQ ID NO: 7309 - DNA, 25 bp, Homo sapiens
tcaatgaatgtggctctgcgcaggc

SEQ ID NO: 7310 - DNA, 25 bp, Homo sapiens
gcagctatggctgttccaataccga

SEQ ID NO: 7311 - DNA, 25 bp, Homo sapiens
acttccgcataggccaagggcactg

SEQ ID NO: 7312 - DNA, 25 bp, Homo sapiens
aagggcactgtgtttctggaatggg

SEQ ID NO: 7313 - DNA, 25 bp, Homo sapiens
aatggatgacaattcactctcccca

SEQ ID NO: 7314 - DNA, 25 bp, Homo sapiens
ctctccccagaggcttgttacgagt

SEQ ID NO: 7315 - DNA, 25 bp, Homo sapiens
caaacgaaactgatgcctccaatat

SEQ ID NO: 7316 - DNA, 25 bp, Homo sapiens
gaagacagccatctttgctttcaat

SEQ ID NO: 7317 - DNA, 25 bp, Homo sapiens
tttcaatatttcccacgtcagtaac

SEQ ID NO: 7318 - DNA, 25 bp, Homo sapiens
cttccagctcttacaactctgacga

SEQ ID NO: 7319 - DNA, 25 bp, Homo sapiens
gccagtggctggaacctattcatta

SEQ ID NO: 7320 - DNA, 25 bp, Homo sapiens
gctttcaattgatggactactctat

SEQ ID NO: 7321 - DNA, 25 bp, Homo sapiens
ttgcttctccaaatacaagtactag

SEQ ID NO: 7322 - DNA, 25 bp, Homo sapiens
aggttgtccatttatggtacctatt

SEQ ID NO: 7323 - DNA, 25 bp, Homo sapiens
attcagttccaatacttcattaatt

SEQ ID NO: 7324 - DNA, 25 bp, Homo sapiens
gttagttcagtagcttatctcagtt

SEQ ID NO: 7325 - DNA, 25 bp, Homo sapiens
gtgtatactgtaatcgtgctatttt

SEQ ID NO: 7326 - DNA, 25 bp, Homo sapiens
ggcccacacgtgcatagaggtctgg

SEQ ID NO: 7327 - DNA, 25 bp, Homo sapiens
gtggccagaggatcaccagtgcatc

SEQ ID NO: 7328 - DNA, 25 bp, Homo sapiens
agaggatcaccagtgcatccttcat

SEQ ID NO: 7329 - DNA, 25 bp, Homo sapiens
atatgccaagattaccctcggtcat

SEQ ID NO: 7330 - DNA, 25 bp, Homo sapiens
cctcggtcattcctgtcaacaaggg

SEQ ID NO: 7331 - DNA, 25 bp, Homo sapiens
tttatttgcctttgtaatttacatt

SEQ ID NO: 7332 - DNA, 25 bp, Homo sapiens
gtgtattgctatatgggtgccaaga

SEQ ID NO: 7333 - DNA, 25 bp, Homo sapiens
gaagaacccgagtgtttgtagtatt

SEQ ID NO: 7334 - DNA, 25 bp, Homo sapiens
aaatctgtgtggtgatacagccata

SEQ ID NO: 7335 - DNA, 25 bp, Homo sapiens
atggggcttatataaactctgtaca

SEQ ID NO: 7336 - DNA, 25 bp, Homo sapiens
tttttaccttgtgtgtgatagtcta

SEQ ID NO: 7337 - DNA, 25 bp, Homo sapiens
gtgatagtctagtcattgcatgtaa

SEQ ID NO: 7338 - DNA, 25 bp, Homo sapiens
acattgatgacttacatttttactg

SEQ ID NO: 7339 - DNA, 25 bp, Homo sapiens
ttactggtaagtcaacatccgttgg

SEQ ID NO: 7340 - DNA, 25 bp, Homo sapiens
atccgttggatgttttctgaagtgg

SEQ ID NO: 7341 - DNA, 25 bp, Homo sapiens
ttctgaagtggctctttttgaagtg

SEQ ID NO: 7342 - DNA, 25 bp, Homo sapiens
gctgataccttcaatttgttacttt

SEQ ID NO: 7343 - DNA, 25 bp, Homo sapiens
actagtgtagcttatcttaaacatt

SEQ ID NO: 7344 - DNA, 25 bp, Homo sapiens
ataaaaccttcagatgtctttaagc

SEQ ID NO: 7345 - DNA, 25 bp, Homo sapiens
gcaagtgcttccttagcagggacag

SEQ ID NO: 7346 - DNA, 25 bp, Homo sapiens
ggtttatcatagatttcaccctccc

SEQ ID NO: 7347 - DNA, 25 bp, Homo sapiens
gagtatgctcttaaatgtcaaacac

SEQ ID NO: 7348 - DNA, 25 bp, Homo sapiens
gtgtctatttgatgtgatgcagatc

SEQ ID NO: 7349 - DNA, 25 bp, Homo sapiens
aggctagggctcttagttttcattc

SEQ ID NO: 7350 - DNA, 25 bp, Homo sapiens
attcctattgccccaagtattgtca

SEQ ID NO: 7351 - DNA, 25 bp, Homo sapiens
aatctgctagttttgcatgtactta

SEQ ID NO: 7352 - DNA, 25 bp, Homo sapiens
agtatattttatccgcattttctta

SEQ ID NO: 7353 - DNA, 25 bp, Homo sapiens
ccgaacgtgggcgccaatggcgaga

SEQ ID NO: 7354 - DNA, 25 bp, Homo sapiens
ggcgccaatggcgagatctgcgtca

SEQ ID NO: 7355 - DNA, 25 bp, Homo sapiens
gccaatggcgagatctgcgtcaacg

SEQ ID NO: 7356 - DNA, 25 bp, Homo sapiens
aatggcgagatctgcgtcaacgtgc

SEQ ID NO: 7357 - DNA, 25 bp, Homo sapiens
agatctgcgtcaacgtgctcaagag

SEQ ID NO: 7358 - DNA, 25 bp, Homo sapiens
gcgtcaacgtgctcaagagggactg

SEQ ID NO: 7359 - DNA, 25 bp, Homo sapiens
cgtgctcaagagggactggacggct

SEQ ID NO: 7360 - DNA, 25 bp, Homo sapiens
ccccgagtctgcactcaacgaggag

SEQ ID NO: 7361 - DNA, 25 bp, Homo sapiens
gagtctgcactcaacgaggaggcgg

SEQ ID NO: 7362 - DNA, 25 bp, Homo sapiens
tctgcactcaacgaggaggcgggcc

SEQ ID NO: 7363 - DNA, 25 bp, Homo sapiens
cccgtctgctcacagagatccacgg

SEQ ID NO: 7364 - DNA, 25 bp, Homo sapiens
gaggctggtgtgccatatgacattg

SEQ ID NO: 7365 - DNA, 25 bp, Homo sapiens
gatcaaccatgattttccagatact

SEQ ID NO: 7366 - DNA, 25 bp, Homo sapiens
tccagatactgatttggtccttgta

SEQ ID NO: 7367 - DNA, 25 bp, Homo sapiens
gatcccaactctattattgcaggca

SEQ ID NO: 7368 - DNA, 25 bp, Homo sapiens
ttgcaggcatgccagtccttgaggt

SEQ ID NO: 7369 - DNA, 25 bp, Homo sapiens
gggtgttggctatgctgcagtggac

SEQ ID NO: 7370 - DNA, 25 bp, Homo sapiens
gtggacaatccaatcttctacaaac

SEQ ID NO: 7371 - DNA, 25 bp, Homo sapiens
tacaaacctaacacggccatgcttc

SEQ ID NO: 7372 - DNA, 25 bp, Homo sapiens
gccatgcttctaggtgatgccaaga

SEQ ID NO: 7373 - DNA, 25 bp, Homo sapiens
gccaagaaaacatgtgacgcgctcc

SEQ ID NO: 7374 - DNA, 25 bp, Homo sapiens
gacgcgctccaggcgaaagttagag

SEQ ID NO: 7375 - DNA, 25 bp, Homo sapiens
ggaagggttttgtgcaatgactaaa

SEQ ID NO: 7376 - DNA, 25 bp, Homo sapiens
tcaatactttcaacccaagtagccc

SEQ ID NO: 7377 - DNA, 25 bp, Homo sapiens
attggagtctaatctttcaaggagg

SEQ ID NO: 7378 - DNA, 25 bp, Homo sapiens
aggatggtaccattgctctttccta

SEQ ID NO: 7379 - DNA, 25 bp, Homo sapiens
gctctttcctagctaaccctagata

SEQ ID NO: 7380 - DNA, 25 bp, Homo sapiens
gctaaccctagatatggcagctctt

SEQ ID NO: 7381 - DNA, 25 bp, Homo sapiens
atggcagctctttaatgtacttcaa

SEQ ID NO: 7382 - DNA, 25 bp, Homo sapiens
agttatttataattgccttgtcata

SEQ ID NO: 7383 - DNA, 25 bp, Homo sapiens
aggtgttctagagccatttgcatac

SEQ ID NO: 7384 - DNA, 25 bp, Homo sapiens
atttcattccattctattgtttaca

SEQ ID NO: 7385 - DNA, 25 bp, Homo sapiens
attgtttacacaacgattactcgaa

SEQ ID NO: 7386 - DNA, 25 bp, Homo sapiens
ggccactatgcgggtagactacgac

SEQ ID NO: 7387 - DNA, 25 bp, Homo sapiens
gacctgaagacctctaacaaccggc

SEQ ID NO: 7388 - DNA, 25 bp, Homo sapiens
aacaaccggctcctcaacaagagga

SEQ ID NO: 7389 - DNA, 25 bp, Homo sapiens
cctcacagggctgcaacaaccagta

SEQ ID NO: 7390 - DNA, 25 bp, Homo sapiens
caaccagtagctcatggggccttgg

SEQ ID NO: 7391 - DNA, 25 bp, Homo sapiens
acagactgaaatgtgctcaggccct

SEQ ID NO: 7392 - DNA, 25 bp, Homo sapiens
tgaagaggaggattcgcctgggcca

SEQ ID NO: 7393 - DNA, 25 bp, Homo sapiens
agagaggctgaccatcactcagttc

SEQ ID NO: 7394 - DNA, 25 bp, Homo sapiens
cacccctggatcaaccaatcgatgg

SEQ ID NO: 7395 - DNA, 25 bp, Homo sapiens
aatcgatggtagtgccacagacccc

SEQ ID NO: 7396 - DNA, 25 bp, Homo sapiens
aggaggacaaagaccactgggacga

SEQ ID NO: 7397 - DNA, 25 bp, Homo sapiens
ctcactattcccgacccaaagggtg

SEQ ID NO: 7398 - DNA, 25 bp, Homo sapiens
gacaaaagccagcatactttccctg

SEQ ID NO: 7399 - DNA, 25 bp, Homo sapiens
gctcaccagatctcaggcaggaaag

SEQ ID NO: 7400 - DNA, 25 bp, Homo sapiens
aagcccctctctgttgaagtcaggg

SEQ ID NO: 7401 - DNA, 25 bp, Homo sapiens
gagctaagtggcttcccattaacct

SEQ ID NO: 7402 - DNA, 25 bp, Homo sapiens
tcagaatgtctggtcctggcttggg

SEQ ID NO: 7403 - DNA, 25 bp, Homo sapiens
gagagggcctttcatggctgatcag

SEQ ID NO: 7404 - DNA, 25 bp, Homo sapiens
caccccaccatggtagccttagggt

SEQ ID NO: 7405 - DNA, 25 bp, Homo sapiens
tagggtgctgagtgcctgatactgc

SEQ ID NO: 7406 - DNA, 25 bp, Homo sapiens
tgatactgcctgacaagtgcctgac

SEQ ID NO: 7407 - DNA, 25 bp, Homo sapiens
gctgggaaaccctagaccatgtcag

SEQ ID NO: 7408 - DNA, 25 bp, Homo sapiens
aactaagttatttactcctcctgct

SEQ ID NO: 7409 - DNA, 25 bp, Homo sapiens
tcctcacccctgtagggaaaccttg

SEQ ID NO: 7410 - DNA, 25 bp, Homo sapiens
gggctgcctgctgtgttaagaggac

SEQ ID NO: 7411 - DNA, 25 bp, Homo sapiens
aagaagactcagtatgctttccctg

SEQ ID NO: 7412 - DNA, 25 bp, Homo sapiens
ggggtacaggcagttaggtgctgaa

SEQ ID NO: 7413 - DNA, 25 bp, Homo sapiens
ggtgctgaatgaagctgccatcctt

SEQ ID NO: 7414 - DNA, 25 bp, Homo sapiens
tgaggacagaggccggggtccaggc

SEQ ID NO: 7415 - DNA, 25 bp, Homo sapiens
tgggcgcaaaggtgcctcatagcat

SEQ ID NO: 7416 - DNA, 25 bp, Homo sapiens
gcattcagcacacacaaacctactg

SEQ ID NO: 7417 - DNA, 25 bp, Homo sapiens
aacctactgcccacatttgggctca

SEQ ID NO: 7418 - DNA, 25 bp, Homo sapiens
tgggctcagggttggccatttgcta

SEQ ID NO: 7419 - DNA, 25 bp, Homo sapiens
gggagtgtctagatgcctgaaaggg

SEQ ID NO: 7420 - DNA, 25 bp, Homo sapiens
tgagctcagcctgtgggcagggtgc

SEQ ID NO: 7421 - DNA, 25 bp, Homo sapiens
gcactccatgtatagtcctcttggg

SEQ ID NO: 7422 - DNA, 25 bp, Homo sapiens
gccatgtttgtggccacgatgggca

SEQ ID NO: 7423 - DNA, 25 bp, Homo sapiens
gaaggcccgtatagccatgggtgga

SEQ ID NO: 7424 - DNA, 25 bp, Homo sapiens
taattttcatcgtggcaggtcttgc

SEQ ID NO: 7425 - DNA, 25 bp, Homo sapiens
ttgctcctggtatggccatcagatt

SEQ ID NO: 7426 - DNA, 25 bp, Homo sapiens
cctttgatccctaccaacattaagt

SEQ ID NO: 7427 - DNA, 25 bp, Homo sapiens
tatgagtttggccctgccatcttta

SEQ ID NO: 7428 - DNA, 25 bp, Homo sapiens
ccatctttattggctgggcagggtc

SEQ ID NO: 7429 - DNA, 25 bp, Homo sapiens
tgccctagtcatcctgggaggtgca

SEQ ID NO: 7430 - DNA, 25 bp, Homo sapiens
aaagctgcattgtcacgtgtgtgtg

SEQ ID NO: 7431 - DNA, 25 bp, Homo sapiens
gagatcgcatatttggggcagctgg

SEQ ID NO: 7432 - DNA, 25 bp, Homo sapiens
gagcctatgtgttgtccaaggcctc

SEQ ID NO: 7433 - DNA, 25 bp, Homo sapiens
aggcctcgttgacatttacatcttt

SEQ ID NO: 7434 - DNA, 25 bp, Homo sapiens
tcaaatgggactcttgtgctgctca

SEQ ID NO: 7435 - DNA, 25 bp, Homo sapiens
gatttgccacagttggtgtaccacg

SEQ ID NO: 7436 - DNA, 25 bp, Homo sapiens
ggtggatcggtgggccaacaaggga

SEQ ID NO: 7437 - DNA, 25 bp, Homo sapiens
agggaggactcattgcatacagatc

SEQ ID NO: 7438 - DNA, 25 bp, Homo sapiens
gtttcggttatctctgtcttttgag

SEQ ID NO: 7439 - DNA, 25 bp, Homo sapiens
tgaggatggctttgtcctgttgctg

SEQ ID NO: 7440 - DNA, 25 bp, Homo sapiens
gttgctggttaacattcaccttcct

SEQ ID NO: 7441 - DNA, 25 bp, Homo sapiens
cgcacacacgtgcacacatgtacac

SEQ ID NO: 7442 - DNA, 25 bp, Homo sapiens
cacacacactgcatatctgagcgcg

SEQ ID NO: 7443 - DNA, 25 bp, Homo sapiens
accttgcaccttcttcaggatttta

SEQ ID NO: 7444 - DNA, 25 bp, Homo sapiens
aaaagcaattcctggtggctgtgtg

SEQ ID NO: 7445 - DNA, 25 bp, Homo sapiens
cttgggcttctgagctggtggccct

SEQ ID NO: 7446 - DNA, 25 bp, Homo sapiens
cctggcccagaggtctggcggaggc

SEQ ID NO: 7447 - DNA, 25 bp, Homo sapiens
gcggggtgtctctacaggggagagg

SEQ ID NO: 7448 - DNA, 25 bp, Homo sapiens
acccgtaccatggggctcaggacag

SEQ ID NO: 7449 - DNA, 25 bp, Homo sapiens
cagagggagctagcagctggcctcc

SEQ ID NO: 7450 - DNA, 25 bp, Homo sapiens
gtgctgggtgcagaaccgccagagc

SEQ ID NO: 7451 - DNA, 25 bp, Homo sapiens
cccaaaaggtgtttctcttctgctc

SEQ ID NO: 7452 - DNA, 25 bp, Homo sapiens
ggtgatgttagatctggaaccccca

SEQ ID NO: 7453 - DNA, 25 bp, Homo sapiens
gggttgggacagggtgctttggaat

SEQ ID NO: 7454 - DNA, 25 bp, Homo sapiens
agagtgaccttagagggctccttgg

SEQ ID NO: 7455 - DNA, 25 bp, Homo sapiens
gaaggtgctcttactcagttaatga

SEQ ID NO: 7456 - DNA, 25 bp, Homo sapiens
gtgactatatttaccaaagccccta

SEQ ID NO: 7457 - DNA, 25 bp, Homo sapiens
gggtcccttgtagcacaggagactg

SEQ ID NO: 7458 - DNA, 25 bp, Homo sapiens
cagggaagggacaccatcaggcctc

SEQ ID NO: 7459 - DNA, 25 bp, Homo sapiens
ccatcaggcctctggctgaggcagt

SEQ ID NO: 7460 - DNA, 25 bp, Homo sapiens
tacctgcatttcccagaggactagc

SEQ ID NO: 7461 - DNA, 25 bp, Homo sapiens
tgagaaaccggcagttcccaagcca

SEQ ID NO: 7462 - DNA, 25 bp, Homo sapiens
cactagagattgcctgtgtcctgcc

SEQ ID NO: 7463 - DNA, 25 bp, Homo sapiens
gccacagacattgccatccaggcag

SEQ ID NO: 7464 - DNA, 25 bp, Homo sapiens
gaagcagctctataacatctacgcc

SEQ ID NO: 7465 - DNA, 25 bp, Homo sapiens
tacgccaagcacaccaaacagagcc

SEQ ID NO: 7466 - DNA, 25 bp, Homo sapiens
cagagcctgcaggtgatcgagtccg

SEQ ID NO: 7467 - DNA, 25 bp, Homo sapiens
tggagagggaccgctacatgagccc

SEQ ID NO: 7468 - DNA, 25 bp, Homo sapiens
cttagacaaggttctggtccaccct

SEQ ID NO: 7469 - DNA, 25 bp, Homo sapiens
accctccccaggacggtgaggatga

SEQ ID NO: 7470 - DNA, 25 bp, Homo sapiens
aggagcctgtagaagcagcgccggc

SEQ ID NO: 7471 - DNA, 25 bp, Homo sapiens
cagctagcacctgagagctgggcct

SEQ ID NO: 7472 - DNA, 25 bp, Homo sapiens
taatttgcaggggtgcccgctatgg

SEQ ID NO: 7473 - DNA, 25 bp, Homo sapiens
cgctatggacggggcattccagctg

SEQ ID NO: 7474 - DNA, 25 bp, Homo sapiens
gccgactacgctgtttacatcaaca

SEQ ID NO: 7475 - DNA, 25 bp, Homo sapiens
tacatcaacacagcccaggagtttg

SEQ ID NO: 7476 - DNA, 25 bp, Homo sapiens
ggacatcgttgaggacctgaggctc

SEQ ID NO: 7477 - DNA, 25 bp, Homo sapiens
gaggacctgaggctcatcaacacac

SEQ ID NO: 7478 - DNA, 25 bp, Homo sapiens
tcatcaacacacaggccatctttgc

SEQ ID NO: 7479 - DNA, 25 bp, Homo sapiens
gccatctttgccaagtgcactggga

SEQ ID NO: 7480 - DNA, 25 bp, Homo sapiens
gtgcactgggatgatcattctgggc

SEQ ID NO: 7481 - DNA, 25 bp, Homo sapiens
actgggatgatcattctgggcgggg

SEQ ID NO: 7482 - DNA, 25 bp, Homo sapiens
gggcgtggtcaagcaccacattgcc

SEQ ID NO: 7483 - DNA, 25 bp, Homo sapiens
caagcaccacattgccaatgccaac

SEQ ID NO: 7484 - DNA, 25 bp, Homo sapiens
tgccaacctcatgcggaacggggcc

SEQ ID NO: 7485 - DNA, 25 bp, Homo sapiens
ataggagacttgtacagttgactgg

SEQ ID NO: 7486 - DNA, 25 bp, Homo sapiens
ggctttcctctcgttggtagttgag

SEQ ID NO: 7487 - DNA, 25 bp, Homo sapiens
tgagacgctgttgcaaattccaccc

SEQ ID NO: 7488 - DNA, 25 bp, Homo sapiens
tccttccctggtccagattgtagct

SEQ ID NO: 7489 - DNA, 25 bp, Homo sapiens
tccagattgtagctcttagtcctcc

SEQ ID NO: 7490 - DNA, 25 bp, Homo sapiens
tcagctggccgggttggaggcctca

SEQ ID NO: 7491 - DNA, 25 bp, Homo sapiens
gctctggtgggaaaatgtcccccac

SEQ ID NO: 7492 - DNA, 25 bp, Homo sapiens
gtttcttgggaaaatatcactttgt

SEQ ID NO: 7493 - DNA, 25 bp, Homo sapiens
atatcactttgtattctctgtccag

SEQ ID NO: 7494 - DNA, 25 bp, Homo sapiens
tttgtattctctgtccagggcttca

SEQ ID NO: 7495 - DNA, 25 bp, Homo sapiens
ccagggcttcagatattttgcacga

SEQ ID NO: 7496 - DNA, 25 bp, Homo sapiens
atgagttctgagcctctcaagttcc

SEQ ID NO: 7497 - DNA, 25 bp, Homo sapiens
taactgtgggactcactgcagcgtc

SEQ ID NO: 7498 - DNA, 25 bp, Homo sapiens
cagcgtcctatcctaaaggcacgag

SEQ ID NO: 7499 - DNA, 25 bp, Homo sapiens
aaatgcaacctgcggagctgggctt

SEQ ID NO: 7500 - DNA, 25 bp, Homo sapiens
ctgggcttggttcccaggtcacagt

SEQ ID NO: 7501 - DNA, 25 bp, Homo sapiens
ggctggctttccacgtgaatgagac

SEQ ID NO: 7502 - DNA, 25 bp, Homo sapiens
ggtttggtgctacagccagtcagaa

SEQ ID NO: 7503 - DNA, 25 bp, Homo sapiens
attcctgtgtgaggcacgttaccct

SEQ ID NO: 7504 - DNA, 25 bp, Homo sapiens
gtcagacttttctgggcagtctcag

SEQ ID NO: 7505 - DNA, 25 bp, Homo sapiens
agtctcagtgacgcatttcctgtgc

SEQ ID NO: 7506 - DNA, 25 bp, Homo sapiens
gctctaaccactgtgagaagcccaa

SEQ ID NO: 7507 - DNA, 25 bp, Homo sapiens
atctgtgtctcgctgttgatgggag

SEQ ID NO: 7508 - DNA, 25 bp, Homo sapiens
gatgggagagcagtttctcgtcagc

SEQ ID NO: 7509 - DNA, 25 bp, Homo sapiens
tttctcgtcagctggtgttagccgg

SEQ ID NO: 7510 - DNA, 25 bp, Homo sapiens
agccgggcggagtgtgttagtctct

SEQ ID NO: 7511 - DNA, 25 bp, Homo sapiens
gttagtctctccagagggaggctgg

SEQ ID NO: 7512 - DNA, 25 bp, Homo sapiens
ttgcatgtgtcacctggagctgggc

SEQ ID NO: 7513 - DNA, 25 bp, Homo sapiens
tggagctgggcactaaccattccaa

SEQ ID NO: 7514 - DNA, 25 bp, Homo sapiens
cccccaacgtgtctaggagagcttt

SEQ ID NO: 7515 - DNA, 25 bp, Homo sapiens
tttctccctagatcgcactgtgggc

SEQ ID NO: 7516 - DNA, 25 bp, Homo sapiens
cctggagggctgctctgtgttaata

SEQ ID NO: 7517 - DNA, 25 bp, Homo sapiens
gttcccagcaccggagaagggggtg

SEQ ID NO: 7518 - DNA, 25 bp, Homo sapiens
gagatgcttcattgagtgttcatta

SEQ ID NO: 7519 - DNA, 25 bp, Homo sapiens
gtgagctggatgattgcccagagtg

SEQ ID NO: 7520 - DNA, 25 bp, Homo sapiens
cccagagtgtgacggcagtcgcagg

SEQ ID NO: 7521 - DNA, 25 bp, Homo sapiens
cccctttgacactgttcgtcgtaga

SEQ ID NO: 7522 - DNA, 25 bp, Homo sapiens
gatgcagtccggccggaaaggggcc

SEQ ID NO: 7523 - DNA, 25 bp, Homo sapiens
gaaaggggccgatattatgtacacg

SEQ ID NO: 7524 - DNA, 25 bp, Homo sapiens
atgtacacggggacagttgactgct

SEQ ID NO: 7525 - DNA, 25 bp, Homo sapiens
gagccaaggccttcttcaaaggtgc

SEQ ID NO: 7526 - DNA, 25 bp, Homo sapiens
aaaggtgcctggtccaatgtgctga

SEQ ID NO: 7527 - DNA, 25 bp, Homo sapiens
gtgctgagaggcatgggcggtgctt

SEQ ID NO: 7528 - DNA, 25 bp, Homo sapiens
catgggcggtgcttttgtattggtg

SEQ ID NO: 7529 - DNA, 25 bp, Homo sapiens
gggggccacagggtgggctgtggag

SEQ ID NO: 7530 - DNA, 25 bp, Homo sapiens
tgtggagctctcaggaagggccctg

SEQ ID NO: 7531 - DNA, 25 bp, Homo sapiens
ctgaggaaggcacacttgctcctgt

SEQ ID NO: 7532 - DNA, 25 bp, Homo sapiens
tgaggggcttcacgagaggccacag

SEQ ID NO: 7533 - DNA, 25 bp, Homo sapiens
gcctgctcaccatctcagtgagggg

SEQ ID NO: 7534 - DNA, 25 bp, Homo sapiens
cccacccattgaagtctccttgggc

SEQ ID NO: 7535 - DNA, 25 bp, Homo sapiens
gtctccttgggccaccaaaggtggt

SEQ ID NO: 7536 - DNA, 25 bp, Homo sapiens
tggccatggtaccggggacttggga

SEQ ID NO: 7537 - DNA, 25 bp, Homo sapiens
agaggagagggatgtcgggggggtg

SEQ ID NO: 7538 - DNA, 25 bp, Homo sapiens
gaaatggggtgaacggtgctggcag

SEQ ID NO: 7539 - DNA, 25 bp, Homo sapiens
gtgctggcagttcggctagatttct

SEQ ID NO: 7540 - DNA, 25 bp, Homo sapiens
atggacgaggtcctgtacagcatcg

SEQ ID NO: 7541 - DNA, 25 bp, Homo sapiens
tcctgtacagcatcgccgagaaggt

SEQ ID NO: 7542 - DNA, 25 bp, Homo sapiens
gagttatacgatccatgtactgtca

SEQ ID NO: 7543 - DNA, 25 bp, Homo sapiens
gattgacttggggactggcaacaac

SEQ ID NO: 7544 - DNA, 25 bp, Homo sapiens
ggacatcatcgagacggtgtaccgc

SEQ ID NO: 7545 - DNA, 25 bp, Homo sapiens
tccaccaagtaccgctactgaggcg

SEQ ID NO: 7546 - DNA, 25 bp, Homo sapiens
cgccctcagtctgcgcggataaatg

SEQ ID NO: 7547 - DNA, 25 bp, Homo sapiens
ataaatgtcgtggagccctttttgt

SEQ ID NO: 7548 - DNA, 25 bp, Homo sapiens
ggctggagcacctctgagatggaat

SEQ ID NO: 7549 - DNA, 25 bp, Homo sapiens
gataacatggtcttaactcaccgaa

SEQ ID NO: 7550 - DNA, 25 bp, Homo sapiens
tcaaagttaattcttacccttggag

SEQ ID NO: 7551 - DNA, 25 bp, Homo sapiens
agaaagaggcgctgctcactgtttt

SEQ ID NO: 7552 - DNA, 25 bp, Homo sapiens
taatcaacgaacttctcttctccac

SEQ ID NO: 7553 - DNA, 25 bp, Homo sapiens
ctccacccagagatggcttttccaa

SEQ ID NO: 7554 - DNA, 25 bp, Homo sapiens
acaatggaatcttccctctgttctc

SEQ ID NO: 7555 - DNA, 25 bp, Homo sapiens
ctctgataacctacttgcttactca

SEQ ID NO: 7556 - DNA, 25 bp, Homo sapiens
caatgcctttaagccaagtcaccct

SEQ ID NO: 7557 - DNA, 25 bp, Homo sapiens
ccaagtcaccctgttgcctatggga

SEQ ID NO: 7558 - DNA, 25 bp, Homo sapiens
gatttggcaagctcaaccacatgct

SEQ ID NO: 7559 - DNA, 25 bp, Homo sapiens
gttgtcaccaacagtctttctgcaa

SEQ ID NO: 7560 - DNA, 25 bp, Homo sapiens
ggaaaaggcttaccaggctgctatg

SEQ ID NO: 7561 - DNA, 25 bp, Homo sapiens
ggctgctatggtcaactcttcagaa

SEQ ID NO: 7562 - DNA, 25 bp, Homo sapiens
ccgaacgcaaggagcgcgagatggt

SEQ ID NO: 7563 - DNA, 25 bp, Homo sapiens
gcaaggagcgcgagatggtggccac

SEQ ID NO: 7564 - DNA, 25 bp, Homo sapiens
caaggagcgcgagatggtggccaca

SEQ ID NO: 7565 - DNA, 25 bp, Homo sapiens
agggatctgcaggactgcagccatg

SEQ ID NO: 7566 - DNA, 25 bp, Homo sapiens
ctgcaggactgcagccatgggggcg

SEQ ID NO: 7567 - DNA, 25 bp, Homo sapiens
cggctgctcaagtgcaagcgtgaca

SEQ ID NO: 7568 - DNA, 25 bp, Homo sapiens
ggctgctcaagtgcaagcgtgacag

SEQ ID NO: 7569 - DNA, 25 bp, Homo sapiens
ctgctcaagtgcaagcgtgacagct

SEQ ID NO: 7570 - DNA, 25 bp, Homo sapiens
tcaagtgcaagcgtgacagcttccc

SEQ ID NO: 7571 - DNA, 25 bp, Homo sapiens
tatgtgatgcgcatgaaggagtttg

SEQ ID NO: 7572 - DNA, 25 bp, Homo sapiens
tgctccagcggaagaagcggcggga

SEQ ID NO: 7573 - DNA, 25 bp, Homo sapiens
ggggaacagattgatccttccaccc

SEQ ID NO: 7574 - DNA, 25 bp, Homo sapiens
tccacccatcgcaagaactacgtac

SEQ ID NO: 7575 - DNA, 25 bp, Homo sapiens
tacgtacgtgtagtgggccggaatg

SEQ ID NO: 7576 - DNA, 25 bp, Homo sapiens
gacctacaaggcatccgaatcgact

SEQ ID NO: 7577 - DNA, 25 bp, Homo sapiens
tcgactcagatattagcggcaccct

SEQ ID NO: 7578 - DNA, 25 bp, Homo sapiens
cggcaccctcaagtttgcgtgtgag

SEQ ID NO: 7579 - DNA, 25 bp, Homo sapiens
tgaactcattgaattcttttcccga

SEQ ID NO: 7580 - DNA, 25 bp, Homo sapiens
cgaacagatctttgtgaccatgccc

SEQ ID NO: 7581 - DNA, 25 bp, Homo sapiens
accatgccctgcacatatcgcatga

SEQ ID NO: 7582 - DNA, 25 bp, Homo sapiens
gagctatgaaccactggagcagccc

SEQ ID NO: 7583 - DNA, 25 bp, Homo sapiens
gcccacactggcttgatggatcacc

SEQ ID NO: 7584 - DNA, 25 bp, Homo sapiens
ttccatgttttctgagtgctctatg

SEQ ID NO: 7585 - DNA, 25 bp, Homo sapiens
gttatccccaagctaaactgcgtgt

SEQ ID NO: 7586 - DNA, 25 bp, Homo sapiens
aactgcgtgttcactgtggaaaccg

SEQ ID NO: 7587 - DNA, 25 bp, Homo sapiens
aaccgatggctttatttcctacatt

SEQ ID NO: 7588 - DNA, 25 bp, Homo sapiens
gcttcggtcaagtgaacggtctgcg

SEQ ID NO: 7589 - DNA, 25 bp, Homo sapiens
tgacctgtgaattctttgccgtcta

SEQ ID NO: 7590 - DNA, 25 bp, Homo sapiens
tggacactccctaaatgtccacctt

SEQ ID NO: 7591 - DNA, 25 bp, Homo sapiens
gccagtgacgctccgagttgaggat

SEQ ID NO: 7592 - DNA, 25 bp, Homo sapiens
caacatgggaaggtcgcagcgtact

SEQ ID NO: 7593 - DNA, 25 bp, Homo sapiens
tcattttgtgtgactcccatgggga

SEQ ID NO: 7594 - DNA, 25 bp, Homo sapiens
gaagcacaccggggttaacactggt

SEQ ID NO: 7595 - DNA, 25 bp, Homo sapiens
aggacgatggggcatgacctcagtc

SEQ ID NO: 7596 - DNA, 25 bp, Homo sapiens
tgacctcagtcaggcactggctgaa

SEQ ID NO: 7597 - DNA, 25 bp, Homo sapiens
gctgaacttggagagggggccggac

SEQ ID NO: 7598 - DNA, 25 bp, Homo sapiens
tgtggggaacaggtcttggggtcat

SEQ ID NO: 7599 - DNA, 25 bp, Homo sapiens
gaagggctggaaacaagtgacccca

SEQ ID NO: 7600 - DNA, 25 bp, Homo sapiens
gtctcccttcttgggtagggcagac

SEQ ID NO: 7601 - DNA, 25 bp, Homo sapiens
gtagggcagacatgccttggtgccg

SEQ ID NO: 7602 - DNA, 25 bp, Homo sapiens
tctacacggactgaggtgcctgctc

SEQ ID NO: 7603 - DNA, 25 bp, Homo sapiens
ctgctcaggtgctatgtcccaagag

SEQ ID NO: 7604 - DNA, 25 bp, Homo sapiens
gagtctgtcttgagatctgattttt

SEQ ID NO: 7605 - DNA, 25 bp, Homo sapiens
tctggttatttatttccttagtgcc

SEQ ID NO: 7606 - DNA, 25 bp, Homo sapiens
tcattgagtatatgccgctgctggc

SEQ ID NO: 7607 - DNA, 25 bp, Homo sapiens
gctgggtgtggaattctttgatgaa

SEQ ID NO: 7608 - DNA, 25 bp, Homo sapiens
attctttatgtatggcttggctcgt

SEQ ID NO: 7609 - DNA, 25 bp, Homo sapiens
ttggctcgtggaccatgtatacgcc

SEQ ID NO: 7610 - DNA, 25 bp, Homo sapiens
tgtatacgccatccgagaagctgcc

SEQ ID NO: 7611 - DNA, 25 bp, Homo sapiens
gccaccaacaacctcatgaaactag

SEQ ID NO: 7612 - DNA, 25 bp, Homo sapiens
cagaagtttggtacagagtgggccc

SEQ ID NO: 7613 - DNA, 25 bp, Homo sapiens
gagtgggcccaaaatactattgttc

SEQ ID NO: 7614 - DNA, 25 bp, Homo sapiens
tgaccactttattctgcattaatgc

SEQ ID NO: 7615 - DNA, 25 bp, Homo sapiens
taagcaaatgctgcccatcgtatta

SEQ ID NO: 7616 - DNA, 25 bp, Homo sapiens
ggaaaaggcctttactagattcttg

SEQ ID NO: 7617 - DNA, 25 bp, Homo sapiens
aaaccttcaagatctcatccaagca

SEQ ID NO: 7618 - DNA, 25 bp, Homo sapiens
tcatttagtgacttaattctttcta

SEQ ID NO: 7619 - DNA, 25 bp, Homo sapiens
tgaaatgggattgttttttactcgt

SEQ ID NO: 7620 - DNA, 25 bp, Homo sapiens
taagccgttcttattgaccaattcc

SEQ ID NO: 7621 - DNA, 25 bp, Homo sapiens
tattgaccaattcctgacacttgat

SEQ ID NO: 7622 - DNA, 25 bp, Homo sapiens
acacttgattgtctcctaatgcttt

SEQ ID NO: 7623 - DNA, 25 bp, Homo sapiens
tctcctaatgctttatccatcacca

SEQ ID NO: 7624 - DNA, 25 bp, Homo sapiens
ggcaccagccacataatgttccaga

SEQ ID NO: 7625 - DNA, 25 bp, Homo sapiens
ggtgtggacccagacgtggagtgga

SEQ ID NO: 7626 - DNA, 25 bp, Homo sapiens
ggagtgattctcttgacgtttacat

SEQ ID NO: 7627 - DNA, 25 bp, Homo sapiens
ctctccatcattccaaagctaaatg

SEQ ID NO: 7628 - DNA, 25 bp, Homo sapiens
agccaagggagctctcactggagga

SEQ ID NO: 7629 - DNA, 25 bp, Homo sapiens
acagaggtgtctgcacttccatgta

SEQ ID NO: 7630 - DNA, 25 bp, Homo sapiens
ttccatgtacaacaaacgctccggg

SEQ ID NO: 7631 - DNA, 25 bp, Homo sapiens
gaaagccagttggcagcccacatgt

SEQ ID NO: 7632 - DNA, 25 bp, Homo sapiens
cacatgtggttacctcacaccagtc

SEQ ID NO: 7633 - DNA, 25 bp, Homo sapiens
gacagtggagagcactcccgatttg

SEQ ID NO: 7634 - DNA, 25 bp, Homo sapiens
gagagcccagaaattcctttgaatc

SEQ ID NO: 7635 - DNA, 25 bp, Homo sapiens
tgatgaagggacacttgggcccctg

SEQ ID NO: 7636 - DNA, 25 bp, Homo sapiens
ggcccctgcctcaggtagatggtgt

SEQ ID NO: 7637 - DNA, 25 bp, Homo sapiens
ggtgttcagacacagcagactgcag

SEQ ID NO: 7638 - DNA, 25 bp, Homo sapiens
tccacccgttttctagagttcttga

SEQ ID NO: 7639 - DNA, 25 bp, Homo sapiens
aatgatggaatgttgactgtgtttg

SEQ ID NO: 7640 - DNA, 25 bp, Homo sapiens
cacacaggacacggaccttcatgga

SEQ ID NO: 7641 - DNA, 25 bp, Homo sapiens
gaccttcatggaagtccttgctctg

SEQ ID NO: 7642 - DNA, 25 bp, Homo sapiens
actgtaatgtgcagcttttattaaa

SEQ ID NO: 7643 - DNA, 25 bp, Homo sapiens
ggttgaactgctaggttgaatgaga

SEQ ID NO: 7644 - DNA, 25 bp, Homo sapiens
gagacttcatctattggactatttt

SEQ ID NO: 7645 - DNA, 25 bp, Homo sapiens
ttaatccaggcatatggtctttagt

SEQ ID NO: 7646 - DNA, 25 bp, Homo sapiens
atggtctttagtaatggcttgtaat

SEQ ID NO: 7647 - DNA, 25 bp, Homo sapiens
ttttccctgttttcagttgtccatg

SEQ ID NO: 7648 - DNA, 25 bp, Homo sapiens
agttgtccatgtacacatagtcatt

SEQ ID NO: 7649 - DNA, 25 bp, Homo sapiens
atcaacatagcatgaaacaccaaat

SEQ ID NO: 7650 - DNA, 25 bp, Homo sapiens
gtgatgcttcaggacgtgacaggct

SEQ ID NO: 7651 - DNA, 25 bp, Homo sapiens
ggctgttctaacatgtgtctacctg

SEQ ID NO: 7652 - DNA, 25 bp, Homo sapiens
cgtcctccaccttgcagaaagaatc

SEQ ID NO: 7653 - DNA, 25 bp, Homo sapiens
aaagaatctagcctttggtctctct

SEQ ID NO: 7654 - DNA, 25 bp, Homo sapiens
atcggggtcatttgctattcccctc

SEQ ID NO: 7655 - DNA, 25 bp, Homo sapiens
tcccctctgatattcaaccctatag

SEQ ID NO: 7656 - DNA, 25 bp, Homo sapiens
tctgatccctctgtacaggctggat

SEQ ID NO: 7657 - DNA, 25 bp, Homo sapiens
tccacacttcctgggaggtcagaga

SEQ ID NO: 7658 - DNA, 25 bp, Homo sapiens
gtcagatggacttcccaagacttgt

SEQ ID NO: 7659 - DNA, 25 bp, Homo sapiens
gtgacatggttcttggatttcctct

SEQ ID NO: 7660 - DNA, 25 bp, Homo sapiens
gacttcctgaggactcgacattgtc

SEQ ID NO: 7661 - DNA, 25 bp, Homo sapiens
ggcctcttgcctgtaaatagaagcc

SEQ ID NO: 7662 - DNA, 25 bp, Homo sapiens
agaagcccgcaaactgtacagattt

SEQ ID NO: 7663 - DNA, 25 bp, Homo sapiens
tttacagaggcatcgagactgggcc

SEQ ID NO: 7664 - DNA, 25 bp, Homo sapiens
gccatctgagagccgatggccccag

SEQ ID NO: 7665 - DNA, 25 bp, Homo sapiens
cctggcctcagcgtggcaaatgcat

SEQ ID NO: 7666 - DNA, 25 bp, Homo sapiens
tatttttcgtaggcagcgtggctcc

SEQ ID NO: 7667 - DNA, 25 bp, Homo sapiens
taggcagcgtggctccagagagccc

SEQ ID NO: 7668 - DNA, 25 bp, Homo sapiens
gtaacctgtttattaaccatacctg

SEQ ID NO: 7669 - DNA, 25 bp, Homo sapiens
taaccatacctgtcctgagttcatg

SEQ ID NO: 7670 - DNA, 25 bp, Homo sapiens
gttcatggccaaaaccttaaataag

SEQ ID NO: 7671 - DNA, 25 bp, Homo sapiens
tctcctgttccagccttgtgaagga

SEQ ID NO: 7672 - DNA, 25 bp, Homo sapiens
tttggctactatggaccactccgaa

SEQ ID NO: 7673 - DNA, 25 bp, Homo sapiens
tgcatcgtgattcctgtccattgga

SEQ ID NO: 7674 - DNA, 25 bp, Homo sapiens
ttgaagatccccgagatgcagctga

SEQ ID NO: 7675 - DNA, 25 bp, Homo sapiens
tgcagctgatgcagtccgagagcta

SEQ ID NO: 7676 - DNA, 25 bp, Homo sapiens
ggaagaacactatgtggctgccgtg

SEQ ID NO: 7677 - DNA, 25 bp, Homo sapiens
agaagtagaaatcgtggcccacctc

SEQ ID NO: 7678 - DNA, 25 bp, Homo sapiens
tcgtcgccctcgagatgattatcgt

SEQ ID NO: 7679 - DNA, 25 bp, Homo sapiens
agaaggagaagcttctctcgcagcc

SEQ ID NO: 7680 - DNA, 25 bp, Homo sapiens
ggagcaggtccctttctagagatag

SEQ ID NO: 7681 - DNA, 25 bp, Homo sapiens
ggagagaaatcacaagccgtcccga

SEQ ID NO: 7682 - DNA, 25 bp, Homo sapiens
cttctctaggtctcgtagtcgatct

SEQ ID NO: 7683 - DNA, 25 bp, Homo sapiens
aaaaggtcacatatcctggagcagg

SEQ ID NO: 7684 - DNA, 25 bp, Homo sapiens
caggaaaacttccacacatcattgg

SEQ ID NO: 7685 - DNA, 25 bp, Homo sapiens
ggaggatcagatctaatagctcatc

SEQ ID NO: 7686 - DNA, 25 bp, Homo sapiens
gatctaatagctcatcatgctcgaa

SEQ ID NO: 7687 - DNA, 25 bp, Homo sapiens
gctcatcatgctcgaaagaatacag

SEQ ID NO: 7688 - DNA, 25 bp, Homo sapiens
gagtggctaaggcaggaaatggagg

SEQ ID NO: 7689 - DNA, 25 bp, Homo sapiens
ggaggtacaaaatcaacatgcaaaa

SEQ ID NO: 7690 - DNA, 25 bp, Homo sapiens
gagtctcttgctgatgatcttttta

SEQ ID NO: 7691 - DNA, 25 bp, Homo sapiens
gatctttttagatacaatccttatt

SEQ ID NO: 7692 - DNA, 25 bp, Homo sapiens
aaacttcctagtaagcatctacttc

SEQ ID NO: 7693 - DNA, 25 bp, Homo sapiens
gcatctacttcaggccaacaaggtt

SEQ ID NO: 7694 - DNA, 25 bp, Homo sapiens
gttgggaattgcatgccatctccac

SEQ ID NO: 7695 - DNA, 25 bp, Homo sapiens
gcctgacctttctgagtgacatggg

SEQ ID NO: 7696 - DNA, 25 bp, Homo sapiens
gtgacatgggtgtgccaggctagac

SEQ ID NO: 7697 - DNA, 25 bp, Homo sapiens
taacctccacagtagcatttcttat

SEQ ID NO: 7698 - DNA, 25 bp, Homo sapiens
ttgtttggtcactgctacaccttag

SEQ ID NO: 7699 - DNA, 25 bp, Homo sapiens
agcttgagcctgtcacgtggtcaag

SEQ ID NO: 7700 - DNA, 25 bp, Homo sapiens
gaggcggcacattggcagtgtgtca

SEQ ID NO: 7701 - DNA, 25 bp, Homo sapiens
gtgtgaaggtcttgcctgaatccat

SEQ ID NO: 7702 - DNA, 25 bp, Homo sapiens
gtccctgccagtgtttagaagagcc

SEQ ID NO: 7703 - DNA, 25 bp, Homo sapiens
agagcctgactgtgttcagtgcctt

SEQ ID NO: 7704 - DNA, 25 bp, Homo sapiens
ggagcagaaagccagggtcctgagt

SEQ ID NO: 7705 - DNA, 25 bp, Homo sapiens
gttttgtaacactgtcctactttat

SEQ ID NO: 7706 - DNA, 25 bp, Homo sapiens
aaggctgttacaatcaagtcgttgc

SEQ ID NO: 7707 - DNA, 25 bp, Homo sapiens
agtcgttgcagggtttggatcagct

SEQ ID NO: 7708 - DNA, 25 bp, Homo sapiens
ggatcagctgtaagttaggtatgcc

SEQ ID NO: 7709 - DNA, 25 bp, Homo sapiens
tcagaactcatggccatttcctgcc

SEQ ID NO: 7710 - DNA, 25 bp, Homo sapiens
tgtaaggctgcattgtgggtttggg

SEQ ID NO: 7711 - DNA, 25 bp, Homo sapiens
gtattaataaggcattgccccctgt

SEQ ID NO: 7712 - DNA, 25 bp, Homo sapiens
gccccctgtttgcactcagggttaa

SEQ ID NO: 7713 - DNA, 25 bp, Homo sapiens
agatgagtcctatacgtggcaattt

SEQ ID NO: 7714 - DNA, 25 bp, Homo sapiens
cgtggcaatttttcaatgtcatctg

SEQ ID NO: 7715 - DNA, 25 bp, Homo sapiens
tctgaagccagcattatcttccaaa

SEQ ID NO: 7716 - DNA, 25 bp, Homo sapiens
aggggaacactgactttctgaagga

SEQ ID NO: 7717 - DNA, 25 bp, Homo sapiens
ccttagtgaaaggttctcagtctct

SEQ ID NO: 7718 - DNA, 25 bp, Homo sapiens
tctctgagagtggaccctaattaac

SEQ ID NO: 7719 - DNA, 25 bp, Homo sapiens
gaccattcatcagcgaataactact

SEQ ID NO: 7720 - DNA, 25 bp, Homo sapiens
tgagcaactctagtgtgccagcaca

SEQ ID NO: 7721 - DNA, 25 bp, Homo sapiens
gcacaggccagacatactagtgagc

SEQ ID NO: 7722 - DNA, 25 bp, Homo sapiens
actagtgagccaggcacatctggcc

SEQ ID NO: 7723 - DNA, 25 bp, Homo sapiens
gaaactcatcctacaggggaaggcc

SEQ ID NO: 7724 - DNA, 25 bp, Homo sapiens
attcctcaagtctgggtggtgacaa

SEQ ID NO: 7725 - DNA, 25 bp, Homo sapiens
ggggctaggtactggactaccacag

SEQ ID NO: 7726 - DNA, 25 bp, Homo sapiens
tgtgttctatgggtttcaattctga

SEQ ID NO: 7727 - DNA, 25 bp, Homo sapiens
attatctggtcttttcctgttgtgc

SEQ ID NO: 7728 - DNA, 25 bp, Homo sapiens
aatgactcattgctccgaatgtcaa

SEQ ID NO: 7729 - DNA, 25 bp, Homo sapiens
tgcgacaaacaatggcacttcatca

SEQ ID NO: 7730 - DNA, 25 bp, Homo sapiens
ctaagcctcaaatgctagcactttt

SEQ ID NO: 7731 - DNA, 25 bp, Homo sapiens
gctagcactttttggcagttggata

SEQ ID NO: 7732 - DNA, 25 bp, Homo sapiens
aatgagacattctttggcagccaaa

SEQ ID NO: 7733 - DNA, 25 bp, Homo sapiens
gagaggccgatggtgaaactttttg

SEQ ID NO: 7734 - DNA, 25 bp, Homo sapiens
gaaactttttgagacaccctatggc

SEQ ID NO: 7735 - DNA, 25 bp, Homo sapiens
tggccttcttgtcaaaaccttcact

SEQ ID NO: 7736 - DNA, 25 bp, Homo sapiens
gttgacgaatcagcatcttgttccc

SEQ ID NO: 7737 - DNA, 25 bp, Homo sapiens
agcatcttgttcccatggtgataac

SEQ ID NO: 7738 - DNA, 25 bp, Homo sapiens
aaacgcattgacttggagcacctgg

SEQ ID NO: 7739 - DNA, 25 bp, Homo sapiens
agaagcactagaccaggacgacctc

SEQ ID NO: 7740 - DNA, 25 bp, Homo sapiens
gaaaccacacattcactcaatatgc

SEQ ID NO: 7741 - DNA, 25 bp, Homo sapiens
tatgcagcttcctgtttcagtaggg

SEQ ID NO: 7742 - DNA, 25 bp, Homo sapiens
aggggagtgacctaactggcctaat

SEQ ID NO: 7743 - DNA, 25 bp, Homo sapiens
ttaatgggataccccgacatttcca

SEQ ID NO: 7744 - DNA, 25 bp, Homo sapiens
ttgtgtctgtgctaacctgggaact

SEQ ID NO: 7745 - DNA, 25 bp, Homo sapiens
gttctttgcttctgcacaagatcca

SEQ ID NO: 7746 - DNA, 25 bp, Homo sapiens
cagaagaacttcacctgcagacctc

SEQ ID NO: 7747 - DNA, 25 bp, Homo sapiens
gcagacctcttcaagtgacactatg

SEQ ID NO: 7748 - DNA, 25 bp, Homo sapiens
taaaaccactgcctattgtaactac

SEQ ID NO: 7749 - DNA, 25 bp, Homo sapiens
agccatttgaagacgcctcgtttgc

SEQ ID NO: 7750 - DNA, 25 bp, Homo sapiens
atttgaagacgcctcgtttgcgctg

SEQ ID NO: 7751 - DNA, 25 bp, Homo sapiens
tattgttcccacaatggctgggagg

SEQ ID NO: 7752 - DNA, 25 bp, Homo sapiens
ccgccagattctcccttaaggaatt

SEQ ID NO: 7753 - DNA, 25 bp, Homo sapiens
gattctcccttaaggaattgacttc

SEQ ID NO: 7754 - DNA, 25 bp, Homo sapiens
aaggaattgacttcagcaggggtgg

SEQ ID NO: 7755 - DNA, 25 bp, Homo sapiens
ggtgctggaggcagactcgagggcc

SEQ ID NO: 7756 - DNA, 25 bp, Homo sapiens
ggaggcagactcgagggccgaattg

SEQ ID NO: 7757 - DNA, 25 bp, Homo sapiens
cagactcgagggccgaattgtttct

SEQ ID NO: 7758 - DNA, 25 bp, Homo sapiens
tcagtcgcaaaggtgaacactcatg

SEQ ID NO: 7759 - DNA, 25 bp, Homo sapiens
aaaggtgaacactcatgcggcagcc

SEQ ID NO: 7760 - DNA, 25 bp, Homo sapiens
ccgttcctggagctggacacgaatt

SEQ ID NO: 7761 - DNA, 25 bp, Homo sapiens
tggagctggacacgaatttgcccgc

SEQ ID NO: 7762 - DNA, 25 bp, Homo sapiens
gtgcccgcggggctggagaaacgac

SEQ ID NO: 7763 - DNA, 25 bp, Homo sapiens
ggggctggagaaacgactctgcgcc

SEQ ID NO: 7764 - DNA, 25 bp, Homo sapiens
gcaaacctgcggaccgcgtgaacgt

SEQ ID NO: 7765 - DNA, 25 bp, Homo sapiens
gaccgcgtgaacgtgacggtacggc

SEQ ID NO: 7766 - DNA, 25 bp, Homo sapiens
ctagccctgggccaggaccggatac

SEQ ID NO: 7767 - DNA, 25 bp, Homo sapiens
caggaccggatacttatccgctttt

SEQ ID NO: 7768 - DNA, 25 bp, Homo sapiens
agtcctggcagattggcaagatagg

SEQ ID NO: 7769 - DNA, 25 bp, Homo sapiens
gatagggacggtcatgactttttta

SEQ ID NO: 7770 - DNA, 25 bp, Homo sapiens
gattgggcacggagggatccagggc

SEQ ID NO: 7771 - DNA, 25 bp, Homo sapiens
tcttccccgagaacttcactgagag

SEQ ID NO: 7772 - DNA, 25 bp, Homo sapiens
cactgagagggtcccatgacggcgg

SEQ ID NO: 7773 - DNA, 25 bp, Homo sapiens
gcagcctccgggcgtgtgaagaaca

SEQ ID NO: 7774 - DNA, 25 bp, Homo sapiens
gagacccccaggcagaggggcgttc

SEQ ID NO: 7775 - DNA, 25 bp, Homo sapiens
ttaggtcgttttccaaagagccgcg

SEQ ID NO: 7776 - DNA, 25 bp, Homo sapiens
caagtccggcggaattcaccagtgt

SEQ ID NO: 7777 - DNA, 25 bp, Homo sapiens
caccagtgttcctgaagctgctgtg

SEQ ID NO: 7778 - DNA, 25 bp, Homo sapiens
agctgctgtgtcctctagttgagtt

SEQ ID NO: 7779 - DNA, 25 bp, Homo sapiens
ccgagccaccatacttaactgaagc

SEQ ID NO: 7780 - DNA, 25 bp, Homo sapiens
tcttttcctggcagctgctgtgggt

SEQ ID NO: 7781 - DNA, 25 bp, Homo sapiens
cgcagacggtctgtgtgctgtttga

SEQ ID NO: 7782 - DNA, 25 bp, Homo sapiens
gagaggaccaaccagaattcccttt

SEQ ID NO: 7783 - DNA, 25 bp, Homo sapiens
gaattccctttggacatttgtgttt

SEQ ID NO: 7784 - DNA, 25 bp, Homo sapiens
gcaactcgtacccaaatttccaaga

SEQ ID NO: 7785 - DNA, 25 bp, Homo sapiens
acatgacctatccaagcgcattacc

SEQ ID NO: 7786 - DNA, 25 bp, Homo sapiens
atcagtggccaggccaaccttggct

SEQ ID NO: 7787 - DNA, 25 bp, Homo sapiens
gccaaccttggctaaatggagcagc

SEQ ID NO: 7788 - DNA, 25 bp, Homo sapiens
ggagaatcgtgtgatcagtgtgcta

SEQ ID NO: 7789 - DNA, 25 bp, Homo sapiens
aaatgctcttatttttccaacagct

SEQ ID NO: 7790 - DNA, 25 bp, Homo sapiens
ttttccaacagctaaactactctta

SEQ ID NO: 7791 - DNA, 25 bp, Homo sapiens
agttgaacagtgtgccctagctttt

SEQ ID NO: 7792 - DNA, 25 bp, Homo sapiens
cctagcttttcttgcaaccagagta

SEQ ID NO: 7793 - DNA, 25 bp, Homo sapiens
gtagtgtatcactgagtcatttgca

SEQ ID NO: 7794 - DNA, 25 bp, Homo sapiens
tgttttctgccacagacctttgggc

SEQ ID NO: 7795 - DNA, 25 bp, Homo sapiens
tgggctgccttatattgtgtgtgtg

SEQ ID NO: 7796 - DNA, 25 bp, Homo sapiens
aagcatgtgtcatccatatttctct

SEQ ID NO: 7797 - DNA, 25 bp, Homo sapiens
ttggagtgagggaggctacctggag

SEQ ID NO: 7798 - DNA, 25 bp, Homo sapiens
ctacctggaggggatcagcccactg

SEQ ID NO: 7799 - DNA, 25 bp, Homo sapiens
cagcccactgacagaccttaatctt

SEQ ID NO: 7800 - DNA, 25 bp, Homo sapiens
attactgctgtggctagagagtttg

SEQ ID NO: 7801 - DNA, 25 bp, Homo sapiens
atatggcatccttcaatttctgtat

SEQ ID NO: 7802 - DNA, 25 bp, Homo sapiens
gtaaaagctttggtttgtgttcgtg

SEQ ID NO: 7803 - DNA, 25 bp, Homo sapiens
tgttctctccgtgaaacttaccttt

SEQ ID NO: 7804 - DNA, 25 bp, Homo sapiens
gaaggccataaagcagcagctgttc

SEQ ID NO: 7805 - DNA, 25 bp, Homo sapiens
ttccagtcctggatttagcccaaag

SEQ ID NO: 7806 - DNA, 25 bp, Homo sapiens
agaatgggtggttgcccatctctgc

SEQ ID NO: 7807 - DNA, 25 bp, Homo sapiens
gaagttttacaagtacctccaatga

SEQ ID NO: 7808 - DNA, 25 bp, Homo sapiens
aaagtatcacattcaggtctgcact

SEQ ID NO: 7809 - DNA, 25 bp, Homo sapiens
ctgcatgcttcgaaactctgacagc

SEQ ID NO: 7810 - DNA, 25 bp, Homo sapiens
ctgacagcatactggaggccattca

SEQ ID NO: 7811 - DNA, 25 bp, Homo sapiens
ggttggggagactacacctgacaaa

SEQ ID NO: 7812 - DNA, 25 bp, Homo sapiens
acacctgacaaacttttcactctta

SEQ ID NO: 7813 - DNA, 25 bp, Homo sapiens
ttaggggcctgtgtgaacgcaccaa

SEQ ID NO: 7814 - DNA, 25 bp, Homo sapiens
ggccaaggagtggacgcttctcttg

SEQ ID NO: 7815 - DNA, 25 bp, Homo sapiens
ggccatgggtgcagaccgaggtatc

SEQ ID NO: 7816 - DNA, 25 bp, Homo sapiens
ccgaggtatccacgtggaggtgccc

SEQ ID NO: 7817 - DNA, 25 bp, Homo sapiens
cagaagcagaacgcttgggtcccct

SEQ ID NO: 7818 - DNA, 25 bp, Homo sapiens
ggtgctgctgggcaaacaggccatc

SEQ ID NO: 7819 - DNA, 25 bp, Homo sapiens
ttgactggccacagggcacattcgc

SEQ ID NO: 7820 - DNA, 25 bp, Homo sapiens
gcctgaagctgccagctgtggtgac

SEQ ID NO: 7821 - DNA, 25 bp, Homo sapiens
tggtgacagctgacctgaggctcaa

SEQ ID NO: 7822 - DNA, 25 bp, Homo sapiens
cacgctgcccaacatcatgaaagcc

SEQ ID NO: 7823 - DNA, 25 bp, Homo sapiens
atcgaggtgatcaagcctggggacc

SEQ ID NO: 7824 - DNA, 25 bp, Homo sapiens
ctgtgatcagtgtggaggacccgcc

SEQ ID NO: 7825 - DNA, 25 bp, Homo sapiens
tggagaccactgaggacctggtggc

SEQ ID NO: 7826 - DNA, 25 bp, Homo sapiens
aaccctattgtcctttatgcatttt

SEQ ID NO: 7827 - DNA, 25 bp, Homo sapiens
gaaggctaatatgcttgctttattt

SEQ ID NO: 7828 - DNA, 25 bp, Homo sapiens
cccaacgtatctggctggcagtctt

SEQ ID NO: 7829 - DNA, 25 bp, Homo sapiens
tatctggctggcagtctttgtcgtt

SEQ ID NO: 7830 - DNA, 25 bp, Homo sapiens
tctttgtcgttgttcattctgggga

SEQ ID NO: 7831 - DNA, 25 bp, Homo sapiens
ggctagcagttctaatgtgacattc

SEQ ID NO: 7832 - DNA, 25 bp, Homo sapiens
tgtgacattctttaagcatatctta

SEQ ID NO: 7833 - DNA, 25 bp, Homo sapiens
ataagctcagctaattcaagacact

SEQ ID NO: 7834 - DNA, 25 bp, Homo sapiens
gacactgtagtcacttgtgcatcag

SEQ ID NO: 7835 - DNA, 25 bp, Homo sapiens
tgtgcatcagtgtgcttgaatttag

SEQ ID NO: 7836 - DNA, 25 bp, Homo sapiens
gaagtacctcatgttgaatgttatt

SEQ ID NO: 7837 - DNA, 25 bp, Homo sapiens
ctgccctccaagatgctggtgatag

SEQ ID NO: 7838 - DNA, 25 bp, Homo sapiens
tgagggacaacagacttcacttccc

SEQ ID NO: 7839 - DNA, 25 bp, Homo sapiens
atcaggaaaaatacaccccatcgcc

SEQ ID NO: 7840 - DNA, 25 bp, Homo sapiens
ccctgctgataccaccagacagaga

SEQ ID NO: 7841 - DNA, 25 bp, Homo sapiens
gagagagagcacttgattcttcccg

SEQ ID NO: 7842 - DNA, 25 bp, Homo sapiens
ttcttcccgagatagccacctggaa

SEQ ID NO: 7843 - DNA, 25 bp, Homo sapiens
ctggaaacactaggtgcctgcccag

SEQ ID NO: 7844 - DNA, 25 bp, Homo sapiens
ccaccttttgctccaccggaggtgg

SEQ ID NO: 7845 - DNA, 25 bp, Homo sapiens
gaaaatctgggcacgatcgggcccc

SEQ ID NO: 7846 - DNA, 25 bp, Homo sapiens
gcagtgcaggacaacatcagctcac

SEQ ID NO: 7847 - DNA, 25 bp, Homo sapiens
ggggaacagcaggtgccagagctaa

SEQ ID NO: 7848 - DNA, 25 bp, Homo sapiens
ggcagctggaatttaaggagggaca

SEQ ID NO: 7849 - DNA, 25 bp, Homo sapiens
aagtgcaaagttattccccatcttc

SEQ ID NO: 7850 - DNA, 25 bp, Homo sapiens
ccatcttccaagggttgaattctgg

SEQ ID NO: 7851 - DNA, 25 bp, Homo sapiens
gaagaagacacattcctagttcccc

SEQ ID NO: 7852 - DNA, 25 bp, Homo sapiens
cccgtgaacttcctttgacttattg

SEQ ID NO: 7853 - DNA, 25 bp, Homo sapiens
ttgacttattgtccccactaaaaca

SEQ ID NO: 7854 - DNA, 25 bp, Homo sapiens
tttcttgcagtttttttatggcatt

SEQ ID NO: 7855 - DNA, 25 bp, Homo sapiens
aaagatgccctaagtgttgaagaag

SEQ ID NO: 7856 - DNA, 25 bp, Homo sapiens
aaagcaccaaattcatgtacagcat

SEQ ID NO: 7857 - DNA, 25 bp, Homo sapiens
catgtacagcatgcatcacggatca

SEQ ID NO: 7858 - DNA, 25 bp, Homo sapiens
gcatcacggatcaatagactgtact

SEQ ID NO: 7859 - DNA, 25 bp, Homo sapiens
ctcacccaggcaatcttgccttctg

SEQ ID NO: 7860 - DNA, 25 bp, Homo sapiens
cttccagccacattgagactttctt

SEQ ID NO: 7861 - DNA, 25 bp, Homo sapiens
gagactttcttctagtgcttttcag

SEQ ID NO: 7862 - DNA, 25 bp, Homo sapiens
gatactcacgtttgcttaaaccctt

SEQ ID NO: 7863 - DNA, 25 bp, Homo sapiens
ttaaaccctttagtgctttgtgata

SEQ ID NO: 7864 - DNA, 25 bp, Homo sapiens
tatttacagctctgtaacctcccgt

SEQ ID NO: 7865 - DNA, 25 bp, Homo sapiens
tcccgttgcgtcaagtctaaaccaa

SEQ ID NO: 7866 - DNA, 25 bp, Homo sapiens
gtggcataacgactgctttaactgt

SEQ ID NO: 7867 - DNA, 25 bp, Homo sapiens
taactgtaagaagtgctccctctca

SEQ ID NO: 7868 - DNA, 25 bp, Homo sapiens
gcgtggcttcctcacagagagggac

SEQ ID NO: 7869 - DNA, 25 bp, Homo sapiens
cagagagggacgacatcctgtgccc

SEQ ID NO: 7870 - DNA, 25 bp, Homo sapiens
acaccagaagtgccatgctcagaaa

SEQ ID NO: 7871 - DNA, 25 bp, Homo sapiens
cttcgaccacgtgatcaccaacatg

SEQ ID NO: 7872 - DNA, 25 bp, Homo sapiens
acaacaattatgagccccgcagtgg

SEQ ID NO: 7873 - DNA, 25 bp, Homo sapiens
caagttcacctgcaaggtgcccggt

SEQ ID NO: 7874 - DNA, 25 bp, Homo sapiens
gagcgtgcacagaaggtggtcacct

SEQ ID NO: 7875 - DNA, 25 bp, Homo sapiens
accttctgtgactatgcctacaaca

SEQ ID NO: 7876 - DNA, 25 bp, Homo sapiens
caccgacaagaactcactactgggc

SEQ ID NO: 7877 - DNA, 25 bp, Homo sapiens
gggcatggagggtgccaacagcatc

SEQ ID NO: 7878 - DNA, 25 bp, Homo sapiens
ttccagatatggaggcctgacctgt

SEQ ID NO: 7879 - DNA, 25 bp, Homo sapiens
gtagggcttggtgaatgctgctgag

SEQ ID NO: 7880 - DNA, 25 bp, Homo sapiens
ggaacagtggtctaattcaactctg

SEQ ID NO: 7881 - DNA, 25 bp, Homo sapiens
ggaaggcaactcagctggaggggca

SEQ ID NO: 7882 - DNA, 25 bp, Homo sapiens
ccggttcccagcataccaaagaagc

SEQ ID NO: 7883 - DNA, 25 bp, Homo sapiens
tcccttggtcccctcaaaagtgagt

SEQ ID NO: 7884 - DNA, 25 bp, Homo sapiens
gggagaggtagacactgcaccacag

SEQ ID NO: 7885 - DNA, 25 bp, Homo sapiens
atgtgcttcaaagttccttatccca

SEQ ID NO: 7886 - DNA, 25 bp, Homo sapiens
aacacccccatgatacaggtctgtg

SEQ ID NO: 7887 - DNA, 25 bp, Homo sapiens
tatatccctacgttaactttgccta

SEQ ID NO: 7888 - DNA, 25 bp, Homo sapiens
ctagtagaggcccttctttgcactt

SEQ ID NO: 7889 - DNA, 25 bp, Homo sapiens
tttgcacttgcttctcatttggcta

SEQ ID NO: 7890 - DNA, 25 bp, Homo sapiens
ctaaggaagtccattctcctctgta

SEQ ID NO: 7891 - DNA, 25 bp, Homo sapiens
tgataccctgggcctttagtgtaac

SEQ ID NO: 7892 - DNA, 25 bp, Homo sapiens
aagtattttccagcagtccaaagat

SEQ ID NO: 7893 - DNA, 25 bp, Homo sapiens
aatacgatttgagacctgaattggt

SEQ ID NO: 7894 - DNA, 25 bp, Homo sapiens
tggtctttggtttccagtgcatcac

SEQ ID NO: 7895 - DNA, 25 bp, Homo sapiens
tccagtgcatcacagcatattttgt

SEQ ID NO: 7896 - DNA, 25 bp, Homo sapiens
actactgcacttgagcatgaatggg

SEQ ID NO: 7897 - DNA, 25 bp, Homo sapiens
atgggtagtagccaaactcacaaat

SEQ ID NO: 7898 - DNA, 25 bp, Homo sapiens
ggagtgatgaacctgcttataccta

SEQ ID NO: 7899 - DNA, 25 bp, Homo sapiens
taagggcaggagcaagcccctcaca

SEQ ID NO: 7900 - DNA, 25 bp, Homo sapiens
cccctcacaatgcagctgcatgggt

SEQ ID NO: 7901 - DNA, 25 bp, Homo sapiens
gctgcatgggtttttagtgcctact

SEQ ID NO: 7902 - DNA, 25 bp, Homo sapiens
actaactttgtgctatctttatgaa

SEQ ID NO: 7903 - DNA, 25 bp, Homo sapiens
attgtggatgtcctgaacagccctt

SEQ ID NO: 7904 - DNA, 25 bp, Homo sapiens
gaacagccctttggaaggacctgac

SEQ ID NO: 7905 - DNA, 25 bp, Homo sapiens
aggacctgaccagaagagcttcatt

SEQ ID NO: 7906 - DNA, 25 bp, Homo sapiens
agaagagcttcattcctgtggaaag

SEQ ID NO: 7907 - DNA, 25 bp, Homo sapiens
ggtcaggatgaccacaactggaaga

SEQ ID NO: 7908 - DNA, 25 bp, Homo sapiens
gagttctatgctaatgaggcctgta

SEQ ID NO: 7909 - DNA, 25 bp, Homo sapiens
cctgtaaacgcttgcaggcccatgg

SEQ ID NO: 7910 - DNA, 25 bp, Homo sapiens
gccttggtgggcagtcctattatct

SEQ ID NO: 7911 - DNA, 25 bp, Homo sapiens
atggctcaggtggatgcttggaaac

SEQ ID NO: 7912 - DNA, 25 bp, Homo sapiens
gaaacatctgccacatttagtgtgt

SEQ ID NO: 7913 - DNA, 25 bp, Homo sapiens
aacagaaatcgcatcaaggtgacca

SEQ ID NO: 7914 - DNA, 25 bp, Homo sapiens
gctggaatacttactcttgtcggga

SEQ ID NO: 7915 - DNA, 25 bp, Homo sapiens
gtggtcacaggggtgtcttgtctga

SEQ ID NO: 7916 - DNA, 25 bp, Homo sapiens
tacaattcagtcttctctttggggt

SEQ ID NO: 7917 - DNA, 25 bp, Homo sapiens
ataggactggaagtttgcccctgtt

SEQ ID NO: 7918 - DNA, 25 bp, Homo sapiens
tgtgcatttgagatagttttcccta

SEQ ID NO: 7919 - DNA, 25 bp, Homo sapiens
gttttccctattctgtggatacagt

SEQ ID NO: 7920 - DNA, 25 bp, Homo sapiens
gagttttcagggagtacacaggtag

SEQ ID NO: 7921 - DNA, 25 bp, Homo sapiens
gtttgaagcattgaccttttattta

SEQ ID NO: 7922 - DNA, 25 bp, Homo sapiens
ttatttctctttcatcaaaacaaaa

SEQ ID NO: 7923 - DNA, 25 bp, Homo sapiens
tactatctctgtattgttctgaccc

SEQ ID NO: 7924 - DNA, 25 bp, Homo sapiens
tctgtattgttctgaccctggtaaa

SEQ ID NO: 7925 - DNA, 25 bp, Homo sapiens
gatacattcgtcagacacaagatcc

SEQ ID NO: 7926 - DNA, 25 bp, Homo sapiens
gacacaagatcccagtgatggcctt

SEQ ID NO: 7927 - DNA, 25 bp, Homo sapiens
gatggccttggtagggaatgatgct

SEQ ID NO: 7928 - DNA, 25 bp, Homo sapiens
gtagggaatgatgctggctggacac

SEQ ID NO: 7929 - DNA, 25 bp, Homo sapiens
gctggctggacacagatttctcggg

SEQ ID NO: 7930 - DNA, 25 bp, Homo sapiens
gacacagatttctcgggagcaggtg

SEQ ID NO: 7931 - DNA, 25 bp, Homo sapiens
cctgtggcctggcctacactgatta

SEQ ID NO: 7932 - DNA, 25 bp, Homo sapiens
cctggcctacactgattatcacaag

SEQ ID NO: 7933 - DNA, 25 bp, Homo sapiens
acaaggcagccatgggtctgggggc

SEQ ID NO: 7934 - DNA, 25 bp, Homo sapiens
cttgctgctctcacgggagaacgag

SEQ ID NO: 7935 - DNA, 25 bp, Homo sapiens
ggagaacgaggatcaggtggtcaag

SEQ ID NO: 7936 - DNA, 25 bp, Homo sapiens
aatgcgaaggctaagtgtcaccccc

SEQ ID NO: 7937 - DNA, 25 bp, Homo sapiens
tctggctgggccttgctaagggcca

SEQ ID NO: 7938 - DNA, 25 bp, Homo sapiens
tagggggcagccagtccaaatgcca

SEQ ID NO: 7939 - DNA, 25 bp, Homo sapiens
aagaagaccagttcttgccctgatt

SEQ ID NO: 7940 - DNA, 25 bp, Homo sapiens
ggccaatcagattttctatgttcta

SEQ ID NO: 7941 - DNA, 25 bp, Homo sapiens
tgttctaaggacatggctgctgtag

SEQ ID NO: 7942 - DNA, 25 bp, Homo sapiens
aattatccccagaagcagcatgaca

SEQ ID NO: 7943 - DNA, 25 bp, Homo sapiens
gacagaatgcctcggggagcacttg

SEQ ID NO: 7944 - DNA, 25 bp, Homo sapiens
atcccttggtaaagacacagcctgt

SEQ ID NO: 7945 - DNA, 25 bp, Homo sapiens
acagcctgttaggctcgtgtgggcc

SEQ ID NO: 7946 - DNA, 25 bp, Homo sapiens
gcctccagtatgttcaccaggggaa

SEQ ID NO: 7947 - DNA, 25 bp, Homo sapiens
aacgatgtcacatgcgtgttcgacc

SEQ ID NO: 7948 - DNA, 25 bp, Homo sapiens
ccaggctaacatcatcttcgacatc

SEQ ID NO: 7949 - DNA, 25 bp, Homo sapiens
tcacggaagggaacctgcgggactc

SEQ ID NO: 7950 - DNA, 25 bp, Homo sapiens
tgcgggactcttttgacatcatcaa

SEQ ID NO: 7951 - DNA, 25 bp, Homo sapiens
agcgttacatggacggcatgaccgt

SEQ ID NO: 7952 - DNA, 25 bp, Homo sapiens
tttcatgccgtcctgaagctggaga

SEQ ID NO: 7953 - DNA, 25 bp, Homo sapiens
tcccaccgaaatgttgtcaacgtcc

SEQ ID NO: 7954 - DNA, 25 bp, Homo sapiens
catcttcgtctctgagtactggttc

SEQ ID NO: 7955 - DNA, 25 bp, Homo sapiens
cctccaggccaaatcattgctgcca

SEQ ID NO: 7956 - DNA, 25 bp, Homo sapiens
gctgccagtgactgtggtctgtact

SEQ ID NO: 7957 - DNA, 25 bp, Homo sapiens
ggtctgtacttgtttataccctcag

SEQ ID NO: 7958 - DNA, 25 bp, Homo sapiens
cactgattcctacccggttgtgaag

SEQ ID NO: 7959 - DNA, 25 bp, Homo sapiens
gcccgctgggcacagcaagggggag

SEQ ID NO: 7960 - DNA, 25 bp, Homo sapiens
ggcacccgagctaggggaggagccc

SEQ ID NO: 7961 - DNA, 25 bp, Homo sapiens
gctgctgaggcagtttgacctggcc

SEQ ID NO: 7962 - DNA, 25 bp, Homo sapiens
ctggtgtcgggccaagcagatgggc

SEQ ID NO: 7963 - DNA, 25 bp, Homo sapiens
caagcagatgggcttggagcctccc

SEQ ID NO: 7964 - DNA, 25 bp, Homo sapiens
ccccagaggtgtggcaggtgctgaa

SEQ ID NO: 7965 - DNA, 25 bp, Homo sapiens
atcccctatgaggcaccacgtaaga

SEQ ID NO: 7966 - DNA, 25 bp, Homo sapiens
atgaggcaccacgtaagacctcctg

SEQ ID NO: 7967 - DNA, 25 bp, Homo sapiens
cagaagcgagagcccattgctcctg

SEQ ID NO: 7968 - DNA, 25 bp, Homo sapiens
catgggccggaagcggctcatcact

SEQ ID NO: 7969 - DNA, 25 bp, Homo sapiens
ttatgcatgctgtgacttagtctat

SEQ ID NO: 7970 - DNA, 25 bp, Homo sapiens
attccaaaattgcttagtcaccatg

SEQ ID NO: 7971 - DNA, 25 bp, Homo sapiens
gtcaccatgcagtgtctgtattttt

SEQ ID NO: 7972 - DNA, 25 bp, Homo sapiens
gaggtggtattacattattcctaat

SEQ ID NO: 7973 - DNA, 25 bp, Homo sapiens
cgttctcttcaattaatggcccttt

SEQ ID NO: 7974 - DNA, 25 bp, Homo sapiens
ggaccaggcttttattttccctgat

SEQ ID NO: 7975 - DNA, 25 bp, Homo sapiens
ccatgcccagtcttcaaatttctaa

SEQ ID NO: 7976 - DNA, 25 bp, Homo sapiens
aatacatgccattaacacagatcaa

SEQ ID NO: 7977 - DNA, 25 bp, Homo sapiens
gacgacccaggatctactatattag

SEQ ID NO: 7978 - DNA, 25 bp, Homo sapiens
agcaggtagcttcttttttctcaaa

SEQ ID NO: 7979 - DNA, 25 bp, Homo sapiens
tactgccaccagattttttattaca

SEQ ID NO: 7980 - DNA, 25 bp, Homo sapiens
aaaagcactctcatcagatatctga

SEQ ID NO: 7981 - DNA, 25 bp, Homo sapiens
ggtgtttatactgatttgattgtgc

SEQ ID NO: 7982 - DNA, 25 bp, Homo sapiens
tttctcttagtcttcttatttaatt

SEQ ID NO: 7983 - DNA, 25 bp, Homo sapiens
aattaacttcattgccgctggattc

SEQ ID NO: 7984 - DNA, 25 bp, Homo sapiens
cattgccgctggattctgttcagcc

SEQ ID NO: 7985 - DNA, 25 bp, Homo sapiens
tatttcttagtggtcattgctctgc

SEQ ID NO: 7986 - DNA, 25 bp, Homo sapiens
ttattgttcagccttatcccttggc

SEQ ID NO: 7987 - DNA, 25 bp, Homo sapiens
ggcacgtaaacagactactagactt

SEQ ID NO: 7988 - DNA, 25 bp, Homo sapiens
gtaggttcgtttgagctttgtgttg

SEQ ID NO: 7989 - DNA, 25 bp, Homo sapiens
gtgtgatactaaggtttgactgcta

SEQ ID NO: 7990 - DNA, 25 bp, Homo sapiens
ttatttgtactgttgatcacatgta

SEQ ID NO: 7991 - DNA, 25 bp, Homo sapiens
agggagcagagctgcctcgagaacc

SEQ ID NO: 7992 - DNA, 25 bp, Homo sapiens
aaccttctgaggctccaatcacttt

SEQ ID NO: 7993 - DNA, 25 bp, Homo sapiens
gggccaaggcctaatgagtcagatt

SEQ ID NO: 7994 - DNA, 25 bp, Homo sapiens
ggactttgaaacacacgaacctggc

SEQ ID NO: 7995 - DNA, 25 bp, Homo sapiens
acgaacctggcgaagaggcttccct

SEQ ID NO: 7996 - DNA, 25 bp, Homo sapiens
gatggaccaggaactagcacacacc

SEQ ID NO: 7997 - DNA, 25 bp, Homo sapiens
ctagcacacacctgcatcagcaaaa

SEQ ID NO: 7998 - DNA, 25 bp, Homo sapiens
aagtggaacctgtatcccagactac

SEQ ID NO: 7999 - DNA, 25 bp, Homo sapiens
gaatcctatagctcccaagctggac

SEQ ID NO: 8000 - DNA, 25 bp, Homo sapiens
caacaccgatcacagaccaacaagt

SEQ ID NO: 8001 - DNA, 25 bp, Homo sapiens
aaccagcacatttagcttctctttt

SEQ ID NO: 8002 - DNA, 25 bp, Homo sapiens
gatggtgatattttccttacaagat

SEQ ID NO: 8003 - DNA, 25 bp, Homo sapiens
actaactagggctttgtattgtcaa

SEQ ID NO: 8004 - DNA, 25 bp, Homo sapiens
gaaaactcttaagctctcttcagtc

SEQ ID NO: 8005 - DNA, 25 bp, Homo sapiens
aagctctcttcagtctctgtaatgt

SEQ ID NO: 8006 - DNA, 25 bp, Homo sapiens
tgtttctgattgcatgtttcttcat

SEQ ID NO: 8007 - DNA, 25 bp, Homo sapiens
taaatgtaggctcagctctttccca

SEQ ID NO: 8008 - DNA, 25 bp, Homo sapiens
aaagctttaagtgcctaaccctgct

SEQ ID NO: 8009 - DNA, 25 bp, Homo sapiens
accctgcttgtctctgtacatagaa

SEQ ID NO: 8010 - DNA, 25 bp, Homo sapiens
gtctctgtacatagaagcctgcaca

SEQ ID NO: 8011 - DNA, 25 bp, Homo sapiens
acagatccaacccttgctaggtatc

SEQ ID NO: 8012 - DNA, 25 bp, Homo sapiens
tcatagtttaggcccatttaccttc

SEQ ID NO: 8013 - DNA, 25 bp, Homo sapiens
tttgttgcgtgtttccattttaaag

SEQ ID NO: 8014 - DNA, 25 bp, Homo sapiens
agccagactcattgcaccttcaatg

SEQ ID NO: 8015 - DNA, 25 bp, Homo sapiens
gcaccttcaatgtctgcatagatcc

SEQ ID NO: 8016 - DNA, 25 bp, Homo sapiens
ttccaactccagaatgatccccaat

SEQ ID NO: 8017 - DNA, 25 bp, Homo sapiens
ccaatcaccctaatctcagaatgct

SEQ ID NO: 8018 - DNA, 25 bp, Homo sapiens
tgtctgttggaaaacccaggactcc

SEQ ID NO: 8019 - DNA, 25 bp, Homo sapiens
tcccatctctttctaggtgtttgca

SEQ ID NO: 8020 - DNA, 25 bp, Homo sapiens
gatgatggttctagagtgtacttcc

SEQ ID NO: 8021 - DNA, 25 bp, Homo sapiens
gtacttccatttgtaagtcctcctg

SEQ ID NO: 8022 - DNA, 25 bp, Homo sapiens
aagtcctcctgataagtgctttctt

SEQ ID NO: 8023 - DNA, 25 bp, Homo sapiens
tgctttcttgtttatcactatgtaa

SEQ ID NO: 8024 - DNA, 25 bp, Homo sapiens
attatatcagattcgtttacttcgt

SEQ ID NO: 8025 - DNA, 25 bp, Homo sapiens
aaatcttaggggtcattatcactta

SEQ ID NO: 8026 - DNA, 25 bp, Homo sapiens
aatactgtacctaggtctttcaaat

SEQ ID NO: 8027 - DNA, 25 bp, Homo sapiens
ttgaaccatggttgacttacaagtg

SEQ ID NO: 8028 - DNA, 25 bp, Homo sapiens
gacttacaagtgtcactacagcttt

SEQ ID NO: 8029 - DNA, 25 bp, Homo sapiens
ttaagcaggacccgggtgagccagt

SEQ ID NO: 8030 - DNA, 25 bp, Homo sapiens
agagctggaagaaggccgtccatcc

SEQ ID NO: 8031 - DNA, 25 bp, Homo sapiens
ccatcctgtctcttgggcggacagt

SEQ ID NO: 8032 - DNA, 25 bp, Homo sapiens
gggcggacagtgtactttcctaata

SEQ ID NO: 8033 - DNA, 25 bp, Homo sapiens
ggaagcacaatggaaatacccctga

SEQ ID NO: 8034 - DNA, 25 bp, Homo sapiens
atacccctgaaccgttttattgcag

SEQ ID NO: 8035 - DNA, 25 bp, Homo sapiens
aggcctctcgagccatgatagagaa

SEQ ID NO: 8036 - DNA, 25 bp, Homo sapiens
caaatatgtctccctgcatgtcagg

SEQ ID NO: 8037 - DNA, 25 bp, Homo sapiens
gcagatggggaggacgcctatgcca

SEQ ID NO: 8038 - DNA, 25 bp, Homo sapiens
gatggccgacgagctgaggcggcac

SEQ ID NO: 8039 - DNA, 25 bp, Homo sapiens
aggcggcacctggagctgaaagaga

SEQ ID NO: 8040 - DNA, 25 bp, Homo sapiens
agagaagggcaggcacgtggtgctg

SEQ ID NO: 8041 - DNA, 25 bp, Homo sapiens
gagagcaaaggcaattcacctccga

SEQ ID NO: 8042 - DNA, 25 bp, Homo sapiens
attcacctccgagctcaggagaggc

SEQ ID NO: 8043 - DNA, 25 bp, Homo sapiens
gcctgtcgcgaggagaagggcctgg

SEQ ID NO: 8044 - DNA, 25 bp, Homo sapiens
gcctggctgccgaggatagtggtgg

SEQ ID NO: 8045 - DNA, 25 bp, Homo sapiens
ggacagcaaggacctcagcgaggtc

SEQ ID NO: 8046 - DNA, 25 bp, Homo sapiens
tcctggtgaggagcttctatctgaa

SEQ ID NO: 8047 - DNA, 25 bp, Homo sapiens
gttccacttcctgagttggtatgac

SEQ ID NO: 8048 - DNA, 25 bp, Homo sapiens
cgtcctgatcgacatggttctcaac

SEQ ID NO: 8049 - DNA, 25 bp, Homo sapiens
gattgatatcgcagcgaccctggag

SEQ ID NO: 8050 - DNA, 25 bp, Homo sapiens
gcacttgagggaccagagacccggc

SEQ ID NO: 8051 - DNA, 25 bp, Homo sapiens
agacccggcatggtccagacgaagg

SEQ ID NO: 8052 - DNA, 25 bp, Homo sapiens
aggagcagtttgagttcgcgctgac

SEQ ID NO: 8053 - DNA, 25 bp, Homo sapiens
ttcgcgctgacagccgtggctgagg

SEQ ID NO: 8054 - DNA, 25 bp, Homo sapiens
accccacggatgttgtcaggaatca

SEQ ID NO: 8055 - DNA, 25 bp, Homo sapiens
tagtaatagggcccttagctctccc

SEQ ID NO: 8056 - DNA, 25 bp, Homo sapiens
ctcccgtagtcagcgcagtttagca

SEQ ID NO: 8057 - DNA, 25 bp, Homo sapiens
gatggagccaggcatcggcaagggc

SEQ ID NO: 8058 - DNA, 25 bp, Homo sapiens
gcctcaagcctgagtggaagcacct

SEQ ID NO: 8059 - DNA, 25 bp, Homo sapiens
gcacctgaggaccggggatcgggac

SEQ ID NO: 8060 - DNA, 25 bp, Homo sapiens
tggaagccagcttaaaccctagccc

SEQ ID NO: 8061 - DNA, 25 bp, Homo sapiens
taaaccctagccctgtgagagcttc

SEQ ID NO: 8062 - DNA, 25 bp, Homo sapiens
tgtatcagacagttgcacacccagg

SEQ ID NO: 8063 - DNA, 25 bp, Homo sapiens
gaacctgaacagctactattcccag

SEQ ID NO: 8064 - DNA, 25 bp, Homo sapiens
cctcacatacagtctcaagcacatt

SEQ ID NO: 8065 - DNA, 25 bp, Homo sapiens
aaattaagtttgcagccatcggccc

SEQ ID NO: 8066 - DNA, 25 bp, Homo sapiens
ccttcctgtaagctgcactgcagag

SEQ ID NO: 8067 - DNA, 25 bp, Homo sapiens
ctggccactggcatcaggaaggctc

SEQ ID NO: 8068 - DNA, 25 bp, Homo sapiens
aatgaccatggttgcagcccaagtc

SEQ ID NO: 8069 - DNA, 25 bp, Homo sapiens
catgttgctgtcactgtcggaggca

SEQ ID NO: 8070 - DNA, 25 bp, Homo sapiens
actcagccaggctgctgggggatgc

SEQ ID NO: 8071 - DNA, 25 bp, Homo sapiens
gggatgcttcagtttcctttacaga

SEQ ID NO: 8072 - DNA, 25 bp, Homo sapiens
actgcgtggtgggaatccaggccaa

SEQ ID NO: 8073 - DNA, 25 bp, Homo sapiens
gacagctctcaatcctcatataggg

SEQ ID NO: 8074 - DNA, 25 bp, Homo sapiens
gctatcgaacttggctatctcacag

SEQ ID NO: 8075 - DNA, 25 bp, Homo sapiens
gccatgaatactagctcctgcagtc

SEQ ID NO: 8076 - DNA, 25 bp, Homo sapiens
aatactagctcctgcagtctgatga

SEQ ID NO: 8077 - DNA, 25 bp, Homo sapiens
tcgatttttgggttctggtcctcgg

SEQ ID NO: 8078 - DNA, 25 bp, Homo sapiens
ggtgaaccctactcagtgtgaagct

SEQ ID NO: 8079 - DNA, 25 bp, Homo sapiens
ccgcggtaatgctggtggtctgcat

SEQ ID NO: 8080 - DNA, 25 bp, Homo sapiens
gcggtaatgctggtggtctgcatca

SEQ ID NO: 8081 - DNA, 25 bp, Homo sapiens
caccaccggatcaacttcgacaaat

SEQ ID NO: 8082 - DNA, 25 bp, Homo sapiens
caccggatcaacttcgacaaatacc

SEQ ID NO: 8083 - DNA, 25 bp, Homo sapiens
ccggatcaacttcgacaaataccac

SEQ ID NO: 8084 - DNA, 25 bp, Homo sapiens
taccacttaaagaggaaccagagct

SEQ ID NO: 8085 - DNA, 25 bp, Homo sapiens
tctgcccaactgtcaaccttgacaa

SEQ ID NO: 8086 - DNA, 25 bp, Homo sapiens
gcccaactgtcaaccttgacaaatt

SEQ ID NO: 8087 - DNA, 25 bp, Homo sapiens
gtgaacagacacgggtgaatgctgc

SEQ ID NO: 8088 - DNA, 25 bp, Homo sapiens
aacagacacgggtgaatgctgctaa

SEQ ID NO: 8089 - DNA, 25 bp, Homo sapiens
gactgaggaagacccggaaacttag

SEQ ID NO: 8090 - DNA, 25 bp, Homo sapiens
agtagtgcctgtggtttagcccacc

SEQ ID NO: 8091 - DNA, 25 bp, Homo sapiens
gtttagcccaccaatcttgatgact

SEQ ID NO: 8092 - DNA, 25 bp, Homo sapiens
gaaatcgctgcaaggtaatcacaat

SEQ ID NO: 8093 - DNA, 25 bp, Homo sapiens
aatggatgtaactgtaccttggtac

SEQ ID NO: 8094 - DNA, 25 bp, Homo sapiens
accttggtacagcttttcacttgtt

SEQ ID NO: 8095 - DNA, 25 bp, Homo sapiens
gacaacacaccttgggtagttctgc

SEQ ID NO: 8096 - DNA, 25 bp, Homo sapiens
tgggtagttctgcttgtgtttttgc

SEQ ID NO: 8097 - DNA, 25 bp, Homo sapiens
gtgctttagttgctagtttgtactg

SEQ ID NO: 8098 - DNA, 25 bp, Homo sapiens
gtactgagagttgacctctccctgt

SEQ ID NO: 8099 - DNA, 25 bp, Homo sapiens
acaattgtgtaatgtgtctccctcc

SEQ ID NO: 8100 - DNA, 25 bp, Homo sapiens
gtctccctcctacattgtaacaatt

SEQ ID NO: 8101 - DNA, 25 bp, Homo sapiens
aaggccttgctgacaacttgcacaa

SEQ ID NO: 8102 - DNA, 25 bp, Homo sapiens
gaatggagtttttcagcctgtggcc

SEQ ID NO: 8103 - DNA, 25 bp, Homo sapiens
cctgtggcccagcactggtcaagaa

SEQ ID NO: 8104 - DNA, 25 bp, Homo sapiens
catgcacaagctttgcgttctgact

SEQ ID NO: 8105 - DNA, 25 bp, Homo sapiens
caatgccagattcctgttttgcgca

SEQ ID NO: 8106 - DNA, 25 bp, Homo sapiens
gttttgcgcattgtcatgggattct

SEQ ID NO: 8107 - DNA, 25 bp, Homo sapiens
tgtggtcttgttcacatgctccacg

SEQ ID NO: 8108 - DNA, 25 bp, Homo sapiens
atgctccacgtagctgtaacttcac

SEQ ID NO: 8109 - DNA, 25 bp, Homo sapiens
gtaacttcacatcatcagcttgcag

SEQ ID NO: 8110 - DNA, 25 bp, Homo sapiens
attgactaaagcattccagtgtcct

SEQ ID NO: 8111 - DNA, 25 bp, Homo sapiens
ctctttctagattgccagctcatga

SEQ ID NO: 8112 - DNA, 25 bp, Homo sapiens
aagagcactctctgagattgctgga

SEQ ID NO: 8113 - DNA, 25 bp, Homo sapiens
tctctcctaatcttgttcgatatga

SEQ ID NO: 8114 - DNA, 25 bp, Homo sapiens
aaggggctaattacttccagcaagc

SEQ ID NO: 8115 - DNA, 25 bp, Homo sapiens
agctctcaaagctagtgaaccagca

SEQ ID NO: 8116 - DNA, 25 bp, Homo sapiens
tagcagagcctcacagacaatggcc

SEQ ID NO: 8117 - DNA, 25 bp, Homo sapiens
caaagctgtcacagagggtgcccag

SEQ ID NO: 8118 - DNA, 25 bp, Homo sapiens
ggcagtagaggaaccatccatatgc

SEQ ID NO: 8119 - DNA, 25 bp, Homo sapiens
gaagcttctactaggatcccagttt

SEQ ID NO: 8120 - DNA, 25 bp, Homo sapiens
ggatcccagttttgccgcagataat

SEQ ID NO: 8121 - DNA, 25 bp, Homo sapiens
gtagtgcagtgatcctttacaggtt

SEQ ID NO: 8122 - DNA, 25 bp, Homo sapiens
aaggttatactatgcctatttgaaa

SEQ ID NO: 8123 - DNA, 25 bp, Homo sapiens
agtattctacagctcaagactgcag

SEQ ID NO: 8124 - DNA, 25 bp, Homo sapiens
gactgcagtgcagatgacgacaact

SEQ ID NO: 8125 - DNA, 25 bp, Homo sapiens
gcagtgcagatgacgacaacttcct

SEQ ID NO: 8126 - DNA, 25 bp, Homo sapiens
gtgcagatgacgacaacttccttgt

SEQ ID NO: 8127 - DNA, 25 bp, Homo sapiens
cagatgacgacaacttccttgtgcc

SEQ ID NO: 8128 - DNA, 25 bp, Homo sapiens
cttccttgtgcccatagcggtggga

SEQ ID NO: 8129 - DNA, 25 bp, Homo sapiens
tgtgcccatagcggtgggagctgcc

SEQ ID NO: 8130 - DNA, 25 bp, Homo sapiens
gctgccttggcaggagtacttattc

SEQ ID NO: 8131 - DNA, 25 bp, Homo sapiens
ggcaggagtacttattctagtgttg

SEQ ID NO: 8132 - DNA, 25 bp, Homo sapiens
tctagtgttgctggcttattttatt

SEQ ID NO: 8133 - DNA, 25 bp, Homo sapiens
tattggtctcaagcaccatcatgct

SEQ ID NO: 8134 - DNA, 25 bp, Homo sapiens
aagattttcttacctctcagttgtt

SEQ ID NO: 8135 - DNA, 25 bp, Homo sapiens
gttgttgaaacactttgcttcttaa

SEQ ID NO: 8136 - DNA, 25 bp, Homo sapiens
aattcttttatcaatcccagcattt

SEQ ID NO: 8137 - DNA, 25 bp, Homo sapiens
ccaaagtgtcatatttactggtcct

SEQ ID NO: 8138 - DNA, 25 bp, Homo sapiens
ttactggtcctggagacaaacttgt

SEQ ID NO: 8139 - DNA, 25 bp, Homo sapiens
acgtgcaatgttttaaggtctatct

SEQ ID NO: 8140 - DNA, 25 bp, Homo sapiens
ggtctatcttaagaagccctggcca

SEQ ID NO: 8141 - DNA, 25 bp, Homo sapiens
gatcctaaccttgaagtatgccttg

SEQ ID NO: 8142 - DNA, 25 bp, Homo sapiens
ccttgaacttattaacatggccatt

SEQ ID NO: 8143 - DNA, 25 bp, Homo sapiens
gtcatttcactactggtgttctgtt

SEQ ID NO: 8144 - DNA, 25 bp, Homo sapiens
taaactcatcaatgtgcctttgcat

SEQ ID NO: 8145 - DNA, 25 bp, Homo sapiens
cctccgtgaagacaagctgggctgg

SEQ ID NO: 8146 - DNA, 25 bp, Homo sapiens
ctaggagggatgaccccactcagct

SEQ ID NO: 8147 - DNA, 25 bp, Homo sapiens
ccaggcagtgttctgccgagacccc

SEQ ID NO: 8148 - DNA, 25 bp, Homo sapiens
gcacagaatgttatccttacgtcct

SEQ ID NO: 8149 - DNA, 25 bp, Homo sapiens
gtcctgagccggtttaagtctgtgg

SEQ ID NO: 8150 - DNA, 25 bp, Homo sapiens
gagaaatccacgtaacctttgcttt

SEQ ID NO: 8151 - DNA, 25 bp, Homo sapiens
acagtggggcaggctttggggttgc

SEQ ID NO: 8152 - DNA, 25 bp, Homo sapiens
gctccattctgtagcattgccagcg

SEQ ID NO: 8153 - DNA, 25 bp, Homo sapiens
gtctctaacaatcctttgcttttcc

SEQ ID NO: 8154 - DNA, 25 bp, Homo sapiens
ttgcttttcctcactcacgtggaaa

SEQ ID NO: 8155 - DNA, 25 bp, Homo sapiens
gaacggttgccccttatttaatgct

SEQ ID NO: 8156 - DNA, 25 bp, Homo sapiens
agctgccttctcggatactgaaagg

SEQ ID NO: 8157 - DNA, 25 bp, Homo sapiens
tgaaaggtcgagttttctgaactgc

SEQ ID NO: 8158 - DNA, 25 bp, Homo sapiens
gatttcaagctgttctgagacatct

SEQ ID NO: 8159 - DNA, 25 bp, Homo sapiens
gctttacttcctgagaggcaatgtt

SEQ ID NO: 8160 - DNA, 25 bp, Homo sapiens
aactgtgacaattttcatattctca

SEQ ID NO: 8161 - DNA, 25 bp, Homo sapiens
agttacacacaatggccacagcagt

SEQ ID NO: 8162 - DNA, 25 bp, Homo sapiens
tagtgcctatactcatgtaatcggt

SEQ ID NO: 8163 - DNA, 25 bp, Homo sapiens
tgtaatcggttactcactactgcct

SEQ ID NO: 8164 - DNA, 25 bp, Homo sapiens
acaggattatagtgccttaaccgat

SEQ ID NO: 8165 - DNA, 25 bp, Homo sapiens
atttaaaactgctcttctgctctag

SEQ ID NO: 8166 - DNA, 25 bp, Homo sapiens
gtacaactgatgcttgttcttattt

SEQ ID NO: 8167 - DNA, 25 bp, Homo sapiens
ctcagaatcccagaggcagtcccag

SEQ ID NO: 8168 - DNA, 25 bp, Homo sapiens
gcagacggcagggccagtatggggc

SEQ ID NO: 8169 - DNA, 25 bp, Homo sapiens
ttttggtttgattctgcctctgtag

SEQ ID NO: 8170 - DNA, 25 bp, Homo sapiens
gcctctgtagctcaaggggggcagc

SEQ ID NO: 8171 - DNA, 25 bp, Homo sapiens
caaggctccatagctttgccaaatg

SEQ ID NO: 8172 - DNA, 25 bp, Homo sapiens
ttgccaaatgcacggagctctgcca

SEQ ID NO: 8173 - DNA, 25 bp, Homo sapiens
tctgccattccggtgcagtgcaggc

SEQ ID NO: 8174 - DNA, 25 bp, Homo sapiens
gccttgcgaagggtttatctgcgtt

SEQ ID NO: 8175 - DNA, 25 bp, Homo sapiens
tgggcttctcctgcatgggagttgt

SEQ ID NO: 8176 - DNA, 25 bp, Homo sapiens
atgactgtcttccctattcttaggg

SEQ ID NO: 8177 - DNA, 25 bp, Homo sapiens
tgccagaaaggcagtctcccaagga

SEQ ID NO: 8178 - DNA, 25 bp, Homo sapiens
acggcatttggaaggccagcttcac

SEQ ID NO: 8179 - DNA, 25 bp, Homo sapiens
cttcaccaccttcactgtgacgaaa

SEQ ID NO: 8180 - DNA, 25 bp, Homo sapiens
aatactggttttaccgcttgctgtc

SEQ ID NO: 8181 - DNA, 25 bp, Homo sapiens
cgatggcactcatctggggcattta

SEQ ID NO: 8182 - DNA, 25 bp, Homo sapiens
atctggggcatttacttcgccattc

SEQ ID NO: 8183 - DNA, 25 bp, Homo sapiens
gcacatctgggcagttgtaccatgc

SEQ ID NO: 8184 - DNA, 25 bp, Homo sapiens
gtgacccactctttgaagctgttgg

SEQ ID NO: 8185 - DNA, 25 bp, Homo sapiens
tattcagcaatgtccgcatcaactt

SEQ ID NO: 8186 - DNA, 25 bp, Homo sapiens
tccttttaattttcctggtgccaat

SEQ ID NO: 8187 - DNA, 25 bp, Homo sapiens
ggtgccaatttcaagttccaagttg

SEQ ID NO: 8188 - DNA, 25 bp, Homo sapiens
gctatttcatctatttttggcagtc

SEQ ID NO: 8189 - DNA, 25 bp, Homo sapiens
ttcagttgctaatgaggctcctccg

SEQ ID NO: 8190 - DNA, 25 bp, Homo sapiens
atttctctgccaattaacttgtcat

SEQ ID NO: 8191 - DNA, 25 bp, Homo sapiens
ttttactattccacaccaaccataa

SEQ ID NO: 8192 - DNA, 25 bp, Homo sapiens
ggatttttcttatgcactcctatgc

SEQ ID NO: 8193 - DNA, 25 bp, Homo sapiens
acatgtggtgtaattctgcttctta

SEQ ID NO: 8194 - DNA, 25 bp, Homo sapiens
tttttatatatgcagtcccatccct

SEQ ID NO: 8195 - DNA, 25 bp, Homo sapiens
gcccggctcttgctgacagaatagg

SEQ ID NO: 8196 - DNA, 25 bp, Homo sapiens
ggagcatttctcacaacatggtatt

SEQ ID NO: 8197 - DNA, 25 bp, Homo sapiens
gtgaccgtgttaaattgtactccct

SEQ ID NO: 8198 - DNA, 25 bp, Homo sapiens
taaattgtactcccttagtcctgta

SEQ ID NO: 8199 - DNA, 25 bp, Homo sapiens
gaatcgcagttacgctgtactttta

SEQ ID NO: 8200 - DNA, 25 bp, Homo sapiens
aggagagctgcgcttgggattgtgc

SEQ ID NO: 8201 - DNA, 25 bp, Homo sapiens
tggacaccagctgggggatccaggg

SEQ ID NO: 8202 - DNA, 25 bp, Homo sapiens
cactgacttcaggatagatgttggg

SEQ ID NO: 8203 - DNA, 25 bp, Homo sapiens
tgcctgggcatggccacatgttaca

SEQ ID NO: 8204 - DNA, 25 bp, Homo sapiens
gtacagaactttgtctacagcacaa

SEQ ID NO: 8205 - DNA, 25 bp, Homo sapiens
gtgactggtatttaatgctgatcta

SEQ ID NO: 8206 - DNA, 25 bp, Homo sapiens
tatgtaataaaggacgccctccctc

SEQ ID NO: 8207 - DNA, 25 bp, Homo sapiens
ttcaccccagagggtcgggcaggtt

SEQ ID NO: 8208 - DNA, 25 bp, Homo sapiens
gggtcgggcaggttgacatatttat

SEQ ID NO: 8209 - DNA, 25 bp, Homo sapiens
tctattctgtaggcttccatgtcca

SEQ ID NO: 8210 - DNA, 25 bp, Homo sapiens
cttccatgtccagaatcctgcttaa

SEQ ID NO: 8211 - DNA, 25 bp, Homo sapiens
ggggaagtttttgctgagtgcctaa

SEQ ID NO: 8212 - DNA, 25 bp, Homo sapiens
tcagagatatggctggcaccctgca

SEQ ID NO: 8213 - DNA, 25 bp, Homo sapiens
caaccaggaatttgctgctcttctg

SEQ ID NO: 8214 - DNA, 25 bp, Homo sapiens
gctcttctggctcagtctgttaatc

SEQ ID NO: 8215 - DNA, 25 bp, Homo sapiens
cagggttttgaagccgtctatcagc

SEQ ID NO: 8216 - DNA, 25 bp, Homo sapiens
ggcagacggtaacaagtactccttg

SEQ ID NO: 8217 - DNA, 25 bp, Homo sapiens
gtactccttgctggattgaacttca

SEQ ID NO: 8218 - DNA, 25 bp, Homo sapiens
gaatggacctctacagtggttggac

SEQ ID NO: 8219 - DNA, 25 bp, Homo sapiens
aactcagatgggatccccttcagtg

SEQ ID NO: 8220 - DNA, 25 bp, Homo sapiens
cccttcagtgcgttgctcaagcatg

SEQ ID NO: 8221 - DNA, 25 bp, Homo sapiens
aagcttcaccaatcaagtcccatgg

SEQ ID NO: 8222 - DNA, 25 bp, Homo sapiens
ctgtcatcaacttcagaggcagctc

SEQ ID NO: 8223 - DNA, 25 bp, Homo sapiens
atatgtgtcgcagtacccattctga

SEQ ID NO: 8224 - DNA, 25 bp, Homo sapiens
gagcgacacagacgttaggcatttc

SEQ ID NO: 8225 - DNA, 25 bp, Homo sapiens
taggcatttcctgctgaacgtttcc

SEQ ID NO: 8226 - DNA, 25 bp, Homo sapiens
ctgaacgtttccccgaagagtcagc

SEQ ID NO: 8227 - DNA, 25 bp, Homo sapiens
ctgtactattgcagacctgtcaccc

SEQ ID NO: 8228 - DNA, 25 bp, Homo sapiens
ccccagttcctatgacacagttatc

SEQ ID NO: 8229 - DNA, 25 bp, Homo sapiens
aaagtattatcattgctcccctgat

SEQ ID NO: 8230 - DNA, 25 bp, Homo sapiens
tgcgggggtctgagtctatgttcaa

SEQ ID NO: 8231 - DNA, 25 bp, Homo sapiens
gttactgctttgcaaagacccgggg

SEQ ID NO: 8232 - DNA, 25 bp, Homo sapiens
gctagtttgctttttgcgtacacag

SEQ ID NO: 8233 - DNA, 25 bp, Homo sapiens
catccttgctgaactacagcttcga

SEQ ID NO: 8234 - DNA, 25 bp, Homo sapiens
gctgaactacagcttcgagaaccaa

SEQ ID NO: 8235 - DNA, 25 bp, Homo sapiens
gcttcgagaaccaagctttcccgat

SEQ ID NO: 8236 - DNA, 25 bp, Homo sapiens
ttcgagaaccaagctttcccgatgt

SEQ ID NO: 8237 - DNA, 25 bp, Homo sapiens
agaaccaagctttcccgatgttcag

SEQ ID NO: 8238 - DNA, 25 bp, Homo sapiens
caagctttcccgatgttcagcatgg

SEQ ID NO: 8239 - DNA, 25 bp, Homo sapiens
agctttcccgatgttcagcatggtg

SEQ ID NO: 8240 - DNA, 25 bp, Homo sapiens
gttcagcatggtgtactcatccata

SEQ ID NO: 8241 - DNA, 25 bp, Homo sapiens
ggtgtactcatccataaagtcatcc

SEQ ID NO: 8242 - DNA, 25 bp, Homo sapiens
gtactcatccataaagtcatcctgg

SEQ ID NO: 8243 - DNA, 25 bp, Homo sapiens
atccataaagtcatcctgggctccc

SEQ ID NO: 8244 - DNA, 25 bp, Homo sapiens
gtcctggaggccatgatttctggag

SEQ ID NO: 8245 - DNA, 25 bp, Homo sapiens
caaggcactgggtctccagttccat

SEQ ID NO: 8246 - DNA, 25 bp, Homo sapiens
tccattctcgcatcctagacattga

SEQ ID NO: 8247 - DNA, 25 bp, Homo sapiens
agacattgacaacgtcgacctggcc

SEQ ID NO: 8248 - DNA, 25 bp, Homo sapiens
gtgatggtggtcaggaaccccaaag

SEQ ID NO: 8249 - DNA, 25 bp, Homo sapiens
gtgacccggacaaggtgctgcggat

SEQ ID NO: 8250 - DNA, 25 bp, Homo sapiens
tgcggatgctgtacgtgtgggcgct

SEQ ID NO: 8251 - DNA, 25 bp, Homo sapiens
cgctctgccgagaccaggacgagct

SEQ ID NO: 8252 - DNA, 25 bp, Homo sapiens
gggcctgttctccaagacagagatg

SEQ ID NO: 8253 - DNA, 25 bp, Homo sapiens
gatgtcggaggtgctcacggagatc

SEQ ID NO: 8254 - DNA, 25 bp, Homo sapiens
tcacggagatcctccgggtggaccc

SEQ ID NO: 8255 - DNA, 25 bp, Homo sapiens
gagatgctgctcagtggacggaagc

SEQ ID NO: 8256 - DNA, 25 bp, Homo sapiens
ggaagctgacagcgcaggaggcgtg

SEQ ID NO: 8257 - DNA, 25 bp, Homo sapiens
aggaggcgtgtggcaagggcctggt

SEQ ID NO: 8258 - DNA, 25 bp, Homo sapiens
ctcgtgcaatccagttgtgcttgag

SEQ ID NO: 8259 - DNA, 25 bp, Homo sapiens
ccctcgtgcgctgcaacatgaagat

SEQ ID NO: 8260 - DNA, 25 bp, Homo sapiens
cgatgagttctgagtgtcgggctgc

SEQ ID NO: 8261 - DNA, 25 bp, Homo sapiens
cccactggtgacaccgggatcgggc

SEQ ID NO: 8262 - DNA, 25 bp, Homo sapiens
tgatccattctcacagcctgaaaca

SEQ ID NO: 8263 - DNA, 25 bp, Homo sapiens
caagctcacccgtagcttacgcttg

SEQ ID NO: 8264 - DNA, 25 bp, Homo sapiens
gaagcaggactgggaacatccacgc

SEQ ID NO: 8265 - DNA, 25 bp, Homo sapiens
gggaacatccacgctatttattatc

SEQ ID NO: 8266 - DNA, 25 bp, Homo sapiens
ttcgggcatcacgccaagttcatcg

SEQ ID NO: 8267 - DNA, 25 bp, Homo sapiens
gttcatcgcttcaacaggcatggac

SEQ ID NO: 8268 - DNA, 25 bp, Homo sapiens
agttctacagcctgtaggccctggc

SEQ ID NO: 8269 - DNA, 25 bp, Homo sapiens
ttcacatcatttcactctggtctga

SEQ ID NO: 8270 - DNA, 25 bp, Homo sapiens
gtggtggcctgagaaccatggtggc

SEQ ID NO: 8271 - DNA, 25 bp, Homo sapiens
catggtggcatggaccaccctcatc

SEQ ID NO: 8272 - DNA, 25 bp, Homo sapiens
tccaggccccatgggaacggatgtg

SEQ ID NO: 8273 - DNA, 25 bp, Homo sapiens
tcccttcctgtcgttcaatggacgt

SEQ ID NO: 8274 - DNA, 25 bp, Homo sapiens
ctgttccacacccattttgttgcag

SEQ ID NO: 8275 - DNA, 25 bp, Homo sapiens
gagccaagggaactgtgaaggggat

SEQ ID NO: 8276 - DNA, 25 bp, Homo sapiens
aggagggcttgtgcagggttttgta

SEQ ID NO: 8277 - DNA, 25 bp, Homo sapiens
aaaacccattccaattatgccagcc

SEQ ID NO: 8278 - DNA, 25 bp, Homo sapiens
gccagtccacaaaaaggtcatgccg

SEQ ID NO: 8279 - DNA, 25 bp, Homo sapiens
aaggtcatgccgtgaacctgctaga

SEQ ID NO: 8280 - DNA, 25 bp, Homo sapiens
acctgctagatgtgccagttcctgt

SEQ ID NO: 8281 - DNA, 25 bp, Homo sapiens
gttgcacgaaaactatctgctcggg

SEQ ID NO: 8282 - DNA, 25 bp, Homo sapiens
aggccagctgtataaatcatcctta

SEQ ID NO: 8283 - DNA, 25 bp, Homo sapiens
tctgaggacatggcacagcgcagga

SEQ ID NO: 8284 - DNA, 25 bp, Homo sapiens
gaaatccgggagactcatctttggt

SEQ ID NO: 8285 - DNA, 25 bp, Homo sapiens
aaaacttgctagttactgcctacct

SEQ ID NO: 8286 - DNA, 25 bp, Homo sapiens
gaactcctgtgtattgcaatggtat

SEQ ID NO: 8287 - DNA, 25 bp, Homo sapiens
gcagaacacatcacacatttaatcc

SEQ ID NO: 8288 - DNA, 25 bp, Homo sapiens
acctcctcaacttcaagctggtcat

SEQ ID NO: 8289 - DNA, 25 bp, Homo sapiens
atctgtcctgatgagggcttctaca

SEQ ID NO: 8290 - DNA, 25 bp, Homo sapiens
tggtctatcaccccaacattgacct

SEQ ID NO: 8291 - DNA, 25 bp, Homo sapiens
cattgacctcgagggcaacgtctgc

SEQ ID NO: 8292 - DNA, 25 bp, Homo sapiens
gtctgcctcaacatcctcagagagg

SEQ ID NO: 8293 - DNA, 25 bp, Homo sapiens
gaagccagtccttacgataaactcc

SEQ ID NO: 8294 - DNA, 25 bp, Homo sapiens
gcagaggtcctgcagaacaaccggc

SEQ ID NO: 8295 - DNA, 25 bp, Homo sapiens
agaacaaccggcggctgtttgagca

SEQ ID NO: 8296 - DNA, 25 bp, Homo sapiens
tgagcagaacgtgcagcgctccatg

SEQ ID NO: 8297 - DNA, 25 bp, Homo sapiens
cctactttgagcgctgcctgaaata

SEQ ID NO: 8298 - DNA, 25 bp, Homo sapiens
gaaatagggttggcgcatacccacc

SEQ ID NO: 8299 - DNA, 25 bp, Homo sapiens
gacatttttacataccgagcctgag

SEQ ID NO: 8300 - DNA, 25 bp, Homo sapiens
ggacttctcatttttggagctttcc

SEQ ID NO: 8301 - DNA, 25 bp, Homo sapiens
ccttccagagtcctggctgattggt

SEQ ID NO: 8302 - DNA, 25 bp, Homo sapiens
tgattggtgttcgctgttcatctga

SEQ ID NO: 8303 - DNA, 25 bp, Homo sapiens
ttcatctgagcccccaaaagcatta

SEQ ID NO: 8304 - DNA, 25 bp, Homo sapiens
tacactactgtgtttcactgaccat

SEQ ID NO: 8305 - DNA, 25 bp, Homo sapiens
actgaccatacatttttcttagccc

SEQ ID NO: 8306 - DNA, 25 bp, Homo sapiens
ttcttagcccctcaagtaatatagc

SEQ ID NO: 8307 - DNA, 25 bp, Homo sapiens
gaatgacaattcccctaaccattcc

SEQ ID NO: 8308 - DNA, 25 bp, Homo sapiens
aaactggtcataaaggcactctgtg

SEQ ID NO: 8309 - DNA, 25 bp, Homo sapiens
gggactgacatcttaagctctcacc

SEQ ID NO: 8310 - DNA, 25 bp, Homo sapiens
atggtaacatgtatctttgccctgg

SEQ ID NO: 8311 - DNA, 25 bp, Homo sapiens
gggtccagtcagtctcagatttaca

SEQ ID NO: 8312 - DNA, 25 bp, Homo sapiens
ataccctcatacgttattgcatttg

SEQ ID NO: 8313 - DNA, 25 bp, Homo sapiens
aagtgcattttaaccagtactctgg

SEQ ID NO: 8314 - DNA, 25 bp, Homo sapiens
agaaatttaagtcctccaattccag

SEQ ID NO: 8315 - DNA, 25 bp, Homo sapiens
ccaattccagcatatccagtgagtt

SEQ ID NO: 8316 - DNA, 25 bp, Homo sapiens
ttggttcttgttcttcttaaatgtg

SEQ ID NO: 8317 - DNA, 25 bp, Homo sapiens
aattgtgctgctacattatactgga

SEQ ID NO: 8318 - DNA, 25 bp, Homo sapiens
ctcccttgaggttctgctagtggtg

SEQ ID NO: 8319 - DNA, 25 bp, Homo sapiens
aggagtggttacaactgagctttta

SEQ ID NO: 8320 - DNA, 25 bp, Homo sapiens
tgagcttttagtaaccatttaaccg

SEQ ID NO: 8321 - DNA, 25 bp, Homo sapiens
gccagcacccgggagatggcgatgc

SEQ ID NO: 8322 - DNA, 25 bp, Homo sapiens
atggcgatgctcatagctcaggcct

SEQ ID NO: 8323 - DNA, 25 bp, Homo sapiens
gctcaggccttacagacgattaact

SEQ ID NO: 8324 - DNA, 25 bp, Homo sapiens
gactgcggctgaggcaaagctgctc

SEQ ID NO: 8325 - DNA, 25 bp, Homo sapiens
gctaccccagagggagttgtcacgc

SEQ ID NO: 8326 - DNA, 25 bp, Homo sapiens
cacgctacagtgagtggctggcctt

SEQ ID NO: 8327 - DNA, 25 bp, Homo sapiens
ggccttttaaatcgacgtctctctc

SEQ ID NO: 8328 - DNA, 25 bp, Homo sapiens
gtttctctctttaatctcacgtagc

SEQ ID NO: 8329 - DNA, 25 bp, Homo sapiens
ttagtacgtgttcttctgtcagggc

SEQ ID NO: 8330 - DNA, 25 bp, Homo sapiens
gtgatagacacttcgggtggacccc

SEQ ID NO: 8331 - DNA, 25 bp, Homo sapiens
ctcgacctcatggcttgcagagtgg

SEQ ID NO: 8332 - DNA, 25 bp, Homo sapiens
agaaaatttgccaatctttcctact

SEQ ID NO: 8333 - DNA, 25 bp, Homo sapiens
gatgacaatcaaagccggcctgaga

SEQ ID NO: 8334 - DNA, 25 bp, Homo sapiens
gccggcctgagaaacactatttgtg

SEQ ID NO: 8335 - DNA, 25 bp, Homo sapiens
atgtccttaaaatgtggtctgccaa

SEQ ID NO: 8336 - DNA, 25 bp, Homo sapiens
gtggtctgccaatctgtacaaaatg

SEQ ID NO: 8337 - DNA, 25 bp, Homo sapiens
atttatgacaagctgtatcactgcc

SEQ ID NO: 8338 - DNA, 25 bp, Homo sapiens
ataatccccacaggcacattaactg

SEQ ID NO: 8339 - DNA, 25 bp, Homo sapiens
taactgttgcacttttgaatgtcca

SEQ ID NO: 8340 - DNA, 25 bp, Homo sapiens
gaaagatacttacatgttcccaaaa

SEQ ID NO: 8341 - DNA, 25 bp, Homo sapiens
aactaacttgatagggtctaccaat

SEQ ID NO: 8342 - DNA, 25 bp, Homo sapiens
tattacgaatgcccctgttcatgtt

SEQ ID NO: 8343 - DNA, 25 bp, Homo sapiens
gtgggacaaggagtgcaggccgcac

SEQ ID NO: 8344 - DNA, 25 bp, Homo sapiens
acaaggagtgcaggccgcacaacct

SEQ ID NO: 8345 - DNA, 25 bp, Homo sapiens
caccggggggatgtggcgattctac

SEQ ID NO: 8346 - DNA, 25 bp, Homo sapiens
ggcgattctacacagaagattcacc

SEQ ID NO: 8347 - DNA, 25 bp, Homo sapiens
acctgggctcaaagttggccctgtt

SEQ ID NO: 8348 - DNA, 25 bp, Homo sapiens
ttggccctgttccagtattggttat

SEQ ID NO: 8349 - DNA, 25 bp, Homo sapiens
ggttatgagtcttctgttcatcgct

SEQ ID NO: 8350 - DNA, 25 bp, Homo sapiens
ttctgttcatcgcttctgtatttat

SEQ ID NO: 8351 - DNA, 25 bp, Homo sapiens
gcacatttggggcaagtacactcgt

SEQ ID NO: 8352 - DNA, 25 bp, Homo sapiens
gggcaagtacactcgttcgtagatt

SEQ ID NO: 8353 - DNA, 25 bp, Homo sapiens
cactcgttcgtagattcagttacat

SEQ ID NO: 8354 - DNA, 25 bp, Homo sapiens
cgcctcgtacgcaacgtggagtact

SEQ ID NO: 8355 - DNA, 25 bp, Homo sapiens
gtactaccagagcaactatgtgttc

SEQ ID NO: 8356 - DNA, 25 bp, Homo sapiens
caactatgtgttcgtgttcctgggc

SEQ ID NO: 8357 - DNA, 25 bp, Homo sapiens
cctcatcctgtactgtgtggtgacg

SEQ ID NO: 8358 - DNA, 25 bp, Homo sapiens
cgcctgttacattctctatctgcgc

SEQ ID NO: 8359 - DNA, 25 bp, Homo sapiens
atctgcgcaccttggagtccaagct

SEQ ID NO: 8360 - DNA, 25 bp, Homo sapiens
ggagtccaagcttgtgctctttggc

SEQ ID NO: 8361 - DNA, 25 bp, Homo sapiens
agcttgtgctctttggccgagaggt

SEQ ID NO: 8362 - DNA, 25 bp, Homo sapiens
ggccgagaggtgagcccagagcatc

SEQ ID NO: 8363 - DNA, 25 bp, Homo sapiens
gcatcagtatgctctggctggaggc

SEQ ID NO: 8364 - DNA, 25 bp, Homo sapiens
gctgccttccaccagattgaggctg

SEQ ID NO: 8365 - DNA, 25 bp, Homo sapiens
aagcaacacgctagaagggtttatg

SEQ ID NO: 8366 - DNA, 25 bp, Homo sapiens
gaaattcttcgactactggtaactg

SEQ ID NO: 8367 - DNA, 25 bp, Homo sapiens
gtaactgacatgagtgatgccgaac

SEQ ID NO: 8368 - DNA, 25 bp, Homo sapiens
gatgccgaacaatacagaagctaca

SEQ ID NO: 8369 - DNA, 25 bp, Homo sapiens
gcatgcaacatgaacagctggaaga

SEQ ID NO: 8370 - DNA, 25 bp, Homo sapiens
ctagtggaagattaccggcgtgtta

SEQ ID NO: 8371 - DNA, 25 bp, Homo sapiens
ggcgtgttattgaacgacttgctca

SEQ ID NO: 8372 - DNA, 25 bp, Homo sapiens
tactgctctgtacaggaagcttgca

SEQ ID NO: 8373 - DNA, 25 bp, Homo sapiens
aattttctgtacaatgtgctgtgaa

SEQ ID NO: 8374 - DNA, 25 bp, Homo sapiens
aatactactgcaattgcttcccttc

SEQ ID NO: 8375 - DNA, 25 bp, Homo sapiens
ggcgatagaggcacaacagaagttc

SEQ ID NO: 8376 - DNA, 25 bp, Homo sapiens
cctcctccagggtgattttatgatc

SEQ ID NO: 8377 - DNA, 25 bp, Homo sapiens
tgatcagtgttgttgctctaggaag

SEQ ID NO: 8378 - DNA, 25 bp, Homo sapiens
ttttccgtttgcttttgttccaatg

SEQ ID NO: 8379 - DNA, 25 bp, Homo sapiens
tacacactgtcatgcttcatcattc

SEQ ID NO: 8380 - DNA, 25 bp, Homo sapiens
cattccctctcatctcaggtagaag

SEQ ID NO: 8381 - DNA, 25 bp, Homo sapiens
cagaagacccctgactcatcatttg

SEQ ID NO: 8382 - DNA, 25 bp, Homo sapiens
ctcatcatttgtggcagtcccttat

SEQ ID NO: 8383 - DNA, 25 bp, Homo sapiens
cagtcccttataattggtgcatagc

SEQ ID NO: 8384 - DNA, 25 bp, Homo sapiens
gatggtttccacatttagatcctgg

SEQ ID NO: 8385 - DNA, 25 bp, Homo sapiens
gatcctggtttcataacttcctgta

SEQ ID NO: 8386 - DNA, 25 bp, Homo sapiens
tgtcctaattcttctgtcctgagaa

SEQ ID NO: 8387 - DNA, 25 bp, Homo sapiens
aaactgcgttaaaggctcgattttg

SEQ ID NO: 8388 - DNA, 25 bp, Homo sapiens
ggctcgattttgtatctgcaggcag

SEQ ID NO: 8389 - DNA, 25 bp, Homo sapiens
atctgcaggcagacacggatctgag

SEQ ID NO: 8390 - DNA, 25 bp, Homo sapiens
ttttgtctaaaatgcctcagtgtat

SEQ ID NO: 8391 - DNA, 25 bp, Homo sapiens
gtatatacccgtacaacgtgtcctc

SEQ ID NO: 8392 - DNA, 25 bp, Homo sapiens
tcacggtgccttttttcacggaagt

SEQ ID NO: 8393 - DNA, 25 bp, Homo sapiens
aatgatgggcgagcgtgcaccatcc

SEQ ID NO: 8394 - DNA, 25 bp, Homo sapiens
ggaatgtttgtctcatcccattctg

SEQ ID NO: 8395 - DNA, 25 bp, Homo sapiens
ccattctgcgtcatgcttgtgtgat

SEQ ID NO: 8396 - DNA, 25 bp, Homo sapiens
gcttgtgtgataactactccggaga

SEQ ID NO: 8397 - DNA, 25 bp, Homo sapiens
ggctgtgtctaaactgcattaccgc

SEQ ID NO: 8398 - DNA, 25 bp, Homo sapiens
ggagcctaaggccattgttgatatc

SEQ ID NO: 8399 - DNA, 25 bp, Homo sapiens
ttctccatgttttatgcttctctga

SEQ ID NO: 8400 - DNA, 25 bp, Homo sapiens
atgggacctcaggaccagagactgc

SEQ ID NO: 8401 - DNA, 25 bp, Homo sapiens
agactgcttgactcatctggggagg

SEQ ID NO: 8402 - DNA, 25 bp, Homo sapiens
aagaagaggcttcctagaccagcac

SEQ ID NO: 8403 - DNA, 25 bp, Homo sapiens
tcctagaccagcacaggctcgagaa

SEQ ID NO: 8404 - DNA, 25 bp, Homo sapiens
aggctcgagaaagacatcccctagg

SEQ ID NO: 8405 - DNA, 25 bp, Homo sapiens
gcctggacttctgagcagctttagc

SEQ ID NO: 8406 - DNA, 25 bp, Homo sapiens
cctttccccattgctcaatggattc

SEQ ID NO: 8407 - DNA, 25 bp, Homo sapiens
aaaaatggcagccacctttccaaga

SEQ ID NO: 8408 - DNA, 25 bp, Homo sapiens
gggtccaagctgtatagtatttgtc

SEQ ID NO: 8409 - DNA, 25 bp, Homo sapiens
ggggataatagcactacctaccaag

SEQ ID NO: 8410 - DNA, 25 bp, Homo sapiens
ctaccaagtgctgtgaggctcaaat

SEQ ID NO: 8411 - DNA, 25 bp, Homo sapiens
tatactgctgtatcatgccaggatt

SEQ ID NO: 8412 - DNA, 25 bp, Homo sapiens
catgccaggatttatcagcattccc

SEQ ID NO: 8413 - DNA, 25 bp, Homo sapiens
caagggagcttgcacggtactgacc

SEQ ID NO: 8414 - DNA, 25 bp, Homo sapiens
ggtactgaccgagtgctgagactac

SEQ ID NO: 8415 - DNA, 25 bp, Homo sapiens
gagactactggtattcccagctgcc

SEQ ID NO: 8416 - DNA, 25 bp, Homo sapiens
ggagctactagaatattctcagcac

SEQ ID NO: 8417 - DNA, 25 bp, Homo sapiens
gcttccttggtttccatgtctgtaa

SEQ ID NO: 8418 - DNA, 25 bp, Homo sapiens
ggtttccatgtctgtaagggttact

SEQ ID NO: 8419 - DNA, 25 bp, Homo sapiens
agggttactgatcacttaccttctt

SEQ ID NO: 8420 - DNA, 25 bp, Homo sapiens
gaccattccatgtgtatcattccat

SEQ ID NO: 8421 - DNA, 25 bp, Homo sapiens
tggccagtgacgtgtgcttctgaga

SEQ ID NO: 8422 - DNA, 25 bp, Homo sapiens
aaagaagattccaactctctcactc

SEQ ID NO: 8423 - DNA, 25 bp, Homo sapiens
ctctctcactctgaaccatgaagct

SEQ ID NO: 8424 - DNA, 25 bp, Homo sapiens
actgctacactgctctgtttggtgt

SEQ ID NO: 8425 - DNA, 25 bp, Homo sapiens
tctccccggcatggtcatgtgatgg

SEQ ID NO: 8426 - DNA, 25 bp, Homo sapiens
cagggacaaagctcttcatccacgg

SEQ ID NO: 8427 - DNA, 25 bp, Homo sapiens
gcttggcgggggacagattctatga

SEQ ID NO: 8428 - DNA, 25 bp, Homo sapiens
gatgacctccactgcattgatataa

SEQ ID NO: 8429 - DNA, 25 bp, Homo sapiens
gaagctaaatcccactggggctgct

SEQ ID NO: 8430 - DNA, 25 bp, Homo sapiens
actcctgcaggagcactggacacaa

SEQ ID NO: 8431 - DNA, 25 bp, Homo sapiens
ctgccagactactgccagactgaga

SEQ ID NO: 8432 - DNA, 25 bp, Homo sapiens
gaaacccagaagctggtagtcatgt

SEQ ID NO: 8433 - DNA, 25 bp, Homo sapiens
ccttctctgccaaacgactgggaaa

SEQ ID NO: 8434 - DNA, 25 bp, Homo sapiens
ggaaaccaaaatgagcccaccttgt

SEQ ID NO: 8435 - DNA, 25 bp, Homo sapiens
aaaatgagcccaccttgtgttcttc

SEQ ID NO: 8436 - DNA, 25 bp, Homo sapiens
tgctatagttcccagctgctgtaac

SEQ ID NO: 8437 - DNA, 25 bp, Homo sapiens
gttcccagctgctgtaacggagcca

SEQ ID NO: 8438 - DNA, 25 bp, Homo sapiens
cacctccaactctaacaataaacca

SEQ ID NO: 8439 - DNA, 25 bp, Homo sapiens
ccaacatttgacaccccagcaatgt

SEQ ID NO: 8440 - DNA, 25 bp, Homo sapiens
tctccaaacccgctcttggacagag

SEQ ID NO: 8441 - DNA, 25 bp, Homo sapiens
gccacagcttaactcctacagagtg

SEQ ID NO: 8442 - DNA, 25 bp, Homo sapiens
gactcctctaagcatttactcattt

SEQ ID NO: 8443 - DNA, 25 bp, Homo sapiens
actcatttactgtattcctgctctg

SEQ ID NO: 8444 - DNA, 25 bp, Homo sapiens
gtattcctgctctgaagatgtggat

SEQ ID NO: 8445 - DNA, 25 bp, Homo sapiens
ggatacagaattagtcactcttgtc

SEQ ID NO: 8446 - DNA, 25 bp, Homo sapiens
tagtcactcttgtcactttatttat

SEQ ID NO: 8447 - DNA, 25 bp, Homo sapiens
tttaaccatctgtgtacattccttt

SEQ ID NO: 8448 - DNA, 25 bp, Homo sapiens
aatattgctggatttgctacctttg

SEQ ID NO: 8449 - DNA, 25 bp, Homo sapiens
gctacctttggttacttgtgcagtg

SEQ ID NO: 8450 - DNA, 25 bp, Homo sapiens
ggctgtgctcagttactatattaag

SEQ ID NO: 8451 - DNA, 25 bp, Homo sapiens
gtgtaacagtaactcttttttgctt

SEQ ID NO: 8452 - DNA, 25 bp, Homo sapiens
gcaattaattgttcttttatcttac

SEQ ID NO: 8453 - DNA, 25 bp, Homo sapiens
tgagtactttagcaattcccagcgt

SEQ ID NO: 8454 - DNA, 25 bp, Homo sapiens
ttcccagcgtattacatacacccag

SEQ ID NO: 8455 - DNA, 25 bp, Homo sapiens
gataaggttctttgcatgttttgtg

SEQ ID NO: 8456 - DNA, 25 bp, Homo sapiens
gtgttatgtattactctgactcttt

SEQ ID NO: 8457 - DNA, 25 bp, Homo sapiens
aatgtgtactaactcctgattttgt

SEQ ID NO: 8458 - DNA, 25 bp, Homo sapiens
ggcagtgacctctagaactcatgca

SEQ ID NO: 8459 - DNA, 25 bp, Homo sapiens
agaactcatgcattgccattggaaa

SEQ ID NO: 8460 - DNA, 25 bp, Homo sapiens
gttgggcatcgatgtcagatcctga

SEQ ID NO: 8461 - DNA, 25 bp, Homo sapiens
gaaaaaatcccatcctagaggcaag

SEQ ID NO: 8462 - DNA, 25 bp, Homo sapiens
gaggcaaggaggctacaccaaacca

SEQ ID NO: 8463 - DNA, 25 bp, Homo sapiens
cagtactttgtcacatggttgtcca

SEQ ID NO: 8464 - DNA, 25 bp, Homo sapiens
gtttcgactggtccagctctgacat

SEQ ID NO: 8465 - DNA, 25 bp, Homo sapiens
tatagagtttatctacacggccccc

SEQ ID NO: 8466 - DNA, 25 bp, Homo sapiens
cccctcctcggcagtgtgtggggtc

SEQ ID NO: 8467 - DNA, 25 bp, Homo sapiens
gggtctcgctggacgttggaggaaa

SEQ ID NO: 8468 - DNA, 25 bp, Homo sapiens
tgagcaccacccagaagaagagcct

SEQ ID NO: 8469 - DNA, 25 bp, Homo sapiens
gaaccacaggtaccagatgggctgc

SEQ ID NO: 8470 - DNA, 25 bp, Homo sapiens
ctgcgagtgcaagatcacgcgctgc

SEQ ID NO: 8471 - DNA, 25 bp, Homo sapiens
accaggccaagttcttcgcctgcat

SEQ ID NO: 8472 - DNA, 25 bp, Homo sapiens
aagagaagtgacggctcctgtgcgt

SEQ ID NO: 8473 - DNA, 25 bp, Homo sapiens
cccccaagcaggagtttctcgacat

SEQ ID NO: 8474 - DNA, 25 bp, Homo sapiens
cgaggacccataagcaggcctccaa

SEQ ID NO: 8475 - DNA, 25 bp, Homo sapiens
gaagtggtctggggctgatcttgcc

SEQ ID NO: 8476 - DNA, 25 bp, Homo sapiens
gatcttgccttgaggaagacccagg

SEQ ID NO: 8477 - DNA, 25 bp, Homo sapiens
cctggattgtgatgcagcctcggga

SEQ ID NO: 8478 - DNA, 25 bp, Homo sapiens
tgcgggggaagacctataccccacg

SEQ ID NO: 8479 - DNA, 25 bp, Homo sapiens
ctaatcccccgggagggagctgact

SEQ ID NO: 8480 - DNA, 25 bp, Homo sapiens
aaaaagctgagggggcctgctggga

SEQ ID NO: 8481 - DNA, 25 bp, Homo sapiens
gagtggctgtttttatgccccagcc

SEQ ID NO: 8482 - DNA, 25 bp, Homo sapiens
ccccagccccgcaagttggggagtg

SEQ ID NO: 8483 - DNA, 25 bp, Homo sapiens
agtgtttgtgggggtccagagccct

SEQ ID NO: 8484 - DNA, 25 bp, Homo sapiens
cccagccaggagagaacctcccgga

SEQ ID NO: 8485 - DNA, 25 bp, Homo sapiens
cccctgctcgggagtaaggctggtc

SEQ ID NO: 8486 - DNA, 25 bp, Homo sapiens
tactaactagtactttcctaattgg

SEQ ID NO: 8487 - DNA, 25 bp, Homo sapiens
atgagggcccgtaacagaaccagtg

SEQ ID NO: 8488 - DNA, 25 bp, Homo sapiens
taaaatgggcctatcacccttgtca

SEQ ID NO: 8489 - DNA, 25 bp, Homo sapiens
gcctatcacccttgtcagagatata

SEQ ID NO: 8490 - DNA, 25 bp, Homo sapiens
ttcccttcatcagctaacacttatc

SEQ ID NO: 8491 - DNA, 25 bp, Homo sapiens
ggatttggcttcatacactgaattt

SEQ ID NO: 8492 - DNA, 25 bp, Homo sapiens
gtgatacgttagagggttcctattc

SEQ ID NO: 8493 - DNA, 25 bp, Homo sapiens
gttcctattcttccattgtacgata

SEQ ID NO: 8494 - DNA, 25 bp, Homo sapiens
gaggtggtatatttaaacttctgta

SEQ ID NO: 8495 - DNA, 25 bp, Homo sapiens
taggcctgggaattccgatcctagc

SEQ ID NO: 8496 - DNA, 25 bp, Homo sapiens
cgatcctagctgcagatcgcatccc

SEQ ID NO: 8497 - DNA, 25 bp, Homo sapiens
acaggagatcaccataagcgtccct

SEQ ID NO: 8498 - DNA, 25 bp, Homo sapiens
aagcgtccctgatatagcagcacac

SEQ ID NO: 8499 - DNA, 25 bp, Homo sapiens
atagcagcacacattttcacgtttc

SEQ ID NO: 8500 - DNA, 25 bp, Homo sapiens
cacaaagtcttgcttcgctcagatg

SEQ ID NO: 8501 - DNA, 25 bp, Homo sapiens
ataagaatgaatgtggcgccccctt

SEQ ID NO: 8502 - DNA, 25 bp, Homo sapiens
aaagctctgccctatcacaaggggg

SEQ ID NO: 8503 - DNA, 25 bp, Homo sapiens
tcagtttacctttggagtcttccct

SEQ ID NO: 8504 - DNA, 25 bp, Homo sapiens
atcgcagacctgtttccaggctgat

SEQ ID NO: 8505 - DNA, 25 bp, Homo sapiens
aggctgatgtttctggtgtgtaatt

SEQ ID NO: 8506 - DNA, 25 bp, Homo sapiens
ttttcccaattgttttagccttgtg

SEQ ID NO: 8507 - DNA, 25 bp, Homo sapiens
aattataacttgcctttcagcgatg

SEQ ID NO: 8508 - DNA, 25 bp, Homo sapiens
cttccacaagtactcgggcaaagag

SEQ ID NO: 8509 - DNA, 25 bp, Homo sapiens
gagggtgacaagttcaagctcaaca

SEQ ID NO: 8510 - DNA, 25 bp, Homo sapiens
agctgctttccagaagctgatgagc

SEQ ID NO: 8511 - DNA, 25 bp, Homo sapiens
gagcaacttggacagcaacagggac

SEQ ID NO: 8512 - DNA, 25 bp, Homo sapiens
gggacaacgaggtggacttccaaga

SEQ ID NO: 8513 - DNA, 25 bp, Homo sapiens
tccaagagtactgtgtcttcctgtc

SEQ ID NO: 8514 - DNA, 25 bp, Homo sapiens
ctgtcctgcatcgccatgatgtgta

SEQ ID NO: 8515 - DNA, 25 bp, Homo sapiens
gatgtgtaacgaattctttgaaggc

SEQ ID NO: 8516 - DNA, 25 bp, Homo sapiens
ggcttcccagataagcagcccagga

SEQ ID NO: 8517 - DNA, 25 bp, Homo sapiens
actcctctgatgtggttggggggtc

SEQ ID NO: 8518 - DNA, 25 bp, Homo sapiens
ctgtcgccagtgggcactttttttt

SEQ ID NO: 8519 - DNA, 25 bp, Homo sapiens
gtatgtgaacatgcaggatcccgag

SEQ ID NO: 8520 - DNA, 25 bp, Homo sapiens
gaacatgcaggatcccgagatggac

SEQ ID NO: 8521 - DNA, 25 bp, Homo sapiens
atgcaggatcccgagatggacatga

SEQ ID NO: 8522 - DNA, 25 bp, Homo sapiens
ggatcccgagatggacatgaagtca

SEQ ID NO: 8523 - DNA, 25 bp, Homo sapiens
gagatggacatgaagtcagtgactg

SEQ ID NO: 8524 - DNA, 25 bp, Homo sapiens
gaagtcagtgactgaccgggcagcc

SEQ ID NO: 8525 - DNA, 25 bp, Homo sapiens
ccatcaactacccgttcgagaaggg

SEQ ID NO: 8526 - DNA, 25 bp, Homo sapiens
gtacccatccggggaggagcgttgc

SEQ ID NO: 8527 - DNA, 25 bp, Homo sapiens
cccatccggggaggagcgttgcatt

SEQ ID NO: 8528 - DNA, 25 bp, Homo sapiens
catccggggaggagcgttgcattgc

SEQ ID NO: 8529 - DNA, 25 bp, Homo sapiens
aggagcgttgcattgcctgcaagct

SEQ ID NO: 8530 - DNA, 25 bp, Homo sapiens
gcagccacctacaagtatgtgaaca

SEQ ID NO: 8531 - DNA, 25 bp, Homo sapiens
catcaccatcgaggctgagccaaga

SEQ ID NO: 8532 - DNA, 25 bp, Homo sapiens
gagccaagagctgatggcagccgcc

SEQ ID NO: 8533 - DNA, 25 bp, Homo sapiens
cccgctatgacatcgacatgaccaa

SEQ ID NO: 8534 - DNA, 25 bp, Homo sapiens
tgaccaagtgcatctactgcggctt

SEQ ID NO: 8535 - DNA, 25 bp, Homo sapiens
ccaactttgagttctccacggagac

SEQ ID NO: 8536 - DNA, 25 bp, Homo sapiens
tccacggagacccatgaggagctgc

SEQ ID NO: 8537 - DNA, 25 bp, Homo sapiens
gttgctcaacaacggggacaagtgg

SEQ ID NO: 8538 - DNA, 25 bp, Homo sapiens
gggacaagtgggaggccgagatcgc

SEQ ID NO: 8539 - DNA, 25 bp, Homo sapiens
ccaacatccaggctgactacttgta

SEQ ID NO: 8540 - DNA, 25 bp, Homo sapiens
ctgactacttgtatcggtgacgccc

SEQ ID NO: 8541 - DNA, 25 bp, Homo sapiens
gatgccattatggctttccctgaag

SEQ ID NO: 8542 - DNA, 25 bp, Homo sapiens
cacaggtgggcgagcggggactgaa

SEQ ID NO: 8543 - DNA, 25 bp, Homo sapiens
ctggatgaggcaacgtcagcgctgg

SEQ ID NO: 8544 - DNA, 25 bp, Homo sapiens
tccaggcttctctggccaaagtctg

SEQ ID NO: 8545 - DNA, 25 bp, Homo sapiens
ctggccaaagtctgtgccaaccgca

SEQ ID NO: 8546 - DNA, 25 bp, Homo sapiens
ccatcgtagtggcacacaggctctc

SEQ ID NO: 8547 - DNA, 25 bp, Homo sapiens
tcaatgctgaccagatcctcgtcat

SEQ ID NO: 8548 - DNA, 25 bp, Homo sapiens
ggagaggggacgacacgaggctctg

SEQ ID NO: 8549 - DNA, 25 bp, Homo sapiens
gaagacactaagcctcagaccatgg

SEQ ID NO: 8550 - DNA, 25 bp, Homo sapiens
tgacaaaagtttggccacttccctc

SEQ ID NO: 8551 - DNA, 25 bp, Homo sapiens
cttatttcatcctggtcttggggta

SEQ ID NO: 8552 - DNA, 25 bp, Homo sapiens
gaagtggagtctcatgacctctcag

SEQ ID NO: 8553 - DNA, 25 bp, Homo sapiens
tgtcacctccctgaaattgcatata

SEQ ID NO: 8554 - DNA, 25 bp, Homo sapiens
tgcacacgtgtgcatttgtttgtat

SEQ ID NO: 8555 - DNA, 25 bp, Homo sapiens
atatttgtccttcgtatagcaagtt

SEQ ID NO: 8556 - DNA, 25 bp, Homo sapiens
gcaagttttttgctcatcagcagag

SEQ ID NO: 8557 - DNA, 25 bp, Homo sapiens
gaagccttaaaaagcacacaccaca

SEQ ID NO: 8558 - DNA, 25 bp, Homo sapiens
aatacattgaccgtagtagctgttc

SEQ ID NO: 8559 - DNA, 25 bp, Homo sapiens
gtagctgttcaactcctagtactta

SEQ ID NO: 8560 - DNA, 25 bp, Homo sapiens
agtccaacaaaccacacacagtaaa

SEQ ID NO: 8561 - DNA, 25 bp, Homo sapiens
catggttcgtattttaggtgactga

SEQ ID NO: 8562 - DNA, 25 bp, Homo sapiens
gacagtcatataaacgtcctgtttc

SEQ ID NO: 8563 - DNA, 25 bp, Homo sapiens
gacaagtggcagtacatccggctga

SEQ ID NO: 8564 - DNA, 25 bp, Homo sapiens
atccggctgatggacagtgtggcac

SEQ ID NO: 8565 - DNA, 25 bp, Homo sapiens
agtgcttccatggtccagaagtgca

SEQ ID NO: 8566 - DNA, 25 bp, Homo sapiens
gagtttgagtgccggggccttgaac

SEQ ID NO: 8567 - DNA, 25 bp, Homo sapiens
ttgaaccagttgatttccagccgca

SEQ ID NO: 8568 - DNA, 25 bp, Homo sapiens
ggagtcagggacagccttcagtgac

SEQ ID NO: 8569 - DNA, 25 bp, Homo sapiens
gaatctatgaggtcacccaccagtt

SEQ ID NO: 8570 - DNA, 25 bp, Homo sapiens
tttgtgaagtgctgatccctcttcc

SEQ ID NO: 8571 - DNA, 25 bp, Homo sapiens
ttgtctcctggtggctatacgaaac

SEQ ID NO: 8572 - DNA, 25 bp, Homo sapiens
gactttattacagcttcccaagccc

SEQ ID NO: 8573 - DNA, 25 bp, Homo sapiens
ttcccaagccccatcaataaagccc

SEQ ID NO: 8574 - DNA, 25 bp, Homo sapiens
cccagactttaccgcggaggcggct

SEQ ID NO: 8575 - DNA, 25 bp, Homo sapiens
gaggcggctgagtgcagctacagct

SEQ ID NO: 8576 - DNA, 25 bp, Homo sapiens
ttcatcttctgcacgttcttcgtga

SEQ ID NO: 8577 - DNA, 25 bp, Homo sapiens
aaactggaaggatcccgggtctcag

SEQ ID NO: 8578 - DNA, 25 bp, Homo sapiens
aggaaacggttcatgtgtcactttt

SEQ ID NO: 8579 - DNA, 25 bp, Homo sapiens
tggaaacactgagccatacaccctc

SEQ ID NO: 8580 - DNA, 25 bp, Homo sapiens
tcatcacagctaaacctggttccct

SEQ ID NO: 8581 - DNA, 25 bp, Homo sapiens
cactcgggcttgtaactgtctgagc

SEQ ID NO: 8582 - DNA, 25 bp, Homo sapiens
tggggtgaaagcagccagctcatcc

SEQ ID NO: 8583 - DNA, 25 bp, Homo sapiens
cccagtgactcacaggacacagcca

SEQ ID NO: 8584 - DNA, 25 bp, Homo sapiens
ggcatctttccttgtcgaatgatac

SEQ ID NO: 8585 - DNA, 25 bp, Homo sapiens
gtgctctccacaacatgtgtgttct

SEQ ID NO: 8586 - DNA, 25 bp, Homo sapiens
gtttctaatatgtggccagggcgtt

SEQ ID NO: 8587 - DNA, 25 bp, Homo sapiens
cagggcgttcagatttccagttttg

SEQ ID NO: 8588 - DNA, 25 bp, Homo sapiens
gatggcaacgagggcactgttatct

SEQ ID NO: 8589 - DNA, 25 bp, Homo sapiens
ggcactgttatcttcgtttgttttc

SEQ ID NO: 8590 - DNA, 25 bp, Homo sapiens
gagattggaaacttcttgccttgaa

SEQ ID NO: 8591 - DNA, 25 bp, Homo sapiens
tatatcttagattctctctcacatt

SEQ ID NO: 8592 - DNA, 25 bp, Homo sapiens
ggaaccagatgatgttcactgctga

SEQ ID NO: 8593 - DNA, 25 bp, Homo sapiens
gctgaaattccataatgcttcccat

SEQ ID NO: 8594 - DNA, 25 bp, Homo sapiens
aggaaagctgctttcacgtcattgc

SEQ ID NO: 8595 - DNA, 25 bp, Homo sapiens
attgccatccagtactgacagggaa

SEQ ID NO: 8596 - DNA, 25 bp, Homo sapiens
tataaatcttcatggtttttctatt

SEQ ID NO: 8597 - DNA, 25 bp, Homo sapiens
tttttctatttctgatacactcagc

SEQ ID NO: 8598 - DNA, 25 bp, Homo sapiens
gatacactcagctatagttaatacc

SEQ ID NO: 8599 - DNA, 25 bp, Homo sapiens
aataccagagtatcctaccaggagt

SEQ ID NO: 8600 - DNA, 25 bp, Homo sapiens
aagaaagttgtacttcctggctggg

SEQ ID NO: 8601 - DNA, 25 bp, Homo sapiens
gacatggcttgattgttctgtttaa

SEQ ID NO: 8602 - DNA, 25 bp, Homo sapiens
gtggcttatgttacacatgttcatg

SEQ ID NO: 8603 - DNA, 25 bp, Homo sapiens
acctctcattcacctgttttatatg

SEQ ID NO: 8604 - DNA, 25 bp, Homo sapiens
tcacctgaaacgtattttgacctaa

SEQ ID NO: 8605 - DNA, 25 bp, Homo sapiens
ttgaattttggacagtgcccccata

SEQ ID NO: 8606 - DNA, 25 bp, Homo sapiens
gtgcccccatataaggaagttactg

SEQ ID NO: 8607 - DNA, 25 bp, Homo sapiens
ggtactaatagtatccagcacagat

SEQ ID NO: 8608 - DNA, 25 bp, Homo sapiens
gcttttctttgctagcacaatgtgt

SEQ ID NO: 8609 - DNA, 25 bp, Homo sapiens
gttttaggtggcatagtggcttaac

SEQ ID NO: 8610 - DNA, 25 bp, Homo sapiens
atattctttcaacttcatctcaata

SEQ ID NO: 8611 - DNA, 25 bp, Homo sapiens
agaatcttgtccaagttgtttcatt

SEQ ID NO: 8612 - DNA, 25 bp, Homo sapiens
gtaagtgttctgcttccaacatctt

SEQ ID NO: 8613 - DNA, 25 bp, Homo sapiens
tcctagtgtcttttttggcctttga

SEQ ID NO: 8614 - DNA, 25 bp, Homo sapiens
acctgtttcataagctttgtaattc

SEQ ID NO: 8615 - DNA, 25 bp, Homo sapiens
aagtgcttgttttacataactgata

SEQ ID NO: 8616 - DNA, 25 bp, Homo sapiens
ctttgtgtgctgttagtattgattc

SEQ ID NO: 8617 - DNA, 25 bp, Homo sapiens
caaatgtcagcagctttaagcctaa

SEQ ID NO: 8618 - DNA, 25 bp, Homo sapiens
gtgcatgtgaccacaaatgcttgct

SEQ ID NO: 8619 - DNA, 25 bp, Homo sapiens
accacaaatgcttgcttggacttgc

SEQ ID NO: 8620 - DNA, 25 bp, Homo sapiens
acttgcccatctagcactttggaaa

SEQ ID NO: 8621 - DNA, 25 bp, Homo sapiens
aatgccaaataatcttccaggtagt

SEQ ID NO: 8622 - DNA, 25 bp, Homo sapiens
atcttccaggtagtgctgcttctga

SEQ ID NO: 8623 - DNA, 25 bp, Homo sapiens
agtgctgcttctgaagttatctctt

SEQ ID NO: 8624 - DNA, 25 bp, Homo sapiens
tgaagttatctcttaatcctcttaa

SEQ ID NO: 8625 - DNA, 25 bp, Homo sapiens
gtgtattaattggccatcatgatgt

SEQ ID NO: 8626 - DNA, 25 bp, Homo sapiens
gttatcatatcttattcccttttat

SEQ ID NO: 8627 - DNA, 25 bp, Homo sapiens
cccttttatgctatgatttattcta

SEQ ID NO: 8628 - DNA, 25 bp, Homo sapiens
atttattctatcttttgtatttcag

SEQ ID NO: 8629 - DNA, 25 bp, Homo sapiens
tgcaggctgaggtcctggagtgcgt

SEQ ID NO: 8630 - DNA, 25 bp, Homo sapiens
caggctgaggtcctggagtgcgtga

SEQ ID NO: 8631 - DNA, 25 bp, Homo sapiens
ctgaggtcctggagtgcgtgagcct

SEQ ID NO: 8632 - DNA, 25 bp, Homo sapiens
tcctggagtgcgtgagcctggtgga

SEQ ID NO: 8633 - DNA, 25 bp, Homo sapiens
gctgacctcgcttaagggcagggag

SEQ ID NO: 8634 - DNA, 25 bp, Homo sapiens
gacctcgcttaagggcagggagaag

SEQ ID NO: 8635 - DNA, 25 bp, Homo sapiens
gcagggagaagctggcacctgtacc

SEQ ID NO: 8636 - DNA, 25 bp, Homo sapiens
agggagaagctggcacctgtaccct

SEQ ID NO: 8637 - DNA, 25 bp, Homo sapiens
ttctctctcctgcagtatgagtgac

SEQ ID NO: 8638 - DNA, 25 bp, Homo sapiens
ctctctcctgcagtatgagtgacca

SEQ ID NO: 8639 - DNA, 25 bp, Homo sapiens
ctctcctgcagtatgagtgaccaca

SEQ ID NO: 8640 - DNA, 25 bp, Homo sapiens
gcaccagtgcgagatctggcgcgag

SEQ ID NO: 8641 - DNA, 25 bp, Homo sapiens
tctcctctgcatgcacttaactttg

SEQ ID NO: 8642 - DNA, 25 bp, Homo sapiens
ggtggtgacggcacacagcatgtac

SEQ ID NO: 8643 - DNA, 25 bp, Homo sapiens
gcatgtactgtggcggctggagaat

SEQ ID NO: 8644 - DNA, 25 bp, Homo sapiens
ggaacacatccggcccaagattgtg

SEQ ID NO: 8645 - DNA, 25 bp, Homo sapiens
aaccacggacacacagcagagcagg

SEQ ID NO: 8646 - DNA, 25 bp, Homo sapiens
gcaggtgactggtggcatcaaggcc

SEQ ID NO: 8647 - DNA, 25 bp, Homo sapiens
ccctggctttgtgcactcagatggc

SEQ ID NO: 8648 - DNA, 25 bp, Homo sapiens
gcaccatcagccatcatgacatgta

SEQ ID NO: 8649 - DNA, 25 bp, Homo sapiens
tgtatgattacctgcatctgagccg

SEQ ID NO: 8650 - DNA, 25 bp, Homo sapiens
cgtctgctggcccaagaccagggcc

SEQ ID NO: 8651 - DNA, 25 bp, Homo sapiens
actgcccaaggcatgttttgcccac

SEQ ID NO: 8652 - DNA, 25 bp, Homo sapiens
ccaccagatcatggcccacgtggag

SEQ ID NO: 8653 - DNA, 25 bp, Homo sapiens
gggtggtcattgcctagaggtgctc

SEQ ID NO: 8654 - DNA, 25 bp, Homo sapiens
tgatgctggaggcagaatcccggct

SEQ ID NO: 8655 - DNA, 25 bp, Homo sapiens
gaatcccggctgtcaaggggtgttc

SEQ ID NO: 8656 - DNA, 25 bp, Homo sapiens
agggacaatttgctgccaaacaccc

SEQ ID NO: 8657 - DNA, 25 bp, Homo sapiens
cacccatgcccagctgtatggctgg

SEQ ID NO: 8658 - DNA, 25 bp, Homo sapiens
aataaatatgctcagccaccctgtg

SEQ ID NO: 8659 - DNA, 25 bp, Homo sapiens
gccgggcaatccagacagcaggcat

SEQ ID NO: 8660 - DNA, 25 bp, Homo sapiens
aggcataaggcaccagttaccctgc

SEQ ID NO: 8661 - DNA, 25 bp, Homo sapiens
tgagtaatgctcgtctgtgtgtttt

SEQ ID NO: 8662 - DNA, 25 bp, Homo sapiens
aacccagtagctgtgacgttccatc

SEQ ID NO: 8663 - DNA, 25 bp, Homo sapiens
ccttaatgcggccctcagattagat

SEQ ID NO: 8664 - DNA, 25 bp, Homo sapiens
gaccctcaaggacctcgaggttact

SEQ ID NO: 8665 - DNA, 25 bp, Homo sapiens
ggttactgcagtcagatgccatctc

SEQ ID NO: 8666 - DNA, 25 bp, Homo sapiens
gctgtggtcaggaactaggcatgct

SEQ ID NO: 8667 - DNA, 25 bp, Homo sapiens
tgctttctggcaatgcactcaccag

SEQ ID NO: 8668 - DNA, 25 bp, Homo sapiens
gagagttggggtgtctggtaggcaa

SEQ ID NO: 8669 - DNA, 25 bp, Homo sapiens
tgtttcgaagtccagttgtcattcc

SEQ ID NO: 8670 - DNA, 25 bp, Homo sapiens
tcattcccgcattcagatttcattt

SEQ ID NO: 8671 - DNA, 25 bp, Homo sapiens
cgtacccaaggacattgcctcaggg

SEQ ID NO: 8672 - DNA, 25 bp, Homo sapiens
tgcctcagggttgcaaactctttaa

SEQ ID NO: 8673 - DNA, 25 bp, Homo sapiens
cactgcaaaaatacaatggcctaca

SEQ ID NO: 8674 - DNA, 25 bp, Homo sapiens
agaaaggagccctgtattgtgagct

SEQ ID NO: 8675 - DNA, 25 bp, Homo sapiens
tgcccctgaatgtggtcgatgccaa

SEQ ID NO: 8676 - DNA, 25 bp, Homo sapiens
gtggtcgatgccaaaggaagatcct

SEQ ID NO: 8677 - DNA, 25 bp, Homo sapiens
ggaagatccttggagaagtcatcaa

SEQ ID NO: 8678 - DNA, 25 bp, Homo sapiens
gtgtgtgtagcctgtggaaagccca

SEQ ID NO: 8679 - DNA, 25 bp, Homo sapiens
ctgtggaaagcccattcggaacaat

SEQ ID NO: 8680 - DNA, 25 bp, Homo sapiens
ttcggaacaatgtttttcacttgga

SEQ ID NO: 8681 - DNA, 25 bp, Homo sapiens
tggaggatggtgaaccctactgtga

SEQ ID NO: 8682 - DNA, 25 bp, Homo sapiens
gaaccctactgtgagactgattatt

SEQ ID NO: 8683 - DNA, 25 bp, Homo sapiens
tgtgagactgattattatgccctct

SEQ ID NO: 8684 - DNA, 25 bp, Homo sapiens
tatttttgccttacagtggatcatt

SEQ ID NO: 8685 - DNA, 25 bp, Homo sapiens
ttgccttacagtggatcattctagt

SEQ ID NO: 8686 - DNA, 25 bp, Homo sapiens
tacagtggatcattctagtaggaaa

SEQ ID NO: 8687 - DNA, 25 bp, Homo sapiens
tttatcaaaatgtgtcatgccagta

SEQ ID NO: 8688 - DNA, 25 bp, Homo sapiens
gtgtcatgccagtaagagatgttat

SEQ ID NO: 8689 - DNA, 25 bp, Homo sapiens
tccccacccaaaaataagctaccat

SEQ ID NO: 8690 - DNA, 25 bp, Homo sapiens
agcttataagtctcaaatttttgcc

SEQ ID NO: 8691 - DNA, 25 bp, Homo sapiens
ttctgttcattgtgtatgcttcatc

SEQ ID NO: 8692 - DNA, 25 bp, Homo sapiens
attgtgtatgcttcatcacctatat

SEQ ID NO: 8693 - DNA, 25 bp, Homo sapiens
gtatgcttcatcacctatattaggc

SEQ ID NO: 8694 - DNA, 25 bp, Homo sapiens
cacctatattaggcaaattccattt

SEQ ID NO: 8695 - DNA, 25 bp, Homo sapiens
cacactggagggcacacacgtaccc

SEQ ID NO: 8696 - DNA, 25 bp, Homo sapiens
caactcctgacagaaagctcctccc

SEQ ID NO: 8697 - DNA, 25 bp, Homo sapiens
gcatgatcctgaaatctgcatccgc

SEQ ID NO: 8698 - DNA, 25 bp, Homo sapiens
tgcatccgccgtggtttgtattcat

SEQ ID NO: 8699 - DNA, 25 bp, Homo sapiens
gccaggggctcgctgtgaggaatag

SEQ ID NO: 8700 - DNA, 25 bp, Homo sapiens
aaaacttttcaccagcctttgagag

SEQ ID NO: 8701 - DNA, 25 bp, Homo sapiens
tttgagagactagactgaccccacc

SEQ ID NO: 8702 - DNA, 25 bp, Homo sapiens
acccttccttcagtgagcagaatca

SEQ ID NO: 8703 - DNA, 25 bp, Homo sapiens
gcagaatcactgtggtcagtctcct

SEQ ID NO: 8704 - DNA, 25 bp, Homo sapiens
cagttcatgaatactcctgttcctc

SEQ ID NO: 8705 - DNA, 25 bp, Homo sapiens
ctggtatacatgcggcttcattgcc

SEQ ID NO: 8706 - DNA, 25 bp, Homo sapiens
gtggccgtagcaacttggcggagac

SEQ ID NO: 8707 - DNA, 25 bp, Homo sapiens
gttagagtggttgcttccttagcct

SEQ ID NO: 8708 - DNA, 25 bp, Homo sapiens
atgtgggcagtttgacttcagcact

SEQ ID NO: 8709 - DNA, 25 bp, Homo sapiens
gttgcctcagaggccaagtttccag

SEQ ID NO: 8710 - DNA, 25 bp, Homo sapiens
ttacctgccgtaaaatgctcaaccc

SEQ ID NO: 8711 - DNA, 25 bp, Homo sapiens
tggaatggaaccttcttaggcctcc

SEQ ID NO: 8712 - DNA, 25 bp, Homo sapiens
gcctcctggtgcaacttaatttttt

SEQ ID NO: 8713 - DNA, 25 bp, Homo sapiens
aatgcctcccattcggatggatctc

SEQ ID NO: 8714 - DNA, 25 bp, Homo sapiens
gatggatctctgcgtttttatactg

SEQ ID NO: 8715 - DNA, 25 bp, Homo sapiens
atactgagtgtgcctaggttgcccc

SEQ ID NO: 8716 - DNA, 25 bp, Homo sapiens
tttccctgttgcgttgctatagatg

SEQ ID NO: 8717 - DNA, 25 bp, Homo sapiens
attccctcagcctatagcatcaaag

SEQ ID NO: 8718 - DNA, 25 bp, Homo sapiens
gcatcaaagcagaccagtggccaac

SEQ ID NO: 8719 - DNA, 25 bp, Homo sapiens
gtatcctaacctgttatgtcctgac

SEQ ID NO: 8720 - DNA, 25 bp, Homo sapiens
tgtcctgacagcaatggtaacccca

SEQ ID NO: 8721 - DNA, 25 bp, Homo sapiens
aatgttgtaatttccgcatggccct

SEQ ID NO: 8722 - DNA, 25 bp, Homo sapiens
ctcccttttcctcaactcagtgagg

SEQ ID NO: 8723 - DNA, 25 bp, Homo sapiens
gctagtgtgttcaatgggacctgct

SEQ ID NO: 8724 - DNA, 25 bp, Homo sapiens
ccccctctctatgtgtatatttcta

SEQ ID NO: 8725 - DNA, 25 bp, Homo sapiens
gggctggggtggatggatgggcaac

SEQ ID NO: 8726 - DNA, 25 bp, Homo sapiens
aacagtgactttgattacccttgct

SEQ ID NO: 8727 - DNA, 25 bp, Homo sapiens
tgtttcttttatctgactgactctg

SEQ ID NO: 8728 - DNA, 25 bp, Homo sapiens
agctgagcaagctttggtgcggcct

SEQ ID NO: 8729 - DNA, 25 bp, Homo sapiens
ccgcggctctatgttctatgatgag

SEQ ID NO: 8730 - DNA, 25 bp, Homo sapiens
gggatctggctcacgagttctatga

SEQ ID NO: 8731 - DNA, 25 bp, Homo sapiens
gagacaatcgtcaccaagaacgggc

SEQ ID NO: 8732 - DNA, 25 bp, Homo sapiens
agcgggccaagctgaggcgagtgca

SEQ ID NO: 8733 - DNA, 25 bp, Homo sapiens
tctgattcctcagggcatcgtgaag

SEQ ID NO: 8734 - DNA, 25 bp, Homo sapiens
gggcatcgtgaagctggatcacccc

SEQ ID NO: 8735 - DNA, 25 bp, Homo sapiens
atttccctgtgatcctctatgaggt

SEQ ID NO: 8736 - DNA, 25 bp, Homo sapiens
gctggggccacaaccctgaataaac

SEQ ID NO: 8737 - DNA, 25 bp, Homo sapiens
gcggctggggcaggttatggtagtg

SEQ ID NO: 8738 - DNA, 25 bp, Homo sapiens
tatggtagtgcggactgcggtgtga

SEQ ID NO: 8739 - DNA, 25 bp, Homo sapiens
gaaaagatacctttctgttcaactt

SEQ ID NO: 8740 - DNA, 25 bp, Homo sapiens
gttcaacttgtatcaactcctcttt

SEQ ID NO: 8741 - DNA, 25 bp, Homo sapiens
aactcctcttttctaattgctgtga

SEQ ID NO: 8742 - DNA, 25 bp, Homo sapiens
ttgattttacccagcttaatctgta

SEQ ID NO: 8743 - DNA, 25 bp, Homo sapiens
attactttcctatcatccatatgca

SEQ ID NO: 8744 - DNA, 25 bp, Homo sapiens
acatattgggtgcttctgaattcct

SEQ ID NO: 8745 - DNA, 25 bp, Homo sapiens
tgcctataatctgttgctttttctc

SEQ ID NO: 8746 - DNA, 25 bp, Homo sapiens
tgctttttctcaatatgtgtcctat

SEQ ID NO: 8747 - DNA, 25 bp, Homo sapiens
atgtgtcctattggaaattcctcaa

SEQ ID NO: 8748 - DNA, 25 bp, Homo sapiens
aattcctcaaatcgttggtgccatc

SEQ ID NO: 8749 - DNA, 25 bp, Homo sapiens
gatgacttgcttactgtatttgcat

SEQ ID NO: 8750 - DNA, 25 bp, Homo sapiens
gctgtggatctgtttggccagggtc

SEQ ID NO: 8751 - DNA, 25 bp, Homo sapiens
atatttgcaagactcagccagctcc

SEQ ID NO: 8752 - DNA, 25 bp, Homo sapiens
tgcccaggtcacagcacaagtgcac

SEQ ID NO: 8753 - DNA, 25 bp, Homo sapiens
tgcacatcagcactatggggcctat

SEQ ID NO: 8754 - DNA, 25 bp, Homo sapiens
gcactatggggcctatgtcctgccc

SEQ ID NO: 8755 - DNA, 25 bp, Homo sapiens
cctgctcacatccacagtcagggca

SEQ ID NO: 8756 - DNA, 25 bp, Homo sapiens
tcccaacaagtgcctctttgtctat

SEQ ID NO: 8757 - DNA, 25 bp, Homo sapiens
aagtgcctctttgtctatgatgtcc

SEQ ID NO: 8758 - DNA, 25 bp, Homo sapiens
ccctggccggctgccatggccagga

SEQ ID NO: 8759 - DNA, 25 bp, Homo sapiens
gctaagtgcctttttgtgtgcaacc

SEQ ID NO: 8760 - DNA, 25 bp, Homo sapiens
ctttttgtgtgcaaccacttaccct

SEQ ID NO: 8761 - DNA, 25 bp, Homo sapiens
attcctctgagaatggcttttatag

SEQ ID NO: 8762 - DNA, 25 bp, Homo sapiens
ataggtattttgcctggtaatgtat

SEQ ID NO: 8763 - DNA, 25 bp, Homo sapiens
attttgcctggtaatgtattcattc

SEQ ID NO: 8764 - DNA, 25 bp, Homo sapiens
tattcattcatgattgcccatattc

SEQ ID NO: 8765 - DNA, 25 bp, Homo sapiens
catgattgcccatattcttgaatgt

SEQ ID NO: 8766 - DNA, 25 bp, Homo sapiens
gcccatattcttgaatgtttcttca

SEQ ID NO: 8767 - DNA, 25 bp, Homo sapiens
atgtttcttcattccaatggggtca

SEQ ID NO: 8768 - DNA, 25 bp, Homo sapiens
tcattccaatggggtcaggtcaata

SEQ ID NO: 8769 - DNA, 25 bp, Homo sapiens
atggggtcaggtcaatattatgaaa

SEQ ID NO: 8770 - DNA, 25 bp, Homo sapiens
ttcacaaaacctgccactacattct

SEQ ID NO: 8771 - DNA, 25 bp, Homo sapiens
acctgccactacattctggtttaca

SEQ ID NO: 8772 - DNA, 25 bp, Homo sapiens
aaagacaagcattgggtcagaccca

SEQ ID NO: 8773 - DNA, 25 bp, Homo sapiens
ttgggtcagacccataaaccacctc

SEQ ID NO: 8774 - DNA, 25 bp, Homo sapiens
aggctgtcatttcattgcactggaa

SEQ ID NO: 8775 - DNA, 25 bp, Homo sapiens
gtaagggagtcattgccttgggcct

SEQ ID NO: 8776 - DNA, 25 bp, Homo sapiens
gccttgggcctgggaatctaagtgg

SEQ ID NO: 8777 - DNA, 25 bp, Homo sapiens
aaagtttatctttgcacaatcaata

SEQ ID NO: 8778 - DNA, 25 bp, Homo sapiens
gaggtggcatgtttagtctaccaaa

SEQ ID NO: 8779 - DNA, 25 bp, Homo sapiens
gaaatatccttttagaagcagcgag

SEQ ID NO: 8780 - DNA, 25 bp, Homo sapiens
gaagcagcgagtgcatgggctaatt

SEQ ID NO: 8781 - DNA, 25 bp, Homo sapiens
atgggctaattatcatcaatcttta

SEQ ID NO: 8782 - DNA, 25 bp, Homo sapiens
ggatctttattggtgaccttttgta

SEQ ID NO: 8783 - DNA, 25 bp, Homo sapiens
gaacttgttcagaccgttttagcac

SEQ ID NO: 8784 - DNA, 25 bp, Homo sapiens
tgtgcagcttccttgagtggcgaga

SEQ ID NO: 8785 - DNA, 25 bp, Homo sapiens
tgctagtctgtatttttgctgtgct

SEQ ID NO: 8786 - DNA, 25 bp, Homo sapiens
gctgaaaccccacgtagtgttcttg

SEQ ID NO: 8787 - DNA, 25 bp, Homo sapiens
aattggactgacataactctcctcc

SEQ ID NO: 8788 - DNA, 25 bp, Homo sapiens
ctcccttgttgatgacttcttgtgg

SEQ ID NO: 8789 - DNA, 25 bp, Homo sapiens
gacttcttgtggcatttcacacact

SEQ ID NO: 8790 - DNA, 25 bp, Homo sapiens
acacactgtagatggtcactccctt

SEQ ID NO: 8791 - DNA, 25 bp, Homo sapiens
actcccttcatgtccatgttagctc

SEQ ID NO: 8792 - DNA, 25 bp, Homo sapiens
tactgttttgctaagccgcttcatt

SEQ ID NO: 8793 - DNA, 25 bp, Homo sapiens
gcttcattcatgcctacacaatttt

SEQ ID NO: 8794 - DNA, 25 bp, Homo sapiens
tacaatccttagcacgttatctcag

SEQ ID NO: 8795 - DNA, 25 bp, Homo sapiens
gcacgttatctcagggcttatgaaa

SEQ ID NO: 8796 - DNA, 25 bp, Homo sapiens
tacacagctggccaccaaatgcgaa

SEQ ID NO: 8797 - DNA, 25 bp, Homo sapiens
gtcaatctgctacttaaccctgaaa

SEQ ID NO: 8798 - DNA, 25 bp, Homo sapiens
agcggaaccataactcattgaattt

SEQ ID NO: 8799 - DNA, 25 bp, Homo sapiens
gtgatctttgtttttggcacatcaa

SEQ ID NO: 8800 - DNA, 25 bp, Homo sapiens
aattctcagtcattattcatgtttc

SEQ ID NO: 8801 - DNA, 25 bp, Homo sapiens
atgtttcttttatgctgctggcttt

SEQ ID NO: 8802 - DNA, 25 bp, Homo sapiens
gcttttgtgccctggaagatcataa

SEQ ID NO: 8803 - DNA, 25 bp, Homo sapiens
tacctggtgaacttgctatctgctc

SEQ ID NO: 8804 - DNA, 25 bp, Homo sapiens
tgctatctgctctgtttctagttaa

SEQ ID NO: 8805 - DNA, 25 bp, Homo sapiens
gaatgcatggtgccggtcagtgggc

SEQ ID NO: 8806 - DNA, 25 bp, Homo sapiens
cacgagaactgctgtctgacctgtg

SEQ ID NO: 8807 - DNA, 25 bp, Homo sapiens
acaagcagacctcagcaacgataag

SEQ ID NO: 8808 - DNA, 25 bp, Homo sapiens
caacgataagatcctctcgcttgtt

SEQ ID NO: 8809 - DNA, 25 bp, Homo sapiens
tcgcttgttcactggggcatgtaca

SEQ ID NO: 8810 - DNA, 25 bp, Homo sapiens
gacggagtcttatctgaactacact

SEQ ID NO: 8811 - DNA, 25 bp, Homo sapiens
gcttgaaggccttttgagttctgct

SEQ ID NO: 8812 - DNA, 25 bp, Homo sapiens
aagactttgtacacactgtcaccag

SEQ ID NO: 8813 - DNA, 25 bp, Homo sapiens
aaatgtgccctatgtaagcttctac

SEQ ID NO: 8814 - DNA, 25 bp, Homo sapiens
ggatcagcggcaacagatgctctcc

SEQ ID NO: 8815 - DNA, 25 bp, Homo sapiens
agctttcacggacaccattccaaaa

SEQ ID NO: 8816 - DNA, 25 bp, Homo sapiens
ggacggactctatgaggggctcaca

SEQ ID NO: 8817 - DNA, 25 bp, Homo sapiens
ggggctcacatggttaacctctaac

SEQ ID NO: 8818 - DNA, 25 bp, Homo sapiens
ttcataggattatcgccaccatcac

SEQ ID NO: 8819 - DNA, 25 bp, Homo sapiens
tgaagctgggccagtcggtgaccac

SEQ ID NO: 8820 - DNA, 25 bp, Homo sapiens
gaccaccattcccactgtgggtttc

SEQ ID NO: 8821 - DNA, 25 bp, Homo sapiens
gtctcatcttcgtagtggactgcgc

SEQ ID NO: 8822 - DNA, 25 bp, Homo sapiens
cgatgaggctcgccaggagctgcac

SEQ ID NO: 8823 - DNA, 25 bp, Homo sapiens
ggagctgcaccgcattatcaatgac

SEQ ID NO: 8824 - DNA, 25 bp, Homo sapiens
gagggacgccataatcctcatcttc

SEQ ID NO: 8825 - DNA, 25 bp, Homo sapiens
ccatgaaaccccacgagatccagga

SEQ ID NO: 8826 - DNA, 25 bp, Homo sapiens
ggcctgacccggattcgggacagga

SEQ ID NO: 8827 - DNA, 25 bp, Homo sapiens
agagtggtcttttcaacactcctcc

SEQ ID NO: 8828 - DNA, 25 bp, Homo sapiens
ggacctcaaccaggacttcagtgga

SEQ ID NO: 8829 - DNA, 25 bp, Homo sapiens
gacttcagtggatttcagcttctag

SEQ ID NO: 8830 - DNA, 25 bp, Homo sapiens
gtggatgttgcactcaaacgggctg

SEQ ID NO: 8831 - DNA, 25 bp, Homo sapiens
gatggagcttcaggcaaaacttaca

SEQ ID NO: 8832 - DNA, 25 bp, Homo sapiens
acttacagcttaacccattttcaag

SEQ ID NO: 8833 - DNA, 25 bp, Homo sapiens
gaaatgtcatgattgccggggtgaa

SEQ ID NO: 8834 - DNA, 25 bp, Homo sapiens
atgggattgctaaaacagcttcctg

SEQ ID NO: 8835 - DNA, 25 bp, Homo sapiens
gatggttcccaatatcatgtgattt

SEQ ID NO: 8836 - DNA, 25 bp, Homo sapiens
agaacctatagcatcttctcattcc

SEQ ID NO: 8837 - DNA, 25 bp, Homo sapiens
aggatgcccacatactgtctaatta

SEQ ID NO: 8838 - DNA, 25 bp, Homo sapiens
cccttccttcatctgacttattgaa

SEQ ID NO: 8839 - DNA, 25 bp, Homo sapiens
tacaaactaacagtcaccagcacca

SEQ ID NO: 8840 - DNA, 25 bp, Homo sapiens
gaattaagtcaactaacctgccttg

SEQ ID NO: 8841 - DNA, 25 bp, Homo sapiens
caatccatatggctttatctggtat

SEQ ID NO: 8842 - DNA, 25 bp, Homo sapiens
aatcttctgcctttgatcatttctg

SEQ ID NO: 8843 - DNA, 25 bp, Homo sapiens
gggccagagaacactatttttacat

SEQ ID NO: 8844 - DNA, 25 bp, Homo sapiens
ggttgcctgaaattccttcatgctt

SEQ ID NO: 8845 - DNA, 25 bp, Homo sapiens
cttcatgctttctattcaggactaa

SEQ ID NO: 8846 - DNA, 25 bp, Homo sapiens
ggactaattcccttactgcaaatgt

SEQ ID NO: 8847 - DNA, 25 bp, Homo sapiens
ctctaacatctcccacaagctaaag

SEQ ID NO: 8848 - DNA, 25 bp, Homo sapiens
acatctgacatcctgtgtttggtta

SEQ ID NO: 8849 - DNA, 25 bp, Homo sapiens
atgaagctcatatccttttgaaggt

SEQ ID NO: 8850 - DNA, 25 bp, Homo sapiens
gagacatttcaaaactgccctaggc

SEQ ID NO: 8851 - DNA, 25 bp, Homo sapiens
cctaggccattgcagcatccttaga

SEQ ID NO: 8852 - DNA, 25 bp, Homo sapiens
gatgggacgcataatcattacctta

SEQ ID NO: 8853 - DNA, 25 bp, Homo sapiens
attaccttaaagcatcaccactcat

SEQ ID NO: 8854 - DNA, 25 bp, Homo sapiens
aagcatcaccactcattttgaccat

SEQ ID NO: 8855 - DNA, 25 bp, Homo sapiens
aaggtcaatcagcctcatgacttta

SEQ ID NO: 8856 - DNA, 25 bp, Homo sapiens
gctatcctttcaaacagctattggc

SEQ ID NO: 8857 - DNA, 25 bp, Homo sapiens
aagtaacatgacttccttatttctg

SEQ ID NO: 8858 - DNA, 25 bp, Homo sapiens
aaatccaggctttatgtacaaacat

SEQ ID NO: 8859 - DNA, 25 bp, Homo sapiens
gatgagcagacttctcggaattcat

SEQ ID NO: 8860 - DNA, 25 bp, Homo sapiens
aaagcacacaacgattatagtaact

SEQ ID NO: 8861 - DNA, 25 bp, Homo sapiens
tcctacaggcctatttaacaagatg

SEQ ID NO: 8862 - DNA, 25 bp, Homo sapiens
aaatgttgctctaatcagattgctt

SEQ ID NO: 8863 - DNA, 25 bp, Homo sapiens
atgtagctcccacaaggtaaacttc

SEQ ID NO: 8864 - DNA, 25 bp, Homo sapiens
aaacttcattggtaagattgcactg

SEQ ID NO: 8865 - DNA, 25 bp, Homo sapiens
gattgcactgttctgattatgtaag

SEQ ID NO: 8866 - DNA, 25 bp, Homo sapiens
gttgacaccacttagatttaaaggc

SEQ ID NO: 8867 - DNA, 25 bp, Homo sapiens
aaggcagacagttttgctttagtac

SEQ ID NO: 8868 - DNA, 25 bp, Homo sapiens
tacctttacatatatagtcactggc

SEQ ID NO: 8869 - DNA, 25 bp, Homo sapiens
agtcactggcatactgagaatatac

SEQ ID NO: 8870 - DNA, 25 bp, Homo sapiens
gagaatatacaatgatcctggaaat

SEQ ID NO: 8871 - DNA, 25 bp, Homo sapiens
cccacctggagctgaatcacatgac

SEQ ID NO: 8872 - DNA, 25 bp, Homo sapiens
cgacccatcctgttcgtgaataggt

SEQ ID NO: 8873 - DNA, 25 bp, Homo sapiens
tcgtgaataggtctcaggggttggg

SEQ ID NO: 8874 - DNA, 25 bp, Homo sapiens
gggggagggactgccagatttggac

SEQ ID NO: 8875 - DNA, 25 bp, Homo sapiens
gccagatttggacactatatttttt

SEQ ID NO: 8876 - DNA, 25 bp, Homo sapiens
ttcaacttgaagatgtgtatttccc

SEQ ID NO: 8877 - DNA, 25 bp, Homo sapiens
taagcctcgtaaaggtcatcccacc

SEQ ID NO: 8878 - DNA, 25 bp, Homo sapiens
aacctccaacacgatccatttagag

SEQ ID NO: 8879 - DNA, 25 bp, Homo sapiens
caacacgatccatttagaggccaaa

SEQ ID NO: 8880 - DNA, 25 bp, Homo sapiens
tttagaggccaaatgtcattctgca

SEQ ID NO: 8881 - DNA, 25 bp, Homo sapiens
caggtgccttcccgatggattaaag

SEQ ID NO: 8882 - DNA, 25 bp, Homo sapiens
taacgagacatagtgctgctaccac

SEQ ID NO: 8883 - DNA, 25 bp, Homo sapiens
gtggatgccagaggaccaggctaat

SEQ ID NO: 8884 - DNA, 25 bp, Homo sapiens
ggaccaggctaatgacttgtgtgtg

SEQ ID NO: 8885 - DNA, 25 bp, Homo sapiens
cttgtgtgtgctgatgtgtttccat

SEQ ID NO: 8886 - DNA, 25 bp, Homo sapiens
atttaatgtgtgtagaccctcctct

SEQ ID NO: 8887 - DNA, 25 bp, Homo sapiens
aatcaaaaagcatttcctaggcagc

SEQ ID NO: 8888 - DNA, 25 bp, Homo sapiens
gaaacagggacatctccatcattac

SEQ ID NO: 8889 - DNA, 25 bp, Homo sapiens
ggacatctccatcattactggctta

SEQ ID NO: 8890 - DNA, 25 bp, Homo sapiens
ttactggcttagttttgctttcctt

SEQ ID NO: 8891 - DNA, 25 bp, Homo sapiens
ttttgctttcctttgacacagtaag

SEQ ID NO: 8892 - DNA, 25 bp, Homo sapiens
gtaaggcaaaggccaagctttcaaa

SEQ ID NO: 8893 - DNA, 25 bp, Homo sapiens
aggaggatccctggaactctatcac

SEQ ID NO: 8894 - DNA, 25 bp, Homo sapiens
tcaccagtggagcattgaccggggc

SEQ ID NO: 8895 - DNA, 25 bp, Homo sapiens
tggccatggtgggctcagcaatgat

SEQ ID NO: 8896 - DNA, 25 bp, Homo sapiens
aatgatggggggcatcctgttggcc

SEQ ID NO: 8897 - DNA, 25 bp, Homo sapiens
tcattgagggcgttggcatcctcct

SEQ ID NO: 8898 - DNA, 25 bp, Homo sapiens
ccccagctatcagcagtaccactga

SEQ ID NO: 8899 - DNA, 25 bp, Homo sapiens
tccccgatggtctacctcgaaggga

SEQ ID NO: 8900 - DNA, 25 bp, Homo sapiens
aagggagggctggctcccagttagc

SEQ ID NO: 8901 - DNA, 25 bp, Homo sapiens
cagagagggtttctactctgctccc

SEQ ID NO: 8902 - DNA, 25 bp, Homo sapiens
tcacatgtacgaagttctcacccca

SEQ ID NO: 8903 - DNA, 25 bp, Homo sapiens
tcctttgtgtggcaccctgatgagt

SEQ ID NO: 8904 - DNA, 25 bp, Homo sapiens
ggtctatcagtcttggaaatctgtc

SEQ ID NO: 8905 - DNA, 25 bp, Homo sapiens
gaaagcacattccgtttataatttt

SEQ ID NO: 8906 - DNA, 25 bp, Homo sapiens
aaaacctgttgtcatgaaggctttt

SEQ ID NO: 8907 - DNA, 25 bp, Homo sapiens
gagtaccagctgatgaaactgcttt

SEQ ID NO: 8908 - DNA, 25 bp, Homo sapiens
gaatgctctgcagaaatatcccaac

SEQ ID NO: 8909 - DNA, 25 bp, Homo sapiens
atatcccaactgtcctacagatgtg

SEQ ID NO: 8910 - DNA, 25 bp, Homo sapiens
gcagtgggcaacatcctcactaagc

SEQ ID NO: 8911 - DNA, 25 bp, Homo sapiens
agtgacttcaactttggcatttcat

SEQ ID NO: 8912 - DNA, 25 bp, Homo sapiens
ggcatttcattcatacttctgtaga

SEQ ID NO: 8913 - DNA, 25 bp, Homo sapiens
gtatttatgtgagacttgcccatct

SEQ ID NO: 8914 - DNA, 25 bp, Homo sapiens
gctgtgtcttgccttttaatcatga

SEQ ID NO: 8915 - DNA, 25 bp, Homo sapiens
acacaatccattacacggttcgggt

SEQ ID NO: 8916 - DNA, 25 bp, Homo sapiens
ggttcgggtatattcagcatgcagc

SEQ ID NO: 8917 - DNA, 25 bp, Homo sapiens
tcagcatgcagctttactttttcaa

SEQ ID NO: 8918 - DNA, 25 bp, Homo sapiens
tcaaagattccttcaccatacacct

SEQ ID NO: 8919 - DNA, 25 bp, Homo sapiens
accccatctaccaattccatataga

SEQ ID NO: 8920 - DNA, 25 bp, Homo sapiens
gactgggccgttactgattgagcta

SEQ ID NO: 8921 - DNA, 25 bp, Homo sapiens
gaggttgtaacagtttctactctag

SEQ ID NO: 8922 - DNA, 25 bp, Homo sapiens
aatataccttctgggatcttcaata

SEQ ID NO: 8923 - DNA, 25 bp, Homo sapiens
atatcattcctagtacctttttgcc

SEQ ID NO: 8924 - DNA, 25 bp, Homo sapiens
gtattatccccatcaagatcacaca

SEQ ID NO: 8925 - DNA, 25 bp, Homo sapiens
aggacgcaaatcttcaggacagtaa

SEQ ID NO: 8926 - DNA, 25 bp, Homo sapiens
gctggacacgctgaccaaggtgttg

SEQ ID NO: 8927 - DNA, 25 bp, Homo sapiens
gaaacctaacagtgctttggatttt

SEQ ID NO: 8928 - DNA, 25 bp, Homo sapiens
gcatcacttaggagctgctactcca

SEQ ID NO: 8929 - DNA, 25 bp, Homo sapiens
ttcgcctagaactggccgaaatgaa

SEQ ID NO: 8930 - DNA, 25 bp, Homo sapiens
aagcttgctcagtatgaaccacctc

SEQ ID NO: 8931 - DNA, 25 bp, Homo sapiens
gaacagatgctatagaactctttta

SEQ ID NO: 8932 - DNA, 25 bp, Homo sapiens
ttaattcacctatcacactctgtta

SEQ ID NO: 8933 - DNA, 25 bp, Homo sapiens
cgctgtcactatggcccattacaaa

SEQ ID NO: 8934 - DNA, 25 bp, Homo sapiens
attacaaagccgccgactcgaagcg

SEQ ID NO: 8935 - DNA, 25 bp, Homo sapiens
gactcgaagcgtgagcagttccgga

SEQ ID NO: 8936 - DNA, 25 bp, Homo sapiens
gagcagttccggaggtacttggaga

SEQ ID NO: 8937 - DNA, 25 bp, Homo sapiens
aagcaggagccggcatcatggattc

SEQ ID NO: 8938 - DNA, 25 bp, Homo sapiens
ggcaaggacttcaatgtgcccctct

SEQ ID NO: 8939 - DNA, 25 bp, Homo sapiens
gcaaagcggcgcaggccggagtggc

SEQ ID NO: 8940 - DNA, 25 bp, Homo sapiens
tgggtgactgggtgctgagcatcga

SEQ ID NO: 8941 - DNA, 25 bp, Homo sapiens
agaatgtttattccatgcccaaggc

SEQ ID NO: 8942 - DNA, 25 bp, Homo sapiens
tggcgagaatgcgggtagcctcaca

SEQ ID NO: 8943 - DNA, 25 bp, Homo sapiens
tagcctcacacacatcgaagctcag

SEQ ID NO: 8944 - DNA, 25 bp, Homo sapiens
gaagctcagaacaagatccgggcct

SEQ ID NO: 8945 - DNA, 25 bp, Homo sapiens
agcctgggcctcagcagggcccagc

SEQ ID NO: 8946 - DNA, 25 bp, Homo sapiens
tgcccaaggcagcacagacctggca

SEQ ID NO: 8947 - DNA, 25 bp, Homo sapiens
agacctggcagacagcagtaccaca

SEQ ID NO: 8948 - DNA, 25 bp, Homo sapiens
tgcacgccctgaagatgacctggca

SEQ ID NO: 8949 - DNA, 25 bp, Homo sapiens
caagacgcccatccggaacagggcc

SEQ ID NO: 8950 - DNA, 25 bp, Homo sapiens
gggccttctacatggaggagggcgt

SEQ ID NO: 8951 - DNA, 25 bp, Homo sapiens
gtgccctattgcgagcgagactatg

SEQ ID NO: 8952 - DNA, 25 bp, Homo sapiens
ggcacgaaatgccatggctgtgact

SEQ ID NO: 8953 - DNA, 25 bp, Homo sapiens
ggctgtgacttcaagatcgacgctg

SEQ ID NO: 8954 - DNA, 25 bp, Homo sapiens
cttcaagatcgacgctggggaccgc

SEQ ID NO: 8955 - DNA, 25 bp, Homo sapiens
tgcttcgtctgtgcgatatgtcaga

SEQ ID NO: 8956 - DNA, 25 bp, Homo sapiens
aggaaagaccttctactccaagaag

SEQ ID NO: 8957 - DNA, 25 bp, Homo sapiens
gtggcccctagcctgaggggcctgg

SEQ ID NO: 8958 - DNA, 25 bp, Homo sapiens
tgcatttctgggtagggctggcaat

SEQ ID NO: 8959 - DNA, 25 bp, Homo sapiens
gagatagctcgcattcagactacct

SEQ ID NO: 8960 - DNA, 25 bp, Homo sapiens
ctcgcattcagactacctactaaca

SEQ ID NO: 8961 - DNA, 25 bp, Homo sapiens
tcagctggaccaactaatcttcgaa

SEQ ID NO: 8962 - DNA, 25 bp, Homo sapiens
aaattcagattggactctatcatat

SEQ ID NO: 8963 - DNA, 25 bp, Homo sapiens
atcatatgtgtcaaatccaagctta

SEQ ID NO: 8964 - DNA, 25 bp, Homo sapiens
gtgtggttcatctgatcgactacta

SEQ ID NO: 8965 - DNA, 25 bp, Homo sapiens
tcgactactatgttcagatgtgcaa

SEQ ID NO: 8966 - DNA, 25 bp, Homo sapiens
taagcggacaggtccagaagccccc

SEQ ID NO: 8967 - DNA, 25 bp, Homo sapiens
actgttcacctttatctgaccaaac

SEQ ID NO: 8968 - DNA, 25 bp, Homo sapiens
ctgaccaaaccgctctacacgtcag

SEQ ID NO: 8969 - DNA, 25 bp, Homo sapiens
ttaacaaatgtaccggtgccatctg

SEQ ID NO: 8970 - DNA, 25 bp, Homo sapiens
atcagagtctcttgggcattttata

SEQ ID NO: 8971 - DNA, 25 bp, Homo sapiens
gtgaccatgaagtcctgtatttgtc

SEQ ID NO: 8972 - DNA, 25 bp, Homo sapiens
ccattctatgggagccttatttcag

SEQ ID NO: 8973 - DNA, 25 bp, Homo sapiens
gtgcaactcaatccccgttaataaa

SEQ ID NO: 8974 - DNA, 25 bp, Homo sapiens
gtaggtataggcattctaccctttc

SEQ ID NO: 8975 - DNA, 25 bp, Homo sapiens
taccctttcaaatagctgtgtccca

SEQ ID NO: 8976 - DNA, 25 bp, Homo sapiens
tgtcccaacctgttgccattgattt

SEQ ID NO: 8977 - DNA, 25 bp, Homo sapiens
ttgtccttgaattgtctaaccatgg

SEQ ID NO: 8978 - DNA, 25 bp, Homo sapiens
acataaacagttgtctcccttctac

SEQ ID NO: 8979 - DNA, 25 bp, Homo sapiens
cagggggatacctgcctgtttttca

SEQ ID NO: 8980 - DNA, 25 bp, Homo sapiens
gtgtttatttactgctgttactatt

SEQ ID NO: 8981 - DNA, 25 bp, Homo sapiens
aggccaaggtggagcaagcggtgga

SEQ ID NO: 8982 - DNA, 25 bp, Homo sapiens
agcggtggagacagagccggagccc

SEQ ID NO: 8983 - DNA, 25 bp, Homo sapiens
ctgcgccagcagaccgagtggcaga

SEQ ID NO: 8984 - DNA, 25 bp, Homo sapiens
gcagaccgagtggcagagcggccag

SEQ ID NO: 8985 - DNA, 25 bp, Homo sapiens
ccagcgctgggaactggcactgggt

SEQ ID NO: 8986 - DNA, 25 bp, Homo sapiens
gcactgggtcgcttttgggattacc

SEQ ID NO: 8987 - DNA, 25 bp, Homo sapiens
gtcgcttttgggattacctgcgctg

SEQ ID NO: 8988 - DNA, 25 bp, Homo sapiens
gattacctgcgctgggtgcagacac

SEQ ID NO: 8989 - DNA, 25 bp, Homo sapiens
aggtcacccaggaactgagggcgct

SEQ ID NO: 8990 - DNA, 25 bp, Homo sapiens
ctgagggcgctgatggacgagacca

SEQ ID NO: 8991 - DNA, 25 bp, Homo sapiens
gaaggcctacaaatcggaactggag

SEQ ID NO: 8992 - DNA, 25 bp, Homo sapiens
gtgcccagcgacaatcactgaacgc

SEQ ID NO: 8993 - DNA, 25 bp, Homo sapiens
gcccagcgacaatcactgaacgccg

SEQ ID NO: 8994 - DNA, 25 bp, Homo sapiens
gcgacaatcactgaacgccgaagcc

SEQ ID NO: 8995 - DNA, 25 bp, Homo sapiens
gaagcgcctggcagtgtaccaggcc

SEQ ID NO: 8996 - DNA, 25 bp, Homo sapiens
aagcgcctggcagtgtaccaggccg

SEQ ID NO: 8997 - DNA, 25 bp, Homo sapiens
tggggcccctggtggaacagggccg

SEQ ID NO: 8998 - DNA, 25 bp, Homo sapiens
ggcccctggtggaacagggccgcgt

SEQ ID NO: 8999 - DNA, 25 bp, Homo sapiens
ccctggtggaacagggccgcgtgcg

SEQ ID NO: 9000 - DNA, 25 bp, Homo sapiens
gcgcgcgcggatggaggagatgggc

SEQ ID NO: 9001 - DNA, 25 bp, Homo sapiens
agcaggcccagcagatacgcctgca

SEQ ID NO: 9002 - DNA, 25 bp, Homo sapiens
tggtggaagacatgcagcgccagtg

SEQ ID NO: 9003 - DNA, 25 bp, Homo sapiens
atgtcagcattggcctctgtgtaca

SEQ ID NO: 9004 - DNA, 25 bp, Homo sapiens
tggcctctgtgtacaaaccaagagc

SEQ ID NO: 9005 - DNA, 25 bp, Homo sapiens
aaccaagagcttttacagatccaga

SEQ ID NO: 9006 - DNA, 25 bp, Homo sapiens
tacttgtctgtcaaatgtttcctta

SEQ ID NO: 9007 - DNA, 25 bp, Homo sapiens
gtctgtaatacactccacttgaagc

SEQ ID NO: 9008 - DNA, 25 bp, Homo sapiens
aatacactccacttgaagcacttaa

SEQ ID NO: 9009 - DNA, 25 bp, Homo sapiens
gaagcacttaagtcttccttaaatg

SEQ ID NO: 9010 - DNA, 25 bp, Homo sapiens
atgatactgtgtgttttcccaaagc

SEQ ID NO: 9011 - DNA, 25 bp, Homo sapiens
tactatctgttgaaaaggtgtcctt

SEQ ID NO: 9012 - DNA, 25 bp, Homo sapiens
tttcttaccaaaattcactaatctt

SEQ ID NO: 9013 - DNA, 25 bp, Homo sapiens
aatgcagaatacttgactcatttaa

SEQ ID NO: 9014 - DNA, 25 bp, Homo sapiens
aaactttttccgtttgctatctcag

SEQ ID NO: 9015 - DNA, 25 bp, Homo sapiens
tcagtacccaagtgccagcatcatt

SEQ ID NO: 9016 - DNA, 25 bp, Homo sapiens
cagcatcatttagttccctctataa

SEQ ID NO: 9017 - DNA, 25 bp, Homo sapiens
gaaatccttattaatgcccttactc

SEQ ID NO: 9018 - DNA, 25 bp, Homo sapiens
attaatgcccttactctatttgaga

SEQ ID NO: 9019 - DNA, 25 bp, Homo sapiens
tcccttttttacttatgcactacat

SEQ ID NO: 9020 - DNA, 25 bp, Homo sapiens
gagccttagcaaatcaccatgacct

SEQ ID NO: 9021 - DNA, 25 bp, Homo sapiens
gattttgcagtgtggaagcgttgaa

SEQ ID NO: 9022 - DNA, 25 bp, Homo sapiens
gaaagttactgcttttccacttgct

SEQ ID NO: 9023 - DNA, 25 bp, Homo sapiens
gcttttccacttgctcatatagtaa

SEQ ID NO: 9024 - DNA, 25 bp, Homo sapiens
ctgtgacagtcaccagctttaagct

SEQ ID NO: 9025 - DNA, 25 bp, Homo sapiens
aaatgaaaagtccaccttgtcttct

SEQ ID NO: 9026 - DNA, 25 bp, Homo sapiens
cagactgcactaaatgttttcctct

SEQ ID NO: 9027 - DNA, 25 bp, Homo sapiens
gttttcctctgttttacaaactgct

SEQ ID NO: 9028 - DNA, 25 bp, Homo sapiens
ttacaaactgcttggcagccccagg

SEQ ID NO: 9029 - DNA, 25 bp, Homo sapiens
gccccaggtgaagcatcaaggattg

SEQ ID NO: 9030 - DNA, 25 bp, Homo sapiens
ggatgcaccaaagtgtgtaccccgt

SEQ ID NO: 9031 - DNA, 25 bp, Homo sapiens
gtgtgtaccccgtaagcatgaaacc

SEQ ID NO: 9032 - DNA, 25 bp, Homo sapiens
gttcttattccggagcctcaaacaa

SEQ ID NO: 9033 - DNA, 25 bp, Homo sapiens
ggagcctcaaacaagcattatacct

SEQ ID NO: 9034 - DNA, 25 bp, Homo sapiens
ctgtgattatgatttcctctcctat

SEQ ID NO: 9035 - DNA, 25 bp, Homo sapiens
gtagcactccacactgatctttgga

SEQ ID NO: 9036 - DNA, 25 bp, Homo sapiens
ggggcagcgtcaccaaaaagcgcaa

SEQ ID NO: 9037 - DNA, 25 bp, Homo sapiens
aactggagtccactgagagccgcag

SEQ ID NO: 9038 - DNA, 25 bp, Homo sapiens
tgaggagggcaagtttgtccggctg

SEQ ID NO: 9039 - DNA, 25 bp, Homo sapiens
gaatggagatgatcccttgctgact

SEQ ID NO: 9040 - DNA, 25 bp, Homo sapiens
ccaccaaagttcaccctgaaggctg

SEQ ID NO: 9041 - DNA, 25 bp, Homo sapiens
gaaggctgggcaggtggtgacgatc

SEQ ID NO: 9042 - DNA, 25 bp, Homo sapiens
tggtgacgatctgggctgcaggagc

SEQ ID NO: 9043 - DNA, 25 bp, Homo sapiens
tggaaggcacagaacacctggggct

SEQ ID NO: 9044 - DNA, 25 bp, Homo sapiens
tggggctgcgggaacagcctgcgta

SEQ ID NO: 9045 - DNA, 25 bp, Homo sapiens
tggccatgcgcaagctggtgcgctc

SEQ ID NO: 9046 - DNA, 25 bp, Homo sapiens
atggagatgacctgctccatcacca

SEQ ID NO: 9047 - DNA, 25 bp, Homo sapiens
gtgggcagctaaatgcagctttgtt

SEQ ID NO: 9048 - DNA, 25 bp, Homo sapiens
aattagacctcaagtctgcctctac

SEQ ID NO: 9049 - DNA, 25 bp, Homo sapiens
gaatgggcgtacagtatataccgtg

SEQ ID NO: 9050 - DNA, 25 bp, Homo sapiens
tatataccgtgacatcctgaaccct

SEQ ID NO: 9051 - DNA, 25 bp, Homo sapiens
gaaagcctgagcccattggatctgt

SEQ ID NO: 9052 - DNA, 25 bp, Homo sapiens
gcccattggatctgtgaaagcctct

SEQ ID NO: 9053 - DNA, 25 bp, Homo sapiens
gcctctagcttcactggtgcagaaa

SEQ ID NO: 9054 - DNA, 25 bp, Homo sapiens
ggtgcagaaaattttcctctagatc

SEQ ID NO: 9055 - DNA, 25 bp, Homo sapiens
gaatcagttaggttcctcactgcaa

SEQ ID NO: 9056 - DNA, 25 bp, Homo sapiens
gaaaagtcatccctatttccttgtt

SEQ ID NO: 9057 - DNA, 25 bp, Homo sapiens
atttgttcagtataagctcgttctt

SEQ ID NO: 9058 - DNA, 25 bp, Homo sapiens
gagttatatcctggctcagtggagt

SEQ ID NO: 9059 - DNA, 25 bp, Homo sapiens
gattaatctctcttgttggtgtttt

SEQ ID NO: 9060 - DNA, 25 bp, Homo sapiens
taggcttgcctttagatcgggtgct

SEQ ID NO: 9061 - DNA, 25 bp, Homo sapiens
tcgggtgctgatattgcctgtttcc

SEQ ID NO: 9062 - DNA, 25 bp, Homo sapiens
cctgtttcctagtaatgggctgatc

SEQ ID NO: 9063 - DNA, 25 bp, Homo sapiens
gaagaagtggtatttgctggcgagt

SEQ ID NO: 9064 - DNA, 25 bp, Homo sapiens
gtgataacaccaaccaaaccactcc

SEQ ID NO: 9065 - DNA, 25 bp, Homo sapiens
aaaccactcctatctgcatgattct

SEQ ID NO: 9066 - DNA, 25 bp, Homo sapiens
gatgcctgttgttttactgtgtata

SEQ ID NO: 9067 - DNA, 25 bp, Homo sapiens
gtggattcatttaaggtctactcaa

SEQ ID NO: 9068 - DNA, 25 bp, Homo sapiens
gtaacactgtccaaaccactaatat

SEQ ID NO: 9069 - DNA, 25 bp, Homo sapiens
cacggactggcagaacgtcttccgc

SEQ ID NO: 9070 - DNA, 25 bp, Homo sapiens
gtacgaccgggacaactccgggatg

SEQ ID NO: 9071 - DNA, 25 bp, Homo sapiens
ttccacgacatcctcattcgaaagt

SEQ ID NO: 9072 - DNA, 25 bp, Homo sapiens
gttacgacacggatcaggacggctg

SEQ ID NO: 9073 - DNA, 25 bp, Homo sapiens
gacggctggattcaggtgtcgtacg

SEQ ID NO: 9074 - DNA, 25 bp, Homo sapiens
ggtgtcgtacgaacagtacctgtcc

SEQ ID NO: 9075 - DNA, 25 bp, Homo sapiens
gtacctgtccatggtcttcagtatc

SEQ ID NO: 9076 - DNA, 25 bp, Homo sapiens
cttcagtatcgtatgaccctggcct

SEQ ID NO: 9077 - DNA, 25 bp, Homo sapiens
cctggcctctcgtgaagagcagcac

SEQ ID NO: 9078 - DNA, 25 bp, Homo sapiens
gtcacgtggggacccagctgtacat

SEQ ID NO: 9079 - DNA, 25 bp, Homo sapiens
ttggtgactgtctcattgtgccatg

SEQ ID NO: 9080 - DNA, 25 bp, Homo sapiens
tggtctgcttggatttcctacagcc

SEQ ID NO: 9081 - DNA, 25 bp, Homo sapiens
ctccgccgtgtgtacgtcattaaca

SEQ ID NO: 9082 - DNA, 25 bp, Homo sapiens
taacaaggagatctgtgttcgtaca

SEQ ID NO: 9083 - DNA, 25 bp, Homo sapiens
ctgtgttcgtacagtgtgtgcccac

SEQ ID NO: 9084 - DNA, 25 bp, Homo sapiens
tcgtacagtgtgtgcccacgaggag

SEQ ID NO: 9085 - DNA, 25 bp, Homo sapiens
agctgacctctgtcgggacaagttc

SEQ ID NO: 9086 - DNA, 25 bp, Homo sapiens
gacctctgtcgggacaagttctcca

SEQ ID NO: 9087 - DNA, 25 bp, Homo sapiens
gacaagttctccaaatgtggcgtga

SEQ ID NO: 9088 - DNA, 25 bp, Homo sapiens
tgtggcgtgatggccagcagcggcc

SEQ ID NO: 9089 - DNA, 25 bp, Homo sapiens
gctgtgggagctgctagggtggtgc

SEQ ID NO: 9090 - DNA, 25 bp, Homo sapiens
tttgaggacagacagtcccccgagg

SEQ ID NO: 9091 - DNA, 25 bp, Homo sapiens
tatatttgagagctcacttcgcccg

SEQ ID NO: 9092 - DNA, 25 bp, Homo sapiens
agctcacttcgcccgaattacaaaa

SEQ ID NO: 9093 - DNA, 25 bp, Homo sapiens
aggatttgttcccttcagtgacttg

SEQ ID NO: 9094 - DNA, 25 bp, Homo sapiens
tgttcccttcagtgacttgagtgtt

SEQ ID NO: 9095 - DNA, 25 bp, Homo sapiens
aatttacactagttgctacttggga

SEQ ID NO: 9096 - DNA, 25 bp, Homo sapiens
gttttcgttatatacttatccctat

SEQ ID NO: 9097 - DNA, 25 bp, Homo sapiens
aattacttgatattccttgtctcca

SEQ ID NO: 9098 - DNA, 25 bp, Homo sapiens
ttgacatcccatgtttgcctggata

SEQ ID NO: 9099 - DNA, 25 bp, Homo sapiens
gttcctcatttcaaacagtatacat

SEQ ID NO: 9100 - DNA, 25 bp, Homo sapiens
acagtatctgatggcccacctataa

SEQ ID NO: 9101 - DNA, 25 bp, Homo sapiens
ttgtatgccaccaatttgtattatt

SEQ ID NO: 9102 - DNA, 25 bp, Homo sapiens
atgccagtcgacttcactgggtact

SEQ ID NO: 9103 - DNA, 25 bp, Homo sapiens
agaatttcgaggagtacctgcgcgc

SEQ ID NO: 9104 - DNA, 25 bp, Homo sapiens
acgtcaatgtggccttgcgcaaaat

SEQ ID NO: 9105 - DNA, 25 bp, Homo sapiens
aaatcgccaacttgctgaagccaga

SEQ ID NO: 9106 - DNA, 25 bp, Homo sapiens
gagatcgtgcaggacggtgaccata

SEQ ID NO: 9107 - DNA, 25 bp, Homo sapiens
ggtgaccatatgatcatccgcacgc

SEQ ID NO: 9108 - DNA, 25 bp, Homo sapiens
atccgcacgctgagcacttttagga

SEQ ID NO: 9109 - DNA, 25 bp, Homo sapiens
gacaagctccagtgtgtgcagaagg

SEQ ID NO: 9110 - DNA, 25 bp, Homo sapiens
gagaaggaggggcgtggctggaccc

SEQ ID NO: 9111 - DNA, 25 bp, Homo sapiens
tgaggcaaaaatgtccagccacccc

SEQ ID NO: 9112 - DNA, 25 bp, Homo sapiens
agcagagtctgtctcttggctttgt

SEQ ID NO: 9113 - DNA, 25 bp, Homo sapiens
gacaagctacgtggagcctggttca

SEQ ID NO: 9114 - DNA, 25 bp, Homo sapiens
gcctggttcaggtccttttagtgag

SEQ ID NO: 9115 - DNA, 25 bp, Homo sapiens
tagtgagtctaccattaccatttcc

SEQ ID NO: 9116 - DNA, 25 bp, Homo sapiens
ttccctgtatattccctctgaacag

SEQ ID NO: 9117 - DNA, 25 bp, Homo sapiens
tgaacagcaatttgatccacccagg

SEQ ID NO: 9118 - DNA, 25 bp, Homo sapiens
ccacccaggcctttagagtcagatg

SEQ ID NO: 9119 - DNA, 25 bp, Homo sapiens
gactgtgtttgtacggtctttcgat

SEQ ID NO: 9120 - DNA, 25 bp, Homo sapiens
ggtctttcgatggattttctagtgc

SEQ ID NO: 9121 - DNA, 25 bp, Homo sapiens
gaaggtttactacactgcaggctac

SEQ ID NO: 9122 - DNA, 25 bp, Homo sapiens
actgcaggctacaacagtcctgtca

SEQ ID NO: 9123 - DNA, 25 bp, Homo sapiens
aagtgcgtgtctagtgtcttctatt

SEQ ID NO: 9124 - DNA, 25 bp, Homo sapiens
gttattcattctgtgatcatttatt

SEQ ID NO: 9125 - DNA, 25 bp, Homo sapiens
tttgttgtacctgctttgactgatg

SEQ ID NO: 9126 - DNA, 25 bp, Homo sapiens
gctttgactgatgctgagattcttc

SEQ ID NO: 9127 - DNA, 25 bp, Homo sapiens
ggcttcctgcaattttctaagcaat

SEQ ID NO: 9128 - DNA, 25 bp, Homo sapiens
agcaatttcttgctctatctctcaa

SEQ ID NO: 9129 - DNA, 25 bp, Homo sapiens
gctctatctctcaaaacttggtatt

SEQ ID NO: 9130 - DNA, 25 bp, Homo sapiens
tgtggttttcaaattggactttcaa

SEQ ID NO: 9131 - DNA, 25 bp, Homo sapiens
aaatctgtccctgagagtgtctctg

SEQ ID NO: 9132 - DNA, 25 bp, Homo sapiens
agggcaaatctgcacctatgtagct

SEQ ID NO: 9133 - DNA, 25 bp, Homo sapiens
tctgcacctatgtagctctgcatct

SEQ ID NO: 9134 - DNA, 25 bp, Homo sapiens
ctgtcttttcaggtttgtcatcaga

SEQ ID NO: 9135 - DNA, 25 bp, Homo sapiens
gttggcaaggagtctgcctccatgc

SEQ ID NO: 9136 - DNA, 25 bp, Homo sapiens
cctccatgctgcagtgttcgagtgg

SEQ ID NO: 9137 - DNA, 25 bp, Homo sapiens
gattgtaggtgcaagctgtccagag

SEQ ID NO: 9138 - DNA, 25 bp, Homo sapiens
ttctgccactcctgacagggtgacc

SEQ ID NO: 9139 - DNA, 25 bp, Homo sapiens
atttgcaatattcctttgggcctct

SEQ ID NO: 9140 - DNA, 25 bp, Homo sapiens
tctgcttctctcacctaaaaaaaga

SEQ ID NO: 9141 - DNA, 25 bp, Homo sapiens
aggagtatgtgtccaatgctgcctt

SEQ ID NO: 9142 - DNA, 25 bp, Homo sapiens
gaatctgtctcccagttatgaatca

SEQ ID NO: 9143 - DNA, 25 bp, Homo sapiens
tatcaagtttgggtctgtgctgctg

SEQ ID NO: 9144 - DNA, 25 bp, Homo sapiens
gggcaaaaccttgctaattttctca

SEQ ID NO: 9145 - DNA, 25 bp, Homo sapiens
attcttgttgccacagctggagctc

SEQ ID NO: 9146 - DNA, 25 bp, Homo sapiens
ggggtctgaggctgtggaagtccga

SEQ ID NO: 9147 - DNA, 25 bp, Homo sapiens
gtggacgtgctttgggggaggtctt

SEQ ID NO: 9148 - DNA, 25 bp, Homo sapiens
tttaactgtaccatccagagcccac

SEQ ID NO: 9149 - DNA, 25 bp, Homo sapiens
atgggatctcctggcagtttgaccc

SEQ ID NO: 9150 - DNA, 25 bp, Homo sapiens
gcagtttgacccttgctgcaagtac

SEQ ID NO: 9151 - DNA, 25 bp, Homo sapiens
cgacgcctataaactgtcgcgcctg

SEQ ID NO: 9152 - DNA, 25 bp, Homo sapiens
ggtgctggtccggaaggacgacctg

SEQ ID NO: 9153 - DNA, 25 bp, Homo sapiens
cgaactctatgccgtatgatttcag

SEQ ID NO: 9154 - DNA, 25 bp, Homo sapiens
gtattcagatcgccacactctgtga

SEQ ID NO: 9155 - DNA, 25 bp, Homo sapiens
cctgggcaggtgtttggcttagtat

SEQ ID NO: 9156 - DNA, 25 bp, Homo sapiens
tacccagggtttttcagctcattac

SEQ ID NO: 9157 - DNA, 25 bp, Homo sapiens
agtaatacctgagtacccatgggaa

SEQ ID NO: 9158 - DNA, 25 bp, Homo sapiens
aacttacctactggggactgtgctc

SEQ ID NO: 9159 - DNA, 25 bp, Homo sapiens
gtgacaggatcatacgtaccccaaa

SEQ ID NO: 9160 - DNA, 25 bp, Homo sapiens
acatcacacagtatactcagctaac

SEQ ID NO: 9161 - DNA, 25 bp, Homo sapiens
tatactcagctaacaaacctgccca

SEQ ID NO: 9162 - DNA, 25 bp, Homo sapiens
tgcccatgtgtttcctgaatctaaa

SEQ ID NO: 9163 - DNA, 25 bp, Homo sapiens
gacaatagtattacccatgggacaa

SEQ ID NO: 9164 - DNA, 25 bp, Homo sapiens
agcaagaatcattttgtgtctcatt

SEQ ID NO: 9165 - DNA, 25 bp, Homo sapiens
caatttgacttttgttccagtgttt

SEQ ID NO: 9166 - DNA, 25 bp, Homo sapiens
gaatagatctttataacctgatgcc

SEQ ID NO: 9167 - DNA, 25 bp, Homo sapiens
attggtattaactatgatcatcttg

SEQ ID NO: 9168 - DNA, 25 bp, Homo sapiens
gactcccgagggctagggctagagc

SEQ ID NO: 9169 - DNA, 25 bp, Homo sapiens
ttcatacctctacatgtctgcttga

SEQ ID NO: 9170 - DNA, 25 bp, Homo sapiens
ctgccagagaactcctatgcatccc

SEQ ID NO: 9171 - DNA, 25 bp, Homo sapiens
ttacttttgtgaacgcttctgccac

SEQ ID NO: 9172 - DNA, 25 bp, Homo sapiens
gtcttccccaaaattgatcactccg

SEQ ID NO: 9173 - DNA, 25 bp, Homo sapiens
ctcccgtagcacactataacatctg

SEQ ID NO: 9174 - DNA, 25 bp, Homo sapiens
gctggagtgttgctgttgcaccata

SEQ ID NO: 9175 - DNA, 25 bp, Homo sapiens
gttgcaccatactttcttgtacatt

SEQ ID NO: 9176 - DNA, 25 bp, Homo sapiens
taagtgccttgcggtcagggactga

SEQ ID NO: 9177 - DNA, 25 bp, Homo sapiens
gaatcttgcccgtttatgtatgctc

SEQ ID NO: 9178 - DNA, 25 bp, Homo sapiens
tatgtatgctccatgtctagcccat

SEQ ID NO: 9179 - DNA, 25 bp, Homo sapiens
tgaggtctgtttaaagtggcaatct

SEQ ID NO: 9180 - DNA, 25 bp, Homo sapiens
gtggcaatctcagatgcagtttgga

SEQ ID NO: 9181 - DNA, 25 bp, Homo sapiens
agagtcagatctttctccttgaata

SEQ ID NO: 9182 - DNA, 25 bp, Homo sapiens
gatctttctccttgaatatctttcg

SEQ ID NO: 9183 - DNA, 25 bp, Homo sapiens
tttctccttgaatatctttcgataa

SEQ ID NO: 9184 - DNA, 25 bp, Homo sapiens
ggtggtgtgatcttaatatatttga

SEQ ID NO: 9185 - DNA, 25 bp, Homo sapiens
aaaaaacttcattctcgtgagtcat

SEQ ID NO: 9186 - DNA, 25 bp, Homo sapiens
attctcgtgagtcatttaaatgtgt

SEQ ID NO: 9187 - DNA, 25 bp, Homo sapiens
tgtacaatgtacacactggtactta

SEQ ID NO: 9188 - DNA, 25 bp, Homo sapiens
acacactggtacttagagtttctgt

SEQ ID NO: 9189 - DNA, 25 bp, Homo sapiens
gtacttagagtttctgtttgattct

SEQ ID NO: 9190 - DNA, 25 bp, Homo sapiens
ctcagaacccaagtgttccatgccc

SEQ ID NO: 9191 - DNA, 25 bp, Homo sapiens
gttccatgcccctgtgtggatggag

SEQ ID NO: 9192 - DNA, 25 bp, Homo sapiens
tcgggtatcctgactgttggacccc

SEQ ID NO: 9193 - DNA, 25 bp, Homo sapiens
ctccagctctgcttaggcattttgc

SEQ ID NO: 9194 - DNA, 25 bp, Homo sapiens
ggacaggcctcagcagggaatgggg

SEQ ID NO: 9195 - DNA, 25 bp, Homo sapiens
aaaacaggacatctgtgaccgccct

SEQ ID NO: 9196 - DNA, 25 bp, Homo sapiens
agccccaaactaagatatccctcac

SEQ ID NO: 9197 - DNA, 25 bp, Homo sapiens
agcccccattacctagggacaagag

SEQ ID NO: 9198 - DNA, 25 bp, Homo sapiens
tggggcctggagcaaggcactctca

SEQ ID NO: 9199 - DNA, 25 bp, Homo sapiens
aggcactctcaaatcttgaaccctg

SEQ ID NO: 9200 - DNA, 25 bp, Homo sapiens
tgaaccctggaccaaagcttttcca

SEQ ID NO: 9201 - DNA, 25 bp, Homo sapiens
gcccttcagtgcgatcaaagttcta

SEQ ID NO: 9202 - DNA, 25 bp, Homo sapiens
gtgcgatcaaagttctacgtgcgag

SEQ ID NO: 9203 - DNA, 25 bp, Homo sapiens
ttctacgtgcgagagccgccgaatg

SEQ ID NO: 9204 - DNA, 25 bp, Homo sapiens
ccgccgaatgccaaacctgactggc

SEQ ID NO: 9205 - DNA, 25 bp, Homo sapiens
acctgactggctgaaagttgggttc

SEQ ID NO: 9206 - DNA, 25 bp, Homo sapiens
tgaaagttgggttcaccttgggcac

SEQ ID NO: 9207 - DNA, 25 bp, Homo sapiens
gtcttcttgtggatctatctcatca

SEQ ID NO: 9208 - DNA, 25 bp, Homo sapiens
ggatctatctcatcaaacaacacaa

SEQ ID NO: 9209 - DNA, 25 bp, Homo sapiens
ggggcccaaggaattcgcaagatgg

SEQ ID NO: 9210 - DNA, 25 bp, Homo sapiens
aggaattcgcaagatggcgccgtcc

SEQ ID NO: 9211 - DNA, 25 bp, Homo sapiens
caagccagcatttgtattttgcatc

SEQ ID NO: 9212 - DNA, 25 bp, Homo sapiens
gcatccagcctttcaaagctgactc

SEQ ID NO: 9213 - DNA, 25 bp, Homo sapiens
actcttctcaatcatctgtgggtca

SEQ ID NO: 9214 - DNA, 25 bp, Homo sapiens
caatgaagtgtatggcctctggagt

SEQ ID NO: 9215 - DNA, 25 bp, Homo sapiens
gctctgtgtcaatgttaacctgtct

SEQ ID NO: 9216 - DNA, 25 bp, Homo sapiens
acctgtctcagatcaagtaattcct

SEQ ID NO: 9217 - DNA, 25 bp, Homo sapiens
gtgttgcaagggaacctcctagcac

SEQ ID NO: 9218 - DNA, 25 bp, Homo sapiens
aaagtcagaatcgcctcagcatttc

SEQ ID NO: 9219 - DNA, 25 bp, Homo sapiens
tcagcatttccatgacgcacattat

SEQ ID NO: 9220 - DNA, 25 bp, Homo sapiens
cgcacattatgcaaatctctttagc

SEQ ID NO: 9221 - DNA, 25 bp, Homo sapiens
ggggaagatttccaccaactgaatc

SEQ ID NO: 9222 - DNA, 25 bp, Homo sapiens
aactgaatcatttgtgcacgtgtat

SEQ ID NO: 9223 - DNA, 25 bp, Homo sapiens
gaatatcacagcttaccttgggaat

SEQ ID NO: 9224 - DNA, 25 bp, Homo sapiens
taattacacgttcaccgtccaagca

SEQ ID NO: 9225 - DNA, 25 bp, Homo sapiens
ctgccatcctgctgtacgatgagct

SEQ ID NO: 9226 - DNA, 25 bp, Homo sapiens
gctggggtctggtgcagatgcatct

SEQ ID NO: 9227 - DNA, 25 bp, Homo sapiens
agatgcatctgcaacgcaggctgcc

SEQ ID NO: 9228 - DNA, 25 bp, Homo sapiens
aacgcaggctgccagatctacggat

SEQ ID NO: 9229 - DNA, 25 bp, Homo sapiens
gatctacggatgttgctgctgtggt

SEQ ID NO: 9230 - DNA, 25 bp, Homo sapiens
gtttgccatcctgtacacgaagcac

SEQ ID NO: 9231 - DNA, 25 bp, Homo sapiens
gaagatgcccctatgataactggat

SEQ ID NO: 9232 - DNA, 25 bp, Homo sapiens
ttcagatgacgtccccatggtgata

SEQ ID NO: 9233 - DNA, 25 bp, Homo sapiens
aaagagctttcctcactagaaacca

SEQ ID NO: 9234 - DNA, 25 bp, Homo sapiens
tgggctttaacattggagtccggct

SEQ ID NO: 9235 - DNA, 25 bp, Homo sapiens
gaagatttcttggctcggtcaaatg

SEQ ID NO: 9236 - DNA, 25 bp, Homo sapiens
ggcatcactccaagcattactaatt

SEQ ID NO: 9237 - DNA, 25 bp, Homo sapiens
gcccagctggtgatgaattctccct

SEQ ID NO: 9238 - DNA, 25 bp, Homo sapiens
ggaacttcctgataaccactcatcc

SEQ ID NO: 9239 - DNA, 25 bp, Homo sapiens
tccaatctcttgtgtggggtgttgc

SEQ ID NO: 9240 - DNA, 25 bp, Homo sapiens
ggtgttgcggggagctttggagatg

SEQ ID NO: 9241 - DNA, 25 bp, Homo sapiens
ttgaggacaatcttccagctggaga

SEQ ID NO: 9242 - DNA, 25 bp, Homo sapiens
gaggaataaccatccctacaactcg

SEQ ID NO: 9243 - DNA, 25 bp, Homo sapiens
tgttggaatcagcaggcctctgtgc

SEQ ID NO: 9244 - DNA, 25 bp, Homo sapiens
tcttataacctgtttccattctcca

SEQ ID NO: 9245 - DNA, 25 bp, Homo sapiens
cactcttatgctgtacccagtttct

SEQ ID NO: 9246 - DNA, 25 bp, Homo sapiens
agctgaaggttgtggcctttgcgct

SEQ ID NO: 9247 - DNA, 25 bp, Homo sapiens
ctttgttccccactggagcagaagg

SEQ ID NO: 9248 - DNA, 25 bp, Homo sapiens
gagcccgaggaggtgtctcaggctg

SEQ ID NO: 9249 - DNA, 25 bp, Homo sapiens
tgcctgagtcgtgacctgctaggcc

SEQ ID NO: 9250 - DNA, 25 bp, Homo sapiens
gagcccactccatctggtagaaggg

SEQ ID NO: 9251 - DNA, 25 bp, Homo sapiens
aagggaaagcccatatgctaccacc

SEQ ID NO: 9252 - DNA, 25 bp, Homo sapiens
tagctcctcccctggagggggaatg

SEQ ID NO: 9253 - DNA, 25 bp, Homo sapiens
tggggaaacagcatctccaagcagc

SEQ ID NO: 9254 - DNA, 25 bp, Homo sapiens
gagttggccatatttacctcagcct

SEQ ID NO: 9255 - DNA, 25 bp, Homo sapiens
aatgtgcctattgctagagctcctc

SEQ ID NO: 9256 - DNA, 25 bp, Homo sapiens
tagtctcaggagtcttaacttttga

SEQ ID NO: 9257 - DNA, 25 bp, Homo sapiens
gaagactctggaccaggtcttagag

SEQ ID NO: 9258 - DNA, 25 bp, Homo sapiens
gtagaccagtgctgtcaagctctct

SEQ ID NO: 9259 - DNA, 25 bp, Homo sapiens
tcaagctctctctcaaagactggga

SEQ ID NO: 9260 - DNA, 25 bp, Homo sapiens
gactgggaacacaaccgtatttctt

SEQ ID NO: 9261 - DNA, 25 bp, Homo sapiens
gtatttcttcaataagcagcctact

SEQ ID NO: 9262 - DNA, 25 bp, Homo sapiens
agcagcctactgaacttgacgcact

SEQ ID NO: 9263 - DNA, 25 bp, Homo sapiens
cttgacgcactggtatttggccatc

SEQ ID NO: 9264 - DNA, 25 bp, Homo sapiens
tggccatctatacaccattcttacc

SEQ ID NO: 9265 - DNA, 25 bp, Homo sapiens
tatagcaacctccttgctttctgta

SEQ ID NO: 9266 - DNA, 25 bp, Homo sapiens
aaaggcaggctgtcatagagttatg

SEQ ID NO: 9267 - DNA, 25 bp, Homo sapiens
gtttcttcactcaactcaggtggca

SEQ ID NO: 9268 - DNA, 25 bp, Homo sapiens
gaattccgttgacttgttggctgcc

SEQ ID NO: 9269 - DNA, 25 bp, Homo sapiens
agaagagccctgaggagatccgcca

SEQ ID NO: 9270 - DNA, 25 bp, Homo sapiens
agtggacctgtctaagccactggtg

SEQ ID NO: 9271 - DNA, 25 bp, Homo sapiens
cagacgtgcccatctacgatggctc

SEQ ID NO: 9272 - DNA, 25 bp, Homo sapiens
ctgggtggagtggtacatgcgcgcc

SEQ ID NO: 9273 - DNA, 25 bp, Homo sapiens
cggcccgaggatgtcatctcagagg

SEQ ID NO: 9274 - DNA, 25 bp, Homo sapiens
tcagagggccgggggaagacccact

SEQ ID NO: 9275 - DNA, 25 bp, Homo sapiens
agctgggcaggacacaggcgagctc

SEQ ID NO: 9276 - DNA, 25 bp, Homo sapiens
acaggcgagctcaggtgatgccggc

SEQ ID NO: 9277 - DNA, 25 bp, Homo sapiens
ccaccagcaatgcctggcctggtag

SEQ ID NO: 9278 - DNA, 25 bp, Homo sapiens
tggtgtacatatgtccgctgggtga

SEQ ID NO: 9279 - DNA, 25 bp, Homo sapiens
tccgctgggtgagttgacctgtggc

SEQ ID NO: 9280 - DNA, 25 bp, Homo sapiens
acctgtggcctcgcacagtgattct

SEQ ID NO: 9281 - DNA, 25 bp, Homo sapiens
gcttgctgtctctcagaattgtttt

SEQ ID NO: 9282 - DNA, 25 bp, Homo sapiens
taatgacgagtgtgcttcagtttgt

SEQ ID NO: 9283 - DNA, 25 bp, Homo sapiens
ttagcaaaaccactctcttgaatca

SEQ ID NO: 9284 - DNA, 25 bp, Homo sapiens
aaaacgccatagcacagctgtcttt

SEQ ID NO: 9285 - DNA, 25 bp, Homo sapiens
agcacatctactccagcatgatctg

SEQ ID NO: 9286 - DNA, 25 bp, Homo sapiens
agcagatgttctgtttggcaccacg

SEQ ID NO: 9287 - DNA, 25 bp, Homo sapiens
ggcaccacgttataatctgcttatt

SEQ ID NO: 9288 - DNA, 25 bp, Homo sapiens
tacaatatacacgtttccctaagaa

SEQ ID NO: 9289 - DNA, 25 bp, Homo sapiens
tggaaggccgtgatgccatcttcaa

SEQ ID NO: 9290 - DNA, 25 bp, Homo sapiens
tcaacagggcctttgggttcatgac

SEQ ID NO: 9291 - DNA, 25 bp, Homo sapiens
gttcatgacaagagtggccctgcag

SEQ ID NO: 9292 - DNA, 25 bp, Homo sapiens
gctgagcacccatgagtgtgccggc

SEQ ID NO: 9293 - DNA, 25 bp, Homo sapiens
agaacgggacataaacctggccagc

SEQ ID NO: 9294 - DNA, 25 bp, Homo sapiens
cagtgtccatgacatagaccctgcc

SEQ ID NO: 9295 - DNA, 25 bp, Homo sapiens
ggcaaagcacacaggctgagcgctg

SEQ ID NO: 9296 - DNA, 25 bp, Homo sapiens
gctgagtccttgctgtgggatgtgc

SEQ ID NO: 9297 - DNA, 25 bp, Homo sapiens
caggaatttagaccttttccctgca

SEQ ID NO: 9298 - DNA, 25 bp, Homo sapiens
ctgggggctctgttacactaatttg

SEQ ID NO: 9299 - DNA, 25 bp, Homo sapiens
cagctgctgccaaacctgagggctg

SEQ ID NO: 9300 - DNA, 25 bp, Homo sapiens
aaggcatctccaacattctgcagag

SEQ ID NO: 9301 - DNA, 25 bp, Homo sapiens
acctttggctcctcaggaactgaca

SEQ ID NO: 9302 - DNA, 25 bp, Homo sapiens
atctgaacacagtcattccttacga

SEQ ID NO: 9303 - DNA, 25 bp, Homo sapiens
tacgagaagaaagcctctcctccct

SEQ ID NO: 9304 - DNA, 25 bp, Homo sapiens
gctgacaaacattctctttgccatg

SEQ ID NO: 9305 - DNA, 25 bp, Homo sapiens
tgcctactttgctaacggactacat

SEQ ID NO: 9306 - DNA, 25 bp, Homo sapiens
gtcattccatcacagggactgcatg

SEQ ID NO: 9307 - DNA, 25 bp, Homo sapiens
gcatgagaccatgtaacctccgaca

SEQ ID NO: 9308 - DNA, 25 bp, Homo sapiens
ttgccgttggcttctagtgctagta

SEQ ID NO: 9309 - DNA, 25 bp, Homo sapiens
gctttcaccgctcattatgtagtct

SEQ ID NO: 9310 - DNA, 25 bp, Homo sapiens
tatgtagtctggctacagccctcaa

SEQ ID NO: 9311 - DNA, 25 bp, Homo sapiens
gtagccatttggggttatctctagt

SEQ ID NO: 9312 - DNA, 25 bp, Homo sapiens
tagtaaggcagatacccacgttggt

SEQ ID NO: 9313 - DNA, 25 bp, Homo sapiens
aacattgttatattctgcgtggtat

SEQ ID NO: 9314 - DNA, 25 bp, Homo sapiens
acattatttcctctatggtagttaa

SEQ ID NO: 9315 - DNA, 25 bp, Homo sapiens
gtgtcatttgactaaacgtttcggt

SEQ ID NO: 9316 - DNA, 25 bp, Homo sapiens
acgtttcggtagaatgcttcatact

SEQ ID NO: 9317 - DNA, 25 bp, Homo sapiens
gtatttcaacaatggactatgcctt

SEQ ID NO: 9318 - DNA, 25 bp, Homo sapiens
tatgccttggtttttcactaatcaa

SEQ ID NO: 9319 - DNA, 25 bp, Homo sapiens
aacatgtgaattgtgatccatttct

SEQ ID NO: 9320 - DNA, 25 bp, Homo sapiens
ctgatatgtcttgaactactgtgtc

SEQ ID NO: 9321 - DNA, 25 bp, Homo sapiens
aaatgtcattgttacctctgtgtgt

SEQ ID NO: 9322 - DNA, 25 bp, Homo sapiens
ctggaggacagcacctgtgacttcg

SEQ ID NO: 9323 - DNA, 25 bp, Homo sapiens
gcaacctcaagcgctatgcatgcac

SEQ ID NO: 9324 - DNA, 25 bp, Homo sapiens
ggctgctatgacacctacaatgcgg

SEQ ID NO: 9325 - DNA, 25 bp, Homo sapiens
ctacaatgcggacatcgactgccag

SEQ ID NO: 9326 - DNA, 25 bp, Homo sapiens
ggatcgacataaccgacgtgcagcc

SEQ ID NO: 9327 - DNA, 25 bp, Homo sapiens
cagcctgggaactacatcctcaagg

SEQ ID NO: 9328 - DNA, 25 bp, Homo sapiens
gagatgcaacattcactacacaggt

SEQ ID NO: 9329 - DNA, 25 bp, Homo sapiens
actacacaggtcgctacgtttctgc

SEQ ID NO: 9330 - DNA, 25 bp, Homo sapiens
tccaatcctgatctccgggagggac

SEQ ID NO: 9331 - DNA, 25 bp, Homo sapiens
gagggacagatggccaatctctccc

SEQ ID NO: 9332 - DNA, 25 bp, Homo sapiens
gccataccacagagctagattgccc

SEQ ID NO: 9333 - DNA, 25 bp, Homo sapiens
gagcggcagctcagcaagtggtgga

SEQ ID NO: 9334 - DNA, 25 bp, Homo sapiens
agcaagtggtggaccaggccacaga

SEQ ID NO: 9335 - DNA, 25 bp, Homo sapiens
ccaggccacagaggcggggcagaaa

SEQ ID NO: 9336 - DNA, 25 bp, Homo sapiens
accacccaggaaaccatcgacaaga

SEQ ID NO: 9337 - DNA, 25 bp, Homo sapiens
gaaaccatcgacaagactgctaacc

SEQ ID NO: 9338 - DNA, 25 bp, Homo sapiens
tcgacaagactgctaaccaggcctc

SEQ ID NO: 9339 - DNA, 25 bp, Homo sapiens
aaaattcggcctcctgaaatgacag

SEQ ID NO: 9340 - DNA, 25 bp, Homo sapiens
acagcagggagacttgggtcggcct

SEQ ID NO: 9341 - DNA, 25 bp, Homo sapiens
agataccccgaagccatggcaagca

SEQ ID NO: 9342 - DNA, 25 bp, Homo sapiens
ccccgaagccatggcaagcaagggc

SEQ ID NO: 9343 - DNA, 25 bp, Homo sapiens
caagcaagggcttgcaggacctgaa

SEQ ID NO: 9344 - DNA, 25 bp, Homo sapiens
agaaggagaccctgcagtacttcca

SEQ ID NO: 9345 - DNA, 25 bp, Homo sapiens
ccccatgcgggcaacgtatctggat

SEQ ID NO: 9346 - DNA, 25 bp, Homo sapiens
gtatctggatgacctgcgcagcaag

SEQ ID NO: 9347 - DNA, 25 bp, Homo sapiens
agatggagtatgccgaggtgcgtgt

SEQ ID NO: 9348 - DNA, 25 bp, Homo sapiens
ccgaggtgcgtgtgctgcacctggc

SEQ ID NO: 9349 - DNA, 25 bp, Homo sapiens
tgcacctggctcacaaggatctgac

SEQ ID NO: 9350 - DNA, 25 bp, Homo sapiens
acaaggatctgacagtgctctgcca

SEQ ID NO: 9351 - DNA, 25 bp, Homo sapiens
tcttgacttgtcacacaatcgcctc

SEQ ID NO: 9352 - DNA, 25 bp, Homo sapiens
aggagctgctactgtgcaacaaccg

SEQ ID NO: 9353 - DNA, 25 bp, Homo sapiens
tgggcatcttggagcaactggctga

SEQ ID NO: 9354 - DNA, 25 bp, Homo sapiens
ttgccctttaacttattgggactga

SEQ ID NO: 9355 - DNA, 25 bp, Homo sapiens
agtgcaccgaatcctgtacaaagac

SEQ ID NO: 9356 - DNA, 25 bp, Homo sapiens
aaagacaggaacctccatattccca

SEQ ID NO: 9357 - DNA, 25 bp, Homo sapiens
gaaaatgggcctgagctgatcctcc

SEQ ID NO: 9358 - DNA, 25 bp, Homo sapiens
tccagtacggaatcagagcccacga

SEQ ID NO: 9359 - DNA, 25 bp, Homo sapiens
ccacgagtggatgttcccggtgtga

SEQ ID NO: 9360 - DNA, 25 bp, Homo sapiens
tccctaccaatgactcacctgaagt

SEQ ID NO: 9361 - DNA, 25 bp, Homo sapiens
aataaaaggccagcgggcggcgtct

SEQ ID NO: 9362 - DNA, 25 bp, Homo sapiens
attactccttgtcgtgcggtcaagg

SEQ ID NO: 9363 - DNA, 25 bp, Homo sapiens
cggtcaaggatacaccttggccccg

SEQ ID NO: 9364 - DNA, 25 bp, Homo sapiens
catgaagcagttgctgcgggccttg

SEQ ID NO: 9365 - DNA, 25 bp, Homo sapiens
ttggaggagggccgcgtgcgggaag

SEQ ID NO: 9366 - DNA, 25 bp, Homo sapiens
gaacgattcaggtccgtgacgagaa

SEQ ID NO: 9367 - DNA, 25 bp, Homo sapiens
cgagaagttattaccgaggcgcggc

SEQ ID NO: 9368 - DNA, 25 bp, Homo sapiens
tctcctcgtctatgatatcaccagc

SEQ ID NO: 9369 - DNA, 25 bp, Homo sapiens
gatatcaccagccgagaaacctaca

SEQ ID NO: 9370 - DNA, 25 bp, Homo sapiens
gaaacctacaatgcgcttactaatt

SEQ ID NO: 9371 - DNA, 25 bp, Homo sapiens
aacagatgcccgaatgctagcgagc

SEQ ID NO: 9372 - DNA, 25 bp, Homo sapiens
gctagcgagccagaacattgtgatc

SEQ ID NO: 9373 - DNA, 25 bp, Homo sapiens
ggatgcagatcgtgaagttaccttc

SEQ ID NO: 9374 - DNA, 25 bp, Homo sapiens
accttcttagaagcctccagatttg

SEQ ID NO: 9375 - DNA, 25 bp, Homo sapiens
aatgggctcaggtattcagtacgga

SEQ ID NO: 9376 - DNA, 25 bp, Homo sapiens
agtacggagatgctgccttgagaca

SEQ ID NO: 9377 - DNA, 25 bp, Homo sapiens
ataaaatgtctacgtctttctccag

SEQ ID NO: 9378 - DNA, 25 bp, Homo sapiens
cagtttctgagccctatgcacattg

SEQ ID NO: 9379 - DNA, 25 bp, Homo sapiens
tcctctggagggcatgtacccacac

SEQ ID NO: 9380 - DNA, 25 bp, Homo sapiens
ctaaataccaactgctcttcctcag

SEQ ID NO: 9381 - DNA, 25 bp, Homo sapiens
acatcagacttggcacgtggtggac

SEQ ID NO: 9382 - DNA, 25 bp, Homo sapiens
ggtggacactaacacacaggcactc

SEQ ID NO: 9383 - DNA, 25 bp, Homo sapiens
gttggtgagaaggtgcctatccccc

SEQ ID NO: 9384 - DNA, 25 bp, Homo sapiens
agaggcccaagataggctggcttcc

SEQ ID NO: 9385 - DNA, 25 bp, Homo sapiens
tcccccgttcaaggtatagtctgcc

SEQ ID NO: 9386 - DNA, 25 bp, Homo sapiens
aacagcctctctcatgtctaaaaag

SEQ ID NO: 9387 - DNA, 25 bp, Homo sapiens
gggatgcattacctttttgcttctt

SEQ ID NO: 9388 - DNA, 25 bp, Homo sapiens
atgtaaactgtgactctacctcgac

SEQ ID NO: 9389 - DNA, 25 bp, Homo sapiens
ctttttataagctgtgtgtgtcctc

SEQ ID NO: 9390 - DNA, 25 bp, Homo sapiens
tgtgtcctctgtattattgttatta

SEQ ID NO: 9391 - DNA, 25 bp, Homo sapiens
cacctagtaggggtctgcacacttg

SEQ ID NO: 9392 - DNA, 25 bp, Homo sapiens
tgcacacttggacagcagggtggga

SEQ ID NO: 9393 - DNA, 25 bp, Homo sapiens
gtgacctctcagtcagactggggtg

SEQ ID NO: 9394 - DNA, 25 bp, Homo sapiens
acctgtccacctcaatgaaggagag

SEQ ID NO: 9395 - DNA, 25 bp, Homo sapiens
agaggagcatggggtgtcccgtttt

SEQ ID NO: 9396 - DNA, 25 bp, Homo sapiens
ccgttttggtgccacactggggtgg

SEQ ID NO: 9397 - DNA, 25 bp, Homo sapiens
ctctctcatcctctctggagaagtg

SEQ ID NO: 9398 - DNA, 25 bp, Homo sapiens
ctggagaagtgggcgctgcaggact

SEQ ID NO: 9399 - DNA, 25 bp, Homo sapiens
atatctccacaggaccttcttggtt

SEQ ID NO: 9400 - DNA, 25 bp, Homo sapiens
tcagggactacttctgaactctacc

SEQ ID NO: 9401 - DNA, 25 bp, Homo sapiens
aatttagacctgaccactggtgcca

SEQ ID NO: 9402 - DNA, 25 bp, Homo sapiens
agtggccttagcaactgggcagttc

SEQ ID NO: 9403 - DNA, 25 bp, Homo sapiens
caaacagtcaccagtccagcagtgc

SEQ ID NO: 9404 - DNA, 25 bp, Homo sapiens
attcctcctccccagaataaagaca

SEQ ID NO: 9405 - DNA, 25 bp, Homo sapiens
tctaccattcagctgccattcataa

SEQ ID NO: 9406 - DNA, 25 bp, Homo sapiens
gcagcatctccagtgacaagtttga

SEQ ID NO: 9407 - DNA, 25 bp, Homo sapiens
atgggaatgtcgtttggcctggagt

SEQ ID NO: 9408 - DNA, 25 bp, Homo sapiens
ggagtcaggcaaatgctctctggag

SEQ ID NO: 9409 - DNA, 25 bp, Homo sapiens
tgaaacttgcgaaatccctggtgcc

SEQ ID NO: 9410 - DNA, 25 bp, Homo sapiens
gaggggggtgtagacgccaagactc

SEQ ID NO: 9411 - DNA, 25 bp, Homo sapiens
gactcacgcatgtgtgacatccgga

SEQ ID NO: 9412 - DNA, 25 bp, Homo sapiens
acatccggagtcctggagccgggtg

SEQ ID NO: 9413 - DNA, 25 bp, Homo sapiens
agtggcaccactaggtgcctgctgc

SEQ ID NO: 9414 - DNA, 25 bp, Homo sapiens
ccaccaatgcagccggggctggcga

SEQ ID NO: 9415 - DNA, 25 bp, Homo sapiens
tgcgttgatgctcagaatcgcctac

SEQ ID NO: 9416 - DNA, 25 bp, Homo sapiens
tgtgcctgcgtgtaaaccacagcct

SEQ ID NO: 9417 - DNA, 25 bp, Homo sapiens
acagcctcagaccagctatggggag

SEQ ID NO: 9418 - DNA, 25 bp, Homo sapiens
caacacggaggatatccagcttccc

SEQ ID NO: 9419 - DNA, 25 bp, Homo sapiens
agcttccccggtctggggtgaggag

SEQ ID NO: 9420 - DNA, 25 bp, Homo sapiens
gtgcccctaggttggtgggtctaca

SEQ ID NO: 9421 - DNA, 25 bp, Homo sapiens
gaagctgccgaaatgctattagcaa

SEQ ID NO: 9422 - DNA, 25 bp, Homo sapiens
gcaaatcttagacatggtggtactg

SEQ ID NO: 9423 - DNA, 25 bp, Homo sapiens
ggatgagtatctgcaagaccagctg

SEQ ID NO: 9424 - DNA, 25 bp, Homo sapiens
gaccagctgattgttttcatggcat

SEQ ID NO: 9425 - DNA, 25 bp, Homo sapiens
ggcattagccaatggagtttccaga

SEQ ID NO: 9426 - DNA, 25 bp, Homo sapiens
acaggaccagttacactccatacgc

SEQ ID NO: 9427 - DNA, 25 bp, Homo sapiens
cactccatacgcaaaccgcgataca

SEQ ID NO: 9428 - DNA, 25 bp, Homo sapiens
gaagtacagtgttctaggtttgctg

SEQ ID NO: 9429 - DNA, 25 bp, Homo sapiens
taggtttgctgagaaggcttcatta

SEQ ID NO: 9430 - DNA, 25 bp, Homo sapiens
taatctcactttgaatatctcctga

SEQ ID NO: 9431 - DNA, 25 bp, Homo sapiens
ttgtttgctggatcatcgcttggta

SEQ ID NO: 9432 - DNA, 25 bp, Homo sapiens
gtctcgccgaccggggagaaggtca

SEQ ID NO: 9433 - DNA, 25 bp, Homo sapiens
tcacgcacactggccaggtttatga

SEQ ID NO: 9434 - DNA, 25 bp, Homo sapiens
agcagcccgtgagcgaggtggagac

SEQ ID NO: 9435 - DNA, 25 bp, Homo sapiens
gtggagactcgggtgatagcgtgcg

SEQ ID NO: 9436 - DNA, 25 bp, Homo sapiens
accggcacatgcggttactgtgggc

SEQ ID NO: 9437 - DNA, 25 bp, Homo sapiens
gttactgtgggctccagttcagaca

SEQ ID NO: 9438 - DNA, 25 bp, Homo sapiens
ctgtgagcatttccgcggggaagct

SEQ ID NO: 9439 - DNA, 25 bp, Homo sapiens
gtgaagctcgctggttctgtgcgaa

SEQ ID NO: 9440 - DNA, 25 bp, Homo sapiens
gtgcgaagggtattcctggtgctga

SEQ ID NO: 9441 - DNA, 25 bp, Homo sapiens
taaagggtgttgctgtcatggctga

SEQ ID NO: 9442 - DNA, 25 bp, Homo sapiens
tgctgaaccggtgtggcgaggcggc

SEQ ID NO: 9443 - DNA, 25 bp, Homo sapiens
ttagttctttgatcacttcagtgac

SEQ ID NO: 9444 - DNA, 25 bp, Homo sapiens
tacccattaatgaatcttctccatg

SEQ ID NO: 9445 - DNA, 25 bp, Homo sapiens
tacacttcttaacctgttgatctat

SEQ ID NO: 9446 - DNA, 25 bp, Homo sapiens
ttaaatagagcagttcttgccaccc

SEQ ID NO: 9447 - DNA, 25 bp, Homo sapiens
ccacccagtcttgtattctgtcttt

SEQ ID NO: 9448 - DNA, 25 bp, Homo sapiens
gtattctgtctttagctagccaaat

SEQ ID NO: 9449 - DNA, 25 bp, Homo sapiens
tgaatttgggttttccacaacctca

SEQ ID NO: 9450 - DNA, 25 bp, Homo sapiens
gcaccacagtgcacaggtcagggct

SEQ ID NO: 9451 - DNA, 25 bp, Homo sapiens
gtcagggctcggagggagcctctgt

SEQ ID NO: 9452 - DNA, 25 bp, Homo sapiens
gagcctctgtgcagatgtgctttct

SEQ ID NO: 9453 - DNA, 25 bp, Homo sapiens
gatgtgctttctttacagtggctgt

SEQ ID NO: 9454 - DNA, 25 bp, Homo sapiens
tgatgtcacctagcagggcttcagg

SEQ ID NO: 9455 - DNA, 25 bp, Homo sapiens
gatgcagagatgacctctcgctgcc

SEQ ID NO: 9456 - DNA, 25 bp, Homo sapiens
gcaggttccatgaaaacagcccttt

SEQ ID NO: 9457 - DNA, 25 bp, Homo sapiens
ttttccaagcccattgtttctgtca

SEQ ID NO: 9458 - DNA, 25 bp, Homo sapiens
gtttctgtcatggtttccatctgtc

SEQ ID NO: 9459 - DNA, 25 bp, Homo sapiens
tttccatctgtcctgagcaagtcat

SEQ ID NO: 9460 - DNA, 25 bp, Homo sapiens
atttcgaacatctcggccattcaaa

SEQ ID NO: 9461 - DNA, 25 bp, Homo sapiens
ccagcataacctctagcatcgattc

SEQ ID NO: 9462 - DNA, 25 bp, Homo sapiens
gatactctaatcactacattgcttt

SEQ ID NO: 9463 - DNA, 25 bp, Homo sapiens
aggactgaccgcttcataagccagt

SEQ ID NO: 9464 - DNA, 25 bp, Homo sapiens
taagccagtacgtctgagctgagta

SEQ ID NO: 9465 - DNA, 25 bp, Homo sapiens
gttgtcgcagccggggaagggaagc

SEQ ID NO: 9466 - DNA, 25 bp, Homo sapiens
atggacgccgttaaacatcctacag

SEQ ID NO: 9467 - DNA, 25 bp, Homo sapiens
cccccgaccacgaagagttgtcttg

SEQ ID NO: 9468 - DNA, 25 bp, Homo sapiens
cagtggctccatcacctttaaaaat

SEQ ID NO: 9469 - DNA, 25 bp, Homo sapiens
gaaaagcaatccaagcctgtgtaaa

SEQ ID NO: 9470 - DNA, 25 bp, Homo sapiens
tcatcatctgtatcagcttggcttg

SEQ ID NO: 9471 - DNA, 25 bp, Homo sapiens
aaattgattctctttatgtcactcc

SEQ ID NO: 9472 - DNA, 25 bp, Homo sapiens
gcacctggacaaattcaatccccgg

SEQ ID NO: 9473 - DNA, 25 bp, Homo sapiens
caatccccggtacttaagtcacact

SEQ ID NO: 9474 - DNA, 25 bp, Homo sapiens
tcggccctgactattgtcttgattg

SEQ ID NO: 9475 - DNA, 25 bp, Homo sapiens
tattgtcttgattgctgttcctttc

SEQ ID NO: 9476 - DNA, 25 bp, Homo sapiens
caacgtctaactggacttcccaaga

SEQ ID NO: 9477 - DNA, 25 bp, Homo sapiens
gataaatggtaccagcgtcctctta

SEQ ID NO: 9478 - DNA, 25 bp, Homo sapiens
aagatgccttaatccattccttgag

SEQ ID NO: 9479 - DNA, 25 bp, Homo sapiens
ccttctgcttctgagttgcacatta

SEQ ID NO: 9480 - DNA, 25 bp, Homo sapiens
gcttccagactctttgcgttggaga

SEQ ID NO: 9481 - DNA, 25 bp, Homo sapiens
gttaggatcttcaagtcccatcata

SEQ ID NO: 9482 - DNA, 25 bp, Homo sapiens
gggattgctttcatctaattctggc

SEQ ID NO: 9483 - DNA, 25 bp, Homo sapiens
aggacctcaccaaaagatccagcct

SEQ ID NO: 9484 - DNA, 25 bp, Homo sapiens
agcctcatacctacatcagacaaaa

SEQ ID NO: 9485 - DNA, 25 bp, Homo sapiens
caaaatatcgccgttgttccttctg

SEQ ID NO: 9486 - DNA, 25 bp, Homo sapiens
tttgctttggaaacacccactcact

SEQ ID NO: 9487 - DNA, 25 bp, Homo sapiens
tattagcacacaactattttcagcc

SEQ ID NO: 9488 - DNA, 25 bp, Homo sapiens
ttcagccctttaataatggagcatc

SEQ ID NO: 9489 - DNA, 25 bp, Homo sapiens
acctgtaaccccaagcaaatataga

SEQ ID NO: 9490 - DNA, 25 bp, Homo sapiens
tttactatgatatccattttccaga

SEQ ID NO: 9491 - DNA, 25 bp, Homo sapiens
aagtttgtttatattcagaagtctg

SEQ ID NO: 9492 - DNA, 25 bp, Homo sapiens
gagactaactctccacttgtatggg

SEQ ID NO: 9493 - DNA, 25 bp, Homo sapiens
aactctccacttgtatgggaactac

SEQ ID NO: 9494 - DNA, 25 bp, Homo sapiens
gggaactacatttcactcttggttt

SEQ ID NO: 9495 - DNA, 25 bp, Homo sapiens
atttcactcttggttttcaggatat

SEQ ID NO: 9496 - DNA, 25 bp, Homo sapiens
tcaggatataacagcacttcaccga

SEQ ID NO: 9497 - DNA, 25 bp, Homo sapiens
taacagcacttcaccgaaatattct

SEQ ID NO: 9498 - DNA, 25 bp, Homo sapiens
ccatactcaagttctggtccttcac

SEQ ID NO: 9499 - DNA, 25 bp, Homo sapiens
accgtttgctcttgctgtagtgaaa

SEQ ID NO: 9500 - DNA, 25 bp, Homo sapiens
cagtaaagagcgcaccgagtcacct

SEQ ID NO: 9501 - DNA, 25 bp, Homo sapiens
tagtgccagtgcattggtccaacct

SEQ ID NO: 9502 - DNA, 25 bp, Homo sapiens
ggacatcccacagcttggtgtgtct

SEQ ID NO: 9503 - DNA, 25 bp, Homo sapiens
atggcccatcattcactgttatgag

SEQ ID NO: 9504 - DNA, 25 bp, Homo sapiens
tgctgactgcaatccgttcgggaga

SEQ ID NO: 9505 - DNA, 25 bp, Homo sapiens
ggaaggtcaagactcagccattcca

SEQ ID NO: 9506 - DNA, 25 bp, Homo sapiens
cctgatgcccaggacggccattaaa

SEQ ID NO: 9507 - DNA, 25 bp, Homo sapiens
ggccattaaatgttaccctgccaca

SEQ ID NO: 9508 - DNA, 25 bp, Homo sapiens
ttccacttcagaccaacttcatact

SEQ ID NO: 9509 - DNA, 25 bp, Homo sapiens
gtgggtgaaggcagagatctaacct

SEQ ID NO: 9510 - DNA, 25 bp, Homo sapiens
gatctaacctggcttgtttagggcc

SEQ ID NO: 9511 - DNA, 25 bp, Homo sapiens
ggcttgtttagggccataccactaa

SEQ ID NO: 9512 - DNA, 25 bp, Homo sapiens
gaaaatctgtgctagaacctgtgtc

SEQ ID NO: 9513 - DNA, 25 bp, Homo sapiens
tagaacctgtgtcttattcctataa

SEQ ID NO: 9514 - DNA, 25 bp, Homo sapiens
attcctataagctatgtgttcagac

SEQ ID NO: 9515 - DNA, 25 bp, Homo sapiens
tgctgagtaaactgcttaacttcaa

SEQ ID NO: 9516 - DNA, 25 bp, Homo sapiens
gaagactaagtctggagctagacat

SEQ ID NO: 9517 - DNA, 25 bp, Homo sapiens
gaagttgatctctgttttgactaaa

SEQ ID NO: 9518 - DNA, 25 bp, Homo sapiens
aatgattggatgagtttattctttt

SEQ ID NO: 9519 - DNA, 25 bp, Homo sapiens
cttatgtttgtttagcgactttagc

SEQ ID NO: 9520 - DNA, 25 bp, Homo sapiens
cagtccactttataaaccgtgatgg

SEQ ID NO: 9521 - DNA, 25 bp, Homo sapiens
gtgagggaaccctggcttgttcaac

SEQ ID NO: 9522 - DNA, 25 bp, Homo sapiens
acctgtcacctcatctttgaagatc

SEQ ID NO: 9523 - DNA, 25 bp, Homo sapiens
gctcgatctggcatatggactaaca

SEQ ID NO: 9524 - DNA, 25 bp, Homo sapiens
cagacagatcacggttgggctgcca

SEQ ID NO: 9525 - DNA, 25 bp, Homo sapiens
gttgggctgccaaatctgtttgaca

SEQ ID NO: 9526 - DNA, 25 bp, Homo sapiens
atatgactgttcgagtgcctgaaac

SEQ ID NO: 9527 - DNA, 25 bp, Homo sapiens
ggctgatgccagacaatccattgat

SEQ ID NO: 9528 - DNA, 25 bp, Homo sapiens
ggcaagacctcctgaactagaacaa

SEQ ID NO: 9529 - DNA, 25 bp, Homo sapiens
gctttactattttaattcaccttgc

SEQ ID NO: 9530 - DNA, 25 bp, Homo sapiens
caccttgcataactactgaattttg

SEQ ID NO: 9531 - DNA, 25 bp, Homo sapiens
gtggcgtgggtggcagaggatcccc

SEQ ID NO: 9532 - DNA, 25 bp, Homo sapiens
aaggatgcaacggatcgctgctgtg

SEQ ID NO: 9533 - DNA, 25 bp, Homo sapiens
cgctgctgtgtcactcatgactgtt

SEQ ID NO: 9534 - DNA, 25 bp, Homo sapiens
catgactgttgctacaaacgtctgg

SEQ ID NO: 9535 - DNA, 25 bp, Homo sapiens
gtggcaccaaatttctgagctacaa

SEQ ID NO: 9536 - DNA, 25 bp, Homo sapiens
ctcggggagcagaatcacctgtgca

SEQ ID NO: 9537 - DNA, 25 bp, Homo sapiens
gctgccacctgttttgctagaaaca

SEQ ID NO: 9538 - DNA, 25 bp, Homo sapiens
aaaccttccacccagtgctgaattt

SEQ ID NO: 9539 - DNA, 25 bp, Homo sapiens
taccctaaccaagttccttggccat

SEQ ID NO: 9540 - DNA, 25 bp, Homo sapiens
cagcagatttccagccttctactgc

SEQ ID NO: 9541 - DNA, 25 bp, Homo sapiens
ctcaactccgtgcttaaccaaagaa

SEQ ID NO: 9542 - DNA, 25 bp, Homo sapiens
gcttcgggcatccaacgcaatgatg

SEQ ID NO: 9543 - DNA, 25 bp, Homo sapiens
cattcccaagtgccggagtggtgtc

SEQ ID NO: 9544 - DNA, 25 bp, Homo sapiens
gtgtctagtgtgtggcggtggagtc

SEQ ID NO: 9545 - DNA, 25 bp, Homo sapiens
gtggagtccatgcctttgaactgga

SEQ ID NO: 9546 - DNA, 25 bp, Homo sapiens
ctggatgtgttctattgatgacctg

SEQ ID NO: 9547 - DNA, 25 bp, Homo sapiens
tgatgacctgtgctctgcaggggaa

SEQ ID NO: 9548 - DNA, 25 bp, Homo sapiens
gcagcatgaaacccttttgtggttc

SEQ ID NO: 9549 - DNA, 25 bp, Homo sapiens
cccaggagcccagtttcaatggcct

SEQ ID NO: 9550 - DNA, 25 bp, Homo sapiens
tcaatggccttgctgtgtggtgttt

SEQ ID NO: 9551 - DNA, 25 bp, Homo sapiens
gctgtgtggtgtttcaagtgcattt

SEQ ID NO: 9552 - DNA, 25 bp, Homo sapiens
tgacacagaaacggcacactcttcc

SEQ ID NO: 9553 - DNA, 25 bp, Homo sapiens
agacaaattgctgctgaccttacgc

SEQ ID NO: 9554 - DNA, 25 bp, Homo sapiens
acgcctgtatattaagcctccgcag

SEQ ID NO: 9555 - DNA, 25 bp, Homo sapiens
aaaccaccccaagatgattacactg

SEQ ID NO: 9556 - DNA, 25 bp, Homo sapiens
agtactgctgccagatctcttttta

SEQ ID NO: 9557 - DNA, 25 bp, Homo sapiens
ttaacatcatgtgcgtctcttggga

SEQ ID NO: 9558 - DNA, 25 bp, Homo sapiens
ccacaatgcccttgtgccttttaat

SEQ ID NO: 9559 - DNA, 25 bp, Homo sapiens
aaggcctgcgcactgaactgtaagg

SEQ ID NO: 9560 - DNA, 25 bp, Homo sapiens
cagggcctcagcgctatggaagagt

SEQ ID NO: 9561 - DNA, 25 bp, Homo sapiens
ggaagagtgtccactgaggctgcac

SEQ ID NO: 9562 - DNA, 25 bp, Homo sapiens
gctgcacatggcccaggagtggcac

SEQ ID NO: 9563 - DNA, 25 bp, Homo sapiens
ggagtggcaccatgttgcagggaca

SEQ ID NO: 9564 - DNA, 25 bp, Homo sapiens
gtttgatgctcgctgggtaacatac

SEQ ID NO: 9565 - DNA, 25 bp, Homo sapiens
tgctcgctgggtaacatacttcaac

SEQ ID NO: 9566 - DNA, 25 bp, Homo sapiens
aacacacttgttacctatgatatgg

SEQ ID NO: 9567 - DNA, 25 bp, Homo sapiens
cctatgatatggttccagagcccaa

SEQ ID NO: 9568 - DNA, 25 bp, Homo sapiens
cggaggaactgggccttgacaaagt

SEQ ID NO: 9569 - DNA, 25 bp, Homo sapiens
gggccttgacaaagtgtaaaccgca

SEQ ID NO: 9570 - DNA, 25 bp, Homo sapiens
gtaaaccgcatggatgggcttcccc

SEQ ID NO: 9571 - DNA, 25 bp, Homo sapiens
ggcttccccaaggatttattgacat

SEQ ID NO: 9572 - DNA, 25 bp, Homo sapiens
ttgctacttgagtgtgaacagttac

SEQ ID NO: 9573 - DNA, 25 bp, Homo sapiens
gaacagttacctggaaatactgatg

SEQ ID NO: 9574 - DNA, 25 bp, Homo sapiens
cctttattgagtaccaagccatgta

SEQ ID NO: 9575 - DNA, 25 bp, Homo sapiens
ctcccccaaccttagatgttctaag

SEQ ID NO: 9576 - DNA, 25 bp, Homo sapiens
attggatctcattggacccttccat

SEQ ID NO: 9577 - DNA, 25 bp, Homo sapiens
cttccatggtgtgatcgtctgactg

SEQ ID NO: 9578 - DNA, 25 bp, Homo sapiens
gactggtgttatcaccgtgggctcc

SEQ ID NO: 9579 - DNA, 25 bp, Homo sapiens
ctgactgggagttgatcgcctttcc

SEQ ID NO: 9580 - DNA, 25 bp, Homo sapiens
gagtgctctgatccctctacagagc

SEQ ID NO: 9581 - DNA, 25 bp, Homo sapiens
cctgactcattctgaaggagcccca

SEQ ID NO: 9582 - DNA, 25 bp, Homo sapiens
gaaggagccccattcctgggaaata

SEQ ID NO: 9583 - DNA, 25 bp, Homo sapiens
aaatcccctaagcagaccactgata

SEQ ID NO: 9584 - DNA, 25 bp, Homo sapiens
tggactctcagtctctgagcagtga

SEQ ID NO: 9585 - DNA, 25 bp, Homo sapiens
ttgtttcaattgcatctcccagata

SEQ ID NO: 9586 - DNA, 25 bp, Homo sapiens
cggcgtggtgaagcggttggtcaaa

SEQ ID NO: 9587 - DNA, 25 bp, Homo sapiens
atttggatcttcaacggatactaga

SEQ ID NO: 9588 - DNA, 25 bp, Homo sapiens
aagcacgtttagtactggattcagt

SEQ ID NO: 9589 - DNA, 25 bp, Homo sapiens
gaagcctgaaacttttctcgtatgg

SEQ ID NO: 9590 - DNA, 25 bp, Homo sapiens
tttctcgtatggggtggtttttgca

SEQ ID NO: 9591 - DNA, 25 bp, Homo sapiens
ttttgcattaaatcctggggtccat

SEQ ID NO: 9592 - DNA, 25 bp, Homo sapiens
cctggggtccattttacaatccatt

SEQ ID NO: 9593 - DNA, 25 bp, Homo sapiens
aatccattatttttgaccactgcta

SEQ ID NO: 9594 - DNA, 25 bp, Homo sapiens
gaccactgctatgtgttcaagtagt

SEQ ID NO: 9595 - DNA, 25 bp, Homo sapiens
gccgatcctcgcgtgagacagatca

SEQ ID NO: 9596 - DNA, 25 bp, Homo sapiens
gatcaagatcaagaccggcgtggtg

SEQ ID NO: 9597 - DNA, 25 bp, Homo sapiens
gtaggtgtctgtagctagtcttcaa

SEQ ID NO: 9598 - DNA, 25 bp, Homo sapiens
tgggctggctttaagtcctgtttga

SEQ ID NO: 9599 - DNA, 25 bp, Homo sapiens
aaagcaacccagtcagctgacttcc

SEQ ID NO: 9600 - DNA, 25 bp, Homo sapiens
gacttcctcgtgcaatgtgttaaac

SEQ ID NO: 9601 - DNA, 25 bp, Homo sapiens
tgtgaactctgcccatgtgtcagga

SEQ ID NO: 9602 - DNA, 25 bp, Homo sapiens
tggtctcttcctttagctgacaagg

SEQ ID NO: 9603 - DNA, 25 bp, Homo sapiens
aggacactcctgaggtctttgttct

SEQ ID NO: 9604 - DNA, 25 bp, Homo sapiens
tattttttttatcctggggccacag

SEQ ID NO: 9605 - DNA, 25 bp, Homo sapiens
tggggccacagttcttgattattcc

SEQ ID NO: 9606 - DNA, 25 bp, Homo sapiens
atggcagtactttaggacacacaca

SEQ ID NO: 9607 - DNA, 25 bp, Homo sapiens
gtcaaaggacctgtgtagcatttca

SEQ ID NO: 9608 - DNA, 25 bp, Homo sapiens
ttttcattgttcattgatatgctca

SEQ ID NO: 9609 - DNA, 25 bp, Homo sapiens
gatatgctcagtatgctgccacata

SEQ ID NO: 9610 - DNA, 25 bp, Homo sapiens
actcttacatgatttctaggcccca

SEQ ID NO: 9611 - DNA, 25 bp, Homo sapiens
attaattctaaccagttgtttgctt

SEQ ID NO: 9612 - DNA, 25 bp, Homo sapiens
tactctgtgctagtgtagtcttact

SEQ ID NO: 9613 - DNA, 25 bp, Homo sapiens
tagagaatgtttatggtcccacttg

SEQ ID NO: 9614 - DNA, 25 bp, Homo sapiens
ttatggtcccacttgtatatgaaaa

SEQ ID NO: 9615 - DNA, 25 bp, Homo sapiens
gagagctctctacatgaagatgact

SEQ ID NO: 9616 - DNA, 25 bp, Homo sapiens
agaactccagattcctggttcatca

SEQ ID NO: 9617 - DNA, 25 bp, Homo sapiens
ggttcatcattctgtattcttactc

SEQ ID NO: 9618 - DNA, 25 bp, Homo sapiens
gtattcttactcactttttcaagtt

SEQ ID NO: 9619 - DNA, 25 bp, Homo sapiens
ccctgggtcagtgtggtcgacagag

SEQ ID NO: 9620 - DNA, 25 bp, Homo sapiens
aagggcctgcccagacaagattttt

SEQ ID NO: 9621 - DNA, 25 bp, Homo sapiens
tggagaccgaggcatacctggggcc

SEQ ID NO: 9622 - DNA, 25 bp, Homo sapiens
ggggccagaggatgaaccggcccac

SEQ ID NO: 9623 - DNA, 25 bp, Homo sapiens
cggcccactcaaggggtggccggca

SEQ ID NO: 9624 - DNA, 25 bp, Homo sapiens
cccgcaaccgaggcatgttcatgaa

SEQ ID NO: 9625 - DNA, 25 bp, Homo sapiens
tcatgaagccggggaccctgtacgt

SEQ ID NO: 9626 - DNA, 25 bp, Homo sapiens
gtacttctgcatgaacatctccagc

SEQ ID NO: 9627 - DNA, 25 bp, Homo sapiens
aaggtctggagaccatgcgtcacgt

SEQ ID NO: 9628 - DNA, 25 bp, Homo sapiens
caagagctttgaccagagggacctg

SEQ ID NO: 9629 - DNA, 25 bp, Homo sapiens
gaagctgtatggctggagcgtggtc

SEQ ID NO: 9630 - DNA, 25 bp, Homo sapiens
cctgaggggcctcttatgggctggg

SEQ ID NO: 9631 - DNA, 25 bp, Homo sapiens
tacccaggtgctaggaacactcctt

SEQ ID NO: 9632 - DNA, 25 bp, Homo sapiens
acactccttcacagatgggtgcttg

SEQ ID NO: 9633 - DNA, 25 bp, Homo sapiens
aacccagctctggtccatagagagc

SEQ ID NO: 9634 - DNA, 25 bp, Homo sapiens
agagagcaaaacgctgtgctgccct

SEQ ID NO: 9635 - DNA, 25 bp, Homo sapiens
tgggtgtggcgcagcatattcagga

SEQ ID NO: 9636 - DNA, 25 bp, Homo sapiens
ggtgggagtgggtccaatgcacttt

SEQ ID NO: 9637 - DNA, 25 bp, Homo sapiens
gcctttcaggggtgggacaccctgt

SEQ ID NO: 9638 - DNA, 25 bp, Homo sapiens
ctgcctcctttgtgaggaagccgct

SEQ ID NO: 9639 - DNA, 25 bp, Homo sapiens
ggactttgttagtttctccaagcag

SEQ ID NO: 9640 - DNA, 25 bp, Homo sapiens
tcatcaccaacgtctgtgccatttt

SEQ ID NO: 9641 - DNA, 25 bp, Homo sapiens
gaatgtcagtccaatctccaatgag

SEQ ID NO: 9642 - DNA, 25 bp, Homo sapiens
acatgagcaaatagacctttccagg

SEQ ID NO: 9643 - DNA, 25 bp, Homo sapiens
gtttctgtaagtttttcctcatggc

SEQ ID NO: 9644 - DNA, 25 bp, Homo sapiens
ttactttctcttgaatatgctacac

SEQ ID NO: 9645 - DNA, 25 bp, Homo sapiens
acatactaaagtttgcattccaggg

SEQ ID NO: 9646 - DNA, 25 bp, Homo sapiens
gcattccagggatattgactgtaca

SEQ ID NO: 9647 - DNA, 25 bp, Homo sapiens
tatgtggtatccatgtgtatcgacc

SEQ ID NO: 9648 - DNA, 25 bp, Homo sapiens
gtgtatcgaccatgtgccatatatc

SEQ ID NO: 9649 - DNA, 25 bp, Homo sapiens
tatggtcactagaaagtctctttat

SEQ ID NO: 9650 - DNA, 25 bp, Homo sapiens
cctcctttctacccataaattacat

SEQ ID NO: 9651 - DNA, 25 bp, Homo sapiens
tacatacgcaagtttttcactgaca

SEQ ID NO: 9652 - DNA, 25 bp, Homo sapiens
tgaatgacctgacttttagccacca

SEQ ID NO: 9653 - DNA, 25 bp, Homo sapiens
tagccaccaggtactctttaaacag

SEQ ID NO: 9654 - DNA, 25 bp, Homo sapiens
gacccagcatctgagttaggttcca

SEQ ID NO: 9655 - DNA, 25 bp, Homo sapiens
ataagtccatctgtcacttgcattc

SEQ ID NO: 9656 - DNA, 25 bp, Homo sapiens
gaaagagtctgaccctttaatccaa

SEQ ID NO: 9657 - DNA, 25 bp, Homo sapiens
gctcctagagtatattcctctgctg

SEQ ID NO: 9658 - DNA, 25 bp, Homo sapiens
aatctaacagtaacacacccctgct

SEQ ID NO: 9659 - DNA, 25 bp, Homo sapiens
ccctgcttgggaccctagctatatg

SEQ ID NO: 9660 - DNA, 25 bp, Homo sapiens
atgcattttatgtgaccttgccatg

SEQ ID NO: 9661 - DNA, 25 bp, Homo sapiens
gtctagcacatgttgatttcctatg

SEQ ID NO: 9662 - DNA, 25 bp, Homo sapiens
atttcctatgtattctgggtattct

SEQ ID NO: 9663 - DNA, 25 bp, Homo sapiens
ggaacgttccagattactcttggtg

SEQ ID NO: 9664 - DNA, 25 bp, Homo sapiens
actcttggtggaaggctctatagct

SEQ ID NO: 9665 - DNA, 25 bp, Homo sapiens
tgaagcttcgtcatcttggactcag

SEQ ID NO: 9666 - DNA, 25 bp, Homo sapiens
gattctagcaatagtgattccactc

SEQ ID NO: 9667 - DNA, 25 bp, Homo sapiens
agaagtctggcaggaactcgaaccc

SEQ ID NO: 9668 - DNA, 25 bp, Homo sapiens
ggcaagcacgcaactaaatcccgaa

SEQ ID NO: 9669 - DNA, 25 bp, Homo sapiens
gtggacttcctattaagacttactt

SEQ ID NO: 9670 - DNA, 25 bp, Homo sapiens
cttctctcaacccctttgtaatggt

SEQ ID NO: 9671 - DNA, 25 bp, Homo sapiens
atggtttgggggcagactcttaagt

SEQ ID NO: 9672 - DNA, 25 bp, Homo sapiens
ctggtaaacattccacgggacactg

SEQ ID NO: 9673 - DNA, 25 bp, Homo sapiens
tctgccctccacttaatgttaatga

SEQ ID NO: 9674 - DNA, 25 bp, Homo sapiens
cccatgtcactggtcagcgtggttt

SEQ ID NO: 9675 - DNA, 25 bp, Homo sapiens
ttagttttgccatcacattgtcacc

SEQ ID NO: 9676 - DNA, 25 bp, Homo sapiens
cacctagccccaagtaatcgggcgc

SEQ ID NO: 9677 - DNA, 25 bp, Homo sapiens
tgccagagttgacccagtgtgcgga

SEQ ID NO: 9678 - DNA, 25 bp, Homo sapiens
gtgtgcggatgataactactgacga

SEQ ID NO: 9679 - DNA, 25 bp, Homo sapiens
gagtcatcgacctcagttagtggtt

SEQ ID NO: 9680 - DNA, 25 bp, Homo sapiens
tgtagtcacattagtttgcctctcc

SEQ ID NO: 9681 - DNA, 25 bp, Homo sapiens
ggacatgatgctaagagccctgggt

SEQ ID NO: 9682 - DNA, 25 bp, Homo sapiens
tgcacgcgtgcatatgctacacata

SEQ ID NO: 9683 - DNA, 25 bp, Homo sapiens
acacatatgtgcttctcagttgcag

SEQ ID NO: 9684 - DNA, 25 bp, Homo sapiens
ggtgctgagtgctatgtgtgcttat

SEQ ID NO: 9685 - DNA, 25 bp, Homo sapiens
gtgttttatttggtctaataccctg

SEQ ID NO: 9686 - DNA, 25 bp, Homo sapiens
gaagtgatgacttgttgcttttcaa

SEQ ID NO: 9687 - DNA, 25 bp, Homo sapiens
tttccccttgtctttgttgtaagag

SEQ ID NO: 9688 - DNA, 25 bp, Homo sapiens
aggaaacaaaagtgtctccctgtgg

SEQ ID NO: 9689 - DNA, 25 bp, Homo sapiens
aagcagcgcaaatctgaggtttccc

SEQ ID NO: 9690 - DNA, 25 bp, Homo sapiens
acacaccgttaagccagaggttctg

SEQ ID NO: 9691 - DNA, 25 bp, Homo sapiens
ccagaggttctgacttcgctaaagg

SEQ ID NO: 9692 - DNA, 25 bp, Homo sapiens
ggaacacatgatccaacagactatg

SEQ ID NO: 9693 - DNA, 25 bp, Homo sapiens
tcccttcatttactttttcttgcta

SEQ ID NO: 9694 - DNA, 25 bp, Homo sapiens
ttttctcccatttggatcctttgag

SEQ ID NO: 9695 - DNA, 25 bp, Homo sapiens
taatgtcttcagcctcataataaag

SEQ ID NO: 9696 - DNA, 25 bp, Homo sapiens
aagtgattctggagttctttgaaat

SEQ ID NO: 9697 - DNA, 25 bp, Homo sapiens
gaactcggattcttttgcatgatgg

SEQ ID NO: 9698 - DNA, 25 bp, Homo sapiens
gcatgatggggtaaagcttagcaga

SEQ ID NO: 9699 - DNA, 25 bp, Homo sapiens
tgggagctaacctttatcccacctt

SEQ ID NO: 9700 - DNA, 25 bp, Homo sapiens
atcttgcaacactatcctgtttctc

SEQ ID NO: 9701 - DNA, 25 bp, Homo sapiens
aatgccaatcatagagggtactgta

SEQ ID NO: 9702 - DNA, 25 bp, Homo sapiens
tgttcacttgagtggaactgctttt

SEQ ID NO: 9703 - DNA, 25 bp, Homo sapiens
atcttgtgtttcttcaaccttcaaa

SEQ ID NO: 9704 - DNA, 25 bp, Homo sapiens
aaccttcaaaactatctcatctgtc

SEQ ID NO: 9705 - DNA, 25 bp, Homo sapiens
aactccaacacaggttttggcatct

SEQ ID NO: 9706 - DNA, 25 bp, Homo sapiens
ttggcatcttttgtgctgtatcttt

SEQ ID NO: 9707 - DNA, 25 bp, Homo sapiens
ctccgtctcctagtgataatgctcc

SEQ ID NO: 9708 - DNA, 25 bp, Homo sapiens
taatgctccaagtctatgaactgtt

SEQ ID NO: 9709 - DNA, 25 bp, Homo sapiens
gggaactttctatgcaatgttcagg

SEQ ID NO: 9710 - DNA, 25 bp, Homo sapiens
ggataaatcgatactgctggccaat

SEQ ID NO: 9711 - DNA, 25 bp, Homo sapiens
cgatactgctggccaatcagtgtca

SEQ ID NO: 9712 - DNA, 25 bp, Homo sapiens
tctcctgggtaaattttgatgtcgc

SEQ ID NO: 9713 - DNA, 25 bp, Homo sapiens
ttcttcatctgaaccaacatgctac

SEQ ID NO: 9714 - DNA, 25 bp, Homo sapiens
tgaccacagacatgttattcttctg

SEQ ID NO: 9715 - DNA, 25 bp, Homo sapiens
gaaagagccacattttggttttatt

SEQ ID NO: 9716 - DNA, 25 bp, Homo sapiens
tgaaatcttttatatctgttgccta

SEQ ID NO: 9717 - DNA, 25 bp, Homo sapiens
atctgttgcctagttttgtacatgg

SEQ ID NO: 9718 - DNA, 25 bp, Homo sapiens
tttggcgacgtaattcccgactatg

SEQ ID NO: 9719 - DNA, 25 bp, Homo sapiens
tcccgactatgtgctgggccagagc

SEQ ID NO: 9720 - DNA, 25 bp, Homo sapiens
tacatccatgggcggctgcagagcc

SEQ ID NO: 9721 - DNA, 25 bp, Homo sapiens
cctggggaagaacttcgccttgcgg

SEQ ID NO: 9722 - DNA, 25 bp, Homo sapiens
gaagctagagcaggacttcgtctcc

SEQ ID NO: 9723 - DNA, 25 bp, Homo sapiens
cttcgtctcccgggtgactgaatgt

SEQ ID NO: 9724 - DNA, 25 bp, Homo sapiens
gactgaatgtctgaccaccgtgaag

SEQ ID NO: 9725 - DNA, 25 bp, Homo sapiens
acaaaacggacagtcagaccctcct

SEQ ID NO: 9726 - DNA, 25 bp, Homo sapiens
cctcctgaccacatttggatctctg

SEQ ID NO: 9727 - DNA, 25 bp, Homo sapiens
ttggatctctggaacagctcatcgc

SEQ ID NO: 9728 - DNA, 25 bp, Homo sapiens
cagctcatcgccgcatcaagagaag

SEQ ID NO: 9729 - DNA, 25 bp, Homo sapiens
attaagcattgccacatctaggaat

SEQ ID NO: 9730 - DNA, 25 bp, Homo sapiens
ggttacaggtgttacttctctgacc

SEQ ID NO: 9731 - DNA, 25 bp, Homo sapiens
tctctgaccttcaatcctactacag

SEQ ID NO: 9732 - DNA, 25 bp, Homo sapiens
gaagcagtcagattggttcatcttc

SEQ ID NO: 9733 - DNA, 25 bp, Homo sapiens
gtacagtattttcaaacttcccagt

SEQ ID NO: 9734 - DNA, 25 bp, Homo sapiens
gttcataccatggatttttctccga

SEQ ID NO: 9735 - DNA, 25 bp, Homo sapiens
gaagtggatactttgccttggggaa

SEQ ID NO: 9736 - DNA, 25 bp, Homo sapiens
aaggccctgatgtataggttgcacc

SEQ ID NO: 9737 - DNA, 25 bp, Homo sapiens
taggttgcaccattactcagacttc

SEQ ID NO: 9738 - DNA, 25 bp, Homo sapiens
gagaagcctgtcttgatatatcatc

SEQ ID NO: 9739 - DNA, 25 bp, Homo sapiens
gatccagctgtgcttaagagccagt

SEQ ID NO: 9740 - DNA, 25 bp, Homo sapiens
ggccttgggttcgtcagcatgggcc

SEQ ID NO: 9741 - DNA, 25 bp, Homo sapiens
ggttcgtcagcatgggccgaggacg

SEQ ID NO: 9742 - DNA, 25 bp, Homo sapiens
gtcagcatgggccgaggacgttgcc

SEQ ID NO: 9743 - DNA, 25 bp, Homo sapiens
tgggccgaggacgttgcctgtagaa

SEQ ID NO: 9744 - DNA, 25 bp, Homo sapiens
ggccgaggacgttgcctgtagaatc

SEQ ID NO: 9745 - DNA, 25 bp, Homo sapiens
aggacgttgcctgtagaatcctcct

SEQ ID NO: 9746 - DNA, 25 bp, Homo sapiens
ctgcctgggagtggctctgtgtgga

SEQ ID NO: 9747 - DNA, 25 bp, Homo sapiens
ctgggagtggctctgtgtggaccag

SEQ ID NO: 9748 - DNA, 25 bp, Homo sapiens
ccattctttttttgacgcagccaat

SEQ ID NO: 9749 - DNA, 25 bp, Homo sapiens
tctttttttgacgcagccaatctgt

SEQ ID NO: 9750 - DNA, 25 bp, Homo sapiens
tttgacgcagccaatctgtgaccac

SEQ ID NO: 9751 - DNA, 25 bp, Homo sapiens
taaagtttaagtgtgcagccatagt

SEQ ID NO: 9752 - DNA, 25 bp, Homo sapiens
gcagccatagtttgggtatttttgg

SEQ ID NO: 9753 - DNA, 25 bp, Homo sapiens
atttttggtttatatgccctcaagt

SEQ ID NO: 9754 - DNA, 25 bp, Homo sapiens
gggttccagtgattaatctccctga

SEQ ID NO: 9755 - DNA, 25 bp, Homo sapiens
tctccctgaacggtgatggcatctg

SEQ ID NO: 9756 - DNA, 25 bp, Homo sapiens
tgaaccaaattgcactgaagttttt

SEQ ID NO: 9757 - DNA, 25 bp, Homo sapiens
gaaatacctttgtagttactcaagc

SEQ ID NO: 9758 - DNA, 25 bp, Homo sapiens
agttactcaagcagttactccctac

SEQ ID NO: 9759 - DNA, 25 bp, Homo sapiens
gttactccctacactgatgcaagga

SEQ ID NO: 9760 - DNA, 25 bp, Homo sapiens
gttcaactacatgttctgggggccc

SEQ ID NO: 9761 - DNA, 25 bp, Homo sapiens
ggggcccggagatagatgactttgc

SEQ ID NO: 9762 - DNA, 25 bp, Homo sapiens
atcctcattcttatactgcttttcg

SEQ ID NO: 9763 - DNA, 25 bp, Homo sapiens
tgaatctctggtacgactgcacgtg

SEQ ID NO: 9764 - DNA, 25 bp, Homo sapiens
gactgcacgtggaacaacgacacca

SEQ ID NO: 9765 - DNA, 25 bp, Homo sapiens
atgggcctgcagtaatgtcagcgag

SEQ ID NO: 9766 - DNA, 25 bp, Homo sapiens
agaatggctggctgaaggcggtgca

SEQ ID NO: 9767 - DNA, 25 bp, Homo sapiens
agctctacaccatgcgacgaggagg

SEQ ID NO: 9768 - DNA, 25 bp, Homo sapiens
agcgtggcggtgtttactggcgcct

SEQ ID NO: 9769 - DNA, 25 bp, Homo sapiens
tggcgccttgatctatgccattcac

SEQ ID NO: 9770 - DNA, 25 bp, Homo sapiens
gagggggcagcttcggatactgctt

SEQ ID NO: 9771 - DNA, 25 bp, Homo sapiens
tcatctacatccacctacggaagcg

SEQ ID NO: 9772 - DNA, 25 bp, Homo sapiens
acggaagcgggagtgagcgccccgc

SEQ ID NO: 9773 - DNA, 25 bp, Homo sapiens
aagaggcatcccaagacctcatctg

SEQ ID NO: 9774 - DNA, 25 bp, Homo sapiens
gcagtgtcaaatcgatggcctggcc

SEQ ID NO: 9775 - DNA, 25 bp, Homo sapiens
ctggccttggcttctgattatttgc

SEQ ID NO: 9776 - DNA, 25 bp, Homo sapiens
tacaggaacccagccagagtttgcc

SEQ ID NO: 9777 - DNA, 25 bp, Homo sapiens
agaggacacttcaaactgcggacac

SEQ ID NO: 9778 - DNA, 25 bp, Homo sapiens
ctcccagctccgtttgatgtgagtt

SEQ ID NO: 9779 - DNA, 25 bp, Homo sapiens
ttcaggccagctgggtttagcccga

SEQ ID NO: 9780 - DNA, 25 bp, Homo sapiens
tagcccgaggctggtcttagatgca

SEQ ID NO: 9781 - DNA, 25 bp, Homo sapiens
gcagcgactgtttcaggggtgactc

SEQ ID NO: 9782 - DNA, 25 bp, Homo sapiens
tttcaggttactcgttcttcagcaa

SEQ ID NO: 9783 - DNA, 25 bp, Homo sapiens
atgctggtgagtgccacgttactcc

SEQ ID NO: 9784 - DNA, 25 bp, Homo sapiens
aaactctaccattcattatgtggta

SEQ ID NO: 9785 - DNA, 25 bp, Homo sapiens
gtggtaactgtattgaacttacttt

SEQ ID NO: 9786 - DNA, 25 bp, Homo sapiens
tgactagatgtcaccacttcaaaaa

SEQ ID NO: 9787 - DNA, 25 bp, Homo sapiens
tgagacggagtcttgctctgttgcc

SEQ ID NO: 9788 - DNA, 25 bp, Homo sapiens
cctcagcttcccaagcagctgggac

SEQ ID NO: 9789 - DNA, 25 bp, Homo sapiens
gtttcaccgtgttagccaggaaggt

SEQ ID NO: 9790 - DNA, 25 bp, Homo sapiens
aggaaggtctcaatctcctgacctc

SEQ ID NO: 9791 - DNA, 25 bp, Homo sapiens
caccatgcccggcccaaatattttt

SEQ ID NO: 9792 - DNA, 25 bp, Homo sapiens
ggatggtataacctaactgataata

SEQ ID NO: 9793 - DNA, 25 bp, Homo sapiens
tttacaaatatcatacactgctggt

SEQ ID NO: 9794 - DNA, 25 bp, Homo sapiens
tacactgctggtgttaccatatgaa

SEQ ID NO: 9795 - DNA, 25 bp, Homo sapiens
agttttgcacttttatagcctattt

SEQ ID NO: 9796 - DNA, 25 bp, Homo sapiens
acacatttgcaagatgattgactca

SEQ ID NO: 9797 - DNA, 25 bp, Homo sapiens
attgactcaatctttgcctaatcca

SEQ ID NO: 9798 - DNA, 25 bp, Homo sapiens
ttgcctaatccaatgagtgttacag

SEQ ID NO: 9799 - DNA, 25 bp, Homo sapiens
gagagcttgctgtgactagaaccat

SEQ ID NO: 9800 - DNA, 25 bp, Homo sapiens
ttcagatttctctttttaaccacat

SEQ ID NO: 9801 - DNA, 25 bp, Homo sapiens
ttcctacagccctttgtacttcaaa

SEQ ID NO: 9802 - DNA, 25 bp, Homo sapiens
atatgtttttgtgtccatcagtatt

SEQ ID NO: 9803 - DNA, 25 bp, Homo sapiens
ttaactattggtatactactggttt

SEQ ID NO: 9804 - DNA, 25 bp, Homo sapiens
agaggtacaattcgttggatttttg

SEQ ID NO: 9805 - DNA, 25 bp, Homo sapiens
gacattacgtgttttatttatgata

SEQ ID NO: 9806 - DNA, 25 bp, Homo sapiens
ggacctcgtaaagcactgtttcaga

SEQ ID NO: 9807 - DNA, 25 bp, Homo sapiens
agagtcatccattccgagagcagat

SEQ ID NO: 9808 - DNA, 25 bp, Homo sapiens
agtgggtttacccttctgagcagat

SEQ ID NO: 9809 - DNA, 25 bp, Homo sapiens
gaagcccttcatgctgcagagtgtc

SEQ ID NO: 9810 - DNA, 25 bp, Homo sapiens
ggtccatcattgatccggtttggag

SEQ ID NO: 9811 - DNA, 25 bp, Homo sapiens
ccaagggcacgaattcgttcctgga

SEQ ID NO: 9812 - DNA, 25 bp, Homo sapiens
gttcctggatggggtatgagttgcc

SEQ ID NO: 9813 - DNA, 25 bp, Homo sapiens
gattggatcataaaccgttgcggga

SEQ ID NO: 9814 - DNA, 25 bp, Homo sapiens
actaccagttcaccatcctggacgt

SEQ ID NO: 9815 - DNA, 25 bp, Homo sapiens
gtcctgccttagattcactttcggc

SEQ ID NO: 9816 - DNA, 25 bp, Homo sapiens
aaagtcgcttggtggcgttggacct

SEQ ID NO: 9817 - DNA, 25 bp, Homo sapiens
caagtatcggggctctgctatcaag

SEQ ID NO: 9818 - DNA, 25 bp, Homo sapiens
tccttcgtggatgcaacctcaacca

SEQ ID NO: 9819 - DNA, 25 bp, Homo sapiens
caaccatatattctacagcaccctg

SEQ ID NO: 9820 - DNA, 25 bp, Homo sapiens
ctacagcccgcatcaatgatcagcc

SEQ ID NO: 9821 - DNA, 25 bp, Homo sapiens
gccctctggcccagcagatgagtca

SEQ ID NO: 9822 - DNA, 25 bp, Homo sapiens
gagtcatctgtcactaggcagcacc

SEQ ID NO: 9823 - DNA, 25 bp, Homo sapiens
tacatgcctgcaacgtcagctatgc

SEQ ID NO: 9824 - DNA, 25 bp, Homo sapiens
agcctacttgccacagtatgcacat

SEQ ID NO: 9825 - DNA, 25 bp, Homo sapiens
agcaggtggctgtcgagacgtctaa

SEQ ID NO: 9826 - DNA, 25 bp, Homo sapiens
tgaccattctccatatacctttcaa

SEQ ID NO: 9827 - DNA, 25 bp, Homo sapiens
aaattcatctagtagctgttccccc

SEQ ID NO: 9828 - DNA, 25 bp, Homo sapiens
atcaccagcaaacgccaggacttgg

SEQ ID NO: 9829 - DNA, 25 bp, Homo sapiens
cagcaaacgccaggacttggctccc

SEQ ID NO: 9830 - DNA, 25 bp, Homo sapiens
catcctcagaactcacaagccattg

SEQ ID NO: 9831 - DNA, 25 bp, Homo sapiens
tcctcagaactcacaagccattgct

SEQ ID NO: 9832 - DNA, 25 bp, Homo sapiens
cccctgcctcggttggtgacagagg

SEQ ID NO: 9833 - DNA, 25 bp, Homo sapiens
tcggttggtgacagagggggtggga

SEQ ID NO: 9834 - DNA, 25 bp, Homo sapiens
ttggtgacagagggggtgggacagg

SEQ ID NO: 9835 - DNA, 25 bp, Homo sapiens
gccataccaaccccaggtattaatt

SEQ ID NO: 9836 - DNA, 25 bp, Homo sapiens
ccaaccccaggtattaattctcgct

SEQ ID NO: 9837 - DNA, 25 bp, Homo sapiens
accccaggtattaattctcgctggt

SEQ ID NO: 9838 - DNA, 25 bp, Homo sapiens
tattaattctcgctggttttgtttt

SEQ ID NO: 9839 - DNA, 25 bp, Homo sapiens
agaacagagtgttcgattctgccct

SEQ ID NO: 9840 - DNA, 25 bp, Homo sapiens
cagagtgttcgattctgccctattt

SEQ ID NO: 9841 - DNA, 25 bp, Homo sapiens
gattctgccctatttatgtttctac

SEQ ID NO: 9842 - DNA, 25 bp, Homo sapiens
ttctgccctatttatgtttctactc

SEQ ID NO: 9843 - DNA, 25 bp, Homo sapiens
ctgccctatttatgtttctactcgg

SEQ ID NO: 9844 - DNA, 25 bp, Homo sapiens
gggaacaaacgttggttgtgtgtgt

SEQ ID NO: 9845 - DNA, 25 bp, Homo sapiens
tgttttgttttgctacgagtccaca

SEQ ID NO: 9846 - DNA, 25 bp, Homo sapiens
tttgttttgctacgagtccacattc

SEQ ID NO: 9847 - DNA, 25 bp, Homo sapiens
tacgagtccacattcctgtttgtaa

SEQ ID NO: 9848 - DNA, 25 bp, Homo sapiens
attcctgtttgtaatccttggttcg

SEQ ID NO: 9849 - DNA, 25 bp, Homo sapiens
tcctgtttgtaatccttggttcgcc

SEQ ID NO: 9850 - DNA, 25 bp, Homo sapiens
tggggacctgtcaggctttgtcatt

SEQ ID NO: 9851 - DNA, 25 bp, Homo sapiens
tttcccagtttgttggtggtgcctt

SEQ ID NO: 9852 - DNA, 25 bp, Homo sapiens
gtgcctttagtggttccctaatttg

SEQ ID NO: 9853 - DNA, 25 bp, Homo sapiens
ttgggaacactgatggggccttgga

SEQ ID NO: 9854 - DNA, 25 bp, Homo sapiens
tgcactggcacatatggtcaccttg

SEQ ID NO: 9855 - DNA, 25 bp, Homo sapiens
tggagggcagacctaggagcccctc

SEQ ID NO: 9856 - DNA, 25 bp, Homo sapiens
aggaccccccaaagctgaggggctg

SEQ ID NO: 9857 - DNA, 25 bp, Homo sapiens
ggggctgaatgtagccttttcaaca

SEQ ID NO: 9858 - DNA, 25 bp, Homo sapiens
aaggctcccacttgagagcagcctc

SEQ ID NO: 9859 - DNA, 25 bp, Homo sapiens
cctcgcttcttcagctaaaactcca

SEQ ID NO: 9860 - DNA, 25 bp, Homo sapiens
gtgggtcattgcggtcttagattat

SEQ ID NO: 9861 - DNA, 25 bp, Homo sapiens
caccttgggtctgtgtcacttgtag

SEQ ID NO: 9862 - DNA, 25 bp, Homo sapiens
gtgtcacttgtaggtttctctgcct

SEQ ID NO: 9863 - DNA, 25 bp, Homo sapiens
ctccaggttgcctcaacagcaggag

SEQ ID NO: 9864 - DNA, 25 bp, Homo sapiens
gcaagatcgctgtgctaggtctgac

SEQ ID NO: 9865 - DNA, 25 bp, Homo sapiens
gtcctgggggtaaagccctcagatc

SEQ ID NO: 9866 - DNA, 25 bp, Homo sapiens
tcagatcccagggtacactcttctc

SEQ ID NO: 9867 - DNA, 25 bp, Homo sapiens
accccagtcacctaagcaatcactg

SEQ ID NO: 9868 - DNA, 25 bp, Homo sapiens
taaggccagctagagcttccactgt

SEQ ID NO: 9869 - DNA, 25 bp, Homo sapiens
ggcactgggcactagctagatgctt

SEQ ID NO: 9870 - DNA, 25 bp, Homo sapiens
ttaggttgcttcagctgatccttca

SEQ ID NO: 9871 - DNA, 25 bp, Homo sapiens
gctgatccttcaactctgtgaggtg

SEQ ID NO: 9872 - DNA, 25 bp, Homo sapiens
cagagcccgagaggaagtttggcgt

SEQ ID NO: 9873 - DNA, 25 bp, Homo sapiens
agaggaagtttggcgtggtggtggt

SEQ ID NO: 9874 - DNA, 25 bp, Homo sapiens
ccggctccgtgcggatgagggactt

SEQ ID NO: 9875 - DNA, 25 bp, Homo sapiens
ggatgagggacttgcggaatccaca

SEQ ID NO: 9876 - DNA, 25 bp, Homo sapiens
ctgaacctgattggcttcgtgtcga

SEQ ID NO: 9877 - DNA, 25 bp, Homo sapiens
ggcttcgtgtcgagaagggagctcg

SEQ ID NO: 9878 - DNA, 25 bp, Homo sapiens
ggagctcgggagcattgatggagtc

SEQ ID NO: 9879 - DNA, 25 bp, Homo sapiens
gcattgatggagtccagcagatttc

SEQ ID NO: 9880 - DNA, 25 bp, Homo sapiens
gatttctttggaggatgctctttcc

SEQ ID NO: 9881 - DNA, 25 bp, Homo sapiens
gatgctctttccagccaagaggtgg

SEQ ID NO: 9882 - DNA, 25 bp, Homo sapiens
atatctgcagtgagagctccagcca

SEQ ID NO: 9883 - DNA, 25 bp, Homo sapiens
agttgaccattatctctattcttaa

SEQ ID NO: 9884 - DNA, 25 bp, Homo sapiens
agacctgctgaaagggtcgctcctc

SEQ ID NO: 9885 - DNA, 25 bp, Homo sapiens
ctcttcacatctgacccgttggaag

SEQ ID NO: 9886 - DNA, 25 bp, Homo sapiens
gaagaagaccggtttggcttccctg

SEQ ID NO: 9887 - DNA, 25 bp, Homo sapiens
ggtctccctctttggggagctttct

SEQ ID NO: 9888 - DNA, 25 bp, Homo sapiens
ttctcttgtgtctgccactttggaa

SEQ ID NO: 9889 - DNA, 25 bp, Homo sapiens
gcttccatttcaagtctgggtcctt

SEQ ID NO: 9890 - DNA, 25 bp, Homo sapiens
agaaactcttgggccagttctctga

SEQ ID NO: 9891 - DNA, 25 bp, Homo sapiens
aaaagaaacgcatcctgcactgcct

SEQ ID NO: 9892 - DNA, 25 bp, Homo sapiens
gtagcacttccaagatggcaccagc

SEQ ID NO: 9893 - DNA, 25 bp, Homo sapiens
ggcaccagcatttggttcttctcaa

SEQ ID NO: 9894 - DNA, 25 bp, Homo sapiens
aggaatctcagtcacaccaaaccaa

SEQ ID NO: 9895 - DNA, 25 bp, Homo sapiens
aagcgggtccagatgtgattcaaac

SEQ ID NO: 9896 - DNA, 25 bp, Homo sapiens
gattcaaacaactgtacggagtggc

SEQ ID NO: 9897 - DNA, 25 bp, Homo sapiens
ggagtggcatattagaattgcccta

SEQ ID NO: 9898 - DNA, 25 bp, Homo sapiens
acacatacatacattgacccacagg

SEQ ID NO: 9899 - DNA, 25 bp, Homo sapiens
acattgacccacaggacattgtaaa

SEQ ID NO: 9900 - DNA, 25 bp, Homo sapiens
taagtagggacttttattccatcct

SEQ ID NO: 9901 - DNA, 25 bp, Homo sapiens
taattattacaagttgctcctgccc

SEQ ID NO: 9902 - DNA, 25 bp, Homo sapiens
cctccctgaactattttgtgctgtg

SEQ ID NO: 9903 - DNA, 25 bp, Homo sapiens
ggtgaactcagatgttatggttttg

SEQ ID NO: 9904 - DNA, 25 bp, Homo sapiens
gtatatgtctgcaatcatggatagg

SEQ ID NO: 9905 - DNA, 25 bp, Homo sapiens
atatgggcaacgattatcttggaaa

SEQ ID NO: 9906 - DNA, 25 bp, Homo sapiens
atatcctcaggatacttttatctta

SEQ ID NO: 9907 - DNA, 25 bp, Homo sapiens
gtgttgagcaagttgcagtgcaaac

SEQ ID NO: 9908 - DNA, 25 bp, Homo sapiens
tatgcacatgaataacctgtaccta

SEQ ID NO: 9909 - DNA, 25 bp, Homo sapiens
cctgtacctataaatcgtgcaataa

SEQ ID NO: 9910 - DNA, 25 bp, Homo sapiens
ataaccatatgcgactattttgcca

SEQ ID NO: 9911 - DNA, 25 bp, Homo sapiens
gcgactattttgccatggagaaatc

SEQ ID NO: 9912 - DNA, 25 bp, Homo sapiens
ggagaaatctgacagcattgcaaac

SEQ ID NO: 9913 - DNA, 25 bp, Homo sapiens
caaacagctttaaacacttccaatg

SEQ ID NO: 9914 - DNA, 25 bp, Homo sapiens
gtaagcccatatgtatttacatcca

SEQ ID NO: 9915 - DNA, 25 bp, Homo sapiens
atgtatttacatccagagtcataat

SEQ ID NO: 9916 - DNA, 25 bp, Homo sapiens
gagctgcatttcatggagcccattt

SEQ ID NO: 9917 - DNA, 25 bp, Homo sapiens
cctctttccttatgactttgttact

SEQ ID NO: 9918 - DNA, 25 bp, Homo sapiens
tccagagttctctgtgcacttctgc

SEQ ID NO: 9919 - DNA, 25 bp, Homo sapiens
gttccgggggaagctgactcaaatc

SEQ ID NO: 9920 - DNA, 25 bp, Homo sapiens
tagggtttttctcgttgtaatattg

SEQ ID NO: 9921 - DNA, 25 bp, Homo sapiens
agttttgcatggcctggtgtgatca

SEQ ID NO: 9922 - DNA, 25 bp, Homo sapiens
aggggaagatactgctttagcctat

SEQ ID NO: 9923 - DNA, 25 bp, Homo sapiens
ctttagcctatcactccttatttta

SEQ ID NO: 9924 - DNA, 25 bp, Homo sapiens
atgccctcagtgtcttagggaactt

SEQ ID NO: 9925 - DNA, 25 bp, Homo sapiens
gatcctctgctaccaaacaatgatg

SEQ ID NO: 9926 - DNA, 25 bp, Homo sapiens
agactcctcaccaatactttatgtt

SEQ ID NO: 9927 - DNA, 25 bp, Homo sapiens
ggaaaataaacactaactgctgctt

SEQ ID NO: 9928 - DNA, 25 bp, Homo sapiens
aaacactaactgctgcttatggata

SEQ ID NO: 9929 - DNA, 25 bp, Homo sapiens
gcttatggataatgttgcaactact

SEQ ID NO: 9930 - DNA, 25 bp, Homo sapiens
gttgcaactacttgttatgcatata

SEQ ID NO: 9931 - DNA, 25 bp, Homo sapiens
tactttttcacatgtatagattgca

SEQ ID NO: 9932 - DNA, 25 bp, Homo sapiens
atagattgcatttcttaggtgtttt

SEQ ID NO: 9933 - DNA, 25 bp, Homo sapiens
atatatactggatcctatcgccttt

SEQ ID NO: 9934 - DNA, 25 bp, Homo sapiens
tactggatcctatcgccttttagta

SEQ ID NO: 9935 - DNA, 25 bp, Homo sapiens
gatcctatcgccttttagtagaata

SEQ ID NO: 9936 - DNA, 25 bp, Homo sapiens
taatagccatattctttattacttt

SEQ ID NO: 9937 - DNA, 25 bp, Homo sapiens
ctaaatccattagcagttacttccc

SEQ ID NO: 9938 - DNA, 25 bp, Homo sapiens
ttattggatatgggctgccatttcc

SEQ ID NO: 9939 - DNA, 25 bp, Homo sapiens
tttccaaaaaatcctgaccaacgtg

SEQ ID NO: 9940 - DNA, 25 bp, Homo sapiens
gaccaacgtggtgaccttctaatag

SEQ ID NO: 9941 - DNA, 25 bp, Homo sapiens
gaatttgaggtgtccttcccagata

SEQ ID NO: 9942 - DNA, 25 bp, Homo sapiens
gtgtccttcccagatactatatctt

SEQ ID NO: 9943 - DNA, 25 bp, Homo sapiens
taggaaacatcttcctgcctcatag

SEQ ID NO: 9944 - DNA, 25 bp, Homo sapiens
aggactggtagtttactgatgtaga

SEQ ID NO: 9945 - DNA, 25 bp, Homo sapiens
gaggacaaaattcttaccattgaga

SEQ ID NO: 9946 - DNA, 25 bp, Homo sapiens
aatagtattccagcagacattgttt

SEQ ID NO: 9947 - DNA, 25 bp, Homo sapiens
gtttacgagaggcattgtgtggctg

SEQ ID NO: 9948 - DNA, 25 bp, Homo sapiens
ggctgctcaattaatgtaccaacac

SEQ ID NO: 9949 - DNA, 25 bp, Homo sapiens
ccatagcaacaagtgacctgcccct

SEQ ID NO: 9950 - DNA, 25 bp, Homo sapiens
cctcagactcaagatcccagatacc

SEQ ID NO: 9951 - DNA, 25 bp, Homo sapiens
gagctggaggagtcatagggcatta

SEQ ID NO: 9952 - DNA, 25 bp, Homo sapiens
cagataattaaccccatgtgtccac

SEQ ID NO: 9953 - DNA, 25 bp, Homo sapiens
tccacccaggccaaagttcttcctg

SEQ ID NO: 9954 - DNA, 25 bp, Homo sapiens
gctaccccacagtggatgtccaggc

SEQ ID NO: 9955 - DNA, 25 bp, Homo sapiens
ggcagatggtccccacatgatgggg

SEQ ID NO: 9956 - DNA, 25 bp, Homo sapiens
gtgtggttttgtgggacttgttcat

SEQ ID NO: 9957 - DNA, 25 bp, Homo sapiens
gtagtgtgggctcaacagtgccaaa

SEQ ID NO: 9958 - DNA, 25 bp, Homo sapiens
tatagtggcacttccccagtatgga

SEQ ID NO: 9959 - DNA, 25 bp, Homo sapiens
ggagctatcagatgctctcatgact

SEQ ID NO: 9960 - DNA, 25 bp, Homo sapiens
aactgggacctcatacatgtgcaag

SEQ ID NO: 9961 - DNA, 25 bp, Homo sapiens
tgtgccgagggctatggaggggact

SEQ ID NO: 9962 - DNA, 25 bp, Homo sapiens
agtgtcaccatgggcagtgccacat

SEQ ID NO: 9963 - DNA, 25 bp, Homo sapiens
ctttagcggcgagcactgccaacaa

SEQ ID NO: 9964 - DNA, 25 bp, Homo sapiens
ctgccaacaagagaatccgtgcctg

SEQ ID NO: 9965 - DNA, 25 bp, Homo sapiens
caagtagtccgagaggtgatccgcc

SEQ ID NO: 9966 - DNA, 25 bp, Homo sapiens
aatgtcgtgggggctgtgggcccca

SEQ ID NO: 9967 - DNA, 25 bp, Homo sapiens
gaaatacgtcttccagtgcacggac

SEQ ID NO: 9968 - DNA, 25 bp, Homo sapiens
gagacacttagagtgcggctgcctc

SEQ ID NO: 9969 - DNA, 25 bp, Homo sapiens
cctctcggactccagcttgatggag

SEQ ID NO: 9970 - DNA, 25 bp, Homo sapiens
gaccccctggtgattcagcatgaag

SEQ ID NO: 9971 - DNA, 25 bp, Homo sapiens
ttcgcgttgaccaagttccttaaag

SEQ ID NO: 9972 - DNA, 25 bp, Homo sapiens
gagggccattggagcttgcagctca

SEQ ID NO: 9973 - DNA, 25 bp, Homo sapiens
tcagacccccactttgagttttatt

SEQ ID NO: 9974 - DNA, 25 bp, Homo sapiens
gtagttggatgcttggcacgtcgtc

SEQ ID NO: 9975 - DNA, 25 bp, Homo sapiens
aataggaaacccttgcctcatcagt

SEQ ID NO: 9976 - DNA, 25 bp, Homo sapiens
gcaaaggtggacaccattctccagc

SEQ ID NO: 9977 - DNA, 25 bp, Homo sapiens
ccagcttcaggggatatgctcgtcc

SEQ ID NO: 9978 - DNA, 25 bp, Homo sapiens
gcagctggccttctggactaaggca

SEQ ID NO: 9979 - DNA, 25 bp, Homo sapiens
gctacacacagagatctggcacccc

SEQ ID NO: 9980 - DNA, 25 bp, Homo sapiens
ttgggaaagcatggcaccctcagac

SEQ ID NO: 9981 - DNA, 25 bp, Homo sapiens
ctcagaccacacagtagccaagttc

SEQ ID NO: 9982 - DNA, 25 bp, Homo sapiens
tcttctgtgttccctttatttatgc

SEQ ID NO: 9983 - DNA, 25 bp, Homo sapiens
tatttatgctggtggcttccatccg

SEQ ID NO: 9984 - DNA, 25 bp, Homo sapiens
agttggtccttgactgtggcattgc

SEQ ID NO: 9985 - DNA, 25 bp, Homo sapiens
ctctgcactgtttctctctgcagac

SEQ ID NO: 9986 - DNA, 25 bp, Homo sapiens
ttctctctgcagacctaggggaaaa

SEQ ID NO: 9987 - DNA, 25 bp, Homo sapiens
ggaagtgcttttctactaaggcctc

SEQ ID NO: 9988 - DNA, 25 bp, Homo sapiens
tctactaaggcctcttactttgggg

SEQ ID NO: 9989 - DNA, 25 bp, Homo sapiens
gggggggatgtgccctacagaagac

SEQ ID NO: 9990 - DNA, 25 bp, Homo sapiens
gggtgcaagtctaacctgtctagca

SEQ ID NO: 9991 - DNA, 25 bp, Homo sapiens
acctgtctagcatgagatcttcttg

SEQ ID NO: 9992 - DNA, 25 bp, Homo sapiens
acttccacttagttgtaccgagcat

SEQ ID NO: 9993 - DNA, 25 bp, Homo sapiens
gcgcgcctgctgttgcagaggagaa

SEQ ID NO: 9994 - DNA, 25 bp, Homo sapiens
caagacactgagatgggcccatgcc

SEQ ID NO: 9995 - DNA, 25 bp, Homo sapiens
catgccgtagacatctggactcagt

SEQ ID NO: 9996 - DNA, 25 bp, Homo sapiens
gcaactccagactgaggtctaccga

SEQ ID NO: 9997 - DNA, 25 bp, Homo sapiens
taccgaggggctcaaacactctacg

SEQ ID NO: 9998 - DNA, 25 bp, Homo sapiens
acactctacgtgcccaattgtgacc

SEQ ID NO: 9999 - DNA, 25 bp, Homo sapiens
aattgtgaccatcgaggcttctacc

SEQ ID NO: 10000 - DNA, 25 bp, Homo sapiens
accggaagcggcagtgccgctcctc

SEQ ID NO: 10001 - DNA, 25 bp, Homo sapiens
gtggatcggatgggcaagtccctgc

SEQ ID NO: 10002 - DNA, 25 bp, Homo sapiens
ctgccccactgggagtagcggctaa

SEQ ID NO: 10003 - DNA, 25 bp, Homo sapiens
gaacatggagctgtcatcactcaac

SEQ ID NO: 10004 - DNA, 25 bp, Homo sapiens
ttccccatctgggccttcataaaat

SEQ ID NO: 10005 - DNA, 25 bp, Homo sapiens
atgcaggggaagccagactggtctc

SEQ ID NO: 10006 - DNA, 25 bp, Homo sapiens
tggtctcaggagcgctaaagccctt

SEQ ID NO: 10007 - DNA, 25 bp, Homo sapiens
gccctgctgtttaggacctgggacc

SEQ ID NO: 10008 - DNA, 25 bp, Homo sapiens
ctgggaccacaatggggtacctgcc

SEQ ID NO: 10009 - DNA, 25 bp, Homo sapiens
tccccaagagatccaggctgtcatg

SEQ ID NO: 10010 - DNA, 25 bp, Homo sapiens
gttggctacttgtgtcttgaaatct

SEQ ID NO: 10011 - DNA, 25 bp, Homo sapiens
agtggaagcccagtcttgagttctt

SEQ ID NO: 10012 - DNA, 25 bp, Homo sapiens
gagttcttgtcttgttaccatttaa

SEQ ID NO: 10013 - DNA, 25 bp, Homo sapiens
agtgggtcatgtttttgctgtggtg

SEQ ID NO: 10014 - DNA, 25 bp, Homo sapiens
gacacatggtacaggcttggagctt

SEQ ID NO: 10015 - DNA, 25 bp, Homo sapiens
gattccacatctcagagtttcctac

SEQ ID NO: 10016 - DNA, 25 bp, Homo sapiens
agaaatacgcagtgcctgtgctcag

SEQ ID NO: 10017 - DNA, 25 bp, Homo sapiens
gcagacaagcgtgttgcacctggtg

SEQ ID NO: 10018 - DNA, 25 bp, Homo sapiens
aacacaccttggtcatgttctacgc

SEQ ID NO: 10019 - DNA, 25 bp, Homo sapiens
cccttggtgcccacactgtaagaag

SEQ ID NO: 10020 - DNA, 25 bp, Homo sapiens
aagaaggtcattccgcactttactg

SEQ ID NO: 10021 - DNA, 25 bp, Homo sapiens
tgctactgctgatgccttcaaagat

SEQ ID NO: 10022 - DNA, 25 bp, Homo sapiens
tgaccgaaagattgcctgtgccgct

SEQ ID NO: 10023 - DNA, 25 bp, Homo sapiens
gacaagaaccaagacctgtgccagc

SEQ ID NO: 10024 - DNA, 25 bp, Homo sapiens
gacagcgaccgcacagaattgggat

SEQ ID NO: 10025 - DNA, 25 bp, Homo sapiens
tttaccaattatattcgagccctcc

SEQ ID NO: 10026 - DNA, 25 bp, Homo sapiens
gccgtgtaccagattgcgtggtcag

SEQ ID NO: 10027 - DNA, 25 bp, Homo sapiens
agctgacagtcggctcctggtcagc

SEQ ID NO: 10028 - DNA, 25 bp, Homo sapiens
ggtatatgctgttgactggagtcca

SEQ ID NO: 10029 - DNA, 25 bp, Homo sapiens
agatgagacggcccgaagttctctc

SEQ ID NO: 10030 - DNA, 25 bp, Homo sapiens
ggctgagatggcagtgcacacaccc

SEQ ID NO: 10031 - DNA, 25 bp, Homo sapiens
ggacctgagaatgcgtgtggcctgc

SEQ ID NO: 10032 - DNA, 25 bp, Homo sapiens
ctgctgtcctcgatagaccggaatg

SEQ ID NO: 10033 - DNA, 25 bp, Homo sapiens
gaagttgtcactgaacttggcccgt

SEQ ID NO: 10034 - DNA, 25 bp, Homo sapiens
ctgctactctgtaccttgctggtac

SEQ ID NO: 10035 - DNA, 25 bp, Homo sapiens
gcagccaggctctatgagtgggccc

SEQ ID NO: 10036 - DNA, 25 bp, Homo sapiens
tatgagtgggcccctagtgtcagct

SEQ ID NO: 10037 - DNA, 25 bp, Homo sapiens
tgtcagcacacatggaaagccccca

SEQ ID NO: 10038 - DNA, 25 bp, Homo sapiens
atggaaagcccccatttgcacagat

SEQ ID NO: 10039 - DNA, 25 bp, Homo sapiens
atatgcaattggtagcaccttagct

SEQ ID NO: 10040 - DNA, 25 bp, Homo sapiens
caccttagctaattaatctgcatat

SEQ ID NO: 10041 - DNA, 25 bp, Homo sapiens
gagttgatgtttcattccatttgtt

SEQ ID NO: 10042 - DNA, 25 bp, Homo sapiens
aaatgcactctcacagtggagttga

SEQ ID NO: 10043 - DNA, 25 bp, Homo sapiens
gatacatgtgggcctgttagtcttc

SEQ ID NO: 10044 - DNA, 25 bp, Homo sapiens
gttagtcttcgaagcttccagatgg

SEQ ID NO: 10045 - DNA, 25 bp, Homo sapiens
gcttccagatggtttgtgttttgag

SEQ ID NO: 10046 - DNA, 25 bp, Homo sapiens
tatcttcttaagtaaatgctctcat

SEQ ID NO: 10047 - DNA, 25 bp, Homo sapiens
tgctctcataacttgtatacatttt

SEQ ID NO: 10048 - DNA, 25 bp, Homo sapiens
atgaagctctggaggcagggctccg

SEQ ID NO: 10049 - DNA, 25 bp, Homo sapiens
cttcctggccaagatgcacatcttc

SEQ ID NO: 10050 - DNA, 25 bp, Homo sapiens
cgtgggagggactgggtcactattg

SEQ ID NO: 10051 - DNA, 25 bp, Homo sapiens
gggtcactattgtggtttttactat

SEQ ID NO: 10052 - DNA, 25 bp, Homo sapiens
taattttgctgacttgactcctgtg

SEQ ID NO: 10053 - DNA, 25 bp, Homo sapiens
ccgcaggaggaagttccacggcagg

SEQ ID NO: 10054 - DNA, 25 bp, Homo sapiens
aagttccacggcaggtggtgcgttc

SEQ ID NO: 10055 - DNA, 25 bp, Homo sapiens
aagtggaagcttgcacggtgggcca

SEQ ID NO: 10056 - DNA, 25 bp, Homo sapiens
aggctgggtgatgacctgaggacca

SEQ ID NO: 10057 - DNA, 25 bp, Homo sapiens
agagacacgcgaccatgttggggct

SEQ ID NO: 10058 - DNA, 25 bp, Homo sapiens
ccatttcatgttccactgtgattaa

SEQ ID NO: 10059 - DNA, 25 bp, Homo sapiens
tcaccctagtctcaggcacaggagc

SEQ ID NO: 10060 - DNA, 25 bp, Homo sapiens
ggctgaccagaactgcacgcaagag

SEQ ID NO: 10061 - DNA, 25 bp, Homo sapiens
agagtgcgtctcggacagcgaatgc

SEQ ID NO: 10062 - DNA, 25 bp, Homo sapiens
gccttctctgccccaatgataagga

SEQ ID NO: 10063 - DNA, 25 bp, Homo sapiens
cagtgccaggtggacacgcagtgtc

SEQ ID NO: 10064 - DNA, 25 bp, Homo sapiens
cacgcagtgtcctggccagatgaaa

SEQ ID NO: 10065 - DNA, 25 bp, Homo sapiens
gaaatgctgccgcaatggctgtggg

SEQ ID NO: 10066 - DNA, 25 bp, Homo sapiens
tgggaaggtgtcctgtgtcactccc

SEQ ID NO: 10067 - DNA, 25 bp, Homo sapiens
cactcccaatttctgaggtccagcc

SEQ ID NO: 10068 - DNA, 25 bp, Homo sapiens
ggagagaaagtttctgcctggccct

SEQ ID NO: 10069 - DNA, 25 bp, Homo sapiens
ctgtattccctcttggggtgaccac

SEQ ID NO: 10070 - DNA, 25 bp, Homo sapiens
ttagtttctttgctctacgtgggca

SEQ ID NO: 10071 - DNA, 25 bp, Homo sapiens
ggagtaccttattatcctacatcgc

SEQ ID NO: 10072 - DNA, 25 bp, Homo sapiens
acatcgcaaatttcaacagctacat

SEQ ID NO: 10073 - DNA, 25 bp, Homo sapiens
gctacattatatttccttctgacac

SEQ ID NO: 10074 - DNA, 25 bp, Homo sapiens
gaaatgtatccttctcacaaagtag

SEQ ID NO: 10075 - DNA, 25 bp, Homo sapiens
gattctccttggcagtgaactactt

SEQ ID NO: 10076 - DNA, 25 bp, Homo sapiens
atgggttgttgctgccatgagcatg

SEQ ID NO: 10077 - DNA, 25 bp, Homo sapiens
gagcatgtacaacctctggagctag

SEQ ID NO: 10078 - DNA, 25 bp, Homo sapiens
ctcctcaggaaagccagttctccaa

SEQ ID NO: 10079 - DNA, 25 bp, Homo sapiens
ccaagttcttaacctgtggcactga

SEQ ID NO: 10080 - DNA, 25 bp, Homo sapiens
gaatgttgagttacctcttcatgtt

SEQ ID NO: 10081 - DNA, 25 bp, Homo sapiens
tgtgtaatacgccaaccagtcaagt

SEQ ID NO: 10082 - DNA, 25 bp, Homo sapiens
accagtcaagttgtgttttggccag

SEQ ID NO: 10083 - DNA, 25 bp, Homo sapiens
gatatgtccaatttcctggctcatt

SEQ ID NO: 10084 - DNA, 25 bp, Homo sapiens
ggctcatttcattgtgctctatggg

SEQ ID NO: 10085 - DNA, 25 bp, Homo sapiens
gcaactcagggctaaagtcatccag

SEQ ID NO: 10086 - DNA, 25 bp, Homo sapiens
gagccagaagtaactttgtcccagt

SEQ ID NO: 10087 - DNA, 25 bp, Homo sapiens
actttgtcccagtcctacaatgtga

SEQ ID NO: 10088 - DNA, 25 bp, Homo sapiens
gaatagttgcctctttttagccatt

SEQ ID NO: 10089 - DNA, 25 bp, Homo sapiens
atattcgtacgcattacttttcaga

SEQ ID NO: 10090 - DNA, 25 bp, Homo sapiens
atacgcactttcagatattcttatt

SEQ ID NO: 10091 - DNA, 25 bp, Homo sapiens
gaagctttctattgtgacttttatg

SEQ ID NO: 10092 - DNA, 25 bp, Homo sapiens
tgtcgggttactgacctcactttat

SEQ ID NO: 10093 - DNA, 25 bp, Homo sapiens
gtaactcgtctatttcagcatgcat

SEQ ID NO: 10094 - DNA, 25 bp, Homo sapiens
gagtcaactaaatctgccttcatac

SEQ ID NO: 10095 - DNA, 25 bp, Homo sapiens
agcctgctgtgcttacatcagcatc

SEQ ID NO: 10096 - DNA, 25 bp, Homo sapiens
ctctcctctaatctgtgtacacatc

SEQ ID NO: 10097 - DNA, 25 bp, Homo sapiens
tctgctcagacgcctatgaaacacc

SEQ ID NO: 10098 - DNA, 25 bp, Homo sapiens
acagtctgagttaccatcatgcaca

SEQ ID NO: 10099 - DNA, 25 bp, Homo sapiens
ggaacctacgcgtttgaatggcttg

SEQ ID NO: 10100 - DNA, 25 bp, Homo sapiens
tggcttgaacgttgcatcttttaaa

SEQ ID NO: 10101 - DNA, 25 bp, Homo sapiens
ggtttcttggcatttatcctagttg

SEQ ID NO: 10102 - DNA, 25 bp, Homo sapiens
atcctagttgtccgtgtttggcaat

SEQ ID NO: 10103 - DNA, 25 bp, Homo sapiens
cctctctgggcatgtctgctacaaa

SEQ ID NO: 10104 - DNA, 25 bp, Homo sapiens
tgaagactgtgattacatgcacctg

SEQ ID NO: 10105 - DNA, 25 bp, Homo sapiens
cacatgacagacaagtaaccccctc

SEQ ID NO: 10106 - DNA, 25 bp, Homo sapiens
ctccaggccaagagtctcagctggc

SEQ ID NO: 10107 - DNA, 25 bp, Homo sapiens
ctcagctggccgagagtccaggcct

SEQ ID NO: 10108 - DNA, 25 bp, Homo sapiens
tcccccgaccgccatggagggggca

SEQ ID NO: 10109 - DNA, 25 bp, Homo sapiens
agcccttgtgtgtctggtcacactt

SEQ ID NO: 10110 - DNA, 25 bp, Homo sapiens
tctggtcacactttttaggcgtcac

SEQ ID NO: 10111 - DNA, 25 bp, Homo sapiens
ttaggcgtcacgccaaaggccagcc

SEQ ID NO: 10112 - DNA, 25 bp, Homo sapiens
ctggccccaatacccattttggaag

SEQ ID NO: 10113 - DNA, 25 bp, Homo sapiens
ccctgtggccgtgtggatgtcggta

SEQ ID NO: 10114 - DNA, 25 bp, Homo sapiens
gactcttcggtgcagttgttggccg

SEQ ID NO: 10115 - DNA, 25 bp, Homo sapiens
tgacgctggacatgttggacctggg

SEQ ID NO: 10116 - DNA, 25 bp, Homo sapiens
ggacctgggggcagccaaggcaaac

SEQ ID NO: 10117 - DNA, 25 bp, Homo sapiens
gatccagatccgaatcgaggccaac

SEQ ID NO: 10118 - DNA, 25 bp, Homo sapiens
caacgaggccctggtgaaggccctg

SEQ ID NO: 10119 - DNA, 25 bp, Homo sapiens
cctggagtaggcggtgcgtacccgg

SEQ ID NO: 10120 - DNA, 25 bp, Homo sapiens
gctgggcagggatgccaggtgggcc

SEQ ID NO: 10121 - DNA, 25 bp, Homo sapiens
gccaccagagggcagtgcaggcttc

SEQ ID NO: 10122 - DNA, 25 bp, Homo sapiens
cctgcctgtgttgaaagctctgggg

SEQ ID NO: 10123 - DNA, 25 bp, Homo sapiens
tggggactgggccagggaagctcct

SEQ ID NO: 10124 - DNA, 25 bp, Homo sapiens
tcagctttgagctgtggctgccacc

SEQ ID NO: 10125 - DNA, 25 bp, Homo sapiens
gagtccagtcgaagattgggtccct

SEQ ID NO: 10126 - DNA, 25 bp, Homo sapiens
tccctggacaatatcacccacgtcc

SEQ ID NO: 10127 - DNA, 25 bp, Homo sapiens
aagacagaccacggggcggagatcg

SEQ ID NO: 10128 - DNA, 25 bp, Homo sapiens
cggagatcgtgtacaagtcgccagt

SEQ ID NO: 10129 - DNA, 25 bp, Homo sapiens
agtcgccagtggtgtctggggacac

SEQ ID NO: 10130 - DNA, 25 bp, Homo sapiens
tccaccggcagcatcgacatggtag

SEQ ID NO: 10131 - DNA, 25 bp, Homo sapiens
gctagctgacgaggtgtctgcctcc

SEQ ID NO: 10132 - DNA, 25 bp, Homo sapiens
gcctccctggccaagcagggtttgt

SEQ ID NO: 10133 - DNA, 25 bp, Homo sapiens
tgtgatcaggcccctggggcggtca

SEQ ID NO: 10134 - DNA, 25 bp, Homo sapiens
gctcctcgcagttcggttaattggt

SEQ ID NO: 10135 - DNA, 25 bp, Homo sapiens
atcacttaacctgcttttgtcactc

SEQ ID NO: 10136 - DNA, 25 bp, Homo sapiens
gatccaggatgtcgggcttgtgccg

SEQ ID NO: 10137 - DNA, 25 bp, Homo sapiens
cgatgggtggtgtgatgtctggggc

SEQ ID NO: 10138 - DNA, 25 bp, Homo sapiens
gaggcggtggaagaagatatcccca

SEQ ID NO: 10139 - DNA, 25 bp, Homo sapiens
agatatccccatagcgaaagaacgg

SEQ ID NO: 10140 - DNA, 25 bp, Homo sapiens
agaacggacacatttcaccgtccgc

SEQ ID NO: 10141 - DNA, 25 bp, Homo sapiens
ccgaggcgaagcccgtggacaaagt

SEQ ID NO: 10142 - DNA, 25 bp, Homo sapiens
ctacatccaaggcatcaacctcgtc

SEQ ID NO: 10143 - DNA, 25 bp, Homo sapiens
ccctgccccaggaaatcaaagccaa

SEQ ID NO: 10144 - DNA, 25 bp, Homo sapiens
aagccaatgtcgccaaagctgaggc

SEQ ID NO: 10145 - DNA, 25 bp, Homo sapiens
ccagctcggaggacttgtgttcagg

SEQ ID NO: 10146 - DNA, 25 bp, Homo sapiens
gccgcacagacctactgtggcggga

SEQ ID NO: 10147 - DNA, 25 bp, Homo sapiens
ctaagtcccaccataacagctaagg

SEQ ID NO: 10148 - DNA, 25 bp, Homo sapiens
tgggagatgatggctcatttccacc

SEQ ID NO: 10149 - DNA, 25 bp, Homo sapiens
acatccacaggcctggacctgggat

SEQ ID NO: 10150 - DNA, 25 bp, Homo sapiens
ggatgtagtttggctcaggtgtccc

SEQ ID NO: 10151 - DNA, 25 bp, Homo sapiens
gtgtccctgcagttggcaaggagtc

SEQ ID NO: 10152 - DNA, 25 bp, Homo sapiens
gcaaggagtcagtactcagtccctg

SEQ ID NO: 10153 - DNA, 25 bp, Homo sapiens
aatttgaggtcctggctgagccaag

SEQ ID NO: 10154 - DNA, 25 bp, Homo sapiens
aatggaccagatctacctcagtatt

SEQ ID NO: 10155 - DNA, 25 bp, Homo sapiens
ggacaccagtggcttcaaacttcct

SEQ ID NO: 10156 - DNA, 25 bp, Homo sapiens
aacttcctggtttcatgatatcttg

SEQ ID NO: 10157 - DNA, 25 bp, Homo sapiens
gatatcttgagacgccttacaaatg

SEQ ID NO: 10158 - DNA, 25 bp, Homo sapiens
cagtgatcagtcgcctcagtaaagc

SEQ ID NO: 10159 - DNA, 25 bp, Homo sapiens
tggatggggagcctacgggtggtaa

SEQ ID NO: 10160 - DNA, 25 bp, Homo sapiens
catggcccctaggcgaggtgatcag

SEQ ID NO: 10161 - DNA, 25 bp, Homo sapiens
tgctcctgaccttgattaacttaac

SEQ ID NO: 10162 - DNA, 25 bp, Homo sapiens
gaagggacactttcaggacccagtc

SEQ ID NO: 10163 - DNA, 25 bp, Homo sapiens
gacccagtccactgtatggcatttg

SEQ ID NO: 10164 - DNA, 25 bp, Homo sapiens
tatgcactgacatgaccctgggtga

SEQ ID NO: 10165 - DNA, 25 bp, Homo sapiens
cgccagccctgcagtattgatgtgc

SEQ ID NO: 10166 - DNA, 25 bp, Homo sapiens
gtgcagtattgcaccacagctctgc

SEQ ID NO: 10167 - DNA, 25 bp, Homo sapiens
tccttttttctgtttgcactgtttg

SEQ ID NO: 10168 - DNA, 25 bp, Homo sapiens
gatgttagctaattccactgtgtat

SEQ ID NO: 10169 - DNA, 25 bp, Homo sapiens
tggagagagcagactggcggggggc

SEQ ID NO: 10170 - DNA, 25 bp, Homo sapiens
ccctccgctctgtagtgctacaggg

SEQ ID NO: 10171 - DNA, 25 bp, Homo sapiens
agtgctacagggtccaacatagaac

SEQ ID NO: 10172 - DNA, 25 bp, Homo sapiens
aacagcgcccaaaggacgcactgag

SEQ ID NO: 10173 - DNA, 25 bp, Homo sapiens
actgagcaacgctattccagctgtc

SEQ ID NO: 10174 - DNA, 25 bp, Homo sapiens
ccccattcccgcagtgggagcaaac

SEQ ID NO: 10175 - DNA, 25 bp, Homo sapiens
gtgggagcaaactgcatgcccagag

SEQ ID NO: 10176 - DNA, 25 bp, Homo sapiens
ccagcggacacacgcggtttggttt

SEQ ID NO: 10177 - DNA, 25 bp, Homo sapiens
gtttggtttgcagcgactggcatac

SEQ ID NO: 10178 - DNA, 25 bp, Homo sapiens
acgcacacaactactacaattccgc

SEQ ID NO: 10179 - DNA, 25 bp, Homo sapiens
acaattccgcctaggtccacaaggc

SEQ ID NO: 10180 - DNA, 25 bp, Homo sapiens
gatgatgcagattgactgtcaggtg

SEQ ID NO: 10181 - DNA, 25 bp, Homo sapiens
gacaccaggatcctccatatcaaaa

SEQ ID NO: 10182 - DNA, 25 bp, Homo sapiens
tatcaaaagttcgtcggttcctcct

SEQ ID NO: 10183 - DNA, 25 bp, Homo sapiens
ctccttacctccgagatcagcagag

SEQ ID NO: 10184 - DNA, 25 bp, Homo sapiens
tcaaaccaacaccttctttggctcc

SEQ ID NO: 10185 - DNA, 25 bp, Homo sapiens
gcaccatccctgagtcattacaata

SEQ ID NO: 10186 - DNA, 25 bp, Homo sapiens
agcacccgcagctatgtggaaaact

SEQ ID NO: 10187 - DNA, 25 bp, Homo sapiens
gggacccccagactgaagagcaggt

SEQ ID NO: 10188 - DNA, 25 bp, Homo sapiens
gtgagcaaaatgctgcttttccttg

SEQ ID NO: 10189 - DNA, 25 bp, Homo sapiens
gtggcaggcagagaactgttcgtac

SEQ ID NO: 10190 - DNA, 25 bp, Homo sapiens
caatgtttcttcagtggcaaatgta

SEQ ID NO: 10191 - DNA, 25 bp, Homo sapiens
cagccatgtccatgggcctggagat

SEQ ID NO: 10192 - DNA, 25 bp, Homo sapiens
agcaacatcatcacgtcgcagaaca

SEQ ID NO: 10193 - DNA, 25 bp, Homo sapiens
aacatcatcacgtcgcagaacatct

SEQ ID NO: 10194 - DNA, 25 bp, Homo sapiens
catcatcacgtcgcagaacatctgg

SEQ ID NO: 10195 - DNA, 25 bp, Homo sapiens
tcatcacgtcgcagaacatctggga

SEQ ID NO: 10196 - DNA, 25 bp, Homo sapiens
tcacgtcgcagaacatctgggaggg

SEQ ID NO: 10197 - DNA, 25 bp, Homo sapiens
caggacgacacggccaaggccaaga

SEQ ID NO: 10198 - DNA, 25 bp, Homo sapiens
acgacacggccaaggccaagatcac

SEQ ID NO: 10199 - DNA, 25 bp, Homo sapiens
aaggccaagatcaccatcgtggcag

SEQ ID NO: 10200 - DNA, 25 bp, Homo sapiens
ggccaagatcaccatcgtggcaggc

SEQ ID NO: 10201 - DNA, 25 bp, Homo sapiens
caagatcaccatcgtggcaggcgtg

SEQ ID NO: 10202 - DNA, 25 bp, Homo sapiens
cccagggaccaacctgcatggactg

SEQ ID NO: 10203 - DNA, 25 bp, Homo sapiens
tgcatggactgtgaaacctcaccct

SEQ ID NO: 10204 - DNA, 25 bp, Homo sapiens
accggcagccctggaaggggcactt

SEQ ID NO: 10205 - DNA, 25 bp, Homo sapiens
tgcccgaggcgcagaagcgcgagat

SEQ ID NO: 10206 - DNA, 25 bp, Homo sapiens
agaagcgcgagatgggcgcgggcct

SEQ ID NO: 10207 - DNA, 25 bp, Homo sapiens
gtcccccacgcgagaagaagtacac

SEQ ID NO: 10208 - DNA, 25 bp, Homo sapiens
agaagaagtacacggccaccaaggt

SEQ ID NO: 10209 - DNA, 25 bp, Homo sapiens
gccagcctgggcacaggctacgacc

SEQ ID NO: 10210 - DNA, 25 bp, Homo sapiens
gctacgaccgcaaggactacgtcta

SEQ ID NO: 10211 - DNA, 25 bp, Homo sapiens
gcaaggactacgtctaagggacaga

SEQ ID NO: 10212 - DNA, 25 bp, Homo sapiens
aagggacagacgcagggagacccca

SEQ ID NO: 10213 - DNA, 25 bp, Homo sapiens
gatgcaacagatatatagccctttc

SEQ ID NO: 10214 - DNA, 25 bp, Homo sapiens
atatatagccctttcaagtcatgtt

SEQ ID NO: 10215 - DNA, 25 bp, Homo sapiens
tgttgtgtttggacttggggttgga

SEQ ID NO: 10216 - DNA, 25 bp, Homo sapiens
tggggttggaacagggagagcagca

SEQ ID NO: 10217 - DNA, 25 bp, Homo sapiens
gccatgtcagctacacgctcaaatg

SEQ ID NO: 10218 - DNA, 25 bp, Homo sapiens
ggtaggggagttggcattgttgata

SEQ ID NO: 10219 - DNA, 25 bp, Homo sapiens
ttgttgataaagccagtcccttcat

SEQ ID NO: 10220 - DNA, 25 bp, Homo sapiens
gtcccttcatttaactgtctttcag

SEQ ID NO: 10221 - DNA, 25 bp, Homo sapiens
tcaggatgttccttcgttgtttcca

SEQ ID NO: 10222 - DNA, 25 bp, Homo sapiens
cacctcttttcaagtccttacattt

SEQ ID NO: 10223 - DNA, 25 bp, Homo sapiens
gaaactgccacatttttgctatcat

SEQ ID NO: 10224 - DNA, 25 bp, Homo sapiens
acttaccaccactaaactgcgagag

SEQ ID NO: 10225 - DNA, 25 bp, Homo sapiens
ggtagctttttctacatcttactcc

SEQ ID NO: 10226 - DNA, 25 bp, Homo sapiens
atcttactcctgttgatgcagctaa

SEQ ID NO: 10227 - DNA, 25 bp, Homo sapiens
ccagacttttcagacaaaccctttg

SEQ ID NO: 10228 - DNA, 25 bp, Homo sapiens
gagcatgctcacttttttatattaa

SEQ ID NO: 10229 - DNA, 25 bp, Homo sapiens
aagcggcgcaaccaggagatgcagc

SEQ ID NO: 10230 - DNA, 25 bp, Homo sapiens
ggacagcagactgccggtaacgcgc

SEQ ID NO: 10231 - DNA, 25 bp, Homo sapiens
gggcgggagagactcagcaacgacc

SEQ ID NO: 10232 - DNA, 25 bp, Homo sapiens
tgcccgctgcagtttcttgggacat

SEQ ID NO: 10233 - DNA, 25 bp, Homo sapiens
gcagtttcttgggacataggagcgc

SEQ ID NO: 10234 - DNA, 25 bp, Homo sapiens
agaagctacagcctggacttaccac

SEQ ID NO: 10235 - DNA, 25 bp, Homo sapiens
atctgccaggcgttgttatgtgcta

SEQ ID NO: 10236 - DNA, 25 bp, Homo sapiens
gggtagcaagtacgtctttgtctta

SEQ ID NO: 10237 - DNA, 25 bp, Homo sapiens
catggaagtcagttgcgggggcagc

SEQ ID NO: 10238 - DNA, 25 bp, Homo sapiens
gtgagtggggttgggcataggctga

SEQ ID NO: 10239 - DNA, 25 bp, Homo sapiens
gtggcctgaatgacacctcttagag

SEQ ID NO: 10240 - DNA, 25 bp, Homo sapiens
tgaagtacaggcacagcccgactgc

SEQ ID NO: 10241 - DNA, 25 bp, Homo sapiens
agggagggatgcacccatcatttac

SEQ ID NO: 10242 - DNA, 25 bp, Homo sapiens
tgggagcatctgtaggaccatctct

SEQ ID NO: 10243 - DNA, 25 bp, Homo sapiens
ggccagatggactgtcctacagcaa

SEQ ID NO: 10244 - DNA, 25 bp, Homo sapiens
acagcaatcgtttccatctgtcacc

SEQ ID NO: 10245 - DNA, 25 bp, Homo sapiens
ctttcataccagtcactatcttggg

SEQ ID NO: 10246 - DNA, 25 bp, Homo sapiens
gtgctttttgttataggatcccttc

SEQ ID NO: 10247 - DNA, 25 bp, Homo sapiens
agatggcatgcacctaggggaataa

SEQ ID NO: 10248 - DNA, 25 bp, Homo sapiens
ataaaaggtcacctcagacaccagg

SEQ ID NO: 10249 - DNA, 25 bp, Homo sapiens
tgcacctgaaggctgcgtgcacctt

SEQ ID NO: 10250 - DNA, 25 bp, Homo sapiens
agacaggactggaccagatgctcct

SEQ ID NO: 10251 - DNA, 25 bp, Homo sapiens
tgtaaacatccaggggtgtgccagg

SEQ ID NO: 10252 - DNA, 25 bp, Homo sapiens
accctcacaactgcttgttcaggta

SEQ ID NO: 10253 - DNA, 25 bp, Homo sapiens
tcaggtatcgtgatgggccactcgg

SEQ ID NO: 10254 - DNA, 25 bp, Homo sapiens
ccactcggtccaaaatcagccaggc

SEQ ID NO: 10255 - DNA, 25 bp, Homo sapiens
aaatcagccaggccatcttttccat

SEQ ID NO: 10256 - DNA, 25 bp, Homo sapiens
cttttccatcatctcacttcaaata

SEQ ID NO: 10257 - DNA, 25 bp, Homo sapiens
ggcaacaggtcctgtcagagctcca

SEQ ID NO: 10258 - DNA, 25 bp, Homo sapiens
ccccagcctttggaggtggcagttc

SEQ ID NO: 10259 - DNA, 25 bp, Homo sapiens
tttggaggtggcagttctgtggctg

SEQ ID NO: 10260 - DNA, 25 bp, Homo sapiens
tctgtggctggttttggtagtccgg

SEQ ID NO: 10261 - DNA, 25 bp, Homo sapiens
cattctcacactgctttttctaagc

SEQ ID NO: 10262 - DNA, 25 bp, Homo sapiens
taagccatccagtgacacttttgga

SEQ ID NO: 10263 - DNA, 25 bp, Homo sapiens
tctgtcagcctcaagcagcatcatt

SEQ ID NO: 10264 - DNA, 25 bp, Homo sapiens
gcctcaagcagcatcattgcaacag

SEQ ID NO: 10265 - DNA, 25 bp, Homo sapiens
agataatgtgttattcacacccaga

SEQ ID NO: 10266 - DNA, 25 bp, Homo sapiens
aattgctttgagtgattcatacaga

SEQ ID NO: 10267 - DNA, 25 bp, Homo sapiens
gaatataagcttccatcaatagtga

SEQ ID NO: 10268 - DNA, 25 bp, Homo sapiens
ttgaaagttgtgggtcagctgacca

SEQ ID NO: 10269 - DNA, 25 bp, Homo sapiens
ggtcagctgaccaggtagaggattc

SEQ ID NO: 10270 - DNA, 25 bp, Homo sapiens
tagaggattcaagactcaatgtgga

SEQ ID NO: 10271 - DNA, 25 bp, Homo sapiens
gaatgttaatggtcaatgctagcac

SEQ ID NO: 10272 - DNA, 25 bp, Homo sapiens
gctagcacaatattcctatgctgca

SEQ ID NO: 10273 - DNA, 25 bp, Homo sapiens
agcattatccttttatctcacaaat

SEQ ID NO: 10274 - DNA, 25 bp, Homo sapiens
tagataatgcctttttggttttgtg

SEQ ID NO: 10275 - DNA, 25 bp, Homo sapiens
ggttttgtgtggtattcaactaata

SEQ ID NO: 10276 - DNA, 25 bp, Homo sapiens
gtttaaagtcacagccgtttgaata

SEQ ID NO: 10277 - DNA, 25 bp, Homo sapiens
cttggtagtacattttctcccttag

SEQ ID NO: 10278 - DNA, 25 bp, Homo sapiens
tctcccttaggaatatacatagtct

SEQ ID NO: 10279 - DNA, 25 bp, Homo sapiens
tgagcaagtcaaccccaatctggaa

SEQ ID NO: 10280 - DNA, 25 bp, Homo sapiens
caatctggaacaatgtccctcctct

SEQ ID NO: 10281 - DNA, 25 bp, Homo sapiens
gaatttccactttccaggtagatga

SEQ ID NO: 10282 - DNA, 25 bp, Homo sapiens
tttcacactgccttcaggccagaag

SEQ ID NO: 10283 - DNA, 25 bp, Homo sapiens
ttgtgactcatcttttactggtttg

SEQ ID NO: 10284 - DNA, 25 bp, Homo sapiens
gatacctgccttgtacttagtacct

SEQ ID NO: 10285 - DNA, 25 bp, Homo sapiens
ttaggcgagtaccatttgcacaatc

SEQ ID NO: 10286 - DNA, 25 bp, Homo sapiens
acccttacctactaggtatcctgct

SEQ ID NO: 10287 - DNA, 25 bp, Homo sapiens
tatcctgctagggttttcaattcca

SEQ ID NO: 10288 - DNA, 25 bp, Homo sapiens
agtaatcagtcaatccaatatcccc

SEQ ID NO: 10289 - DNA, 25 bp, Homo sapiens
atcccccatctttgtcttgaaacaa

SEQ ID NO: 10290 - DNA, 25 bp, Homo sapiens
aatttattttgcttctgtggttgta

SEQ ID NO: 10291 - DNA, 25 bp, Homo sapiens
atgctgttgctaaaggtggcgcaga

SEQ ID NO: 10292 - DNA, 25 bp, Homo sapiens
gcttaatgtccagtgattggccttt

SEQ ID NO: 10293 - DNA, 25 bp, Homo sapiens
ttggcctttgcttcttaatttattt

SEQ ID NO: 10294 - DNA, 25 bp, Homo sapiens
taattttttacttgtgccacttaat

SEQ ID NO: 10295 - DNA, 25 bp, Homo sapiens
ttttcattcttcactgtagttttaa

SEQ ID NO: 10296 - DNA, 25 bp, Homo sapiens
tacatgcctgcctcgtagtgaagtt

SEQ ID NO: 10297 - DNA, 25 bp, Homo sapiens
gaagttgtagctctccgtaatatgt

SEQ ID NO: 10298 - DNA, 25 bp, Homo sapiens
gaatgttgactacctgaagttcctt

SEQ ID NO: 10299 - DNA, 25 bp, Homo sapiens
gaagttcctttttagatgtgctatt

SEQ ID NO: 10300 - DNA, 25 bp, Homo sapiens
gttggattcagagggttccttgaaa

SEQ ID NO: 10301 - DNA, 25 bp, Homo sapiens
aggttaccatcactggatctgctgc

SEQ ID NO: 10302 - DNA, 25 bp, Homo sapiens
tctgctgccagcattagcctggctc

SEQ ID NO: 10303 - DNA, 25 bp, Homo sapiens
agcctggctcaatatctaatcaatg

SEQ ID NO: 10304 - DNA, 25 bp, Homo sapiens
tcaatgtcaggctttcctcggagac

SEQ ID NO: 10305 - DNA, 25 bp, Homo sapiens
ttcctcggagacgggtggcatgggg

SEQ ID NO: 10306 - DNA, 25 bp, Homo sapiens
agattcatccataatccctttctgc

SEQ ID NO: 10307 - DNA, 25 bp, Homo sapiens
gaacagtcagcgattccaggtttta

SEQ ID NO: 10308 - DNA, 25 bp, Homo sapiens
gatgcatctgctcagactacttctc

SEQ ID NO: 10309 - DNA, 25 bp, Homo sapiens
agactacttctcatgaactcaccat

SEQ ID NO: 10310 - DNA, 25 bp, Homo sapiens
aatcgggcgtcaaggcgccaaaatc

SEQ ID NO: 10311 - DNA, 25 bp, Homo sapiens
gagatccgtcagatgtctggggcgc

SEQ ID NO: 10312 - DNA, 25 bp, Homo sapiens
tgatctcacttctgtcagatgctcc

SEQ ID NO: 10313 - DNA, 25 bp, Homo sapiens
gatgctcccatccactattaatgca

SEQ ID NO: 10314 - DNA, 25 bp, Homo sapiens
agagggcggcaatgacactgcacct

SEQ ID NO: 10315 - DNA, 25 bp, Homo sapiens
gcccaggctgacttacacattgagg

SEQ ID NO: 10316 - DNA, 25 bp, Homo sapiens
tgtcaccttcgtcctgaatgaccac

SEQ ID NO: 10317 - DNA, 25 bp, Homo sapiens
catggccttcactggagatgccctg

SEQ ID NO: 10318 - DNA, 25 bp, Homo sapiens
caggagactgtctgatctaccctgc

SEQ ID NO: 10319 - DNA, 25 bp, Homo sapiens
ttaccatgggttcacagtgtccacc

SEQ ID NO: 10320 - DNA, 25 bp, Homo sapiens
gaggagaggactctgaaccctcggc

SEQ ID NO: 10321 - DNA, 25 bp, Homo sapiens
gcagatagactttgctgttccagcc

SEQ ID NO: 10322 - DNA, 25 bp, Homo sapiens
gttccagccaacatgcgctgtgggg

SEQ ID NO: 10323 - DNA, 25 bp, Homo sapiens
gggtccatctgtagcaaatgggttg

SEQ ID NO: 10324 - DNA, 25 bp, Homo sapiens
ctgtgtattcgccaggaatcacccc

SEQ ID NO: 10325 - DNA, 25 bp, Homo sapiens
ccgataggctgccaccctattaggt

SEQ ID NO: 10326 - DNA, 25 bp, Homo sapiens
gtagttgcatcagtttgctgtaaca

SEQ ID NO: 10327 - DNA, 25 bp, Homo sapiens
gtggtgaagcaggtcaggggaggtc

SEQ ID NO: 10328 - DNA, 25 bp, Homo sapiens
gaagtccgggagatgaatggctgtc

SEQ ID NO: 10329 - DNA, 25 bp, Homo sapiens
atggctgtctaggaaggaggatgtc

SEQ ID NO: 10330 - DNA, 25 bp, Homo sapiens
ggaggatgtcagtgcacggttagtg

SEQ ID NO: 10331 - DNA, 25 bp, Homo sapiens
gtttgagcagagggcagacttgtaa

SEQ ID NO: 10332 - DNA, 25 bp, Homo sapiens
atgtggggacccgattagcagaaag

SEQ ID NO: 10333 - DNA, 25 bp, Homo sapiens
gaacgtggacttttacacatgtgca

SEQ ID NO: 10334 - DNA, 25 bp, Homo sapiens
tttaggcagatcctctgctgccagc

SEQ ID NO: 10335 - DNA, 25 bp, Homo sapiens
tcaaccacaccatcttggctggagt

SEQ ID NO: 10336 - DNA, 25 bp, Homo sapiens
ggagttcacagcaatgaccactctg

SEQ ID NO: 10337 - DNA, 25 bp, Homo sapiens
gagatgaggaaccagccgtcctctc

SEQ ID NO: 10338 - DNA, 25 bp, Homo sapiens
ttggaggataaacagcctcccccta

SEQ ID NO: 10339 - DNA, 25 bp, Homo sapiens
cccctacccaattgccagggcaagg

SEQ ID NO: 10340 - DNA, 25 bp, Homo sapiens
tgacagtatttgttcctggacccca

SEQ ID NO: 10341 - DNA, 25 bp, Homo sapiens
tagcttatgtgacaaccctcatctt

SEQ ID NO: 10342 - DNA, 25 bp, Homo sapiens
atccccatcccttctgaaagtagga

SEQ ID NO: 10343 - DNA, 25 bp, Homo sapiens
gaacagactctggagtgtccattta

SEQ ID NO: 10344 - DNA, 25 bp, Homo sapiens
aatgagcgccacctttaggcagatc

SEQ ID NO: 10345 - DNA, 25 bp, Homo sapiens
ggcttgtttaaggttcttgctgccc

SEQ ID NO: 10346 - DNA, 25 bp, Homo sapiens
gaattttttcctaccattatggctt

SEQ ID NO: 10347 - DNA, 25 bp, Homo sapiens
ttctttgcattcgtccttaggtact

SEQ ID NO: 10348 - DNA, 25 bp, Homo sapiens
gtaaagaccatttagtcctcacctt

SEQ ID NO: 10349 - DNA, 25 bp, Homo sapiens
tagtcctcaccttctgttttagagt

SEQ ID NO: 10350 - DNA, 25 bp, Homo sapiens
tcactccctgtcatagttaccgatg

SEQ ID NO: 10351 - DNA, 25 bp, Homo sapiens
accgatggtgtcccgttgtgtgggt

SEQ ID NO: 10352 - DNA, 25 bp, Homo sapiens
ttgtgtgggtttactctgtgctaag

SEQ ID NO: 10353 - DNA, 25 bp, Homo sapiens
gtcttacacttctcaaatgctactc

SEQ ID NO: 10354 - DNA, 25 bp, Homo sapiens
atatagccttaactcttactgtttt

SEQ ID NO: 10355 - DNA, 25 bp, Homo sapiens
tactgttttgtgcggtgtgtctcca

SEQ ID NO: 10356 - DNA, 25 bp, Homo sapiens
taaattgtccctcgtattatttctc

SEQ ID NO: 10357 - DNA, 25 bp, Homo sapiens
attatttctccacgtctgttttagt

SEQ ID NO: 10358 - DNA, 25 bp, Homo sapiens
gttttagtttaatgtctcctaagct

SEQ ID NO: 10359 - DNA, 25 bp, Homo sapiens
agcttttctctcatagcgtagacct

SEQ ID NO: 10360 - DNA, 25 bp, Homo sapiens
ggatgggaagattgcccagtccccg

SEQ ID NO: 10361 - DNA, 25 bp, Homo sapiens
caagtgagtttgcactgtcagcccc

SEQ ID NO: 10362 - DNA, 25 bp, Homo sapiens
tcagccccagaccgtaagcttggct

SEQ ID NO: 10363 - DNA, 25 bp, Homo sapiens
gcttggctacactgatgtttttctt

SEQ ID NO: 10364 - DNA, 25 bp, Homo sapiens
gaatgtatcagccagagtagcaagt

SEQ ID NO: 10365 - DNA, 25 bp, Homo sapiens
aaatcatagtatctgtcatcttgca

SEQ ID NO: 10366 - DNA, 25 bp, Homo sapiens
gtcatcttgcagtattaccaatgct

SEQ ID NO: 10367 - DNA, 25 bp, Homo sapiens
cacctcctgtgcactttgagcaatg

SEQ ID NO: 10368 - DNA, 25 bp, Homo sapiens
tcgagggccctataccatggcccac

SEQ ID NO: 10369 - DNA, 25 bp, Homo sapiens
ggagcagagagccaagcatcttccc

SEQ ID NO: 10370 - DNA, 25 bp, Homo sapiens
ttccctgggaagtctttctggccaa

SEQ ID NO: 10371 - DNA, 25 bp, Homo sapiens
tctggccaagtctggccagcctggc

SEQ ID NO: 10372 - DNA, 25 bp, Homo sapiens
gccaccccatggtctgatgggcatg

SEQ ID NO: 10373 - DNA, 25 bp, Homo sapiens
aaaaaacggagtccgcaggccgcag

SEQ ID NO: 10374 - DNA, 25 bp, Homo sapiens
tgtgaagaccactcgttctgtggtt

SEQ ID NO: 10375 - DNA, 25 bp, Homo sapiens
ttctgtggttggggtcctgcaagaa

SEQ ID NO: 10376 - DNA, 25 bp, Homo sapiens
tggcacagtagctggggagacctca

SEQ ID NO: 10377 - DNA, 25 bp, Homo sapiens
agacctcagcagggctgctcagtgc

SEQ ID NO: 10378 - DNA, 25 bp, Homo sapiens
ttctcattttttcaggacaaacgtt

SEQ ID NO: 10379 - DNA, 25 bp, Homo sapiens
gcactggagggcaaaacggggcggt

SEQ ID NO: 10380 - DNA, 25 bp, Homo sapiens
gcggtccttatcctatttaatgtgt

SEQ ID NO: 10381 - DNA, 25 bp, Homo sapiens
aatgtgttcggcctttaattctgtt

SEQ ID NO: 10382 - DNA, 25 bp, Homo sapiens
taattctgttttgcctgctatagta

SEQ ID NO: 10383 - DNA, 25 bp, Homo sapiens
tgctatagtattgccattgccacct

SEQ ID NO: 10384 - DNA, 25 bp, Homo sapiens
gatgtttagcatgtaactcgcttaa

SEQ ID NO: 10385 - DNA, 25 bp, Homo sapiens
ctctttcagtcatgagccctacaca

SEQ ID NO: 10386 - DNA, 25 bp, Homo sapiens
agccctacacatttgcatgaaagat

SEQ ID NO: 10387 - DNA, 25 bp, Homo sapiens
ggtatatatgtatcccattttgtaa

SEQ ID NO: 10388 - DNA, 25 bp, Homo sapiens
aaggcataacagtggttgtgtggta

SEQ ID NO: 10389 - DNA, 25 bp, Homo sapiens
ggaacgcttggaagcccttgatgcc

SEQ ID NO: 10390 - DNA, 25 bp, Homo sapiens
acgcttggaagcccttgatgccaat

SEQ ID NO: 10391 - DNA, 25 bp, Homo sapiens
ttggaagcccttgatgccaattctc

SEQ ID NO: 10392 - DNA, 25 bp, Homo sapiens
cccttgatgccaattctcggaagca

SEQ ID NO: 10393 - DNA, 25 bp, Homo sapiens
gccaattctcggaagcaagaagcag

SEQ ID NO: 10394 - DNA, 25 bp, Homo sapiens
gaatggtatgcaagacaggacgagc

SEQ ID NO: 10395 - DNA, 25 bp, Homo sapiens
gcaagacaggacgagcagctacaga

SEQ ID NO: 10396 - DNA, 25 bp, Homo sapiens
gacaggacgagcagctacagaaaac

SEQ ID NO: 10397 - DNA, 25 bp, Homo sapiens
ggaagcttcccaagagtagcctcaa

SEQ ID NO: 10398 - DNA, 25 bp, Homo sapiens
cttcccaagagtagcctcaacctgt

SEQ ID NO: 10399 - DNA, 25 bp, Homo sapiens
caagagtagcctcaacctgtgcttc

SEQ ID NO: 10400 - DNA, 25 bp, Homo sapiens
gtaatgaagagctaactgtgttata

SEQ ID NO: 10401 - DNA, 25 bp, Homo sapiens
gtgttataatcatcttgcttttgcc

SEQ ID NO: 10402 - DNA, 25 bp, Homo sapiens
agttcccagtatcagaaatgtcctt

SEQ ID NO: 10403 - DNA, 25 bp, Homo sapiens
tcttgatgactaataccattctatg

SEQ ID NO: 10404 - DNA, 25 bp, Homo sapiens
gtagttatatgcccagactgtatta

SEQ ID NO: 10405 - DNA, 25 bp, Homo sapiens
gctaaggtgcaataacatttgctac

SEQ ID NO: 10406 - DNA, 25 bp, Homo sapiens
caagagtttcctcaaaatagttatt

SEQ ID NO: 10407 - DNA, 25 bp, Homo sapiens
gaatcagaatgtctgtgtatttctt

SEQ ID NO: 10408 - DNA, 25 bp, Homo sapiens
gtgtatttcttgtctgtttctatgt

SEQ ID NO: 10409 - DNA, 25 bp, Homo sapiens
gtttctatgttgtcttatagctctg

SEQ ID NO: 10410 - DNA, 25 bp, Homo sapiens
agctctgactaaatgtgtttaccta

SEQ ID NO: 10411 - DNA, 25 bp, Homo sapiens
acagccacagtttatcctgaaccgc

SEQ ID NO: 10412 - DNA, 25 bp, Homo sapiens
gtccgctcccagatgtatagtactg

SEQ ID NO: 10413 - DNA, 25 bp, Homo sapiens
gtactgattatgaccagattctacc

SEQ ID NO: 10414 - DNA, 25 bp, Homo sapiens
gattctacctgattgttattcttgg

SEQ ID NO: 10415 - DNA, 25 bp, Homo sapiens
gttattcttggcctgaagaggtgca

SEQ ID NO: 10416 - DNA, 25 bp, Homo sapiens
gagacaattttgcttcactttgcct

SEQ ID NO: 10417 - DNA, 25 bp, Homo sapiens
cttcactttgccttctggttattta

SEQ ID NO: 10418 - DNA, 25 bp, Homo sapiens
tggttatttatggtttctgtctgaa

SEQ ID NO: 10419 - DNA, 25 bp, Homo sapiens
gtctgaattattctgcctacgttct

SEQ ID NO: 10420 - DNA, 25 bp, Homo sapiens
ctgcctacgttctctttaaaagctg

SEQ ID NO: 10421 - DNA, 25 bp, Homo sapiens
aaaagctgttgtacgtactacggag

SEQ ID NO: 10422 - DNA, 25 bp, Homo sapiens
gagaatactggcttcattacacttg

SEQ ID NO: 10423 - DNA, 25 bp, Homo sapiens
cattacacttgtacagccgagttct

SEQ ID NO: 10424 - DNA, 25 bp, Homo sapiens
ttcttcccgcattactgctgtttaa

SEQ ID NO: 10425 - DNA, 25 bp, Homo sapiens
gaacgtgattagtcatcgccgagaa

SEQ ID NO: 10426 - DNA, 25 bp, Homo sapiens
gccgaggaggtagtcacgcggcacg

SEQ ID NO: 10427 - DNA, 25 bp, Homo sapiens
cgccggtgattgccacgatgtgatt

SEQ ID NO: 10428 - DNA, 25 bp, Homo sapiens
agaagcaccatattatcccagacat

SEQ ID NO: 10429 - DNA, 25 bp, Homo sapiens
tatcccagacatgttctttcaagcc

SEQ ID NO: 10430 - DNA, 25 bp, Homo sapiens
ccctctctaaattcactgtcatcat

SEQ ID NO: 10431 - DNA, 25 bp, Homo sapiens
agtattatttgactccggtctcctt

SEQ ID NO: 10432 - DNA, 25 bp, Homo sapiens
gagatatttgatgtccttttgccga

SEQ ID NO: 10433 - DNA, 25 bp, Homo sapiens
aagccttacagttatcctgcaaggg

SEQ ID NO: 10434 - DNA, 25 bp, Homo sapiens
tctttcttctcgcctaggatttcag

SEQ ID NO: 10435 - DNA, 25 bp, Homo sapiens
cgcctaggatttcagccatgcgcgc

SEQ ID NO: 10436 - DNA, 25 bp, Homo sapiens
gcatgtctaattcatttactcacca

SEQ ID NO: 10437 - DNA, 25 bp, Homo sapiens
atcagctgttgcaggcagtgtctta

SEQ ID NO: 10438 - DNA, 25 bp, Homo sapiens
gaagcctaattgtcacatcaagcat

SEQ ID NO: 10439 - DNA, 25 bp, Homo sapiens
catcaagcatcattgtccccatgca

SEQ ID NO: 10440 - DNA, 25 bp, Homo sapiens
caccttatacatcacttcctgtttt

SEQ ID NO: 10441 - DNA, 25 bp, Homo sapiens
gagcaaagcatcggtcatgtgtgta

SEQ ID NO: 10442 - DNA, 25 bp, Homo sapiens
gtgtattttttcatagtcccacctt

SEQ ID NO: 10443 - DNA, 25 bp, Homo sapiens
atagtcccaccttggagcatttatg

SEQ ID NO: 10444 - DNA, 25 bp, Homo sapiens
aacttaagatggacacagctgactg

SEQ ID NO: 10445 - DNA, 25 bp, Homo sapiens
agatggacacagctgactggacccc

SEQ ID NO: 10446 - DNA, 25 bp, Homo sapiens
cacttctatgtctctggaccacagg

SEQ ID NO: 10447 - DNA, 25 bp, Homo sapiens
ggcaagtgggctgatggggtccgcc

SEQ ID NO: 10448 - DNA, 25 bp, Homo sapiens
gtctcctggacaaggagtttccagc

SEQ ID NO: 10449 - DNA, 25 bp, Homo sapiens
cctggacaaggagtttccagctgct

SEQ ID NO: 10450 - DNA, 25 bp, Homo sapiens
ggctggagtctcaggccaaattgca

SEQ ID NO: 10451 - DNA, 25 bp, Homo sapiens
aggccaaattgcagagggtcctcca

SEQ ID NO: 10452 - DNA, 25 bp, Homo sapiens
cagggtcctgaagagcactggacta

SEQ ID NO: 10453 - DNA, 25 bp, Homo sapiens
cctgaagagcactggactaagagtc

SEQ ID NO: 10454 - DNA, 25 bp, Homo sapiens
actaagagtctagtggttccagggc

SEQ ID NO: 10455 - DNA, 25 bp, Homo sapiens
ggaaatcggacctctaatccaagca

SEQ ID NO: 10456 - DNA, 25 bp, Homo sapiens
gacctctaatccaagcatattgctt

SEQ ID NO: 10457 - DNA, 25 bp, Homo sapiens
gcatattgcttgctattaatcgcca

SEQ ID NO: 10458 - DNA, 25 bp, Homo sapiens
aacgtaccttgaaactctctatctc

SEQ ID NO: 10459 - DNA, 25 bp, Homo sapiens
ctggacactccagggtagagaatga

SEQ ID NO: 10460 - DNA, 25 bp, Homo sapiens
gtatggaagtagtccggcttttgaa

SEQ ID NO: 10461 - DNA, 25 bp, Homo sapiens
tttgcaggactgccttggtggcttt

SEQ ID NO: 10462 - DNA, 25 bp, Homo sapiens
actgccttggtggctttgtttgctg

SEQ ID NO: 10463 - DNA, 25 bp, Homo sapiens
gtttgctgggacaaggcccacaacc

SEQ ID NO: 10464 - DNA, 25 bp, Homo sapiens
atgaggctttctttgattcctcctc

SEQ ID NO: 10465 - DNA, 25 bp, Homo sapiens
tcctcagttctacctagtttcacag

SEQ ID NO: 10466 - DNA, 25 bp, Homo sapiens
gaaggcggctgatgagagcgagaga

SEQ ID NO: 10467 - DNA, 25 bp, Homo sapiens
tgaaggtcatcgaaaaccgggccat

SEQ ID NO: 10468 - DNA, 25 bp, Homo sapiens
aggccaagcacatcgctgaggattc

SEQ ID NO: 10469 - DNA, 25 bp, Homo sapiens
gctgaggattcagaccgcaaatatg

SEQ ID NO: 10470 - DNA, 25 bp, Homo sapiens
agctggagcgctcggaggagagggc

SEQ ID NO: 10471 - DNA, 25 bp, Homo sapiens
tggagcgctcggaggagagggctga

SEQ ID NO: 10472 - DNA, 25 bp, Homo sapiens
gaggagatcaaactgttggaggaga

SEQ ID NO: 10473 - DNA, 25 bp, Homo sapiens
aggctgagacccgagcagagtttgc

SEQ ID NO: 10474 - DNA, 25 bp, Homo sapiens
gacccgagcagagtttgccgagagg

SEQ ID NO: 10475 - DNA, 25 bp, Homo sapiens
agagtttgccgagaggtctgtggca

SEQ ID NO: 10476 - DNA, 25 bp, Homo sapiens
aaagttggagaaaaccatcgatgac

SEQ ID NO: 10477 - DNA, 25 bp, Homo sapiens
gaatttctgttgagtctcttgcaaa

SEQ ID NO: 10478 - DNA, 25 bp, Homo sapiens
gaaatccctttacctatcagaaaca

SEQ ID NO: 10479 - DNA, 25 bp, Homo sapiens
aaacaccttaattctactgctcttt

SEQ ID NO: 10480 - DNA, 25 bp, Homo sapiens
tacttttgtgaattccttagccttt

SEQ ID NO: 10481 - DNA, 25 bp, Homo sapiens
agcctttcttccttggtgcataaag

SEQ ID NO: 10482 - DNA, 25 bp, Homo sapiens
tctcaggactcttctcttgtaaaga

SEQ ID NO: 10483 - DNA, 25 bp, Homo sapiens
gctgaaattcgtactatattggcca

SEQ ID NO: 10484 - DNA, 25 bp, Homo sapiens
gagcgagttaggtgatcttggtttc

SEQ ID NO: 10485 - DNA, 25 bp, Homo sapiens
cttggtttcaatttccgagcctttg

SEQ ID NO: 10486 - DNA, 25 bp, Homo sapiens
tatgtaggacctttggacccagggt

SEQ ID NO: 10487 - DNA, 25 bp, Homo sapiens
ggacccagggtcctacagatagata

SEQ ID NO: 10488 - DNA, 25 bp, Homo sapiens
ggaaatttgacatcatccccactat

SEQ ID NO: 10489 - DNA, 25 bp, Homo sapiens
tccccactatgatcaacatcggctc

SEQ ID NO: 10490 - DNA, 25 bp, Homo sapiens
gcactgctaggcatggcgaccgtgc

SEQ ID NO: 10491 - DNA, 25 bp, Homo sapiens
gtgacatcatagtcctctactgcat

SEQ ID NO: 10492 - DNA, 25 bp, Homo sapiens
gaatctgattgagtctccactccac

SEQ ID NO: 10493 - DNA, 25 bp, Homo sapiens
cagcagctcctgtgtgttgtgtgca

SEQ ID NO: 10494 - DNA, 25 bp, Homo sapiens
ccgcctcgatacacgggacgttgag

SEQ ID NO: 10495 - DNA, 25 bp, Homo sapiens
ttgagcacaacgtatctcctggcta

SEQ ID NO: 10496 - DNA, 25 bp, Homo sapiens
agacctggctggcaacgagcagcgc

SEQ ID NO: 10497 - DNA, 25 bp, Homo sapiens
gctcatcaaggcctatggcatccgc

SEQ ID NO: 10498 - DNA, 25 bp, Homo sapiens
atccgcttcgacatcattgtgtttg

SEQ ID NO: 10499 - DNA, 25 bp, Homo sapiens
ccctgacccaattgtcatcaaccat

SEQ ID NO: 10500 - DNA, 25 bp, Homo sapiens
catcaaccatgtcatcagcgtggac

SEQ ID NO: 10501 - DNA, 25 bp, Homo sapiens
aaaggggcagatgagcagcttcctc

SEQ ID NO: 10502 - DNA, 25 bp, Homo sapiens
ttcatgctaagcttctccagagacc

SEQ ID NO: 10503 - DNA, 25 bp, Homo sapiens
aaaggctatgtccaagacctgctcc

SEQ ID NO: 10504 - DNA, 25 bp, Homo sapiens
agccggcaaccctgaagaggagcgc

SEQ ID NO: 10505 - DNA, 25 bp, Homo sapiens
aagaggagcgccgggctgagttcta

SEQ ID NO: 10506 - DNA, 25 bp, Homo sapiens
caagatccagcagcgcaggcaggag

SEQ ID NO: 10507 - DNA, 25 bp, Homo sapiens
gctggagcagtcgctggttgtgcgc

SEQ ID NO: 10508 - DNA, 25 bp, Homo sapiens
tggttgtgcgcaacacctaggagcc

SEQ ID NO: 10509 - DNA, 25 bp, Homo sapiens
gcacgacggaactttcagccgtgtc

SEQ ID NO: 10510 - DNA, 25 bp, Homo sapiens
ggacagcagcttctcggaatgcatg

SEQ ID NO: 10511 - DNA, 25 bp, Homo sapiens
gcttgagcagcagcttggtgaagcg

SEQ ID NO: 10512 - DNA, 25 bp, Homo sapiens
gtgaagcgggaagtctccaagggcc

SEQ ID NO: 10513 - DNA, 25 bp, Homo sapiens
gctccaccgaagcggaattctccat

SEQ ID NO: 10514 - DNA, 25 bp, Homo sapiens
agacgacagcagtgaggcggactcc

SEQ ID NO: 10515 - DNA, 25 bp, Homo sapiens
gaaccggaggtctgcgaggacctgg

SEQ ID NO: 10516 - DNA, 25 bp, Homo sapiens
agaaggagtgccataccttctccca

SEQ ID NO: 10517 - DNA, 25 bp, Homo sapiens
ggaggtgcctgaaagctgggagcgt

SEQ ID NO: 10518 - DNA, 25 bp, Homo sapiens
aaagctgggagcgtgggctcagcag

SEQ ID NO: 10519 - DNA, 25 bp, Homo sapiens
ctttctctgcctggcaacatcttac

SEQ ID NO: 10520 - DNA, 25 bp, Homo sapiens
tttgaggccccaactcaagtgtcac

SEQ ID NO: 10521 - DNA, 25 bp, Homo sapiens
atgcaggatccaaaccaagccgatg

SEQ ID NO: 10522 - DNA, 25 bp, Homo sapiens
ctaaccccacgccatgtgatggagc

SEQ ID NO: 10523 - DNA, 25 bp, Homo sapiens
gctgatcaaggtcatgtttctcact

SEQ ID NO: 10524 - DNA, 25 bp, Homo sapiens
acattgatgatcacattctgccctt

SEQ ID NO: 10525 - DNA, 25 bp, Homo sapiens
cattctgccctttactacaggacag

SEQ ID NO: 10526 - DNA, 25 bp, Homo sapiens
gaagttgcaagcctttgtcttactc

SEQ ID NO: 10527 - DNA, 25 bp, Homo sapiens
gtcttactctttcagtcaggaccta

SEQ ID NO: 10528 - DNA, 25 bp, Homo sapiens
gccagccatctcagcagggaagaac

SEQ ID NO: 10529 - DNA, 25 bp, Homo sapiens
gaacaaccttctcaaccaaaactgc

SEQ ID NO: 10530 - DNA, 25 bp, Homo sapiens
ggtgggggaatctcacactgactaa

SEQ ID NO: 10531 - DNA, 25 bp, Homo sapiens
ggacgctttgtattcagagatggct

SEQ ID NO: 10532 - DNA, 25 bp, Homo sapiens
cattagacgttcctgagcatccaag

SEQ ID NO: 10533 - DNA, 25 bp, Homo sapiens
gctgatacctcaatctttactactg

SEQ ID NO: 10534 - DNA, 25 bp, Homo sapiens
actctaaacctgatttttgccatgg

SEQ ID NO: 10535 - DNA, 25 bp, Homo sapiens
tttgccatggattccttctggccaa

SEQ ID NO: 10536 - DNA, 25 bp, Homo sapiens
atggattccttctggccaagaaatt

SEQ ID NO: 10537 - DNA, 25 bp, Homo sapiens
acaatataatcctaaaccttgacag

SEQ ID NO: 10538 - DNA, 25 bp, Homo sapiens
gagaagccaatgcagaactgatggg

SEQ ID NO: 10539 - DNA, 25 bp, Homo sapiens
ttacctctgcatcagtgcatttcta

SEQ ID NO: 10540 - DNA, 25 bp, Homo sapiens
tgcattttctgatcctgtagtgcct

SEQ ID NO: 10541 - DNA, 25 bp, Homo sapiens
gtgcctctatagaagtacccacaga

SEQ ID NO: 10542 - DNA, 25 bp, Homo sapiens
taaaattttctagattactccaata

SEQ ID NO: 10543 - DNA, 25 bp, Homo sapiens
tcgtgggccgcagcaggaagcaaag

SEQ ID NO: 10544 - DNA, 25 bp, Homo sapiens
cgtggacaccaaggcgggccacggg

SEQ ID NO: 10545 - DNA, 25 bp, Homo sapiens
cagacatgtttgcgttcatcgcgcg

SEQ ID NO: 10546 - DNA, 25 bp, Homo sapiens
ggtgcctgaatgtcgactggattcc

SEQ ID NO: 10547 - DNA, 25 bp, Homo sapiens
ccataaacagttttcgtgcttcctc

SEQ ID NO: 10548 - DNA, 25 bp, Homo sapiens
tgcttcctcctgacagcgacagaaa

SEQ ID NO: 10549 - DNA, 25 bp, Homo sapiens
ttcccacgttgacaccaagaaacca

SEQ ID NO: 10550 - DNA, 25 bp, Homo sapiens
accactgggcataatgcttccccac

SEQ ID NO: 10551 - DNA, 25 bp, Homo sapiens
ctgcactcacaggctacagttgaac

SEQ ID NO: 10552 - DNA, 25 bp, Homo sapiens
ggcttctcctttttagcaaggcctt

SEQ ID NO: 10553 - DNA, 25 bp, Homo sapiens
ttccaccctgtctaggcacatgtgg

SEQ ID NO: 10554 - DNA, 25 bp, Homo sapiens
caggcccagagcgattgcagttgct

SEQ ID NO: 10555 - DNA, 25 bp, Homo sapiens
ttgcagttgctctacggtgagcccg

SEQ ID NO: 10556 - DNA, 25 bp, Homo sapiens
cgtgctggcagggatcgtgatggga

SEQ ID NO: 10557 - DNA, 25 bp, Homo sapiens
ggatcgtgatgggagacctggtgct

SEQ ID NO: 10558 - DNA, 25 bp, Homo sapiens
gcgacccggaaacagcgtatcactg

SEQ ID NO: 10559 - DNA, 25 bp, Homo sapiens
gtatcactgagaccgagtcgcctta

SEQ ID NO: 10560 - DNA, 25 bp, Homo sapiens
gagctccagggtcagaggtcggatg

SEQ ID NO: 10561 - DNA, 25 bp, Homo sapiens
gtcggatgtctacagcgacctcaac

SEQ ID NO: 10562 - DNA, 25 bp, Homo sapiens
tcaacacacagaggccgtattacaa

SEQ ID NO: 10563 - DNA, 25 bp, Homo sapiens
gagcccgaatcatgacagtcagcaa

SEQ ID NO: 10564 - DNA, 25 bp, Homo sapiens
catggggggacttgaaccctgcagc

SEQ ID NO: 10565 - DNA, 25 bp, Homo sapiens
ttcagccgtctcagacgctactttg

SEQ ID NO: 10566 - DNA, 25 bp, Homo sapiens
acgctactttgtggcattcgacggg

SEQ ID NO: 10567 - DNA, 25 bp, Homo sapiens
cattcgacggggacctggtacagga

SEQ ID NO: 10568 - DNA, 25 bp, Homo sapiens
tcagccacgcacgtgctgggtagca

SEQ ID NO: 10569 - DNA, 25 bp, Homo sapiens
ggtctccccagagtggatttgggca

SEQ ID NO: 10570 - DNA, 25 bp, Homo sapiens
gatttgggcatgtatccggaaacgg

SEQ ID NO: 10571 - DNA, 25 bp, Homo sapiens
aaacggagactggtagctccctgct

SEQ ID NO: 10572 - DNA, 25 bp, Homo sapiens
tactctcctttaccatactattgga

SEQ ID NO: 10573 - DNA, 25 bp, Homo sapiens
attggactggactcaggctggaggc

SEQ ID NO: 10574 - DNA, 25 bp, Homo sapiens
agctgaagtcagtttgtcttgctgg

SEQ ID NO: 10575 - DNA, 25 bp, Homo sapiens
tcagagctgggtgctgggtttgcca

SEQ ID NO: 10576 - DNA, 25 bp, Homo sapiens
tcgactgcatccacctaatcaatga

SEQ ID NO: 10577 - DNA, 25 bp, Homo sapiens
catggtgtccggcgcggacgatggc

SEQ ID NO: 10578 - DNA, 25 bp, Homo sapiens
gccttgtggggtctctccaagaagc

SEQ ID NO: 10579 - DNA, 25 bp, Homo sapiens
gcagcgtgaagctcacgggctgcgg

SEQ ID NO: 10580 - DNA, 25 bp, Homo sapiens
tgtgcggctttggcagtgtggggaa

SEQ ID NO: 10581 - DNA, 25 bp, Homo sapiens
ggtgggttttatcaacagcctcaag

SEQ ID NO: 10582 - DNA, 25 bp, Homo sapiens
gagcacaggcttggccgatggtgga

SEQ ID NO: 10583 - DNA, 25 bp, Homo sapiens
aagaggctcggaattctgtctgcat

SEQ ID NO: 10584 - DNA, 25 bp, Homo sapiens
tgacggctgggggccgggatgggac

SEQ ID NO: 10585 - DNA, 25 bp, Homo sapiens
gccgggatgggactgtacgtgtgtg

SEQ ID NO: 10586 - DNA, 25 bp, Homo sapiens
gtacgtgtgtggaagatccccgagg

SEQ ID NO: 10587 - DNA, 25 bp, Homo sapiens
tatgaatgagccagccatgcttcct

SEQ ID NO: 10588 - DNA, 25 bp, Homo sapiens
cttcccctgtctgggccaaacaggg

SEQ ID NO: 10589 - DNA, 25 bp, Homo sapiens
gacaatccatgctctaagatccatt

SEQ ID NO: 10590 - DNA, 25 bp, Homo sapiens
gaatgtttctgcaaccctaaggcac

SEQ ID NO: 10591 - DNA, 25 bp, Homo sapiens
gcacagagagccaaccctgagtgtc

SEQ ID NO: 10592 - DNA, 25 bp, Homo sapiens
gccagtgagagacctggcctcagcc

SEQ ID NO: 10593 - DNA, 25 bp, Homo sapiens
tggggcttgggagaccccataggcc

SEQ ID NO: 10594 - DNA, 25 bp, Homo sapiens
ctccgtttcattctgtgtgcgttgt

SEQ ID NO: 10595 - DNA, 25 bp, Homo sapiens
gcgtttttctaggactctgtgcaac

SEQ ID NO: 10596 - DNA, 25 bp, Homo sapiens
gtgcaactgtcgtatatggtcccgt

SEQ ID NO: 10597 - DNA, 25 bp, Homo sapiens
ggctgaccgctttgtacatgagaat

SEQ ID NO: 10598 - DNA, 25 bp, Homo sapiens
cagaccggcagtcatcatggcagtt

SEQ ID NO: 10599 - DNA, 25 bp, Homo sapiens
tacatgcaagctgtagccagccctt

SEQ ID NO: 10600 - DNA, 25 bp, Homo sapiens
caccactgcaggataaccgaactca

SEQ ID NO: 10601 - DNA, 25 bp, Homo sapiens
gcagtattactatcacaccaacagc

SEQ ID NO: 10602 - DNA, 25 bp, Homo sapiens
cctcttcctcgacaatcacaaatta

SEQ ID NO: 10603 - DNA, 25 bp, Homo sapiens
tatatataactgaccacgctcaccc

SEQ ID NO: 10604 - DNA, 25 bp, Homo sapiens
accctcatccagtccatactgatat

SEQ ID NO: 10605 - DNA, 25 bp, Homo sapiens
ctcaatccttttttaatcatccctc

SEQ ID NO: 10606 - DNA, 25 bp, Homo sapiens
gactgactgaactcgtactttggga

SEQ ID NO: 10607 - DNA, 25 bp, Homo sapiens
gttgcctgcatagtcatatcgagtg

SEQ ID NO: 10608 - DNA, 25 bp, Homo sapiens
gtgcacttactgtatatcttttcat

SEQ ID NO: 10609 - DNA, 25 bp, Homo sapiens
gagtagcagaaccaggagcctcttc

SEQ ID NO: 10610 - DNA, 25 bp, Homo sapiens
aaattcctaggattggctgtcccct

SEQ ID NO: 10611 - DNA, 25 bp, Homo sapiens
aagcttggtggagcgtctgcacctt

SEQ ID NO: 10612 - DNA, 25 bp, Homo sapiens
tttgggcctcgtgagggatctgcct

SEQ ID NO: 10613 - DNA, 25 bp, Homo sapiens
gcaaagagctcttgatcccgatttc

SEQ ID NO: 10614 - DNA, 25 bp, Homo sapiens
tcttgatcccgatttcatgcacagc

SEQ ID NO: 10615 - DNA, 25 bp, Homo sapiens
tgcacagccctgcagtaaggagccc

SEQ ID NO: 10616 - DNA, 25 bp, Homo sapiens
gttctcttttcttacattatgacgt

SEQ ID NO: 10617 - DNA, 25 bp, Homo sapiens
gggatcctgtaagcagacttgggca

SEQ ID NO: 10618 - DNA, 25 bp, Homo sapiens
acttgggcagtctccttttgaaata

SEQ ID NO: 10619 - DNA, 25 bp, Homo sapiens
gtagaacacgtgtgcctgtttaagt

SEQ ID NO: 10620 - DNA, 25 bp, Homo sapiens
gcgaggacgaggcttaaaaacttct

SEQ ID NO: 10621 - DNA, 25 bp, Homo sapiens
aaaacttctcagatcaatcgtgcat

SEQ ID NO: 10622 - DNA, 25 bp, Homo sapiens
ttctcagatcaatcgtgcatcctta

SEQ ID NO: 10623 - DNA, 25 bp, Homo sapiens
gatcaatcgtgcatccttagtgaac

SEQ ID NO: 10624 - DNA, 25 bp, Homo sapiens
atcgtgcatccttagtgaacttctg

SEQ ID NO: 10625 - DNA, 25 bp, Homo sapiens
catccttagtgaacttctgttgtcc

SEQ ID NO: 10626 - DNA, 25 bp, Homo sapiens
tcctcaagcatggtctttctacttg

SEQ ID NO: 10627 - DNA, 25 bp, Homo sapiens
tgcctctgttagaaattcacactgt

SEQ ID NO: 10628 - DNA, 25 bp, Homo sapiens
gaaattcacactgttgatgtaatga

SEQ ID NO: 10629 - DNA, 25 bp, Homo sapiens
gatgtaatgatgtggaactcctcta

SEQ ID NO: 10630 - DNA, 25 bp, Homo sapiens
gtggaactcctctaaaaattacagt

SEQ ID NO: 10631 - DNA, 25 bp, Homo sapiens
atggccagaagtctggtccccaagg

SEQ ID NO: 10632 - DNA, 25 bp, Homo sapiens
gtccccaaggctctggagccatacg

SEQ ID NO: 10633 - DNA, 25 bp, Homo sapiens
ggctcagggaactgttggaggcgtg

SEQ ID NO: 10634 - DNA, 25 bp, Homo sapiens
tggaggcgtgttcatcacgacggca

SEQ ID NO: 10635 - DNA, 25 bp, Homo sapiens
agtgacctgaccaacggtgcagatg

SEQ ID NO: 10636 - DNA, 25 bp, Homo sapiens
acggtgcagatgggatgctggccac

SEQ ID NO: 10637 - DNA, 25 bp, Homo sapiens
tggccacaagctccaatgggtctca

SEQ ID NO: 10638 - DNA, 25 bp, Homo sapiens
gtgtcctacgtcggggaggacgacg

SEQ ID NO: 10639 - DNA, 25 bp, Homo sapiens
ggaggacgatgacttcaacgagaat

SEQ ID NO: 10640 - DNA, 25 bp, Homo sapiens
ccacttcagattcggcttcaggaaa

SEQ ID NO: 10641 - DNA, 25 bp, Homo sapiens
gaagcggatgggcatggcttgcggg

SEQ ID NO: 10642 - DNA, 25 bp, Homo sapiens
gcatgaggtctgccagaaggccctg

SEQ ID NO: 10643 - DNA, 25 bp, Homo sapiens
aggccctgcgtgtggatggtgacac

SEQ ID NO: 10644 - DNA, 25 bp, Homo sapiens
agaggatggctctatgctggtgact

SEQ ID NO: 10645 - DNA, 25 bp, Homo sapiens
cacatcgcctctggttaaatctctc

SEQ ID NO: 10646 - DNA, 25 bp, Homo sapiens
atctctcctgcttggtgatttcagc

SEQ ID NO: 10647 - DNA, 25 bp, Homo sapiens
gctacagcaaagcccattggccaga

SEQ ID NO: 10648 - DNA, 25 bp, Homo sapiens
tctggttgcctatagtgctctggga

SEQ ID NO: 10649 - DNA, 25 bp, Homo sapiens
gctaccagctacagcgtggggttgt

SEQ ID NO: 10650 - DNA, 25 bp, Homo sapiens
tgtggtcctggccaagagctacaat

SEQ ID NO: 10651 - DNA, 25 bp, Homo sapiens
tgacccttgatatttttgctggccc

SEQ ID NO: 10652 - DNA, 25 bp, Homo sapiens
cccccctaattatccattttctgat

SEQ ID NO: 10653 - DNA, 25 bp, Homo sapiens
ttgtggttgttgagaggcattttca

SEQ ID NO: 10654 - DNA, 25 bp, Homo sapiens
taatccatgctgttggtcataagtt

SEQ ID NO: 10655 - DNA, 25 bp, Homo sapiens
gcattgacacatttaaagcttttca

SEQ ID NO: 10656 - DNA, 25 bp, Homo sapiens
tatacttggtccttgcaatggtgtg

SEQ ID NO: 10657 - DNA, 25 bp, Homo sapiens
ggtccttgcaatggtgtgagtttta

SEQ ID NO: 10658 - DNA, 25 bp, Homo sapiens
gattgcattatcgtgattggtggtt

SEQ ID NO: 10659 - DNA, 25 bp, Homo sapiens
cagaaatctatacttggcatccaac

SEQ ID NO: 10660 - DNA, 25 bp, Homo sapiens
ggaaggtatgtcctgtcagtatctt

SEQ ID NO: 10661 - DNA, 25 bp, Homo sapiens
ctgtcagtatcttaaccctttcaac

SEQ ID NO: 10662 - DNA, 25 bp, Homo sapiens
cctttcaacaagacatttacctatt

SEQ ID NO: 10663 - DNA, 25 bp, Homo sapiens
gtctttccttacgttctcaaaatat

SEQ ID NO: 10664 - DNA, 25 bp, Homo sapiens
agggcctggagaataagccggtggc

SEQ ID NO: 10665 - DNA, 25 bp, Homo sapiens
gcctggagaataagccggtggccga

SEQ ID NO: 10666 - DNA, 25 bp, Homo sapiens
tggagaataagccggtggccgagag

SEQ ID NO: 10667 - DNA, 25 bp, Homo sapiens
ccctgctctatggggacccagagct

SEQ ID NO: 10668 - DNA, 25 bp, Homo sapiens
ctatggggacccagagcttgaacac

SEQ ID NO: 10669 - DNA, 25 bp, Homo sapiens
gacccagagcttgaacacgcgtaga

SEQ ID NO: 10670 - DNA, 25 bp, Homo sapiens
cccagagcttgaacacgcgtagact

SEQ ID NO: 10671 - DNA, 25 bp, Homo sapiens
cttgaacacgcgtagactggggtcc

SEQ ID NO: 10672 - DNA, 25 bp, Homo sapiens
ccgcccgacgtgtctacgtcggctg

SEQ ID NO: 10673 - DNA, 25 bp, Homo sapiens
acgtgtctacgtcggctgaagagac

SEQ ID NO: 10674 - DNA, 25 bp, Homo sapiens
gtcggctgaagagacagcgggggcg

SEQ ID NO: 10675 - DNA, 25 bp, Homo sapiens
ccagcagtcactgggtcaccagagt

SEQ ID NO: 10676 - DNA, 25 bp, Homo sapiens
agaagatggccgggaactcgatcct

SEQ ID NO: 10677 - DNA, 25 bp, Homo sapiens
aagtttttgctacttgtctgggtct

SEQ ID NO: 10678 - DNA, 25 bp, Homo sapiens
gtacatatatggccgtcacctatac

SEQ ID NO: 10679 - DNA, 25 bp, Homo sapiens
gtcacctatacttctggggatattc

SEQ ID NO: 10680 - DNA, 25 bp, Homo sapiens
ccggtttccgactgagtctggggat

SEQ ID NO: 10681 - DNA, 25 bp, Homo sapiens
tggggattttggccttgttgaccct

SEQ ID NO: 10682 - DNA, 25 bp, Homo sapiens
cctcctaggtgccctgggaattgca

SEQ ID NO: 10683 - DNA, 25 bp, Homo sapiens
aaactgaggcggcaattctaacttt

SEQ ID NO: 10684 - DNA, 25 bp, Homo sapiens
gaagctgttcccaccatgaaggtaa

SEQ ID NO: 10685 - DNA, 25 bp, Homo sapiens
ttctctcggcctgtcagcaaagtta

SEQ ID NO: 10686 - DNA, 25 bp, Homo sapiens
gaggaggggaggtcctgaggggact

SEQ ID NO: 10687 - DNA, 25 bp, Homo sapiens
tcccagcaaatggtgctctcctggc

SEQ ID NO: 10688 - DNA, 25 bp, Homo sapiens
ccctcagccatgtggcacttctgag

SEQ ID NO: 10689 - DNA, 25 bp, Homo sapiens
agctcctgacctaggccaaggggag

SEQ ID NO: 10690 - DNA, 25 bp, Homo sapiens
acctaggccaaggggaggtctctgc

SEQ ID NO: 10691 - DNA, 25 bp, Homo sapiens
gtccctggccatgggtaggagactg

SEQ ID NO: 10692 - DNA, 25 bp, Homo sapiens
ccttctcctcagctgcagtcgaagg

SEQ ID NO: 10693 - DNA, 25 bp, Homo sapiens
tcctcagctgcagtcgaaggcttta

SEQ ID NO: 10694 - DNA, 25 bp, Homo sapiens
gaaggctttaactttgcacacttgg

SEQ ID NO: 10695 - DNA, 25 bp, Homo sapiens
gcacacttgggatcacagttgcgtc

SEQ ID NO: 10696 - DNA, 25 bp, Homo sapiens
cttgggatcacagttgcgtcattgt

SEQ ID NO: 10697 - DNA, 25 bp, Homo sapiens
cgacgaacactacgagtaccggcat

SEQ ID NO: 10698 - DNA, 25 bp, Homo sapiens
ttatgttacccagagaactttccaa

SEQ ID NO: 10699 - DNA, 25 bp, Homo sapiens
acttggtgtccaacagagtctaggc

SEQ ID NO: 10700 - DNA, 25 bp, Homo sapiens
tattcttctctttagacgacctctt

SEQ ID NO: 10701 - DNA, 25 bp, Homo sapiens
tctctttagacgacctcttccaaaa

SEQ ID NO: 10702 - DNA, 25 bp, Homo sapiens
acaaatctttcatccatacctgtgc

SEQ ID NO: 10703 - DNA, 25 bp, Homo sapiens
gtgcatgagctgtattcttcacagc

SEQ ID NO: 10704 - DNA, 25 bp, Homo sapiens
gcaacagagctcagttaaatgcaac

SEQ ID NO: 10705 - DNA, 25 bp, Homo sapiens
gataaaagttcttccagtcagtttt

SEQ ID NO: 10706 - DNA, 25 bp, Homo sapiens
cagtcagtttttctcttaagtgcct

SEQ ID NO: 10707 - DNA, 25 bp, Homo sapiens
cgctctcgtttcattttctgcagcg

SEQ ID NO: 10708 - DNA, 25 bp, Homo sapiens
gaccggaacacttgcctttgagcgg

SEQ ID NO: 10709 - DNA, 25 bp, Homo sapiens
gtctacactgccaaccagaactgtg

SEQ ID NO: 10710 - DNA, 25 bp, Homo sapiens
aactgtgtagatgcgtaccccactt

SEQ ID NO: 10711 - DNA, 25 bp, Homo sapiens
ggggctactttgcagccaagttcct

SEQ ID NO: 10712 - DNA, 25 bp, Homo sapiens
tgctgcgtttgctggactgatgtac

SEQ ID NO: 10713 - DNA, 25 bp, Homo sapiens
gactgatgtacttgtttgtgcggca

SEQ ID NO: 10714 - DNA, 25 bp, Homo sapiens
agcacccctggctacatatttggga

SEQ ID NO: 10715 - DNA, 25 bp, Homo sapiens
ggaaacgcatcatactcttcctgtt

SEQ ID NO: 10716 - DNA, 25 bp, Homo sapiens
cctcatgtccgttgctggcatattc

SEQ ID NO: 10717 - DNA, 25 bp, Homo sapiens
tattcaactattacctcatcttctt

SEQ ID NO: 10718 - DNA, 25 bp, Homo sapiens
gtaggcaatgttgtcctgttggcca

SEQ ID NO: 10719 - DNA, 25 bp, Homo sapiens
tgcgcgaggtacttcatcgattcca

SEQ ID NO: 10720 - DNA, 25 bp, Homo sapiens
aggctgaagcagctgagcgtcgagc

SEQ ID NO: 10721 - DNA, 25 bp, Homo sapiens
cgtcgagccctacagtcaggaagag

SEQ ID NO: 10722 - DNA, 25 bp, Homo sapiens
gcgggtatgggatcctatgtgcccc

SEQ ID NO: 10723 - DNA, 25 bp, Homo sapiens
ggtccctgagatggatacctctacc

SEQ ID NO: 10724 - DNA, 25 bp, Homo sapiens
cctctacctgacatggcctgaagat

SEQ ID NO: 10725 - DNA, 25 bp, Homo sapiens
aggaattgcccatggacagtgacgc

SEQ ID NO: 10726 - DNA, 25 bp, Homo sapiens
gtgacgcaaggactaggctgggagg

SEQ ID NO: 10727 - DNA, 25 bp, Homo sapiens
tttgcctctgggtttggggagcgga

SEQ ID NO: 10728 - DNA, 25 bp, Homo sapiens
ggcggccggacttggatgagattca

SEQ ID NO: 10729 - DNA, 25 bp, Homo sapiens
gatgagattcaccgcgagctgcggc

SEQ ID NO: 10730 - DNA, 25 bp, Homo sapiens
agcggtagccagaggtaccagcttc

SEQ ID NO: 10731 - DNA, 25 bp, Homo sapiens
tgctcaggaggtccccattgagatc

SEQ ID NO: 10732 - DNA, 25 bp, Homo sapiens
aacagatgttctgggtgcgagcccg

SEQ ID NO: 10733 - DNA, 25 bp, Homo sapiens
ggggctatattggcgagggcgacat

SEQ ID NO: 10734 - DNA, 25 bp, Homo sapiens
catgaagatgcactgctgcgtggcc

SEQ ID NO: 10735 - DNA, 25 bp, Homo sapiens
tctccgactatgccttcttgggcac

SEQ ID NO: 10736 - DNA, 25 bp, Homo sapiens
actgctgcctcaccagtggcagcac

SEQ ID NO: 10737 - DNA, 25 bp, Homo sapiens
caaggtgcacttcatggtctcactg

SEQ ID NO: 10738 - DNA, 25 bp, Homo sapiens
gctgaccactggatgctctatgaat

SEQ ID NO: 10739 - DNA, 25 bp, Homo sapiens
atgggcgggtgtggagtcaggatgg

SEQ ID NO: 10740 - DNA, 25 bp, Homo sapiens
gggcgtgatccgagtgaagccccag

SEQ ID NO: 10741 - DNA, 25 bp, Homo sapiens
agttccacatttgaggcagtcttaa

SEQ ID NO: 10742 - DNA, 25 bp, Homo sapiens
atcttccaaatggcagccctatccc

SEQ ID NO: 10743 - DNA, 25 bp, Homo sapiens
aggacagtagccagagtccttccca

SEQ ID NO: 10744 - DNA, 25 bp, Homo sapiens
gtccttcccaggtggaccaattctg

SEQ ID NO: 10745 - DNA, 25 bp, Homo sapiens
ggctttgccggatggtttgaaacct

SEQ ID NO: 10746 - DNA, 25 bp, Homo sapiens
ctgcccggttcctagtggagaagat

SEQ ID NO: 10747 - DNA, 25 bp, Homo sapiens
gctgatatatggcttctgcttctct

SEQ ID NO: 10748 - DNA, 25 bp, Homo sapiens
tgtcatgttagctgggagtcttccc

SEQ ID NO: 10749 - DNA, 25 bp, Homo sapiens
gtcttcccacatgtggcacttcaaa

SEQ ID NO: 10750 - DNA, 25 bp, Homo sapiens
caaaaggcagcaccactgggcgcct

SEQ ID NO: 10751 - DNA, 25 bp, Homo sapiens
ggagaagtatccctgctagtggctc

SEQ ID NO: 10752 - DNA, 25 bp, Homo sapiens
tttaatatctccaacctgcttgtgc

SEQ ID NO: 10753 - DNA, 25 bp, Homo sapiens
gaacacctgtacctcaacaacaata

SEQ ID NO: 10754 - DNA, 25 bp, Homo sapiens
caacgacctagtggcgttccatgac

SEQ ID NO: 10755 - DNA, 25 bp, Homo sapiens
ctcctcggacctggagaacgtgcca

SEQ ID NO: 10756 - DNA, 25 bp, Homo sapiens
cgctacctgcggctggatggaaact

SEQ ID NO: 10757 - DNA, 25 bp, Homo sapiens
tggaaactacttgaagccgcccatc

SEQ ID NO: 10758 - DNA, 25 bp, Homo sapiens
ttatcccaccctcgaggcagggaaa

SEQ ID NO: 10759 - DNA, 25 bp, Homo sapiens
gcgagacttcaaggactcagtttgg

SEQ ID NO: 10760 - DNA, 25 bp, Homo sapiens
tcagtttggttccacccagttgaaa

SEQ ID NO: 10761 - DNA, 25 bp, Homo sapiens
ttgaaagacaaccagtgcacaccca

SEQ ID NO: 10762 - DNA, 25 bp, Homo sapiens
gactccccaagaactcctttaatat

SEQ ID NO: 10763 - DNA, 25 bp, Homo sapiens
ttatgctgcatttggctggagcccg

SEQ ID NO: 10764 - DNA, 25 bp, Homo sapiens
tgctgccaactccatgtcagggaag

SEQ ID NO: 10765 - DNA, 25 bp, Homo sapiens
gtcagggaagtcgcttttggtgcct

SEQ ID NO: 10766 - DNA, 25 bp, Homo sapiens
tggctggtttgcccagagccaagct

SEQ ID NO: 10767 - DNA, 25 bp, Homo sapiens
ggagctttgctcttggaattactga

SEQ ID NO: 10768 - DNA, 25 bp, Homo sapiens
gacacaagtggccttaagtcttttt

SEQ ID NO: 10769 - DNA, 25 bp, Homo sapiens
aaatgcctcgagccatagagcctga

SEQ ID NO: 10770 - DNA, 25 bp, Homo sapiens
gcttcactcagctggactgcattga

SEQ ID NO: 10771 - DNA, 25 bp, Homo sapiens
actgcattgaaggcgaggctgcccc

SEQ ID NO: 10772 - DNA, 25 bp, Homo sapiens
ggctgccccttggatcaagcagaaa

SEQ ID NO: 10773 - DNA, 25 bp, Homo sapiens
gaacgttccctttggggatagtctg

SEQ ID NO: 10774 - DNA, 25 bp, Homo sapiens
cctgctctggacttgaatgccccag

SEQ ID NO: 10775 - DNA, 25 bp, Homo sapiens
tcaccacggtgactgctgaggacga

SEQ ID NO: 10776 - DNA, 25 bp, Homo sapiens
gaggacgaggcccagatggaacatt

SEQ ID NO: 10777 - DNA, 25 bp, Homo sapiens
ggaacattacaggggctactttggg

SEQ ID NO: 10778 - DNA, 25 bp, Homo sapiens
gggatatctgggacaagatgctgca

SEQ ID NO: 10779 - DNA, 25 bp, Homo sapiens
gaagagttgtgtctgcggttcatgc

SEQ ID NO: 10780 - DNA, 25 bp, Homo sapiens
gacccctgaaaagcagtcatcctga

SEQ ID NO: 10781 - DNA, 25 bp, Homo sapiens
tggctccagaggacctgagactcac

SEQ ID NO: 10782 - DNA, 25 bp, Homo sapiens
cagaggacctgagactcacactctc

SEQ ID NO: 10783 - DNA, 25 bp, Homo sapiens
gtcctgcatggggcagaggcttccg

SEQ ID NO: 10784 - DNA, 25 bp, Homo sapiens
cacccccatgtggcagcccatgggt

SEQ ID NO: 10785 - DNA, 25 bp, Homo sapiens
gcaaacatccggaagtatcccacca

SEQ ID NO: 10786 - DNA, 25 bp, Homo sapiens
tatcccaccaagaaacaacagctcc

SEQ ID NO: 10787 - DNA, 25 bp, Homo sapiens
tatttccagttacttgcctgcattc

SEQ ID NO: 10788 - DNA, 25 bp, Homo sapiens
taataggtttgcccttgcatctcat

SEQ ID NO: 10789 - DNA, 25 bp, Homo sapiens
gggactgtggtccattgtacaagcc

SEQ ID NO: 10790 - DNA, 25 bp, Homo sapiens
gaatttgggtacatggactacgccc

SEQ ID NO: 10791 - DNA, 25 bp, Homo sapiens
ggactacgcccaagcaaggtttgat

SEQ ID NO: 10792 - DNA, 25 bp, Homo sapiens
gaagcttggggtgtgactgtgggga

SEQ ID NO: 10793 - DNA, 25 bp, Homo sapiens
acctcatcactggactgcatgggga

SEQ ID NO: 10794 - DNA, 25 bp, Homo sapiens
gtggcaggaggctttgggtggctca

SEQ ID NO: 10795 - DNA, 25 bp, Homo sapiens
tttgggtggctcactactgaacaca

SEQ ID NO: 10796 - DNA, 25 bp, Homo sapiens
gagcattcgcggcggacgcgaggac

SEQ ID NO: 10797 - DNA, 25 bp, Homo sapiens
ggacgcgaggacaggacgctgtacg

SEQ ID NO: 10798 - DNA, 25 bp, Homo sapiens
gcgaggacaggacgctgtacgagcg

SEQ ID NO: 10799 - DNA, 25 bp, Homo sapiens
gacaggacgctgtacgagcggatcg

SEQ ID NO: 10800 - DNA, 25 bp, Homo sapiens
gacgctgtacgagcggatcgtgtct

SEQ ID NO: 10801 - DNA, 25 bp, Homo sapiens
tgtacgagcggatcgtgtctcggct

SEQ ID NO: 10802 - DNA, 25 bp, Homo sapiens
gcgattcgggacagtgctcaccgag

SEQ ID NO: 10803 - DNA, 25 bp, Homo sapiens
gattcgggacagtgctcaccgagca

SEQ ID NO: 10804 - DNA, 25 bp, Homo sapiens
acagtgctcaccgagcacgtggcgg

SEQ ID NO: 10805 - DNA, 25 bp, Homo sapiens
ccctgtacttctgcgggagcattcg

SEQ ID NO: 10806 - DNA, 25 bp, Homo sapiens
tgtacttctgcgggagcattcgcgg

SEQ ID NO: 10807 - DNA, 25 bp, Homo sapiens
gctttccagcccctttatatattgg

SEQ ID NO: 10808 - DNA, 25 bp, Homo sapiens
gaagcggttcattgctattattgca

SEQ ID NO: 10809 - DNA, 25 bp, Homo sapiens
ggtgcctgcatgtttgaagactgaa

SEQ ID NO: 10810 - DNA, 25 bp, Homo sapiens
gagggtgctgaagatgttcccacta

SEQ ID NO: 10811 - DNA, 25 bp, Homo sapiens
gaagatgttcccactaatttccagc

SEQ ID NO: 10812 - DNA, 25 bp, Homo sapiens
gggcttcggaggacagtctgtctga

SEQ ID NO: 10813 - DNA, 25 bp, Homo sapiens
ccctgcagcactttcagcatatgca

SEQ ID NO: 10814 - DNA, 25 bp, Homo sapiens
gagaccgcgctgaacttaggagggc

SEQ ID NO: 10815 - DNA, 25 bp, Homo sapiens
gggccttcacacagactgatgtggc

SEQ ID NO: 10816 - DNA, 25 bp, Homo sapiens
tgatgtggctaccttctcagaatta

SEQ ID NO: 10817 - DNA, 25 bp, Homo sapiens
atcaacggacttatctcagctctcc

SEQ ID NO: 10818 - DNA, 25 bp, Homo sapiens
atacctgatgcctctaagctgcaat

SEQ ID NO: 10819 - DNA, 25 bp, Homo sapiens
agaggagcagtttatcctttcccag

SEQ ID NO: 10820 - DNA, 25 bp, Homo sapiens
gctggacagtgctcacatcaaagcc

SEQ ID NO: 10821 - DNA, 25 bp, Homo sapiens
acatcaaagccgttcctgagcatgc

SEQ ID NO: 10822 - DNA, 25 bp, Homo sapiens
gcttctctccaagcaattcgtgcag

SEQ ID NO: 10823 - DNA, 25 bp, Homo sapiens
gagctactttgccagctagaggccg

SEQ ID NO: 10824 - DNA, 25 bp, Homo sapiens
ccgccacgcaagtgaagccagcaga

SEQ ID NO: 10825 - DNA, 25 bp, Homo sapiens
gcagaggagtgatagctgctcccca

SEQ ID NO: 10826 - DNA, 25 bp, Homo sapiens
atgccaacctgcctttgttacaagg

SEQ ID NO: 10827 - DNA, 25 bp, Homo sapiens
atttattggcttcaaggcccacctc

SEQ ID NO: 10828 - DNA, 25 bp, Homo sapiens
cccccaatcagtgttcttatttcag

SEQ ID NO: 10829 - DNA, 25 bp, Homo sapiens
ccgtccgctgttactcagctgaggt

SEQ ID NO: 10830 - DNA, 25 bp, Homo sapiens
tcctctttggggccaagctgtactc

SEQ ID NO: 10831 - DNA, 25 bp, Homo sapiens
cacgtccatcgacatgtggtcagcc

SEQ ID NO: 10832 - DNA, 25 bp, Homo sapiens
gcctctttttcccggcaatgatgtc

SEQ ID NO: 10833 - DNA, 25 bp, Homo sapiens
gaccaagctgccagactataagccc

SEQ ID NO: 10834 - DNA, 25 bp, Homo sapiens
tataagccctatccgatgtacccgg

SEQ ID NO: 10835 - DNA, 25 bp, Homo sapiens
acaacatccctggtgaacgtcgtgc

SEQ ID NO: 10836 - DNA, 25 bp, Homo sapiens
cgtgcccaaactcaatgccacaggg

SEQ ID NO: 10837 - DNA, 25 bp, Homo sapiens
gccacagggagggatctgctgcaga

SEQ ID NO: 10838 - DNA, 25 bp, Homo sapiens
accttctgaagtgtaaccctgtcca

SEQ ID NO: 10839 - DNA, 25 bp, Homo sapiens
cctgtccagcgtatctcagcagaag

SEQ ID NO: 10840 - DNA, 25 bp, Homo sapiens
gaagaagtctggtgacatctggctg

SEQ ID NO: 10841 - DNA, 25 bp, Homo sapiens
agtctggtgacatctggctggacgc

SEQ ID NO: 10842 - DNA, 25 bp, Homo sapiens
acgcctacctccatcagtgaaggca

SEQ ID NO: 10843 - DNA, 25 bp, Homo sapiens
tacctccatcagtgaaggcaacacc

SEQ ID NO: 10844 - DNA, 25 bp, Homo sapiens
atcagtgaaggcaacacccaggcgg

SEQ ID NO: 10845 - DNA, 25 bp, Homo sapiens
acacccaggcgggcagagaagggct

SEQ ID NO: 10846 - DNA, 25 bp, Homo sapiens
gcgggcagagaagggctcagggcac

SEQ ID NO: 10847 - DNA, 25 bp, Homo sapiens
ccccctcacatgtgtattcagcagc

SEQ ID NO: 10848 - DNA, 25 bp, Homo sapiens
cctcacatgtgtattcagcagccct

SEQ ID NO: 10849 - DNA, 25 bp, Homo sapiens
gatgggacaggggtagagggaaggt

SEQ ID NO: 10850 - DNA, 25 bp, Homo sapiens
gcacattttcctagagcgagaattg

SEQ ID NO: 10851 - DNA, 25 bp, Homo sapiens
aactgctttaagtcatgcttatgct

SEQ ID NO: 10852 - DNA, 25 bp, Homo sapiens
aagtcatgcttatgctgctggtgcc

SEQ ID NO: 10853 - DNA, 25 bp, Homo sapiens
tcatgcttatgctgctggtgccagt

SEQ ID NO: 10854 - DNA, 25 bp, Homo sapiens
gcttatgctgctggtgccagtcatt

SEQ ID NO: 10855 - DNA, 25 bp, Homo sapiens
tgctgctggtgccagtcatttgaag

SEQ ID NO: 10856 - DNA, 25 bp, Homo sapiens
gtccttggaggaaaagcagtcgtgc

SEQ ID NO: 10857 - DNA, 25 bp, Homo sapiens
gcagtcgtgcttaaagttcaaagct

SEQ ID NO: 10858 - DNA, 25 bp, Homo sapiens
gttcaaagctaatgatcacggatat

SEQ ID NO: 10859 - DNA, 25 bp, Homo sapiens
ggatatgacaacttccgttccagta

SEQ ID NO: 10860 - DNA, 25 bp, Homo sapiens
gacaacttccgttccagtaataaat

SEQ ID NO: 10861 - DNA, 25 bp, Homo sapiens
gtaataaatacagctcatcttgaaa

SEQ ID NO: 10862 - DNA, 25 bp, Homo sapiens
taatttctttacatactcaaaacca

SEQ ID NO: 10863 - DNA, 25 bp, Homo sapiens
aaaggtgctatcgttcaacttcaaa

SEQ ID NO: 10864 - DNA, 25 bp, Homo sapiens
tcaacttcaaaacatgtttcctagt

SEQ ID NO: 10865 - DNA, 25 bp, Homo sapiens
gtggatgtatgttcaaacacctttt

SEQ ID NO: 10866 - DNA, 25 bp, Homo sapiens
aaacaccttttagtattgatagctt

SEQ ID NO: 10867 - DNA, 25 bp, Homo sapiens
gtattgatagcttacatatggccaa

SEQ ID NO: 10868 - DNA, 25 bp, Homo sapiens
acatgggtatgctgtagctaacttt

SEQ ID NO: 10869 - DNA, 25 bp, Homo sapiens
tctgggaggattttttggttgccta

SEQ ID NO: 10870 - DNA, 25 bp, Homo sapiens
ggttgcctaaagtggctatagttac

SEQ ID NO: 10871 - DNA, 25 bp, Homo sapiens
ttaacaactaccttatttttcactg

SEQ ID NO: 10872 - DNA, 25 bp, Homo sapiens
ttttcactgtacagacactaattca

SEQ ID NO: 10873 - DNA, 25 bp, Homo sapiens
aaaggtgctgaggactaccctgacc

SEQ ID NO: 10874 - DNA, 25 bp, Homo sapiens
gataggattcacagcttgagctcaa

SEQ ID NO: 10875 - DNA, 25 bp, Homo sapiens
gagctcaaataagccacagcgtcct

SEQ ID NO: 10876 - DNA, 25 bp, Homo sapiens
agcgtcctgtgtttactcatgaaaa

SEQ ID NO: 10877 - DNA, 25 bp, Homo sapiens
ggctctgtataactatactcccagg

SEQ ID NO: 10878 - DNA, 25 bp, Homo sapiens
gtgatgacggctggtttgtggggac

SEQ ID NO: 10879 - DNA, 25 bp, Homo sapiens
tccccggaaactacgtcaagaggct

SEQ ID NO: 10880 - DNA, 25 bp, Homo sapiens
aagaggctgtgaattgcgctccctc

SEQ ID NO: 10881 - DNA, 25 bp, Homo sapiens
tcccgttgtcatgccttacggtttc

SEQ ID NO: 10882 - DNA, 25 bp, Homo sapiens
gggacgacatggcaggctggtcccc

SEQ ID NO: 10883 - DNA, 25 bp, Homo sapiens
gaaagtgtggattcctacttcctgc

SEQ ID NO: 10884 - DNA, 25 bp, Homo sapiens
tctcctcctcaactcagagtggggc

SEQ ID NO: 10885 - DNA, 25 bp, Homo sapiens
agaaaccaggcagccttttgtccct

SEQ ID NO: 10886 - DNA, 25 bp, Homo sapiens
gaaccactggcattatcgagacctg

SEQ ID NO: 10887 - DNA, 25 bp, Homo sapiens
agaatcacaggcgcagagcccatct

SEQ ID NO: 10888 - DNA, 25 bp, Homo sapiens
gagcccatcttcattgatgccaact

SEQ ID NO: 10889 - DNA, 25 bp, Homo sapiens
ccaacttccagagcacagtccctgg

SEQ ID NO: 10890 - DNA, 25 bp, Homo sapiens
gcatctgcagtacatcgtgacctgg

SEQ ID NO: 10891 - DNA, 25 bp, Homo sapiens
tgacctggtatggactctctgcagc

SEQ ID NO: 10892 - DNA, 25 bp, Homo sapiens
cagctacatcctacctgtggtttaa

SEQ ID NO: 10893 - DNA, 25 bp, Homo sapiens
aattcctacgtgggacacctggtgt

SEQ ID NO: 10894 - DNA, 25 bp, Homo sapiens
caagactgcctttatgctggatcat

SEQ ID NO: 10895 - DNA, 25 bp, Homo sapiens
aggccacaaagcaagtttctgtctt

SEQ ID NO: 10896 - DNA, 25 bp, Homo sapiens
gacacatcctgtgactatggctacc

SEQ ID NO: 10897 - DNA, 25 bp, Homo sapiens
ctatggctaccacaggcgatttgca

SEQ ID NO: 10898 - DNA, 25 bp, Homo sapiens
ggcgatttgcatgtactgcacacac

SEQ ID NO: 10899 - DNA, 25 bp, Homo sapiens
gagtcctggctgttatgatacctat

SEQ ID NO: 10900 - DNA, 25 bp, Homo sapiens
taaaggtcagtgtaaaccccagcta

SEQ ID NO: 10901 - DNA, 25 bp, Homo sapiens
cagctacctggttcctgaatctgac

SEQ ID NO: 10902 - DNA, 25 bp, Homo sapiens
gttgtgcgctgtgacattcgctaca

SEQ ID NO: 10903 - DNA, 25 bp, Homo sapiens
ttcgctacacaggacatcatgcgta

SEQ ID NO: 10904 - DNA, 25 bp, Homo sapiens
tcatgcgtatgcctcaggctgcaca

SEQ ID NO: 10905 - DNA, 25 bp, Homo sapiens
gctgcacaatttcaccgtattagaa

SEQ ID NO: 10906 - DNA, 25 bp, Homo sapiens
aaccagtgcctctatggacggctgc

SEQ ID NO: 10907 - DNA, 25 bp, Homo sapiens
gctgtggccccttcagacaatgggc

SEQ ID NO: 10908 - DNA, 25 bp, Homo sapiens
ttcaggacaggacaccaggctggct

SEQ ID NO: 10909 - DNA, 25 bp, Homo sapiens
aaatatgttctctgacaggacccag

SEQ ID NO: 10910 - DNA, 25 bp, Homo sapiens
ggaggttttccatgtccaaatgagg

SEQ ID NO: 10911 - DNA, 25 bp, Homo sapiens
gaggtcaagatgccgaaatcccaga

SEQ ID NO: 10912 - DNA, 25 bp, Homo sapiens
aatcccagatctgacttcacacttc

SEQ ID NO: 10913 - DNA, 25 bp, Homo sapiens
gcgcctcacggatggcaaagctctc

SEQ ID NO: 10914 - DNA, 25 bp, Homo sapiens
tctcctcacccatgggactgtagtg

SEQ ID NO: 10915 - DNA, 25 bp, Homo sapiens
aaacccgcgtctaggtgatgctttt

SEQ ID NO: 10916 - DNA, 25 bp, Homo sapiens
aaagttgtagcttcgtgctttgtac

SEQ ID NO: 10917 - DNA, 25 bp, Homo sapiens
catgaccagctgaggctacgcatag

SEQ ID NO: 10918 - DNA, 25 bp, Homo sapiens
tgaggctacgcataggggtccatac

SEQ ID NO: 10919 - DNA, 25 bp, Homo sapiens
gtgctggggttgttggcctgaagat

SEQ ID NO: 10920 - DNA, 25 bp, Homo sapiens
gaacactgcttctcgaatggagtct

SEQ ID NO: 10921 - DNA, 25 bp, Homo sapiens
aatggagtctaatggtcaagcgctg

SEQ ID NO: 10922 - DNA, 25 bp, Homo sapiens
tcaagcgctgaagatccatgtctcc

SEQ ID NO: 10923 - DNA, 25 bp, Homo sapiens
ctctaccaccaaggatgccctagat

SEQ ID NO: 10924 - DNA, 25 bp, Homo sapiens
ctagatgagctaggatgcttccagc

SEQ ID NO: 10925 - DNA, 25 bp, Homo sapiens
atgcttccagctagagcttcggggg

SEQ ID NO: 10926 - DNA, 25 bp, Homo sapiens
agctagagcttcggggggatgtgga

SEQ ID NO: 10927 - DNA, 25 bp, Homo sapiens
gatgcgaacatactggctcttagga

SEQ ID NO: 10928 - DNA, 25 bp, Homo sapiens
taaggacctttactgccacaaatca

SEQ ID NO: 10929 - DNA, 25 bp, Homo sapiens
gactggcttggccacaacctgaaag

SEQ ID NO: 10930 - DNA, 25 bp, Homo sapiens
ggacagtatattgccattacccagg

SEQ ID NO: 10931 - DNA, 25 bp, Homo sapiens
cagggcctgcaaacattaaccatga

SEQ ID NO: 10932 - DNA, 25 bp, Homo sapiens
taaccatgaccaatgcagcagccac

SEQ ID NO: 10933 - DNA, 25 bp, Homo sapiens
agccgggtactaccattctacagta

SEQ ID NO: 10934 - DNA, 25 bp, Homo sapiens
ggacagcagatcttagtgcccagca

SEQ ID NO: 10935 - DNA, 25 bp, Homo sapiens
tgttgttcaagctgcctctggagac

SEQ ID NO: 10936 - DNA, 25 bp, Homo sapiens
caaacataccagattcgcacagcac

SEQ ID NO: 10937 - DNA, 25 bp, Homo sapiens
tggagttgttatggcatcctcccca

SEQ ID NO: 10938 - DNA, 25 bp, Homo sapiens
cacttcctacacagcctgctgaaga

SEQ ID NO: 10939 - DNA, 25 bp, Homo sapiens
gagcctcaagagcacagccaaatgg

SEQ ID NO: 10940 - DNA, 25 bp, Homo sapiens
agcacagccaaatgggcggcatccc

SEQ ID NO: 10941 - DNA, 25 bp, Homo sapiens
aatgttttgttttggctagcatgtg

SEQ ID NO: 10942 - DNA, 25 bp, Homo sapiens
gatctacatgacctttctgtccagc

SEQ ID NO: 10943 - DNA, 25 bp, Homo sapiens
caaggcctcatcacaggtcaacgtg

SEQ ID NO: 10944 - DNA, 25 bp, Homo sapiens
gaaactccaggaccagatctttaat

SEQ ID NO: 10945 - DNA, 25 bp, Homo sapiens
catgaagtacgacagctacagccgc

SEQ ID NO: 10946 - DNA, 25 bp, Homo sapiens
agatttgcctgatgctcaaactgca

SEQ ID NO: 10947 - DNA, 25 bp, Homo sapiens
catgagcccccaaaaagccgggact

SEQ ID NO: 10948 - DNA, 25 bp, Homo sapiens
gccgggactggcagctttaagaagc

SEQ ID NO: 10949 - DNA, 25 bp, Homo sapiens
cgtgccgggtttatcattgctttgt

SEQ ID NO: 10950 - DNA, 25 bp, Homo sapiens
ggccgcagctgaagggtgtggtcct

SEQ ID NO: 10951 - DNA, 25 bp, Homo sapiens
tttacccgcaagccgaagaagccca

SEQ ID NO: 10952 - DNA, 25 bp, Homo sapiens
ttacccgcaagccgaagaagcccaa

SEQ ID NO: 10953 - DNA, 25 bp, Homo sapiens
cccaactcagccaatcgcaagtgct

SEQ ID NO: 10954 - DNA, 25 bp, Homo sapiens
aactcagccaatcgcaagtgctgtc

SEQ ID NO: 10955 - DNA, 25 bp, Homo sapiens
ctcagccaatcgcaagtgctgtcga

SEQ ID NO: 10956 - DNA, 25 bp, Homo sapiens
gccaatcgcaagtgctgtcgagtgc

SEQ ID NO: 10957 - DNA, 25 bp, Homo sapiens
atcgcaagtgctgtcgagtgcggct

SEQ ID NO: 10958 - DNA, 25 bp, Homo sapiens
cgcaagtgctgtcgagtgcggctca

SEQ ID NO: 10959 - DNA, 25 bp, Homo sapiens
caagtgctgtcgagtgcggctcagc

SEQ ID NO: 10960 - DNA, 25 bp, Homo sapiens
gtgctgtcgagtgcggctcagcact

SEQ ID NO: 10961 - DNA, 25 bp, Homo sapiens
gtttctgacgcatttcaacactcac

SEQ ID NO: 10962 - DNA, 25 bp, Homo sapiens
ggcgggaagacgcgttgaacccagg

SEQ ID NO: 10963 - DNA, 25 bp, Homo sapiens
agaacctgctgaaaaccgatgaccc

SEQ ID NO: 10964 - DNA, 25 bp, Homo sapiens
gatgacccccagcattgaaatggac

SEQ ID NO: 10965 - DNA, 25 bp, Homo sapiens
ggactctgagatggcagcgtggtgc

SEQ ID NO: 10966 - DNA, 25 bp, Homo sapiens
actgattacacaagactgccctttc

SEQ ID NO: 10967 - DNA, 25 bp, Homo sapiens
gctgtgatctcgacaacttactttc

SEQ ID NO: 10968 - DNA, 25 bp, Homo sapiens
cataaagcacagatctccgcacagg

SEQ ID NO: 10969 - DNA, 25 bp, Homo sapiens
cctcggctacctacttagctttggg

SEQ ID NO: 10970 - DNA, 25 bp, Homo sapiens
aagctgtgtgaccatcagctcgcac

SEQ ID NO: 10971 - DNA, 25 bp, Homo sapiens
ctggtccaaggtctgtgacgtgctc

SEQ ID NO: 10972 - DNA, 25 bp, Homo sapiens
ataactgctgatggtagctggcttt

SEQ ID NO: 10973 - DNA, 25 bp, Homo sapiens
ggtagctggcttttgaaatcctatg

SEQ ID NO: 10974 - DNA, 25 bp, Homo sapiens
gctggcttttgaaatcctatggggt

SEQ ID NO: 10975 - DNA, 25 bp, Homo sapiens
ttgaaatcctatggggtctctgaat

SEQ ID NO: 10976 - DNA, 25 bp, Homo sapiens
ctctcttttgctccatatggtgctg

SEQ ID NO: 10977 - DNA, 25 bp, Homo sapiens
ttgctccatatggtgctgttctcta

SEQ ID NO: 10978 - DNA, 25 bp, Homo sapiens
atatggtgctgttctctatgtgttt

SEQ ID NO: 10979 - DNA, 25 bp, Homo sapiens
ggtgctgttctctatgtgtttgcag

SEQ ID NO: 10980 - DNA, 25 bp, Homo sapiens
tttttaggcaccaaatctccctcat

SEQ ID NO: 10981 - DNA, 25 bp, Homo sapiens
gtgcccagaatggatgaccagggac

SEQ ID NO: 10982 - DNA, 25 bp, Homo sapiens
tgaccagggaccttaaagagtggct

SEQ ID NO: 10983 - DNA, 25 bp, Homo sapiens
agtatgaaaatttccgccaccttct

SEQ ID NO: 10984 - DNA, 25 bp, Homo sapiens
gcaagccccagtggatgatgcacag

SEQ ID NO: 10985 - DNA, 25 bp, Homo sapiens
gatgcacaggaaattcttcactcca

SEQ ID NO: 10986 - DNA, 25 bp, Homo sapiens
tcttcactccagatttccaatgcca

SEQ ID NO: 10987 - DNA, 25 bp, Homo sapiens
tgaacatggaggcagccaggcccgt

SEQ ID NO: 10988 - DNA, 25 bp, Homo sapiens
tcaacccttcacagactcataataa

SEQ ID NO: 10989 - DNA, 25 bp, Homo sapiens
gcaggagtctggagcacctattctt

SEQ ID NO: 10990 - DNA, 25 bp, Homo sapiens
tggagcacctattcttacagatgat

SEQ ID NO: 10991 - DNA, 25 bp, Homo sapiens
tcacttgaagaaacttgctgtgtcc

SEQ ID NO: 10992 - DNA, 25 bp, Homo sapiens
gctgtgtccagtgctgcttgaagtg

SEQ ID NO: 10993 - DNA, 25 bp, Homo sapiens
ttattttgcttaccacagtgttata

SEQ ID NO: 10994 - DNA, 25 bp, Homo sapiens
ggtgcaacaggaccaatgggccagc

SEQ ID NO: 10995 - DNA, 25 bp, Homo sapiens
gaccaatgggccagcaaggcatccc

SEQ ID NO: 10996 - DNA, 25 bp, Homo sapiens
caggcaaggctggccactgtaatcc

SEQ ID NO: 10997 - DNA, 25 bp, Homo sapiens
ctttggggccatgccgatggagcag

SEQ ID NO: 10998 - DNA, 25 bp, Homo sapiens
catgccgatggagcagcagtaccca

SEQ ID NO: 10999 - DNA, 25 bp, Homo sapiens
aaccatgaaggggccttttggctga

SEQ ID NO: 11000 - DNA, 25 bp, Homo sapiens
agactccgttgggaataaatggcca

SEQ ID NO: 11001 - DNA, 25 bp, Homo sapiens
ggccaaagcttataggactctgtga

SEQ ID NO: 11002 - DNA, 25 bp, Homo sapiens
gactctgtgacaggttgtgaatgtt

SEQ ID NO: 11003 - DNA, 25 bp, Homo sapiens
aagggcatttgggtacaggggcata

SEQ ID NO: 11004 - DNA, 25 bp, Homo sapiens
aatcctagctattcaaggggctgag

SEQ ID NO: 11005 - DNA, 25 bp, Homo sapiens
tgaccatgcaccttacaatttctga

SEQ ID NO: 11006 - DNA, 25 bp, Homo sapiens
atgctttatatgagtgtcttctggg

SEQ ID NO: 11007 - DNA, 25 bp, Homo sapiens
aagactcacactgcagcaatcatcc

SEQ ID NO: 11008 - DNA, 25 bp, Homo sapiens
gaactgtggcacggttgctcaacac

SEQ ID NO: 11009 - DNA, 25 bp, Homo sapiens
ctcaacacatcacctcggacaaatt

SEQ ID NO: 11010 - DNA, 25 bp, Homo sapiens
tcaggaagcatttctttagcccaca

SEQ ID NO: 11011 - DNA, 25 bp, Homo sapiens
gacccaggtgctctgtatgtttgtt

SEQ ID NO: 11012 - DNA, 25 bp, Homo sapiens
catcatatccaagttcactctgtct

SEQ ID NO: 11013 - DNA, 25 bp, Homo sapiens
gtgttttatccaacttttgtgcata

SEQ ID NO: 11014 - DNA, 25 bp, Homo sapiens
ggcatggtttgcttaggagttcaga

SEQ ID NO: 11015 - DNA, 25 bp, Homo sapiens
tcagagttccttcatcatcgaaata

SEQ ID NO: 11016 - DNA, 25 bp, Homo sapiens
ccttctctgatttcttcagcagggt

SEQ ID NO: 11017 - DNA, 25 bp, Homo sapiens
atggggaatgcttgtcactgtggag

SEQ ID NO: 11018 - DNA, 25 bp, Homo sapiens
atatgtctgataccgttgttataac

SEQ ID NO: 11019 - DNA, 25 bp, Homo sapiens
gcaaggccattgcaacaggcattta

SEQ ID NO: 11020 - DNA, 25 bp, Homo sapiens
ggggcatttgtaaaggtgtccctgg

SEQ ID NO: 11021 - DNA, 25 bp, Homo sapiens
ggcattgccaagtgtgtgtcgctca

SEQ ID NO: 11022 - DNA, 25 bp, Homo sapiens
gtgtgtcgctcataggactagtgta

SEQ ID NO: 11023 - DNA, 25 bp, Homo sapiens
atgctgatttgcttctggtttctgt

SEQ ID NO: 11024 - DNA, 25 bp, Homo sapiens
ctaccatgtcgcacactttgttaat

SEQ ID NO: 11025 - DNA, 25 bp, Homo sapiens
gttaatgacaaacttcactctacac

SEQ ID NO: 11026 - DNA, 25 bp, Homo sapiens
cactctacactatacagtaccttgt

SEQ ID NO: 11027 - DNA, 25 bp, Homo sapiens
tgctgggcagctggctagagcaggc

SEQ ID NO: 11028 - DNA, 25 bp, Homo sapiens
cagcggcagtcagtgaggccgaggc

SEQ ID NO: 11029 - DNA, 25 bp, Homo sapiens
tctacgagcagaacagccgctacca

SEQ ID NO: 11030 - DNA, 25 bp, Homo sapiens
gtgggggccagaaggcaacatcctg

SEQ ID NO: 11031 - DNA, 25 bp, Homo sapiens
gcaacatcctggactatgccaacaa

SEQ ID NO: 11032 - DNA, 25 bp, Homo sapiens
tgccaacaagcagctggcggggttg

SEQ ID NO: 11033 - DNA, 25 bp, Homo sapiens
gaggcgctggttgacagtgtggccc

SEQ ID NO: 11034 - DNA, 25 bp, Homo sapiens
cctttccaacagcaccagtttgaca

SEQ ID NO: 11035 - DNA, 25 bp, Homo sapiens
ggccttcgttctcagcaagcagagg

SEQ ID NO: 11036 - DNA, 25 bp, Homo sapiens
tcaaatattaccccggctgggtggc

SEQ ID NO: 11037 - DNA, 25 bp, Homo sapiens
tggtgatagattcgccaccactggg

SEQ ID NO: 11038 - DNA, 25 bp, Homo sapiens
tgtgcttcgagttggtgtttctttc

SEQ ID NO: 11039 - DNA, 25 bp, Homo sapiens
gtggtcacaacccagttactcataa

SEQ ID NO: 11040 - DNA, 25 bp, Homo sapiens
gtatttgttcgtagatatgcccaga

SEQ ID NO: 11041 - DNA, 25 bp, Homo sapiens
gtcagtcaactataaacaggcccaa

SEQ ID NO: 11042 - DNA, 25 bp, Homo sapiens
aactgttccattactacgcaaacac

SEQ ID NO: 11043 - DNA, 25 bp, Homo sapiens
aacacatattagaggcctttgctga

SEQ ID NO: 11044 - DNA, 25 bp, Homo sapiens
cacattagctggatcttagccaccc

SEQ ID NO: 11045 - DNA, 25 bp, Homo sapiens
gcatattggaatcccatctacccat

SEQ ID NO: 11046 - DNA, 25 bp, Homo sapiens
atctacccatagttcctctgaaggt

SEQ ID NO: 11047 - DNA, 25 bp, Homo sapiens
cacacccaccaatacctaaatctgt

SEQ ID NO: 11048 - DNA, 25 bp, Homo sapiens
gtgctcattgagtagttccagacag

SEQ ID NO: 11049 - DNA, 25 bp, Homo sapiens
gaaatggtcctaatcctgagtcgtc

SEQ ID NO: 11050 - DNA, 25 bp, Homo sapiens
tgagtcgtcacccttggattttatg

SEQ ID NO: 11051 - DNA, 25 bp, Homo sapiens
atggatcacggagctgaccatcttt

SEQ ID NO: 11052 - DNA, 25 bp, Homo sapiens
gaccatctttacctggtcctggaac

SEQ ID NO: 11053 - DNA, 25 bp, Homo sapiens
gaaaatgagcctttggaccagtctt

SEQ ID NO: 11054 - DNA, 25 bp, Homo sapiens
gagcctttggaccagtctttattaa

SEQ ID NO: 11055 - DNA, 25 bp, Homo sapiens
tgagtagtctgcatatcgaatatct

SEQ ID NO: 11056 - DNA, 25 bp, Homo sapiens
gaatatctagagctctaaacccccc

SEQ ID NO: 11057 - DNA, 25 bp, Homo sapiens
gtcctgtggtttcattagtctgata

SEQ ID NO: 11058 - DNA, 25 bp, Homo sapiens
agggatttcctcagtcacagatgat

SEQ ID NO: 11059 - DNA, 25 bp, Homo sapiens
ggaaagctgcaataaagccacaatg

SEQ ID NO: 11060 - DNA, 25 bp, Homo sapiens
taatcccaacactttaggagtccaa

SEQ ID NO: 11061 - DNA, 25 bp, Homo sapiens
ggccaaggtgataaaacccgtctct

SEQ ID NO: 11062 - DNA, 25 bp, Homo sapiens
tgttggtgcaggcttgcaatcccag

SEQ ID NO: 11063 - DNA, 25 bp, Homo sapiens
ctacttgggacgctgaggtgggagg

SEQ ID NO: 11064 - DNA, 25 bp, Homo sapiens
aggtgggaggatcgcctgaacctca

SEQ ID NO: 11065 - DNA, 25 bp, Homo sapiens
tgcagtgagccgagagcatgccgct

SEQ ID NO: 11066 - DNA, 25 bp, Homo sapiens
aaagtctaattgctgtcctgtggtt

SEQ ID NO: 11067 - DNA, 25 bp, Homo sapiens
ctgtcctgtggtttcattagtctga

SEQ ID NO: 11068 - DNA, 25 bp, Homo sapiens
agggatttcctcagtcacagatgat

SEQ ID NO: 11069 - DNA, 25 bp, Homo sapiens
tgggggctttatcatgcaacattag

SEQ ID NO: 11070 - DNA, 25 bp, Homo sapiens
gagcttttcagttaaacatactcct

SEQ ID NO: 11071 - DNA, 25 bp, Homo sapiens
tgactattctcatctctgttttgca

SEQ ID NO: 11072 - DNA, 25 bp, Homo sapiens
tgttttgcaggtttacgccgcacac

SEQ ID NO: 11073 - DNA, 25 bp, Homo sapiens
gcacactttgatttccttaatagcc

SEQ ID NO: 11074 - DNA, 25 bp, Homo sapiens
agcccatttctgttaacctattatc

SEQ ID NO: 11075 - DNA, 25 bp, Homo sapiens
aacaaagacattcttcccacttctt

SEQ ID NO: 11076 - DNA, 25 bp, Homo sapiens
atgtggtttggatgtgtgctttaat

SEQ ID NO: 11077 - DNA, 25 bp, Homo sapiens
tagaaattaataccactacccgtga

SEQ ID NO: 11078 - DNA, 25 bp, Homo sapiens
ctacccgtgaattatatggcctgac

SEQ ID NO: 11079 - DNA, 25 bp, Homo sapiens
gaagaacagtactccacaaacatgg

SEQ ID NO: 11080 - DNA, 25 bp, Homo sapiens
ggtaacaagagttccatcccaggag

SEQ ID NO: 11081 - DNA, 25 bp, Homo sapiens
atcccaggaggccaaacggtgcaac

SEQ ID NO: 11082 - DNA, 25 bp, Homo sapiens
accagtcggtgagtgagcagatcaa

SEQ ID NO: 11083 - DNA, 25 bp, Homo sapiens
gtggaagcaagccttcaatgccacg

SEQ ID NO: 11084 - DNA, 25 bp, Homo sapiens
tcaatgccacggctgtggtgcggca

SEQ ID NO: 11085 - DNA, 25 bp, Homo sapiens
gctgtggtgcggcacatgaggaaac

SEQ ID NO: 11086 - DNA, 25 bp, Homo sapiens
cagctggctgttgctgtcgagactg

SEQ ID NO: 11087 - DNA, 25 bp, Homo sapiens
ctgcgtggagccgggcacagaactg

SEQ ID NO: 11088 - DNA, 25 bp, Homo sapiens
gtcatgatcctctgcgtgggagggc

SEQ ID NO: 11089 - DNA, 25 bp, Homo sapiens
ccaaagatttcatccggcacttgat

SEQ ID NO: 11090 - DNA, 25 bp, Homo sapiens
agaaaagattcacctgtgagcaggc

SEQ ID NO: 11091 - DNA, 25 bp, Homo sapiens
ccttgcagcacccatggattgcagg

SEQ ID NO: 11092 - DNA, 25 bp, Homo sapiens
agataagaatatccaccagtcggtg

SEQ ID NO: 11093 - DNA, 25 bp, Homo sapiens
ttatgttctaagtgcctccaagttc

SEQ ID NO: 11094 - DNA, 25 bp, Homo sapiens
gtaagtctttaatgccgatatcttc

SEQ ID NO: 11095 - DNA, 25 bp, Homo sapiens
taagcaaacttacaggtcctgctga

SEQ ID NO: 11096 - DNA, 25 bp, Homo sapiens
atgtggcagatctacatgtctagag

SEQ ID NO: 11097 - DNA, 25 bp, Homo sapiens
gaacactgtgctctattaccattat

SEQ ID NO: 11098 - DNA, 25 bp, Homo sapiens
tagagatggtttctactggctgcca

SEQ ID NO: 11099 - DNA, 25 bp, Homo sapiens
tactggctgccagaatctagagcaa

SEQ ID NO: 11100 - DNA, 25 bp, Homo sapiens
tgatatgcttctttgtgttatttcc

SEQ ID NO: 11101 - DNA, 25 bp, Homo sapiens
tatttccctcccaagtaaatgtttg

SEQ ID NO: 11102 - DNA, 25 bp, Homo sapiens
atgtttgtccttgggtccattttct

SEQ ID NO: 11103 - DNA, 25 bp, Homo sapiens
gtccttgggtccattttctatgctt

SEQ ID NO: 11104 - DNA, 25 bp, Homo sapiens
gtgcttagcggctctgaggtgaccg

SEQ ID NO: 11105 - DNA, 25 bp, Homo sapiens
tgaccgcatagacttctcagaccaa

SEQ ID NO: 11106 - DNA, 25 bp, Homo sapiens
ggcaatcaaggcctgagcaaccaaa

SEQ ID NO: 11107 - DNA, 25 bp, Homo sapiens
cccatatggcttttctacctgtaac

SEQ ID NO: 11108 - DNA, 25 bp, Homo sapiens
tagagccatggccgtagatttataa

SEQ ID NO: 11109 - DNA, 25 bp, Homo sapiens
gactgaagacagtccctatcctaga

SEQ ID NO: 11110 - DNA, 25 bp, Homo sapiens
tcctagaggggttgagctttcttcc

SEQ ID NO: 11111 - DNA, 25 bp, Homo sapiens
gctttcttcctccttgggttggagg

SEQ ID NO: 11112 - DNA, 25 bp, Homo sapiens
ggggatcggcaaacaggctacccct

SEQ ID NO: 11113 - DNA, 25 bp, Homo sapiens
gaggtcccatgtgccatgagtgtgc

SEQ ID NO: 11114 - DNA, 25 bp, Homo sapiens
cagggccaggaaggcaggttccctc

SEQ ID NO: 11115 - DNA, 25 bp, Homo sapiens
aggatgcactgtgcttggtcctgac

SEQ ID NO: 11116 - DNA, 25 bp, Homo sapiens
gggtgacctgaagttccacatctac

SEQ ID NO: 11117 - DNA, 25 bp, Homo sapiens
tacaacatgggcaaccctggcttcg

SEQ ID NO: 11118 - DNA, 25 bp, Homo sapiens
agcgggccttgttttatgcggcaga

SEQ ID NO: 11119 - DNA, 25 bp, Homo sapiens
tagaagacctccaccgtgagaacac

SEQ ID NO: 11120 - DNA, 25 bp, Homo sapiens
aacaccgtctaccgagatctgaaac

SEQ ID NO: 11121 - DNA, 25 bp, Homo sapiens
ttaggatctcagacctgggcttggc

SEQ ID NO: 11122 - DNA, 25 bp, Homo sapiens
tgggcttggctgtgaagatccccga

SEQ ID NO: 11123 - DNA, 25 bp, Homo sapiens
aatgtatgcctgcaagcgcttggag

SEQ ID NO: 11124 - DNA, 25 bp, Homo sapiens
gagtccatggccctcaatgagaagc

SEQ ID NO: 11125 - DNA, 25 bp, Homo sapiens
cctggcctatgcctacgagaccaag

SEQ ID NO: 11126 - DNA, 25 bp, Homo sapiens
tcccgtcgacgtagaacctcgaggt

SEQ ID NO: 11127 - DNA, 25 bp, Homo sapiens
gtagaacctcgaggtttctcaaaga

SEQ ID NO: 11128 - DNA, 25 bp, Homo sapiens
agaaatttccactcaggtctgtttt

SEQ ID NO: 11129 - DNA, 25 bp, Homo sapiens
gggtggattggatttgtctttggtg

SEQ ID NO: 11130 - DNA, 25 bp, Homo sapiens
ccaattggatacgacaacttgcacg

SEQ ID NO: 11131 - DNA, 25 bp, Homo sapiens
acttgcacgtattttaatagcgtca

SEQ ID NO: 11132 - DNA, 25 bp, Homo sapiens
atttctctactgtctcagtttacat

SEQ ID NO: 11133 - DNA, 25 bp, Homo sapiens
gtgtatattttctgtgcagccactg

SEQ ID NO: 11134 - DNA, 25 bp, Homo sapiens
gtgcagccactgttaagccatgtgt

SEQ ID NO: 11135 - DNA, 25 bp, Homo sapiens
gccatgtgttccaaggcattttagc

SEQ ID NO: 11136 - DNA, 25 bp, Homo sapiens
gtgactcaagacttccagagcctca

SEQ ID NO: 11137 - DNA, 25 bp, Homo sapiens
tgggagcatggtgagcagccctggt

SEQ ID NO: 11138 - DNA, 25 bp, Homo sapiens
tgctcagcagccatacctatgggac

SEQ ID NO: 11139 - DNA, 25 bp, Homo sapiens
catacctatgggacacacactacga

SEQ ID NO: 11140 - DNA, 25 bp, Homo sapiens
gacacacactacgaaaaggatgcct

SEQ ID NO: 11141 - DNA, 25 bp, Homo sapiens
ggagattttactcctttcttcaaca

SEQ ID NO: 11142 - DNA, 25 bp, Homo sapiens
ttttactcctttcttcaacaactat

SEQ ID NO: 11143 - DNA, 25 bp, Homo sapiens
actcctttcttcaacaactattcac

SEQ ID NO: 11144 - DNA, 25 bp, Homo sapiens
ttcttcaacaactattcactggaca

SEQ ID NO: 11145 - DNA, 25 bp, Homo sapiens
tattcactggacaagttctctgctc

SEQ ID NO: 11146 - DNA, 25 bp, Homo sapiens
gtgaatgtattgttctagtgggata

SEQ ID NO: 11147 - DNA, 25 bp, Homo sapiens
gtattgttctagtgggatacacaaa

SEQ ID NO: 11148 - DNA, 25 bp, Homo sapiens
aaactgcttagatgacggggcctcc

SEQ ID NO: 11149 - DNA, 25 bp, Homo sapiens
gaatttctgttagcaatatgttagc

SEQ ID NO: 11150 - DNA, 25 bp, Homo sapiens
ttagcaagagagggcactcccaggc

SEQ ID NO: 11151 - DNA, 25 bp, Homo sapiens
cctccccaggcgatggacaattatg

SEQ ID NO: 11152 - DNA, 25 bp, Homo sapiens
gtgatacatgccgaatgccacacgt

SEQ ID NO: 11153 - DNA, 25 bp, Homo sapiens
tgccgaatgccacacgtaaacactt

SEQ ID NO: 11154 - DNA, 25 bp, Homo sapiens
aactgacagatgaccgcaataatga

SEQ ID NO: 11155 - DNA, 25 bp, Homo sapiens
tccactggagttcactttcaattgc

SEQ ID NO: 11156 - DNA, 25 bp, Homo sapiens
tggagttcactttcaattgcttctg

SEQ ID NO: 11157 - DNA, 25 bp, Homo sapiens
tctttccctgggaaggctgggggca

SEQ ID NO: 11158 - DNA, 25 bp, Homo sapiens
gcaggggaggtctggatgtgacacc

SEQ ID NO: 11159 - DNA, 25 bp, Homo sapiens
tgaccttcatggccgtcggaggagg

SEQ ID NO: 11160 - DNA, 25 bp, Homo sapiens
tggcagcagcgtcgtcataggtaat

SEQ ID NO: 11161 - DNA, 25 bp, Homo sapiens
gtcgtcataggtaatattggtgccc

SEQ ID NO: 11162 - DNA, 25 bp, Homo sapiens
attggtgccctgatgggctacgcca

SEQ ID NO: 11163 - DNA, 25 bp, Homo sapiens
gccacccacaagtatctcgatagtg

SEQ ID NO: 11164 - DNA, 25 bp, Homo sapiens
ggatgaggagtagccagcagctccc

SEQ ID NO: 11165 - DNA, 25 bp, Homo sapiens
ttcttggcctaactcttccagttag

SEQ ID NO: 11166 - DNA, 25 bp, Homo sapiens
aactcttccagttaggatctagaac

SEQ ID NO: 11167 - DNA, 25 bp, Homo sapiens
gatgcgaacatagtacactgcagcc

SEQ ID NO: 11168 - DNA, 25 bp, Homo sapiens
attacaagcatgcgccgacgatgcc

SEQ ID NO: 11169 - DNA, 25 bp, Homo sapiens
gacgatgcccagaatccagaacttt

SEQ ID NO: 11170 - DNA, 25 bp, Homo sapiens
ctgtccccgtgttgcatgaaggagc

SEQ ID NO: 11171 - DNA, 25 bp, Homo sapiens
gcattgactggtttacaggccctgc

SEQ ID NO: 11172 - DNA, 25 bp, Homo sapiens
ggatgccttcccaaacctgaaggac

SEQ ID NO: 11173 - DNA, 25 bp, Homo sapiens
ggacttcatctcccgatttgagggc

SEQ ID NO: 11174 - DNA, 25 bp, Homo sapiens
gaagatctctgcctacatgaagtcc

SEQ ID NO: 11175 - DNA, 25 bp, Homo sapiens
aagatggctgtctggggcaacaagt

SEQ ID NO: 11176 - DNA, 25 bp, Homo sapiens
gggagtgaggagcccatactcagcc

SEQ ID NO: 11177 - DNA, 25 bp, Homo sapiens
ttactcccaagacttcattgtccct

SEQ ID NO: 11178 - DNA, 25 bp, Homo sapiens
catgcaggccctttgaagcctcagc

SEQ ID NO: 11179 - DNA, 25 bp, Homo sapiens
ccttccttcctgttagtggttgtgt

SEQ ID NO: 11180 - DNA, 25 bp, Homo sapiens
tgtgtctgctttaaagggcctgcct

SEQ ID NO: 11181 - DNA, 25 bp, Homo sapiens
gggatcctatttagctcttagtacc

SEQ ID NO: 11182 - DNA, 25 bp, Homo sapiens
aagttcggcatgtagctcatgatct

SEQ ID NO: 11183 - DNA, 25 bp, Homo sapiens
gatctatgctgtttctatgtcgtgg

SEQ ID NO: 11184 - DNA, 25 bp, Homo sapiens
atgtcgtggaagcaccggatggggg

SEQ ID NO: 11185 - DNA, 25 bp, Homo sapiens
gggtagtgagcaaatctgccctgct

SEQ ID NO: 11186 - DNA, 25 bp, Homo sapiens
tgctcagcagtcaccatagcagctg

SEQ ID NO: 11187 - DNA, 25 bp, Homo sapiens
cagcactgcctgagtagttttgatc

SEQ ID NO: 11188 - DNA, 25 bp, Homo sapiens
aagtgcttttgtctccagagtatgc

SEQ ID NO: 11189 - DNA, 25 bp, Homo sapiens
cagagtatgcgggagacccttccac

SEQ ID NO: 11190 - DNA, 25 bp, Homo sapiens
gatggatatttcttccccaaggatt

SEQ ID NO: 11191 - DNA, 25 bp, Homo sapiens
caagatagtgtgctttattctgttg

SEQ ID NO: 11192 - DNA, 25 bp, Homo sapiens
atatcttcttcaggctctgacaggc

SEQ ID NO: 11193 - DNA, 25 bp, Homo sapiens
aacttccacatatttttcaactgca

SEQ ID NO: 11194 - DNA, 25 bp, Homo sapiens
cataactttcactaacacacacata

SEQ ID NO: 11195 - DNA, 25 bp, Homo sapiens
gcaaaatttttctagcttccatcct

SEQ ID NO: 11196 - DNA, 25 bp, Homo sapiens
gggggagctggtaactgatgaaatc

SEQ ID NO: 11197 - DNA, 25 bp, Homo sapiens
cccaccttttctcttcaggaaatat

SEQ ID NO: 11198 - DNA, 25 bp, Homo sapiens
gtttggttaacgtgatacattctgt

SEQ ID NO: 11199 - DNA, 25 bp, Homo sapiens
aaacatctactgaatttctgtaatt

SEQ ID NO: 11200 - DNA, 25 bp, Homo sapiens
aatattttgctgctagttaactatg

SEQ ID NO: 11201 - DNA, 25 bp, Homo sapiens
gaagaatcttacagatgctgctata

SEQ ID NO: 11202 - DNA, 25 bp, Homo sapiens
gatgtattactcttattatttctat

SEQ ID NO: 11203 - DNA, 25 bp, Homo sapiens
gaagttgttcaactatccttgccac

SEQ ID NO: 11204 - DNA, 25 bp, Homo sapiens
gaccaaacaaggttttcactgcttt

SEQ ID NO: 11205 - DNA, 25 bp, Homo sapiens
attgtcttgactactcaaagcccct

SEQ ID NO: 11206 - DNA, 25 bp, Homo sapiens
aaagcccctgaattgttgtcaactt

SEQ ID NO: 11207 - DNA, 25 bp, Homo sapiens
gtgtagccctaacgtcatttagctt

SEQ ID NO: 11208 - DNA, 25 bp, Homo sapiens
atttagcttgttgtctgatgcctcc

SEQ ID NO: 11209 - DNA, 25 bp, Homo sapiens
tgtctgatgcctccagtaggacacc

SEQ ID NO: 11210 - DNA, 25 bp, Homo sapiens
gtaggacacctccgatggagctttg

SEQ ID NO: 11211 - DNA, 25 bp, Homo sapiens
aagatgcatctcgcataggctgcct

SEQ ID NO: 11212 - DNA, 25 bp, Homo sapiens
tatgatgaaggaccgtgcacctcca

SEQ ID NO: 11213 - DNA, 25 bp, Homo sapiens
cacctccactccaacagagtgctga

SEQ ID NO: 11214 - DNA, 25 bp, Homo sapiens
acatcgacgtggagattacaggacc

SEQ ID NO: 11215 - DNA, 25 bp, Homo sapiens
ggagacagagaatccagtgggaaat

SEQ ID NO: 11216 - DNA, 25 bp, Homo sapiens
tgggaaatacacatttgctgctcac

SEQ ID NO: 11217 - DNA, 25 bp, Homo sapiens
tgttttagtaaccggatgtccacca

SEQ ID NO: 11218 - DNA, 25 bp, Homo sapiens
tagtaaccggatgtccaccatgact

SEQ ID NO: 11219 - DNA, 25 bp, Homo sapiens
ggatgtccaccatgactccaaaaat

SEQ ID NO: 11220 - DNA, 25 bp, Homo sapiens
gactccaaaaatagtgatgttcacc

SEQ ID NO: 11221 - DNA, 25 bp, Homo sapiens
tcaccattgatattggggaggctcc

SEQ ID NO: 11222 - DNA, 25 bp, Homo sapiens
ggggaggctccaaaaggacaagata

SEQ ID NO: 11223 - DNA, 25 bp, Homo sapiens
ggaaacagaagctcaccagaacaag

SEQ ID NO: 11224 - DNA, 25 bp, Homo sapiens
gaagctcaccagaacaagctagaag

SEQ ID NO: 11225 - DNA, 25 bp, Homo sapiens
gatcaatgagctagcagtggcgatg

SEQ ID NO: 11226 - DNA, 25 bp, Homo sapiens
agtggcgatgacagctgtaaagcac

SEQ ID NO: 11227 - DNA, 25 bp, Homo sapiens
ggaatacatggaagtccgggagaga

SEQ ID NO: 11228 - DNA, 25 bp, Homo sapiens
ggagagaatacacagagccatcaac

SEQ ID NO: 11229 - DNA, 25 bp, Homo sapiens
gagccatcaacgacaacacaaacag

SEQ ID NO: 11230 - DNA, 25 bp, Homo sapiens
ctcttgttctagttgccatgacatt

SEQ ID NO: 11231 - DNA, 25 bp, Homo sapiens
gacattgggacagatctactacctg

SEQ ID NO: 11232 - DNA, 25 bp, Homo sapiens
gagattttttgaagtccggagagtt

SEQ ID NO: 11233 - DNA, 25 bp, Homo sapiens
ctcttcctgatgatcccaactcaga

SEQ ID NO: 11234 - DNA, 25 bp, Homo sapiens
gatcccaactcagaattcactgttt

SEQ ID NO: 11235 - DNA, 25 bp, Homo sapiens
atgtcattagtttctccatttttat

SEQ ID NO: 11236 - DNA, 25 bp, Homo sapiens
tatgggtacaacgtggctgctgtca

SEQ ID NO: 11237 - DNA, 25 bp, Homo sapiens
ttgacgttgctgtggtctgtaaccg

SEQ ID NO: 11238 - DNA, 25 bp, Homo sapiens
taaccgtgtccatgtttccatttgg

SEQ ID NO: 11239 - DNA, 25 bp, Homo sapiens
tggtcggccccttggtgaataaatt

SEQ ID NO: 11240 - DNA, 25 bp, Homo sapiens
tattttctatcgtgcctgcgatctt

SEQ ID NO: 11241 - DNA, 25 bp, Homo sapiens
gcagagtcgccacatcatttgagct

SEQ ID NO: 11242 - DNA, 25 bp, Homo sapiens
atgtgcaggtgtatcttccaacgtg

SEQ ID NO: 11243 - DNA, 25 bp, Homo sapiens
caacgtggtccccatgtacttaggg

SEQ ID NO: 11244 - DNA, 25 bp, Homo sapiens
tcatcactgttggcatccttgtggc

SEQ ID NO: 11245 - DNA, 25 bp, Homo sapiens
tggtcttcggaatctccttgcaaac

SEQ ID NO: 11246 - DNA, 25 bp, Homo sapiens
aaacgtagatggctggccgatcctg

SEQ ID NO: 11247 - DNA, 25 bp, Homo sapiens
gacttctagctgtctgtgaatatcc

SEQ ID NO: 11248 - DNA, 25 bp, Homo sapiens
aactctgatgtggaatgcagtcctc

SEQ ID NO: 11249 - DNA, 25 bp, Homo sapiens
tccccaccccagtgggaactgtgca

SEQ ID NO: 11250 - DNA, 25 bp, Homo sapiens
ctgtcaccagacccgagtcaattaa

SEQ ID NO: 11251 - DNA, 25 bp, Homo sapiens
gagtcaattaaacagctggtcctcc

SEQ ID NO: 11252 - DNA, 25 bp, Homo sapiens
cactttgctggttcagccttcgtgt

SEQ ID NO: 11253 - DNA, 25 bp, Homo sapiens
tcttccggggccatgggcatttgtt

SEQ ID NO: 11254 - DNA, 25 bp, Homo sapiens
agagccaaattcatcctcttaccag

SEQ ID NO: 11255 - DNA, 25 bp, Homo sapiens
agatccttttccagaaatacctgtc

SEQ ID NO: 11256 - DNA, 25 bp, Homo sapiens
acaggttcctgtggagacactgagt

SEQ ID NO: 11257 - DNA, 25 bp, Homo sapiens
gacactgagtcagaattcttcatcc

SEQ ID NO: 11258 - DNA, 25 bp, Homo sapiens
tccatctgccccaggacaagagcaa

SEQ ID NO: 11259 - DNA, 25 bp, Homo sapiens
gacatcagttgcccagtcatgtgat

SEQ ID NO: 11260 - DNA, 25 bp, Homo sapiens
cctgccatcttgccttaggaacagc

SEQ ID NO: 11261 - DNA, 25 bp, Homo sapiens
gctggctggggcgttagccaagcca

SEQ ID NO: 11262 - DNA, 25 bp, Homo sapiens
aagccacctactgccaggaattgga

SEQ ID NO: 11263 - DNA, 25 bp, Homo sapiens
ttccctcctgtgtcaagtagctaac

SEQ ID NO: 11264 - DNA, 25 bp, Homo sapiens
tgtaggtcacaggttgaggcccagc

SEQ ID NO: 11265 - DNA, 25 bp, Homo sapiens
tttccatcctttagcaggctgggcc

SEQ ID NO: 11266 - DNA, 25 bp, Homo sapiens
agaacgtgcagggcctgcctagctt

SEQ ID NO: 11267 - DNA, 25 bp, Homo sapiens
gcctagcttgcgtgcttgaggaagg

SEQ ID NO: 11268 - DNA, 25 bp, Homo sapiens
aggaaggtggcattccgtgcttgcc

SEQ ID NO: 11269 - DNA, 25 bp, Homo sapiens
ctgagccctacgaggagctggaggc

SEQ ID NO: 11270 - DNA, 25 bp, Homo sapiens
gagctggaggcggaggagtgcggga

SEQ ID NO: 11271 - DNA, 25 bp, Homo sapiens
cggaggagtgcgggatcctggacgg

SEQ ID NO: 11272 - DNA, 25 bp, Homo sapiens
gcatggcctgcgttgacatcaacga

SEQ ID NO: 11273 - DNA, 25 bp, Homo sapiens
acgagtgtgatgaggccgaggctgc

SEQ ID NO: 11274 - DNA, 25 bp, Homo sapiens
tgtgatgaggccgaggctgcctccc

SEQ ID NO: 11275 - DNA, 25 bp, Homo sapiens
ctgcagcccgcttatgcgtatgtgc

SEQ ID NO: 11276 - DNA, 25 bp, Homo sapiens
cagcccgcttatgcgtatgtgcacg

SEQ ID NO: 11277 - DNA, 25 bp, Homo sapiens
cttatgcgtatgtgcacggggccgc

SEQ ID NO: 11278 - DNA, 25 bp, Homo sapiens
ccgcctggacctggagaagggacct

SEQ ID NO: 11279 - DNA, 25 bp, Homo sapiens
gacctggagaagggacctacggacg

SEQ ID NO: 11280 - DNA, 25 bp, Homo sapiens
tgctgacatctgtgcgtaactctgc

SEQ ID NO: 11281 - DNA, 25 bp, Homo sapiens
aactctgccacgtgtcacagtgagg

SEQ ID NO: 11282 - DNA, 25 bp, Homo sapiens
ttttcagctgttctttgtagtccct

SEQ ID NO: 11283 - DNA, 25 bp, Homo sapiens
gcttcacaaggggccccaattcaag

SEQ ID NO: 11284 - DNA, 25 bp, Homo sapiens
gaatggttgcatgatctgccttgcc

SEQ ID NO: 11285 - DNA, 25 bp, Homo sapiens
gagtacccagctgtcaagttctgca

SEQ ID NO: 11286 - DNA, 25 bp, Homo sapiens
tgaagagctcagttattggcgccag

SEQ ID NO: 11287 - DNA, 25 bp, Homo sapiens
agttcaccaggaatgcccttcctgc

SEQ ID NO: 11288 - DNA, 25 bp, Homo sapiens
ttttgttcgtgttactgaccagctg

SEQ ID NO: 11289 - DNA, 25 bp, Homo sapiens
gggggatgatttctttgctgtggac

SEQ ID NO: 11290 - DNA, 25 bp, Homo sapiens
gaccttgaagcttttctccaggaat

SEQ ID NO: 11291 - DNA, 25 bp, Homo sapiens
actgcacttcgaatgtgttaccaag

SEQ ID NO: 11292 - DNA, 25 bp, Homo sapiens
ttatggttaccctttgatgctgttc

SEQ ID NO: 11293 - DNA, 25 bp, Homo sapiens
gactttgatttctgcagcaccaatg

SEQ ID NO: 11294 - DNA, 25 bp, Homo sapiens
gcagtcagaggggctccgtgaagca

SEQ ID NO: 11295 - DNA, 25 bp, Homo sapiens
gtcctacaaattaccatgtctcctg

SEQ ID NO: 11296 - DNA, 25 bp, Homo sapiens
atgtctcctgacaagccttatttca

SEQ ID NO: 11297 - DNA, 25 bp, Homo sapiens
aatgcaggaagttcccaccttgact

SEQ ID NO: 11298 - DNA, 25 bp, Homo sapiens
ccaccttgactatcccaaagattct

SEQ ID NO: 11299 - DNA, 25 bp, Homo sapiens
caagatttccttactgaaaccctct

SEQ ID NO: 11300 - DNA, 25 bp, Homo sapiens
cagaggcttcctttcattacagtat

SEQ ID NO: 11301 - DNA, 25 bp, Homo sapiens
ttgtggaatattactgctgccctga

SEQ ID NO: 11302 - DNA, 25 bp, Homo sapiens
gaaaacccactggttcttagctctg

SEQ ID NO: 11303 - DNA, 25 bp, Homo sapiens
gcctagttactatcctgtcagttct

SEQ ID NO: 11304 - DNA, 25 bp, Homo sapiens
agaatctgggccctaggagccctgt

SEQ ID NO: 11305 - DNA, 25 bp, Homo sapiens
aatactggagcaacaatgcccctgc

SEQ ID NO: 11306 - DNA, 25 bp, Homo sapiens
tcactctcaccaagtcaccagaggg

SEQ ID NO: 11307 - DNA, 25 bp, Homo sapiens
ctgtaggacctcttttgttgcttaa

SEQ ID NO: 11308 - DNA, 25 bp, Homo sapiens
taagaatcaggcagtcgcccacttc

SEQ ID NO: 11309 - DNA, 25 bp, Homo sapiens
gcccacttctctccagatgaaggga

SEQ ID NO: 11310 - DNA, 25 bp, Homo sapiens
gacattcataggtcccaaatctgcc

SEQ ID NO: 11311 - DNA, 25 bp, Homo sapiens
aatttacttcttccacacatgtggt

SEQ ID NO: 11312 - DNA, 25 bp, Homo sapiens
agcctcttatgcaccacagttaaat

SEQ ID NO: 11313 - DNA, 25 bp, Homo sapiens
cacccacaacatctacgaatcgtac

SEQ ID NO: 11314 - DNA, 25 bp, Homo sapiens
gaatcgtacttctttaattgatcta

SEQ ID NO: 11315 - DNA, 25 bp, Homo sapiens
tgatctaatttacatattctgcgtg

SEQ ID NO: 11316 - DNA, 25 bp, Homo sapiens
attctgcgtgttgtattcagcacta

SEQ ID NO: 11317 - DNA, 25 bp, Homo sapiens
aggatatttactacttttgcatgaa

SEQ ID NO: 11318 - DNA, 25 bp, Homo sapiens
gctttcaagtacatggctagctttt

SEQ ID NO: 11319 - DNA, 25 bp, Homo sapiens
ggctagcttttatggcagttctggt

SEQ ID NO: 11320 - DNA, 25 bp, Homo sapiens
atggcagttctggtgaatgttcaat

SEQ ID NO: 11321 - DNA, 25 bp, Homo sapiens
gttcaatgggaactggtcaccatga

SEQ ID NO: 11322 - DNA, 25 bp, Homo sapiens
gattaacgacaagattttctacttt

SEQ ID NO: 11323 - DNA, 25 bp, Homo sapiens
tgtccttcagccaaacacaatatgg

SEQ ID NO: 11324 - DNA, 25 bp, Homo sapiens
gtcatattgtttcctgtgctggagc

SEQ ID NO: 11325 - DNA, 25 bp, Homo sapiens
tgatatttctttcagacttcgccag

SEQ ID NO: 11326 - DNA, 25 bp, Homo sapiens
gacttcgccagacagattgctgata

SEQ ID NO: 11327 - DNA, 25 bp, Homo sapiens
ataacatcaggttccagttgcttga

SEQ ID NO: 11328 - DNA, 25 bp, Homo sapiens
aagaagtactgcccttttgtgtgtt

SEQ ID NO: 11329 - DNA, 25 bp, Homo sapiens
ttattccactggcgcatcatatgca

SEQ ID NO: 11330 - DNA, 25 bp, Homo sapiens
ggttcacaccattttgtttagacaa

SEQ ID NO: 11331 - DNA, 25 bp, Homo sapiens
aggcgtcaacgtgcattttatttat

SEQ ID NO: 11332 - DNA, 25 bp, Homo sapiens
tttccaatttctacctttactacat

SEQ ID NO: 11333 - DNA, 25 bp, Homo sapiens
ctacctttactacatcttttcaaca

SEQ ID NO: 11334 - DNA, 25 bp, Homo sapiens
aggccctgagttggcagtggcccat

SEQ ID NO: 11335 - DNA, 25 bp, Homo sapiens
gaactaggctcatcagaatcgtgac

SEQ ID NO: 11336 - DNA, 25 bp, Homo sapiens
gaatcgtgactattattgctccatc

SEQ ID NO: 11337 - DNA, 25 bp, Homo sapiens
agaaatgatgtggaccttgctggaa

SEQ ID NO: 11338 - DNA, 25 bp, Homo sapiens
aacaatttttgttcaatgcccaccg

SEQ ID NO: 11339 - DNA, 25 bp, Homo sapiens
gttcaatgcccaccgagacatatag

SEQ ID NO: 11340 - DNA, 25 bp, Homo sapiens
tgatacatgtgtcccttataggctc

SEQ ID NO: 11341 - DNA, 25 bp, Homo sapiens
tatttagtcaaaccaccttttatgt

SEQ ID NO: 11342 - DNA, 25 bp, Homo sapiens
tatagcataaaaacctccagtactt

SEQ ID NO: 11343 - DNA, 25 bp, Homo sapiens
ctccagtactttggttgacccttgt

SEQ ID NO: 11344 - DNA, 25 bp, Homo sapiens
ggttgacccttgtatgtcacagctc

SEQ ID NO: 11345 - DNA, 25 bp, Homo sapiens
gtcacagctctgctctatttattat

SEQ ID NO: 11346 - DNA, 25 bp, Homo sapiens
catgctggaccagatcaactcctgt

SEQ ID NO: 11347 - DNA, 25 bp, Homo sapiens
ctggaccagatcaactcctgtctgg

SEQ ID NO: 11348 - DNA, 25 bp, Homo sapiens
ggaccagatcaactcctgtctggac

SEQ ID NO: 11349 - DNA, 25 bp, Homo sapiens
gaccagatcaactcctgtctggacc

SEQ ID NO: 11350 - DNA, 25 bp, Homo sapiens
ccagatcaactcctgtctggaccac

SEQ ID NO: 11351 - DNA, 25 bp, Homo sapiens
ctgctggagtccaaccggcagacac

SEQ ID NO: 11352 - DNA, 25 bp, Homo sapiens
ctggcttagacaccttctcaagggc

SEQ ID NO: 11353 - DNA, 25 bp, Homo sapiens
gcttagacaccttctcaagggctgg

SEQ ID NO: 11354 - DNA, 25 bp, Homo sapiens
ttagacaccttctcaagggctggcc

SEQ ID NO: 11355 - DNA, 25 bp, Homo sapiens
ccaggccttgagtgtccacattaaa

SEQ ID NO: 11356 - DNA, 25 bp, Homo sapiens
aggccttgagtgtccacattaaatg

SEQ ID NO: 11357 - DNA, 25 bp, Homo sapiens
cccgccccagatggattttacattt

SEQ ID NO: 11358 - DNA, 25 bp, Homo sapiens
tgtttcgctccaaagggttgtcttc

SEQ ID NO: 11359 - DNA, 25 bp, Homo sapiens
ggttgtcttcctcgccaaaaggagg

SEQ ID NO: 11360 - DNA, 25 bp, Homo sapiens
ggacattctgtaaactgtccctccc

SEQ ID NO: 11361 - DNA, 25 bp, Homo sapiens
tccctccctaattccaaggatcaga

SEQ ID NO: 11362 - DNA, 25 bp, Homo sapiens
gaccgaagccacagggcagcatgga

SEQ ID NO: 11363 - DNA, 25 bp, Homo sapiens
taaatgtgttactggctttgtgcct

SEQ ID NO: 11364 - DNA, 25 bp, Homo sapiens
tttgtgcctgtagctcattttatta

SEQ ID NO: 11365 - DNA, 25 bp, Homo sapiens
tatgacctatatgctcctgatttaa

SEQ ID NO: 11366 - DNA, 25 bp, Homo sapiens
aagagatctgtgtactgtttacttc

SEQ ID NO: 11367 - DNA, 25 bp, Homo sapiens
cttgtatctcctttctcgggaattg

SEQ ID NO: 11368 - DNA, 25 bp, Homo sapiens
tgtaaacccatctatttaaacgcaa

SEQ ID NO: 11369 - DNA, 25 bp, Homo sapiens
cgcaaaggtgggttgatgtcagttt

SEQ ID NO: 11370 - DNA, 25 bp, Homo sapiens
agcagaaagcattcactatcctcta

SEQ ID NO: 11371 - DNA, 25 bp, Homo sapiens
actatcctctaagatttgtttctgc

SEQ ID NO: 11372 - DNA, 25 bp, Homo sapiens
atttcaccttgtacaatggccagcc

SEQ ID NO: 11373 - DNA, 25 bp, Homo sapiens
tggccagcccctaaagcaggaaaca

SEQ ID NO: 11374 - DNA, 25 bp, Homo sapiens
ttgcccagcccttgaatcatgtggc

SEQ ID NO: 11375 - DNA, 25 bp, Homo sapiens
tttagtggtttcttagcctctctta

SEQ ID NO: 11376 - DNA, 25 bp, Homo sapiens
ctctcttacagcccacggggatagt

SEQ ID NO: 11377 - DNA, 25 bp, Homo sapiens
agcccacggggatagtactgtacat

SEQ ID NO: 11378 - DNA, 25 bp, Homo sapiens
gtactgtacatcaataccttcatat

SEQ ID NO: 11379 - DNA, 25 bp, Homo sapiens
tcagtcccagctcagatcgaattat

SEQ ID NO: 11380 - DNA, 25 bp, Homo sapiens
acaagcacacacaattttatccaat

SEQ ID NO: 11381 - DNA, 25 bp, Homo sapiens
ccctcgaatagcttgagagccccac

SEQ ID NO: 11382 - DNA, 25 bp, Homo sapiens
gtgacttcatccacactgacgtcac

SEQ ID NO: 11383 - DNA, 25 bp, Homo sapiens
ctgcacatttgcacacgatccggag

SEQ ID NO: 11384 - DNA, 25 bp, Homo sapiens
acacgatccggagagccgaaggccg

SEQ ID NO: 11385 - DNA, 25 bp, Homo sapiens
tgtagtttccaaagacacgtctgca

SEQ ID NO: 11386 - DNA, 25 bp, Homo sapiens
gacacgtctgcatttgaatttctag

SEQ ID NO: 11387 - DNA, 25 bp, Homo sapiens
aaatcacatcatgcctagaatctga

SEQ ID NO: 11388 - DNA, 25 bp, Homo sapiens
aaccgactgtttgcattttccatat

SEQ ID NO: 11389 - DNA, 25 bp, Homo sapiens
atatatccttttatctgctcttttt

SEQ ID NO: 11390 - DNA, 25 bp, Homo sapiens
ctgtggtgcccatcgaaactacaag

SEQ ID NO: 11391 - DNA, 25 bp, Homo sapiens
caagaagctgttgggctcctgttgc

SEQ ID NO: 11392 - DNA, 25 bp, Homo sapiens
tgagtatcctccgggcagaactgga

SEQ ID NO: 11393 - DNA, 25 bp, Homo sapiens
gcgctaggcatgaagggtacccctt

SEQ ID NO: 11394 - DNA, 25 bp, Homo sapiens
tggcctccttggatgttgcgaacat

SEQ ID NO: 11395 - DNA, 25 bp, Homo sapiens
tgcgaacatcatcagtggctcgggc

SEQ ID NO: 11396 - DNA, 25 bp, Homo sapiens
cgacggaccctggactcagatgaag

SEQ ID NO: 11397 - DNA, 25 bp, Homo sapiens
gactggtcacatatgcgtggcatca

SEQ ID NO: 11398 - DNA, 25 bp, Homo sapiens
gcgagagtaactgagctctgccacc

SEQ ID NO: 11399 - DNA, 25 bp, Homo sapiens
aggagggacccttgatacatgtaca

SEQ ID NO: 11400 - DNA, 25 bp, Homo sapiens
acaaagcatacatagcaccccttgc

SEQ ID NO: 11401 - DNA, 25 bp, Homo sapiens
ccagttcccaggctgcagttgaggg

SEQ ID NO: 11402 - DNA, 25 bp, Homo sapiens
tgcagttgagggtctgtccttgtca

SEQ ID NO: 11403 - DNA, 25 bp, Homo sapiens
gggctgtctggtgtatggtagggtg

SEQ ID NO: 11404 - DNA, 25 bp, Homo sapiens
tggtagggtgctcagcagcatccct

SEQ ID NO: 11405 - DNA, 25 bp, Homo sapiens
cctctgcccactagacatcagaagc

SEQ ID NO: 11406 - DNA, 25 bp, Homo sapiens
aatatctccagaccttggcaaatgt

SEQ ID NO: 11407 - DNA, 25 bp, Homo sapiens
ctgtgggggaaaattgccctcaatt

SEQ ID NO: 11408 - DNA, 25 bp, Homo sapiens
ttgccctcaattgagaaccactggt

SEQ ID NO: 11409 - DNA, 25 bp, Homo sapiens
accactggtctagctagacctgcac

SEQ ID NO: 11410 - DNA, 25 bp, Homo sapiens
gtgttcagacagccacatgagggga

SEQ ID NO: 11411 - DNA, 25 bp, Homo sapiens
acagtgcagctacaggatatgccat

SEQ ID NO: 11412 - DNA, 25 bp, Homo sapiens
cacctgcttagggactttgaactta

SEQ ID NO: 11413 - DNA, 25 bp, Homo sapiens
gaacttaaatatatccccttcctca

SEQ ID NO: 11414 - DNA, 25 bp, Homo sapiens
cccttcctcaagtggtgctatttta

SEQ ID NO: 11415 - DNA, 25 bp, Homo sapiens
ttctgaattcattatgatccccata

SEQ ID NO: 11416 - DNA, 25 bp, Homo sapiens
tccccatattgggtaatgctgaaca

SEQ ID NO: 11417 - DNA, 25 bp, Homo sapiens
gatatgtcatagggatttctttctg

SEQ ID NO: 11418 - DNA, 25 bp, Homo sapiens
gacaaaagggtgctttgctgttctt

SEQ ID NO: 11419 - DNA, 25 bp, Homo sapiens
ttttgtattctatcccagatcacag

SEQ ID NO: 11420 - DNA, 25 bp, Homo sapiens
tcaaaccgtcaccctttagtttgct

SEQ ID NO: 11421 - DNA, 25 bp, Homo sapiens
gtcaccctttagtttgcttgaactt

SEQ ID NO: 11422 - DNA, 25 bp, Homo sapiens
gaactttagtaaaccacctgcttag

SEQ ID NO: 11423 - DNA, 25 bp, Homo sapiens
gaagcaagtttcatcgtgtcatcaa

SEQ ID NO: 11424 - DNA, 25 bp, Homo sapiens
gtgacatcaccactggagatggcac

SEQ ID NO: 11425 - DNA, 25 bp, Homo sapiens
actgggggtgtgagcatctatggtg

SEQ ID NO: 11426 - DNA, 25 bp, Homo sapiens
ggcattgggtgggtcagcatggcca

SEQ ID NO: 11427 - DNA, 25 bp, Homo sapiens
tctttatcaccttgaccaagcccac

SEQ ID NO: 11428 - DNA, 25 bp, Homo sapiens
gcccacctggttggacggcaaacat

SEQ ID NO: 11429 - DNA, 25 bp, Homo sapiens
tgcactccatagagctccaagcaac

SEQ ID NO: 11430 - DNA, 25 bp, Homo sapiens
aagcaactgatgggcatgaccgtcc

SEQ ID NO: 11431 - DNA, 25 bp, Homo sapiens
tcaccaactgctcgatcatcaacag

SEQ ID NO: 11432 - DNA, 25 bp, Homo sapiens
acgccttttgtggttgagatcgctg

SEQ ID NO: 11433 - DNA, 25 bp, Homo sapiens
gagatcgctgattggtgacacaact

SEQ ID NO: 11434 - DNA, 25 bp, Homo sapiens
ggaactaatgtccctgagatgttta

SEQ ID NO: 11435 - DNA, 25 bp, Homo sapiens
gactgggacatatcatccctagagg

SEQ ID NO: 11436 - DNA, 25 bp, Homo sapiens
gaacctccacctgcgaaaaatgaac

SEQ ID NO: 11437 - DNA, 25 bp, Homo sapiens
gctcatgtgctaaatgcctggggcg

SEQ ID NO: 11438 - DNA, 25 bp, Homo sapiens
gcctggggcgcatttaatcctaagg

SEQ ID NO: 11439 - DNA, 25 bp, Homo sapiens
tgtgactgattggagcgacacttca

SEQ ID NO: 11440 - DNA, 25 bp, Homo sapiens
aagccagcagtatttcagtatcaca

SEQ ID NO: 11441 - DNA, 25 bp, Homo sapiens
ccgtgtttcccacagcaacacagag

SEQ ID NO: 11442 - DNA, 25 bp, Homo sapiens
aatggtctctttaatggcacccaat

SEQ ID NO: 11443 - DNA, 25 bp, Homo sapiens
aaggtgtttaagacttccgctgctg

SEQ ID NO: 11444 - DNA, 25 bp, Homo sapiens
agacttccgctgctgcttaaaaata

SEQ ID NO: 11445 - DNA, 25 bp, Homo sapiens
tgtgggagtcttgggtactcgcacc

SEQ ID NO: 11446 - DNA, 25 bp, Homo sapiens
gcacctcttggctttgttgatgctc

SEQ ID NO: 11447 - DNA, 25 bp, Homo sapiens
tccgccaggaaggccacttgtgtgt

SEQ ID NO: 11448 - DNA, 25 bp, Homo sapiens
agtgtaaacttccgttcattgctct

SEQ ID NO: 11449 - DNA, 25 bp, Homo sapiens
atttgtattacgtatctccccaagt

SEQ ID NO: 11450 - DNA, 25 bp, Homo sapiens
gccagctgcatctgtctgaatggtg

SEQ ID NO: 11451 - DNA, 25 bp, Homo sapiens
gaatggtgcgtgaaggctctcagac

SEQ ID NO: 11452 - DNA, 25 bp, Homo sapiens
ttacatgccccgtttttgagactga

SEQ ID NO: 11453 - DNA, 25 bp, Homo sapiens
atctcgatgcaggtggatctccttg

SEQ ID NO: 11454 - DNA, 25 bp, Homo sapiens
gccaaccctcctccaatggaaattc

SEQ ID NO: 11455 - DNA, 25 bp, Homo sapiens
aattcccgtgttgcttcaaactgag

SEQ ID NO: 11456 - DNA, 25 bp, Homo sapiens
gagcgattccattttatgactgttg

SEQ ID NO: 11457 - DNA, 25 bp, Homo sapiens
ttatgactgttgtttttcacatttt

SEQ ID NO: 11458 - DNA, 25 bp, Homo sapiens
ttcatctttctaaggtgtgtctctt

SEQ ID NO: 11459 - DNA, 25 bp, Homo sapiens
ctaaggtgtgtctcttttccaatga

SEQ ID NO: 11460 - DNA, 25 bp, Homo sapiens
tgagaagtcatttttgcaagccaaa

SEQ ID NO: 11461 - DNA, 25 bp, Homo sapiens
gcaagccaaaagtcgatcaatcgca

SEQ ID NO: 11462 - DNA, 25 bp, Homo sapiens
gtcgatcaatcgcattcattttaag

SEQ ID NO: 11463 - DNA, 25 bp, Homo sapiens
attatacctttttagtacttgctga

SEQ ID NO: 11464 - DNA, 25 bp, Homo sapiens
gggtaaatcacatactttgtttaga

SEQ ID NO: 11465 - DNA, 25 bp, Homo sapiens
tcacccagctggtctcatacataga

SEQ ID NO: 11466 - DNA, 25 bp, Homo sapiens
catacatagacagcacttgtgaagg

SEQ ID NO: 11467 - DNA, 25 bp, Homo sapiens
gaaccgctttcagaaccgagtgcgc

SEQ ID NO: 11468 - DNA, 25 bp, Homo sapiens
gcgcgagaaacagaagctcttccag

SEQ ID NO: 11469 - DNA, 25 bp, Homo sapiens
aggacaatgacatcccgttgtacct

SEQ ID NO: 11470 - DNA, 25 bp, Homo sapiens
gtacctgaagggcggcatcgttgac

SEQ ID NO: 11471 - DNA, 25 bp, Homo sapiens
ggcatcgttgacaacatcctgtacc

SEQ ID NO: 11472 - DNA, 25 bp, Homo sapiens
atcctgtaccgagtgacaatgacgc

SEQ ID NO: 11473 - DNA, 25 bp, Homo sapiens
acaatgacgctgtgtctgggcggca

SEQ ID NO: 11474 - DNA, 25 bp, Homo sapiens
ctacgcgtgtccttgggcggagaag

SEQ ID NO: 11475 - DNA, 25 bp, Homo sapiens
agaagcctggggggcctgagagact

SEQ ID NO: 11476 - DNA, 25 bp, Homo sapiens
gaagggaggtgactccggcggaaga

SEQ ID NO: 11477 - DNA, 25 bp, Homo sapiens
caaggcagaatgcaggcccttcggg

SEQ ID NO: 11478 - DNA, 25 bp, Homo sapiens
ggaaatctgaacccctggatgagag

SEQ ID NO: 11479 - DNA, 25 bp, Homo sapiens
tgacaatgacttctgacccttttgc

SEQ ID NO: 11480 - DNA, 25 bp, Homo sapiens
ggaccctggcagattaaaaccctca

SEQ ID NO: 11481 - DNA, 25 bp, Homo sapiens
taagctggctggactcatgatcact

SEQ ID NO: 11482 - DNA, 25 bp, Homo sapiens
ttatttctgctttagcctcctatgt

SEQ ID NO: 11483 - DNA, 25 bp, Homo sapiens
gctgacgccacacaagtcttggctg

SEQ ID NO: 11484 - DNA, 25 bp, Homo sapiens
gtcttggctgcttttgttactatac

SEQ ID NO: 11485 - DNA, 25 bp, Homo sapiens
ttggcactggggactcatgtttgga

SEQ ID NO: 11486 - DNA, 25 bp, Homo sapiens
gaatcgtaggggaacatctggctgt

SEQ ID NO: 11487 - DNA, 25 bp, Homo sapiens
gaacatttcctatacatcggctttt

SEQ ID NO: 11488 - DNA, 25 bp, Homo sapiens
ctttcgtctgcatgttcacaatacc

SEQ ID NO: 11489 - DNA, 25 bp, Homo sapiens
aggtaagatgttaatctcccagccc

SEQ ID NO: 11490 - DNA, 25 bp, Homo sapiens
gaggctactcttgacttagacctat

SEQ ID NO: 11491 - DNA, 25 bp, Homo sapiens
ctgaaagatctctgtcacatccaac

SEQ ID NO: 11492 - DNA, 25 bp, Homo sapiens
agagcatccctatgggcttggacca

SEQ ID NO: 11493 - DNA, 25 bp, Homo sapiens
tttcatcggtgcctggtactctggc

SEQ ID NO: 11494 - DNA, 25 bp, Homo sapiens
tcagcctttaggtctttagtccggg

SEQ ID NO: 11495 - DNA, 25 bp, Homo sapiens
tagtccgggggacttggggctgaga

SEQ ID NO: 11496 - DNA, 25 bp, Homo sapiens
taaataaccctgggctgtccagcct

SEQ ID NO: 11497 - DNA, 25 bp, Homo sapiens
gctgtccagccttaatagacttctc

SEQ ID NO: 11498 - DNA, 25 bp, Homo sapiens
agacttctcttacattttcgtcctg

SEQ ID NO: 11499 - DNA, 25 bp, Homo sapiens
cagctggaccatctctgtaggatcg

SEQ ID NO: 11500 - DNA, 25 bp, Homo sapiens
aagtacaaggaatttgccatcccag

SEQ ID NO: 11501 - DNA, 25 bp, Homo sapiens
gtacaaggaatttgccatcccagag

SEQ ID NO: 11502 - DNA, 25 bp, Homo sapiens
acaaggaatttgccatcccagagga

SEQ ID NO: 11503 - DNA, 25 bp, Homo sapiens
actgtcagagccggcggtggtgcag

SEQ ID NO: 11504 - DNA, 25 bp, Homo sapiens
tgtcagagccggcggtggtgcagaa

SEQ ID NO: 11505 - DNA, 25 bp, Homo sapiens
tcagagccggcggtggtgcagaaga

SEQ ID NO: 11506 - DNA, 25 bp, Homo sapiens
ctccatgcctgaccaacaggcccag

SEQ ID NO: 11507 - DNA, 25 bp, Homo sapiens
gacacagatcccggggagctgtgag

SEQ ID NO: 11508 - DNA, 25 bp, Homo sapiens
cagatcccggggagctgtgagggcc

SEQ ID NO: 11509 - DNA, 25 bp, Homo sapiens
tgggcagtgggtggatcctggtttc

SEQ ID NO: 11510 - DNA, 25 bp, Homo sapiens
cagtgggtggatcctggtttcgtgt

SEQ ID NO: 11511 - DNA, 25 bp, Homo sapiens
tggtgacacaaacagccttttccca

SEQ ID NO: 11512 - DNA, 25 bp, Homo sapiens
ggtacctggagcgagtggacgagca

SEQ ID NO: 11513 - DNA, 25 bp, Homo sapiens
gcagcatcgccgaaagtatgcccgg

SEQ ID NO: 11514 - DNA, 25 bp, Homo sapiens
gcgtcccgtctaaaggtgttctgca

SEQ ID NO: 11515 - DNA, 25 bp, Homo sapiens
aacgtatgctagcagagcttctccc

SEQ ID NO: 11516 - DNA, 25 bp, Homo sapiens
cttctccccgtgaatcatattttta

SEQ ID NO: 11517 - DNA, 25 bp, Homo sapiens
aagatcccactcttagctggtaaat

SEQ ID NO: 11518 - DNA, 25 bp, Homo sapiens
gaatcgacatagtagccccataagc

SEQ ID NO: 11519 - DNA, 25 bp, Homo sapiens
gagtgaggagccatctctagcgggc

SEQ ID NO: 11520 - DNA, 25 bp, Homo sapiens
cactgtcctgggcttatggtgccta

SEQ ID NO: 11521 - DNA, 25 bp, Homo sapiens
gcatgcagatcagctgttgccttca

SEQ ID NO: 11522 - DNA, 25 bp, Homo sapiens
tgatgaccctcaagggacttcccag

SEQ ID NO: 11523 - DNA, 25 bp, Homo sapiens
cagcacctacaacaaagacttacag

SEQ ID NO: 11524 - DNA, 25 bp, Homo sapiens
tctctacgctgcagattcaccaaga

SEQ ID NO: 11525 - DNA, 25 bp, Homo sapiens
cactgaccttgcctattacctggtc

SEQ ID NO: 11526 - DNA, 25 bp, Homo sapiens
tggtccgcaaagggatgccattccg

SEQ ID NO: 11527 - DNA, 25 bp, Homo sapiens
aagctgtgttcatggccgagaccaa

SEQ ID NO: 11528 - DNA, 25 bp, Homo sapiens
gatctgcgtgtgggactacgggcac

SEQ ID NO: 11529 - DNA, 25 bp, Homo sapiens
agtgtggagcagtatggtgccctgg

SEQ ID NO: 11530 - DNA, 25 bp, Homo sapiens
cagcgtcgactggcagatccgccag

SEQ ID NO: 11531 - DNA, 25 bp, Homo sapiens
aaccccgacagtttggagctgatcc

SEQ ID NO: 11532 - DNA, 25 bp, Homo sapiens
gagctgatccggagcaaggctgggc

SEQ ID NO: 11533 - DNA, 25 bp, Homo sapiens
gctgcgggagaacctagcgcttaag

SEQ ID NO: 11534 - DNA, 25 bp, Homo sapiens
cctagcgcttaaggagctctgcctg

SEQ ID NO: 11535 - DNA, 25 bp, Homo sapiens
gctgggcgaagaatggggcccccgc

SEQ ID NO: 11536 - DNA, 25 bp, Homo sapiens
ccccgcgacctaggcgatggaagct

SEQ ID NO: 11537 - DNA, 25 bp, Homo sapiens
taggcgatggaagctccagcactgg

SEQ ID NO: 11538 - DNA, 25 bp, Homo sapiens
gtgggcagtccggatcagttgcccc

SEQ ID NO: 11539 - DNA, 25 bp, Homo sapiens
tgttcccccgatgattgaaggcact

SEQ ID NO: 11540 - DNA, 25 bp, Homo sapiens
cccccgatgattgaaggcactgctt

SEQ ID NO: 11541 - DNA, 25 bp, Homo sapiens
ccgctggcatggactaagaaatcct

SEQ ID NO: 11542 - DNA, 25 bp, Homo sapiens
gaaatcctgacaccaagaagggccc

SEQ ID NO: 11543 - DNA, 25 bp, Homo sapiens
gaaggctggagcggagggacttgct

SEQ ID NO: 11544 - DNA, 25 bp, Homo sapiens
gcccagctttcactggggggagacg

SEQ ID NO: 11545 - DNA, 25 bp, Homo sapiens
ggggggagacgaggagaggcaatgg

SEQ ID NO: 11546 - DNA, 25 bp, Homo sapiens
cttggcaacagaatgctcagcccct

SEQ ID NO: 11547 - DNA, 25 bp, Homo sapiens
cccctcgtggcaggacttgacaagg

SEQ ID NO: 11548 - DNA, 25 bp, Homo sapiens
gacaagggcaagcttgaccaggaag

SEQ ID NO: 11549 - DNA, 25 bp, Homo sapiens
ctggccttgggcaagggcactcagc

SEQ ID NO: 11550 - DNA, 25 bp, Homo sapiens
cttatccccaccatggggtccatgg

SEQ ID NO: 11551 - DNA, 25 bp, Homo sapiens
gtccatggtctatttattctcgccc

SEQ ID NO: 11552 - DNA, 25 bp, Homo sapiens
gagattcacagtgtcctggggtaag

SEQ ID NO: 11553 - DNA, 25 bp, Homo sapiens
gggggggttcacagtaatcatggtc

SEQ ID NO: 11554 - DNA, 25 bp, Homo sapiens
cagtaatcatggtctactcctcttt

SEQ ID NO: 11555 - DNA, 25 bp, Homo sapiens
gaccctaatttgtatcattctgagt

SEQ ID NO: 11556 - DNA, 25 bp, Homo sapiens
cagtcaccgactgcttttgataagt

SEQ ID NO: 11557 - DNA, 25 bp, Homo sapiens
gagtcccactcggtaagagttgctt

SEQ ID NO: 11558 - DNA, 25 bp, Homo sapiens
gacactgttgacatttgggctggat

SEQ ID NO: 11559 - DNA, 25 bp, Homo sapiens
aaacccctgtggtggggtctgtgct

SEQ ID NO: 11560 - DNA, 25 bp, Homo sapiens
ggtctgtgctgtgcattgcaggatg

SEQ ID NO: 11561 - DNA, 25 bp, Homo sapiens
ttgcaggatggtgagcagcgtccct

SEQ ID NO: 11562 - DNA, 25 bp, Homo sapiens
tgacacccacagttatgccggatgt

SEQ ID NO: 11563 - DNA, 25 bp, Homo sapiens
ttatgccggatgttgccagatgccc

SEQ ID NO: 11564 - DNA, 25 bp, Homo sapiens
gccagatgcccctagggacagagtc

SEQ ID NO: 11565 - DNA, 25 bp, Homo sapiens
cccaactgaggaccactgtctacag

SEQ ID NO: 11566 - DNA, 25 bp, Homo sapiens
aacaatcagcaatgcctgtggaaca

SEQ ID NO: 11567 - DNA, 25 bp, Homo sapiens
attggactgattcatgctattgcaa

SEQ ID NO: 11568 - DNA, 25 bp, Homo sapiens
gatgcactttgaatctggatcaacc

SEQ ID NO: 11569 - DNA, 25 bp, Homo sapiens
ggaatctgtgtcaatgagccctgaa

SEQ ID NO: 11570 - DNA, 25 bp, Homo sapiens
gagccctgaagaacgagccagatac

SEQ ID NO: 11571 - DNA, 25 bp, Homo sapiens
ctatgatgccatccgagttactcat

SEQ ID NO: 11572 - DNA, 25 bp, Homo sapiens
agttactcatgagaccagtgcccat

SEQ ID NO: 11573 - DNA, 25 bp, Homo sapiens
agtgcccatgaaggtcagactgagg

SEQ ID NO: 11574 - DNA, 25 bp, Homo sapiens
tttatggagcgcgaccctgatgaac

SEQ ID NO: 11575 - DNA, 25 bp, Homo sapiens
gatttaatgcgattgctctttctgc

SEQ ID NO: 11576 - DNA, 25 bp, Homo sapiens
gctctttctgcagcatagcttgtca

SEQ ID NO: 11577 - DNA, 25 bp, Homo sapiens
aagtctctaggttctgagctctggc

SEQ ID NO: 11578 - DNA, 25 bp, Homo sapiens
ctggctttgccttggctttgcaagg

SEQ ID NO: 11579 - DNA, 25 bp, Homo sapiens
ttggctttgcaagggctctgtgaca

SEQ ID NO: 11580 - DNA, 25 bp, Homo sapiens
gcaagggctctgtgacaaggaagga

SEQ ID NO: 11581 - DNA, 25 bp, Homo sapiens
aggaaggaagtcagcatgcctctag

SEQ ID NO: 11582 - DNA, 25 bp, Homo sapiens
ggaagtcagcatgcctctagaggca

SEQ ID NO: 11583 - DNA, 25 bp, Homo sapiens
ggaagggaggaacactgcactctta

SEQ ID NO: 11584 - DNA, 25 bp, Homo sapiens
ggaacactgcactcttaagcttccg

SEQ ID NO: 11585 - DNA, 25 bp, Homo sapiens
tccccaactaaagcctagaagagct

SEQ ID NO: 11586 - DNA, 25 bp, Homo sapiens
cttctgaggcgctgctttgtcaaaa

SEQ ID NO: 11587 - DNA, 25 bp, Homo sapiens
ggcgctgctttgtcaaaaggaagtc

SEQ ID NO: 11588 - DNA, 25 bp, Homo sapiens
gggagccaaggctttatacgtctaa

SEQ ID NO: 11589 - DNA, 25 bp, Homo sapiens
tagctgaatccgcccagtgatagcc

SEQ ID NO: 11590 - DNA, 25 bp, Homo sapiens
cagtgatagcctgtgggcaccagca

SEQ ID NO: 11591 - DNA, 25 bp, Homo sapiens
gatacagcacccatctacaaagacc

SEQ ID NO: 11592 - DNA, 25 bp, Homo sapiens
aaacaaacctcttctgggatctcct

SEQ ID NO: 11593 - DNA, 25 bp, Homo sapiens
gggatctccttttgtgaaaaccagt

SEQ ID NO: 11594 - DNA, 25 bp, Homo sapiens
gtgtggtcttgttcagaagcagcca

SEQ ID NO: 11595 - DNA, 25 bp, Homo sapiens
tgccctttcccttcagaaaacgatg

SEQ ID NO: 11596 - DNA, 25 bp, Homo sapiens
aacgatggcaggcattcctctgagt

SEQ ID NO: 11597 - DNA, 25 bp, Homo sapiens
tacaagcagagactcactccaaccc

SEQ ID NO: 11598 - DNA, 25 bp, Homo sapiens
ctcactccaacccaaactagctggg

SEQ ID NO: 11599 - DNA, 25 bp, Homo sapiens
cttgcttatatcatgtgctgccgac

SEQ ID NO: 11600 - DNA, 25 bp, Homo sapiens
gtgctgccgacgggaaggcgtggaa

SEQ ID NO: 11601 - DNA, 25 bp, Homo sapiens
acaccagacatccaactggtccatc

SEQ ID NO: 11602 - DNA, 25 bp, Homo sapiens
ctggtccatcacagtgctattcaga

SEQ ID NO: 11603 - DNA, 25 bp, Homo sapiens
gaaatctaccaaggagcttcgagac

SEQ ID NO: 11604 - DNA, 25 bp, Homo sapiens
aaggagcttcgagacatgtccaaga

SEQ ID NO: 11605 - DNA, 25 bp, Homo sapiens
tgttccaccctgtgactggggaaat

SEQ ID NO: 11606 - DNA, 25 bp, Homo sapiens
aacatgccattgatgcaaacgcagc

SEQ ID NO: 11607 - DNA, 25 bp, Homo sapiens
aacgcagcagaacttgccacatcag

SEQ ID NO: 11608 - DNA, 25 bp, Homo sapiens
attccccaacagcagactacaggta

SEQ ID NO: 11609 - DNA, 25 bp, Homo sapiens
tgcatgagcttttctggcatatgtt

SEQ ID NO: 11610 - DNA, 25 bp, Homo sapiens
aacacctcatccaaggagctggggc

SEQ ID NO: 11611 - DNA, 25 bp, Homo sapiens
ggggcagacttcattgattctagag

SEQ ID NO: 11612 - DNA, 25 bp, Homo sapiens
gagagacctgtttcagtgcctactc

SEQ ID NO: 11613 - DNA, 25 bp, Homo sapiens
cttaccatcacggcttcactgaggt

SEQ ID NO: 11614 - DNA, 25 bp, Homo sapiens
taaacaggagacagtctctcccctc

SEQ ID NO: 11615 - DNA, 25 bp, Homo sapiens
tacctcaacttcttggggtgggaat

SEQ ID NO: 11616 - DNA, 25 bp, Homo sapiens
gatggctagttgctgtgttacgggt

SEQ ID NO: 11617 - DNA, 25 bp, Homo sapiens
gtgggggagaggacttcttcctaca

SEQ ID NO: 11618 - DNA, 25 bp, Homo sapiens
cttcctacacgcgcattgagacaga

SEQ ID NO: 11619 - DNA, 25 bp, Homo sapiens
gagattctgttggttgactgcctaa

SEQ ID NO: 11620 - DNA, 25 bp, Homo sapiens
ggccttcagattataccagcttagc

SEQ ID NO: 11621 - DNA, 25 bp, Homo sapiens
cccctacagtggttctctggacaag

SEQ ID NO: 11622 - DNA, 25 bp, Homo sapiens
tggacaaggctttgtccatcccggt

SEQ ID NO: 11623 - DNA, 25 bp, Homo sapiens
ggacccacagaaacagcctgacagc

SEQ ID NO: 11624 - DNA, 25 bp, Homo sapiens
ctgacagcagctggtttggtccttg

SEQ ID NO: 11625 - DNA, 25 bp, Homo sapiens
gtgtgagggaccaagcatgtggccc

SEQ ID NO: 11626 - DNA, 25 bp, Homo sapiens
aagcatgtggcccaggctctaagct

SEQ ID NO: 11627 - DNA, 25 bp, Homo sapiens
gctctaagctctgcggggattggag

SEQ ID NO: 11628 - DNA, 25 bp, Homo sapiens
gtccctgtggcgaagttacctgggg

SEQ ID NO: 11629 - DNA, 25 bp, Homo sapiens
gcccgtgctggcgggattgggcatg

SEQ ID NO: 11630 - DNA, 25 bp, Homo sapiens
gctgctcccaaagatttctgactca

SEQ ID NO: 11631 - DNA, 25 bp, Homo sapiens
cgttctgtgcttcttaccagaggtt

SEQ ID NO: 11632 - DNA, 25 bp, Homo sapiens
atcctctacagccagatgtcacagg

SEQ ID NO: 11633 - DNA, 25 bp, Homo sapiens
gtcacagggatacgtctactttcac

SEQ ID NO: 11634 - DNA, 25 bp, Homo sapiens
acgtctactttcacttggtgctgga

SEQ ID NO: 11635 - DNA, 25 bp, Homo sapiens
gcagcaaagcacaggttctcctgga

SEQ ID NO: 11636 - DNA, 25 bp, Homo sapiens
ctaagccaagacactggttctcctt

SEQ ID NO: 11637 - DNA, 25 bp, Homo sapiens
gaccttcctagccaagacactggtt

SEQ ID NO: 11638 - DNA, 25 bp, Homo sapiens
cctagccaagacactggttctcctt

SEQ ID NO: 11639 - DNA, 25 bp, Homo sapiens
tgggagatggcatttggcttctgag

SEQ ID NO: 11640 - DNA, 25 bp, Homo sapiens
ccccagaatgcctcacgtgcttggg

SEQ ID NO: 11641 - DNA, 25 bp, Homo sapiens
cttggggagaaagcacccctcttgc

SEQ ID NO: 11642 - DNA, 25 bp, Homo sapiens
ccctcttgccaacaagcctggaaag

SEQ ID NO: 11643 - DNA, 25 bp, Homo sapiens
gcaaatcacagcttcttcgtttaag

SEQ ID NO: 11644 - DNA, 25 bp, Homo sapiens
gaatgcccagggacgtgtgaatgcc

SEQ ID NO: 11645 - DNA, 25 bp, Homo sapiens
gggacgtgtgaatgcctggcaagcc

SEQ ID NO: 11646 - DNA, 25 bp, Homo sapiens
tataacacagggctgcaagtctctg

SEQ ID NO: 11647 - DNA, 25 bp, Homo sapiens
aaagagctataccatccactacagt

SEQ ID NO: 11648 - DNA, 25 bp, Homo sapiens
gctgaaatcctccatggtggacaag

SEQ ID NO: 11649 - DNA, 25 bp, Homo sapiens
tttccaggtttatccgtgtcattcc

SEQ ID NO: 11650 - DNA, 25 bp, Homo sapiens
aaagtattgcacttcgcctggaact

SEQ ID NO: 11651 - DNA, 25 bp, Homo sapiens
aactctttggctgtgatatttacta

SEQ ID NO: 11652 - DNA, 25 bp, Homo sapiens
agactctttaagacctcaaaccatt

SEQ ID NO: 11653 - DNA, 25 bp, Homo sapiens
gggcaatgtattttacgctgtgtta

SEQ ID NO: 11654 - DNA, 25 bp, Homo sapiens
tcagtgtccccaacagcagatgagg

SEQ ID NO: 11655 - DNA, 25 bp, Homo sapiens
gtagtttgcttcttaagaccactcc

SEQ ID NO: 11656 - DNA, 25 bp, Homo sapiens
aagagtgggcctgatagctcaacca

SEQ ID NO: 11657 - DNA, 25 bp, Homo sapiens
agctcaaccaactcctttagcatgt

SEQ ID NO: 11658 - DNA, 25 bp, Homo sapiens
tagactttccaaatgcatcctgcaa

SEQ ID NO: 11659 - DNA, 25 bp, Homo sapiens
gggactgacaagcacactgtttaga

SEQ ID NO: 11660 - DNA, 25 bp, Homo sapiens
ctatgtgcagcatctttcctaactt

SEQ ID NO: 11661 - DNA, 25 bp, Homo sapiens
aggtgcacagctgggagggactgcc

SEQ ID NO: 11662 - DNA, 25 bp, Homo sapiens
ggctgtttcgtacaacattcttgcc

SEQ ID NO: 11663 - DNA, 25 bp, Homo sapiens
attcttgccaattcccttgaggaga

SEQ ID NO: 11664 - DNA, 25 bp, Homo sapiens
aaaattcttcacatggcttctgcat

SEQ ID NO: 11665 - DNA, 25 bp, Homo sapiens
tgtatttcttacaggcctacagaaa

SEQ ID NO: 11666 - DNA, 25 bp, Homo sapiens
gatttgtgcccattcctaatatttt

SEQ ID NO: 11667 - DNA, 25 bp, Homo sapiens
gtcaaggacgaatttgcacagtgat

SEQ ID NO: 11668 - DNA, 25 bp, Homo sapiens
aagtatataatatgtcacctggcac

SEQ ID NO: 11669 - DNA, 25 bp, Homo sapiens
cacctggcacattcattttctcagt

SEQ ID NO: 11670 - DNA, 25 bp, Homo sapiens
aatgtccttatgcttttagagttgc

SEQ ID NO: 11671 - DNA, 25 bp, Homo sapiens
tttggtagggtgagtgtttccactc

SEQ ID NO: 11672 - DNA, 25 bp, Homo sapiens
atgcatggcaaatctgtcggtctcc

SEQ ID NO: 11673 - DNA, 25 bp, Homo sapiens
gtcggtctccagttggttatctgaa

SEQ ID NO: 11674 - DNA, 25 bp, Homo sapiens
gaatagtgtcaccaattccaccaag

SEQ ID NO: 11675 - DNA, 25 bp, Homo sapiens
aattccaccaagacagtgctgagat

SEQ ID NO: 11676 - DNA, 25 bp, Homo sapiens
tggccgagacagagtgccgctatgc

SEQ ID NO: 11677 - DNA, 25 bp, Homo sapiens
gctgagtgagctccgatgcgagatg

SEQ ID NO: 11678 - DNA, 25 bp, Homo sapiens
gatggaggctcagaaccaggagtac

SEQ ID NO: 11679 - DNA, 25 bp, Homo sapiens
gctgcttgacataaagacacggctg

SEQ ID NO: 11680 - DNA, 25 bp, Homo sapiens
ggagcaggagatcgctacttaccgc

SEQ ID NO: 11681 - DNA, 25 bp, Homo sapiens
ggcattggcatcagggaagcctctt

SEQ ID NO: 11682 - DNA, 25 bp, Homo sapiens
ggaagcctcttcaggaggtggtggt

SEQ ID NO: 11683 - DNA, 25 bp, Homo sapiens
gtagcagcagcaatttccacatcaa

SEQ ID NO: 11684 - DNA, 25 bp, Homo sapiens
gatggacaggtggtttcttcccaca

SEQ ID NO: 11685 - DNA, 25 bp, Homo sapiens
ctcggtcttttatttcagggctttg

SEQ ID NO: 11686 - DNA, 25 bp, Homo sapiens
ggagatgcagctgtattgtgtaaca

SEQ ID NO: 11687 - DNA, 25 bp, Homo sapiens
ttggccttcggagcaggaagctaaa

SEQ ID NO: 11688 - DNA, 25 bp, Homo sapiens
gaagacatccccgtgaagactttga

SEQ ID NO: 11689 - DNA, 25 bp, Homo sapiens
gttaccaacaacagcagacttctag

SEQ ID NO: 11690 - DNA, 25 bp, Homo sapiens
gcagacttctagcatgtacttatca

SEQ ID NO: 11691 - DNA, 25 bp, Homo sapiens
tgagacctcacagtaatcttcacac

SEQ ID NO: 11692 - DNA, 25 bp, Homo sapiens
cttcacacttaaccttagacaccta

SEQ ID NO: 11693 - DNA, 25 bp, Homo sapiens
gacacctatgcagtcatgttgggag

SEQ ID NO: 11694 - DNA, 25 bp, Homo sapiens
aggttacaatgttacttcagcccac

SEQ ID NO: 11695 - DNA, 25 bp, Homo sapiens
tgttacttcagcccacagtttattt

SEQ ID NO: 11696 - DNA, 25 bp, Homo sapiens
catattatatatttctgccacctgg

SEQ ID NO: 11697 - DNA, 25 bp, Homo sapiens
tctgccacctggattttcctggata

SEQ ID NO: 11698 - DNA, 25 bp, Homo sapiens
gcatgttagtttggtgctacacagt

SEQ ID NO: 11699 - DNA, 25 bp, Homo sapiens
agtgttgatttttgtgatgtccttt

SEQ ID NO: 11700 - DNA, 25 bp, Homo sapiens
gatgtcctttggtcatgtttctgtt

SEQ ID NO: 11701 - DNA, 25 bp, Homo sapiens
gtttctgttagactgtagctgtgaa

SEQ ID NO: 11702 - DNA, 25 bp, Homo sapiens
ttcttttttccagcccataagacta

SEQ ID NO: 11703 - DNA, 25 bp, Homo sapiens
ttaaatctgcttgcactagctgtgc

SEQ ID NO: 11704 - DNA, 25 bp, Homo sapiens
gaccacatttgattcaactgagacc

SEQ ID NO: 11705 - DNA, 25 bp, Homo sapiens
aactgagaccttgtgtatgtgacat

SEQ ID NO: 11706 - DNA, 25 bp, Homo sapiens
gatgttattgtttaccactgaggtg

SEQ ID NO: 11707 - DNA, 25 bp, Homo sapiens
taccgtgttttctttgtattgtgtt

SEQ ID NO: 11708 - DNA, 25 bp, Homo sapiens
tttcatgttcttgtattgcaaccta

SEQ ID NO: 11709 - DNA, 25 bp, Homo sapiens
ggagcccaaatttaggacactagca

SEQ ID NO: 11710 - DNA, 25 bp, Homo sapiens
aagccagtggctttatgacttttaa

SEQ ID NO: 11711 - DNA, 25 bp, Homo sapiens
tgctatttgtgggggtttttctctc

SEQ ID NO: 11712 - DNA, 25 bp, Homo sapiens
ggggtttttctctcattatttggat

SEQ ID NO: 11713 - DNA, 25 bp, Homo sapiens
ggatggaatctctttggtcaaatgc

SEQ ID NO: 11714 - DNA, 25 bp, Homo sapiens
tacttatcttctatccaaggaggtc

SEQ ID NO: 11715 - DNA, 25 bp, Homo sapiens
aagtctgccttatttgttacatttg

SEQ ID NO: 11716 - DNA, 25 bp, Homo sapiens
gaccttgctttaacattatctccag

SEQ ID NO: 11717 - DNA, 25 bp, Homo sapiens
gaaactgttgttttcctgaacatct

SEQ ID NO: 11718 - DNA, 25 bp, Homo sapiens
aagtgtgtagactgcattcttgcta

SEQ ID NO: 11719 - DNA, 25 bp, Homo sapiens
gtaatgtgaccttttcactgtgcaa

SEQ ID NO: 11720 - DNA, 25 bp, Homo sapiens
attttaagccctatcactgacacat

SEQ ID NO: 11721 - DNA, 25 bp, Homo sapiens
cactgacacatcagcatgttttctg

SEQ ID NO: 11722 - DNA, 25 bp, Homo sapiens
ttatgacagtatcgaggcttgtgat

SEQ ID NO: 11723 - DNA, 25 bp, Homo sapiens
ggcttgtgatgacgaatcctgctct

SEQ ID NO: 11724 - DNA, 25 bp, Homo sapiens
gatgacgaatcctgctctaaaatac

SEQ ID NO: 11725 - DNA, 25 bp, Homo sapiens
gtcagttaacgtcacccaaaagcac

SEQ ID NO: 11726 - DNA, 25 bp, Homo sapiens
ctgccacaaaaatgttcacttcgaa

SEQ ID NO: 11727 - DNA, 25 bp, Homo sapiens
agttcctggaatggcacgttgctgc

SEQ ID NO: 11728 - DNA, 25 bp, Homo sapiens
gaatggcacgttgctgccagtgccc

SEQ ID NO: 11729 - DNA, 25 bp, Homo sapiens
ggcccgcacgttttatgaggttgat

SEQ ID NO: 11730 - DNA, 25 bp, Homo sapiens
tatcggtgctatgtgtttggtttat

SEQ ID NO: 11731 - DNA, 25 bp, Homo sapiens
gtcaattagagcgatcccaaggcat

SEQ ID NO: 11732 - DNA, 25 bp, Homo sapiens
caaggcatgggaccaggcctgcttg

SEQ ID NO: 11733 - DNA, 25 bp, Homo sapiens
ggcctgcttgcctatgtgtgatggc

SEQ ID NO: 11734 - DNA, 25 bp, Homo sapiens
ggatttagcactggggtctcagcac

SEQ ID NO: 11735 - DNA, 25 bp, Homo sapiens
gtctgagactaagtgatctgccctc

SEQ ID NO: 11736 - DNA, 25 bp, Homo sapiens
ccactggcaaggccaaggtctcctc

SEQ ID NO: 11737 - DNA, 25 bp, Homo sapiens
tcctccacgttttttctgcaattaa

SEQ ID NO: 11738 - DNA, 25 bp, Homo sapiens
gagcaaagccttatccgaatcggat

SEQ ID NO: 11739 - DNA, 25 bp, Homo sapiens
gtctttaattttgagcaccttacca

SEQ ID NO: 11740 - DNA, 25 bp, Homo sapiens
caacaccacaaagatcgcatctgtt

SEQ ID NO: 11741 - DNA, 25 bp, Homo sapiens
agtccaaacctttatctgtctgtta

SEQ ID NO: 11742 - DNA, 25 bp, Homo sapiens
atgggattttctagtttcctgcctt

SEQ ID NO: 11743 - DNA, 25 bp, Homo sapiens
tcctgccttcagagtatctaatcct

SEQ ID NO: 11744 - DNA, 25 bp, Homo sapiens
ttaatgatctggtggtctcctcgtc

SEQ ID NO: 11745 - DNA, 25 bp, Homo sapiens
ctcgtcaatccatcagcaatgcttc

SEQ ID NO: 11746 - DNA, 25 bp, Homo sapiens
gcaatgcttctctcatagtgtcata

SEQ ID NO: 11747 - DNA, 25 bp, Homo sapiens
aaggtgttcattttgtcacaagctg

SEQ ID NO: 11748 - DNA, 25 bp, Homo sapiens
ggacgtagagttggcctttttacag

SEQ ID NO: 11749 - DNA, 25 bp, Homo sapiens
ggaccatccaaatttatggccgtat

SEQ ID NO: 11750 - DNA, 25 bp, Homo sapiens
atggccgtatcaaatggtagctgaa

SEQ ID NO: 11751 - DNA, 25 bp, Homo sapiens
atttgagcactggtctctcttggaa

SEQ ID NO: 11752 - DNA, 25 bp, Homo sapiens
atgagcatctcaaatgttttctgca

SEQ ID NO: 11753 - DNA, 25 bp, Homo sapiens
tagaattgacaaaaggccctggcaa

SEQ ID NO: 11754 - DNA, 25 bp, Homo sapiens
ttaaattgtcaaggcccaagggcta

SEQ ID NO: 11755 - DNA, 25 bp, Homo sapiens
cattcattaatttctcacatgggat

SEQ ID NO: 11756 - DNA, 25 bp, Homo sapiens
ttcctgggctgatctgccttacata

SEQ ID NO: 11757 - DNA, 25 bp, Homo sapiens
cacataaggtcctttgcttttcttt

SEQ ID NO: 11758 - DNA, 25 bp, Homo sapiens
gtagttgactttcatgtcactcact

SEQ ID NO: 11759 - DNA, 25 bp, Homo sapiens
aaataggtctcttaacctggcacca

SEQ ID NO: 11760 - DNA, 25 bp, Homo sapiens
gatacttacatttcatggacagcat

SEQ ID NO: 11761 - DNA, 25 bp, Homo sapiens
ggaacatagtctcagattcttctaa

SEQ ID NO: 11762 - DNA, 25 bp, Homo sapiens
gtgtatctcacaatgtcatgtaatg

SEQ ID NO: 11763 - DNA, 25 bp, Homo sapiens
gaattcttgttctgatgctgaacta

SEQ ID NO: 11764 - DNA, 25 bp, Homo sapiens
agaaaaagcacagctctcactggcc

SEQ ID NO: 11765 - DNA, 25 bp, Homo sapiens
ggaaatccagccccatagaaaacaa

SEQ ID NO: 11766 - DNA, 25 bp, Homo sapiens
ttttgtcccgccgagtactatgtat

SEQ ID NO: 11767 - DNA, 25 bp, Homo sapiens
cgagtactatgtattaccagccccc

SEQ ID NO: 11768 - DNA, 25 bp, Homo sapiens
tcctttgccgtgttggatttccggt

SEQ ID NO: 11769 - DNA, 25 bp, Homo sapiens
tccgctctctcatgtggggatgttt

SEQ ID NO: 11770 - DNA, 25 bp, Homo sapiens
gtggggatgtttgtgctgcagacaa

SEQ ID NO: 11771 - DNA, 25 bp, Homo sapiens
tttacattaaagccgccgttttcat

SEQ ID NO: 11772 - DNA, 25 bp, Homo sapiens
gccgttttcatgaccaatcctatgt

SEQ ID NO: 11773 - DNA, 25 bp, Homo sapiens
tcatttctactttgactaataccca

SEQ ID NO: 11774 - DNA, 25 bp, Homo sapiens
tcttcacggtttcacttttaagact

SEQ ID NO: 11775 - DNA, 25 bp, Homo sapiens
tggagcaggtagctgtgctggcgtc

SEQ ID NO: 11776 - DNA, 25 bp, Homo sapiens
gtctttgggaatcctttctttcctg

SEQ ID NO: 11777 - DNA, 25 bp, Homo sapiens
tggcctcagtgattccagtggacag

SEQ ID NO: 11778 - DNA, 25 bp, Homo sapiens
ggagctccaaacctgtagaggaccc

SEQ ID NO: 11779 - DNA, 25 bp, Homo sapiens
gattccacctataattctgtcttgc

SEQ ID NO: 11780 - DNA, 25 bp, Homo sapiens
ggcaggacagtagatccctatggtt

SEQ ID NO: 11781 - DNA, 25 bp, Homo sapiens
ggaagttctgtttggagcccatttc

SEQ ID NO: 11782 - DNA, 25 bp, Homo sapiens
gaaaggtgcttctacctctgatttc

SEQ ID NO: 11783 - DNA, 25 bp, Homo sapiens
gatttcaccccagagttggagttct

SEQ ID NO: 11784 - DNA, 25 bp, Homo sapiens
gtacatctgtgtccatgtgtgacca

SEQ ID NO: 11785 - DNA, 25 bp, Homo sapiens
gtgaccatgtgtctgtgaggcaggg

SEQ ID NO: 11786 - DNA, 25 bp, Homo sapiens
ggaagtcttcataaagccgcagtag

SEQ ID NO: 11787 - DNA, 25 bp, Homo sapiens
ccagatggtgttaactggccgcccc

SEQ ID NO: 11788 - DNA, 25 bp, Homo sapiens
ttgggagcttgctgtgtctaacctc

SEQ ID NO: 11789 - DNA, 25 bp, Homo sapiens
tagggtcacctcctgtttgtgaaag

SEQ ID NO: 11790 - DNA, 25 bp, Homo sapiens
tgtgaaaggggaccttcttgttcgg

SEQ ID NO: 11791 - DNA, 25 bp, Homo sapiens
cctggagcagctctcgagaactacc

SEQ ID NO: 11792 - DNA, 25 bp, Homo sapiens
gctctcgagaactacctgttggtat

SEQ ID NO: 11793 - DNA, 25 bp, Homo sapiens
tgttggtattgtccacaagctctcc

SEQ ID NO: 11794 - DNA, 25 bp, Homo sapiens
ccccatcttgtgccatgttttaagt

SEQ ID NO: 11795 - DNA, 25 bp, Homo sapiens
ctaaaactcacccaacagatctttc

SEQ ID NO: 11796 - DNA, 25 bp, Homo sapiens
agatctttccagaggtccatggtgg

SEQ ID NO: 11797 - DNA, 25 bp, Homo sapiens
gattctgcctccaaggatgtttaaa

SEQ ID NO: 11798 - DNA, 25 bp, Homo sapiens
gcagtggcatgctaagtacccaaat

SEQ ID NO: 11799 - DNA, 25 bp, Homo sapiens
aagattaagattatgctctggcatc

SEQ ID NO: 11800 - DNA, 25 bp, Homo sapiens
gctctggcatctaacatatgattct

SEQ ID NO: 11801 - DNA, 25 bp, Homo sapiens
caaatgtctatccacaggctaaccc

SEQ ID NO: 11802 - DNA, 25 bp, Homo sapiens
gctaaccccactctatgaatcaata

SEQ ID NO: 11803 - DNA, 25 bp, Homo sapiens
gaagctatgaccttttgctgaaata

SEQ ID NO: 11804 - DNA, 25 bp, Homo sapiens
gttactgaacaggcaggccactttg

SEQ ID NO: 11805 - DNA, 25 bp, Homo sapiens
tttgcctctaaattacctctgataa

SEQ ID NO: 11806 - DNA, 25 bp, Homo sapiens
aaggctctacctcaaagacctttgc

SEQ ID NO: 11807 - DNA, 25 bp, Homo sapiens
gacctttgcacagtttattggtgtc

SEQ ID NO: 11808 - DNA, 25 bp, Homo sapiens
agggacatgcttagcagtccccttc

SEQ ID NO: 11809 - DNA, 25 bp, Homo sapiens
gaaggatttggtccgtcataaccca

SEQ ID NO: 11810 - DNA, 25 bp, Homo sapiens
ataacccaaggtaccatcctaggct

SEQ ID NO: 11811 - DNA, 25 bp, Homo sapiens
atcctaggctgacacctaactcttc

SEQ ID NO: 11812 - DNA, 25 bp, Homo sapiens
ctttcatttcttctacaactcatac

SEQ ID NO: 11813 - DNA, 25 bp, Homo sapiens
ttcttctacaactcatacactcgta

SEQ ID NO: 11814 - DNA, 25 bp, Homo sapiens
tacactcgtatgatacttcgacact

SEQ ID NO: 11815 - DNA, 25 bp, Homo sapiens
cttcgacactgttcttagctcaatg

SEQ ID NO: 11816 - DNA, 25 bp, Homo sapiens
agctcaatgagcatgtttagacttt

SEQ ID NO: 11817 - DNA, 25 bp, Homo sapiens
tggtgttttttcctatgggtgttat

SEQ ID NO: 11818 - DNA, 25 bp, Homo sapiens
atgggtgttatcacctagctgaatg

SEQ ID NO: 11819 - DNA, 25 bp, Homo sapiens
cagtgttctctgatgatgatttcaa

SEQ ID NO: 11820 - DNA, 25 bp, Homo sapiens
gcttatttctgcattccacaaagtt

SEQ ID NO: 11821 - DNA, 25 bp, Homo sapiens
taattgctggcctcagattgtcctt

SEQ ID NO: 11822 - DNA, 25 bp, Homo sapiens
gattgtccttatgttcctgagttat

SEQ ID NO: 11823 - DNA, 25 bp, Homo sapiens
gttcctgagttatgatccttgagta

SEQ ID NO: 11824 - DNA, 25 bp, Homo sapiens
acactaactttgtccaactctgtct

SEQ ID NO: 11825 - DNA, 25 bp, Homo sapiens
tttgtccaactctgtctgtaagctg

SEQ ID NO: 11826 - DNA, 25 bp, Homo sapiens
aagctggagcatttttctgatgcca

SEQ ID NO: 11827 - DNA, 25 bp, Homo sapiens
gatatttgtcttgtccacattgtga

SEQ ID NO: 11828 - DNA, 25 bp, Homo sapiens
taaataagccacccttctgattgtc

SEQ ID NO: 11829 - DNA, 25 bp, Homo sapiens
ccttctgattgtcgttctactgtat

SEQ ID NO: 11830 - DNA, 25 bp, Homo sapiens
ctttctcagtgtccgtggcattttt

SEQ ID NO: 11831 - DNA, 25 bp, Homo sapiens
tggcatttttgtgacttcccagcac

SEQ ID NO: 11832 - DNA, 25 bp, Homo sapiens
aatgagtgaggcgcttggtgccctc

SEQ ID NO: 11833 - DNA, 25 bp, Homo sapiens
attgtgaactttccatcagactgcc

SEQ ID NO: 11834 - DNA, 25 bp, Homo sapiens
cattcttctcctgttggttattctg

SEQ ID NO: 11835 - DNA, 25 bp, Homo sapiens
gacacagacccatgacatgtcttat

SEQ ID NO: 11836 - DNA, 25 bp, Homo sapiens
ctccaatggctttatcctacctaga

SEQ ID NO: 11837 - DNA, 25 bp, Homo sapiens
tcccttccagcccattttaattaga

SEQ ID NO: 11838 - DNA, 25 bp, Homo sapiens
tccaccttgcctatctttgggtaga

SEQ ID NO: 11839 - DNA, 25 bp, Homo sapiens
tccctggcactggttgttttctgtg

SEQ ID NO: 11840 - DNA, 25 bp, Homo sapiens
cagttttgaactggccctgaggaaa

SEQ ID NO: 11841 - DNA, 25 bp, Homo sapiens
gcaaagcaactgcccttgaaatcgc

SEQ ID NO: 11842 - DNA, 25 bp, Homo sapiens
tgtggacttgtctgatcccaagcaa

SEQ ID NO: 11843 - DNA, 25 bp, Homo sapiens
cataaactccatgttctgatcaata

SEQ ID NO: 11844 - DNA, 25 bp, Homo sapiens
actttgctgccaatactctgggtgt

SEQ ID NO: 11845 - DNA, 25 bp, Homo sapiens
ctgggtgtgtacattctcacgaccg

SEQ ID NO: 11846 - DNA, 25 bp, Homo sapiens
gcctgatccctgtgctggagaaaga

SEQ ID NO: 11847 - DNA, 25 bp, Homo sapiens
ctggagaaagaacacgacccccgag

SEQ ID NO: 11848 - DNA, 25 bp, Homo sapiens
caccaatgatctccagtccgaaaga

SEQ ID NO: 11849 - DNA, 25 bp, Homo sapiens
gatggaactatggtctatgcacaaa

SEQ ID NO: 11850 - DNA, 25 bp, Homo sapiens
agcaagtggttctgacggagcggtg

SEQ ID NO: 11851 - DNA, 25 bp, Homo sapiens
tgtgaggcaggcgatgccggggttc

SEQ ID NO: 11852 - DNA, 25 bp, Homo sapiens
ccactatggtgggagacgaacggaa

SEQ ID NO: 11853 - DNA, 25 bp, Homo sapiens
gacgaacggaagggttggtgggctg

SEQ ID NO: 11854 - DNA, 25 bp, Homo sapiens
cagagcaggctcagactctgggtcc

SEQ ID NO: 11855 - DNA, 25 bp, Homo sapiens
tggacagatagacagtgctgccctg

SEQ ID NO: 11856 - DNA, 25 bp, Homo sapiens
ggcccacagagatgcatgcgcaggc

SEQ ID NO: 11857 - DNA, 25 bp, Homo sapiens
agagatgcatgcgcaggctcatatg

SEQ ID NO: 11858 - DNA, 25 bp, Homo sapiens
tgcatgcgcaggctcatatgcgtcc

SEQ ID NO: 11859 - DNA, 25 bp, Homo sapiens
ttcagtgcggtagctacttgtttac

SEQ ID NO: 11860 - DNA, 25 bp, Homo sapiens
gcaaaaaggcgaagcgcttcttggg

SEQ ID NO: 11861 - DNA, 25 bp, Homo sapiens
catcgtagctcgtaacagccgcaag

SEQ ID NO: 11862 - DNA, 25 bp, Homo sapiens
gctcgtaacagccgcaagatggcct

SEQ ID NO: 11863 - DNA, 25 bp, Homo sapiens
ccaggcgctgtttgaaggtgtcgtg

SEQ ID NO: 11864 - DNA, 25 bp, Homo sapiens
gctgtttgaaggtgtcgtgcgccag

SEQ ID NO: 11865 - DNA, 25 bp, Homo sapiens
tgaaggtgtcgtgcgccagatacgc

SEQ ID NO: 11866 - DNA, 25 bp, Homo sapiens
ccagatacgcctgcgcagggacagc

SEQ ID NO: 11867 - DNA, 25 bp, Homo sapiens
gatacgcctgcgcagggacagcaaa

SEQ ID NO: 11868 - DNA, 25 bp, Homo sapiens
acgcctgcgcagggacagcaaagaa

SEQ ID NO: 11869 - DNA, 25 bp, Homo sapiens
gggacagcaaagaagccaacgcacg

SEQ ID NO: 11870 - DNA, 25 bp, Homo sapiens
aagaagccaacgcacgacggcaagc

SEQ ID NO: 11871 - DNA, 25 bp, Homo sapiens
gccaacgcacgacggcaagcaggca

SEQ ID NO: 11872 - DNA, 25 bp, Homo sapiens
caggcacccggaggcgagagagcct

SEQ ID NO: 11873 - DNA, 25 bp, Homo sapiens
cccggaggcgagagagccttggcaa

SEQ ID NO: 11874 - DNA, 25 bp, Homo sapiens
ggatgtttttaatcccactatggac

SEQ ID NO: 11875 - DNA, 25 bp, Homo sapiens
gtttttaatcccactatggactcag

SEQ ID NO: 11876 - DNA, 25 bp, Homo sapiens
taatcccactatggactcagtctcc

SEQ ID NO: 11877 - DNA, 25 bp, Homo sapiens
ccactcctggtcattggtggatgtt

SEQ ID NO: 11878 - DNA, 25 bp, Homo sapiens
gcctgctagggaaaactgctcctca

SEQ ID NO: 11879 - DNA, 25 bp, Homo sapiens
gctagggaaaactgctcctcattat

SEQ ID NO: 11880 - DNA, 25 bp, Homo sapiens
gggaaaactgctcctcattatcatc

SEQ ID NO: 11881 - DNA, 25 bp, Homo sapiens
cattatcatcactattattgctcac

SEQ ID NO: 11882 - DNA, 25 bp, Homo sapiens
tatcatcactattattgctcaccac

SEQ ID NO: 11883 - DNA, 25 bp, Homo sapiens
tcatcactattattgctcaccactg

SEQ ID NO: 11884 - DNA, 25 bp, Homo sapiens
atcactattattgctcaccactgta

SEQ ID NO: 11885 - DNA, 25 bp, Homo sapiens
tgcttctattagtcacctaaccctc

SEQ ID NO: 11886 - DNA, 25 bp, Homo sapiens
ggtggggccaagagtcacttctaat

SEQ ID NO: 11887 - DNA, 25 bp, Homo sapiens
gggaggattgtcacacctcccacac

SEQ ID NO: 11888 - DNA, 25 bp, Homo sapiens
cctcccacacgtgcaagagcaactg

SEQ ID NO: 11889 - DNA, 25 bp, Homo sapiens
ggatgggactggacctcaggagtta

SEQ ID NO: 11890 - DNA, 25 bp, Homo sapiens
gagttaacaagtgcccagctggggc

SEQ ID NO: 11891 - DNA, 25 bp, Homo sapiens
aggcctctggagtcactcatacaag

SEQ ID NO: 11892 - DNA, 25 bp, Homo sapiens
gggcaaccccaacgaggaagtggcg

SEQ ID NO: 11893 - DNA, 25 bp, Homo sapiens
gatgcttcatgggactgggggtctc

SEQ ID NO: 11894 - DNA, 25 bp, Homo sapiens
ctgccctcagcttggataaccaggc

SEQ ID NO: 11895 - DNA, 25 bp, Homo sapiens
aatgacagccccttaagcatgcttc

SEQ ID NO: 11896 - DNA, 25 bp, Homo sapiens
gctggagatgcattacgtttcaaca

SEQ ID NO: 11897 - DNA, 25 bp, Homo sapiens
gacaatgatcgatatccttctggga

SEQ ID NO: 11898 - DNA, 25 bp, Homo sapiens
ggctgtactacagttcaggctggtg

SEQ ID NO: 11899 - DNA, 25 bp, Homo sapiens
taatgggattttctggggtacctgg

SEQ ID NO: 11900 - DNA, 25 bp, Homo sapiens
gggtacctggcctggtgtaagtgag

SEQ ID NO: 11901 - DNA, 25 bp, Homo sapiens
aagtgaggcacaccctggtggctac

SEQ ID NO: 11902 - DNA, 25 bp, Homo sapiens
gatgatgatcagacccaagcacttt

SEQ ID NO: 11903 - DNA, 25 bp, Homo sapiens
gccataaatcactctgttcattcct

SEQ ID NO: 11904 - DNA, 25 bp, Homo sapiens
cattcctccaggtattcgttatcta

SEQ ID NO: 11905 - DNA, 25 bp, Homo sapiens
gggcaattaattccttcagcacttt

SEQ ID NO: 11906 - DNA, 25 bp, Homo sapiens
ggtgtcgaactatatgccttgtatg

SEQ ID NO: 11907 - DNA, 25 bp, Homo sapiens
tcatccatctcagcatcaacacaat

SEQ ID NO: 11908 - DNA, 25 bp, Homo sapiens
cacaatttccaggggacctcaggtc

SEQ ID NO: 11909 - DNA, 25 bp, Homo sapiens
acctcaggtctacctcaggactgaa

SEQ ID NO: 11910 - DNA, 25 bp, Homo sapiens
ttcctcctccttgaatctgagactg

SEQ ID NO: 11911 - DNA, 25 bp, Homo sapiens
tgagactggctgcccattctgagat

SEQ ID NO: 11912 - DNA, 25 bp, Homo sapiens
gatgaaggtaagatgccgcatcacc

SEQ ID NO: 11913 - DNA, 25 bp, Homo sapiens
gacagctgccttgataccagctctc

SEQ ID NO: 11914 - DNA, 25 bp, Homo sapiens
ccttgataccagctctctgtggaaa

SEQ ID NO: 11915 - DNA, 25 bp, Homo sapiens
tggaaacccccgaggagttggatct

SEQ ID NO: 11916 - DNA, 25 bp, Homo sapiens
ggacttctctcctgaagaacacgca

SEQ ID NO: 11917 - DNA, 25 bp, Homo sapiens
gggtacaagctccagaacagtaacc

SEQ ID NO: 11918 - DNA, 25 bp, Homo sapiens
ttacctctctggagacttcttgctg

SEQ ID NO: 11919 - DNA, 25 bp, Homo sapiens
gtgtgctcagggactatttggaact

SEQ ID NO: 11920 - DNA, 25 bp, Homo sapiens
ttaacactccccgagctgattgttt

SEQ ID NO: 11921 - DNA, 25 bp, Homo sapiens
caagtgtgtttgttccagagtgtgg

SEQ ID NO: 11922 - DNA, 25 bp, Homo sapiens
gacatgggcatcacgtaaattggtt

SEQ ID NO: 11923 - DNA, 25 bp, Homo sapiens
attggttttgtttgctattctgtgt

SEQ ID NO: 11924 - DNA, 25 bp, Homo sapiens
ctgtgtgtcagaaccaacgagtgta

SEQ ID NO: 11925 - DNA, 25 bp, Homo sapiens
gcaggtcatctcttattgtttctaa

SEQ ID NO: 11926 - DNA, 25 bp, Homo sapiens
gaagaggtgagtgatccagctttct

SEQ ID NO: 11927 - DNA, 25 bp, Homo sapiens
gattgaggctatgtacttggtgggg

SEQ ID NO: 11928 - DNA, 25 bp, Homo sapiens
gttattgtctgtgccatgaccttca

SEQ ID NO: 11929 - DNA, 25 bp, Homo sapiens
acacgtgggcacctgagcacaggga

SEQ ID NO: 11930 - DNA, 25 bp, Homo sapiens
agaaatgcccagcaaagacccttcc

SEQ ID NO: 11931 - DNA, 25 bp, Homo sapiens
ggcaccagagggtccaagacaagac

SEQ ID NO: 11932 - DNA, 25 bp, Homo sapiens
gacaagactggaagggcacctcggg

SEQ ID NO: 11933 - DNA, 25 bp, Homo sapiens
gcacctcgggttcgggaggagctgt

SEQ ID NO: 11934 - DNA, 25 bp, Homo sapiens
tgtgagtggctgagccagctccttg

SEQ ID NO: 11935 - DNA, 25 bp, Homo sapiens
tgaggatgtggccacttgacttgtg

SEQ ID NO: 11936 - DNA, 25 bp, Homo sapiens
gccatcttgatgccaggacacacag

SEQ ID NO: 11937 - DNA, 25 bp, Homo sapiens
tcagaggacagtgcacaggctagcc

SEQ ID NO: 11938 - DNA, 25 bp, Homo sapiens
tgcacaggctagcctggagctcacc

SEQ ID NO: 11939 - DNA, 25 bp, Homo sapiens
cagatggggaacactgtgcctccct

SEQ ID NO: 11940 - DNA, 25 bp, Homo sapiens
ggggatttctgcatcgaggttggca

SEQ ID NO: 11941 - DNA, 25 bp, Homo sapiens
ttcacggcagcgactcggtggagag

SEQ ID NO: 11942 - DNA, 25 bp, Homo sapiens
cgagctcctctgctgggaggacagc

SEQ ID NO: 11943 - DNA, 25 bp, Homo sapiens
acagcgctgggcactggctgtatga

SEQ ID NO: 11944 - DNA, 25 bp, Homo sapiens
gcactggctgtatgagtagcccggc

SEQ ID NO: 11945 - DNA, 25 bp, Homo sapiens
tatgagtagcccggcagatgcgcgt

SEQ ID NO: 11946 - DNA, 25 bp, Homo sapiens
cctttggacgggctgctgaacatcc

SEQ ID NO: 11947 - DNA, 25 bp, Homo sapiens
catccacctgtctggacgttgcatg

SEQ ID NO: 11948 - DNA, 25 bp, Homo sapiens
ggacgttgcatggagggtggcgcag

SEQ ID NO: 11949 - DNA, 25 bp, Homo sapiens
tccctggcgtacagggtttcctgcc

SEQ ID NO: 11950 - DNA, 25 bp, Homo sapiens
cggctcgcctggaaacgtgccagga

SEQ ID NO: 11951 - DNA, 25 bp, Homo sapiens
aaaatggtgtcttaagtgcttagtg

SEQ ID NO: 11952 - DNA, 25 bp, Homo sapiens
actgtgcgttgtacatagttctaat

SEQ ID NO: 11953 - DNA, 25 bp, Homo sapiens
gttctaatgcattgtattgaccacc

SEQ ID NO: 11954 - DNA, 25 bp, Homo sapiens
attgaccaccagtacttctataatg

SEQ ID NO: 11955 - DNA, 25 bp, Homo sapiens
gcagagacctccctctgaaaaacac

SEQ ID NO: 11956 - DNA, 25 bp, Homo sapiens
cctgggatgaggacttgctttcttt

SEQ ID NO: 11957 - DNA, 25 bp, Homo sapiens
ccatgtcttagttggatgtccctga

SEQ ID NO: 11958 - DNA, 25 bp, Homo sapiens
ggacacaggctgtgcattgtgccag

SEQ ID NO: 11959 - DNA, 25 bp, Homo sapiens
gtctgtggactgctgatgtacagtg

SEQ ID NO: 11960 - DNA, 25 bp, Homo sapiens
atggactgtccattgacgttcctaa

SEQ ID NO: 11961 - DNA, 25 bp, Homo sapiens
ttgacgttcctaatgtggtagcaga

SEQ ID NO: 11962 - DNA, 25 bp, Homo sapiens
gtgggcagatgtaaagagaccggca

SEQ ID NO: 11963 - DNA, 25 bp, Homo sapiens
gagaccggcaaagttcacgtgactg

SEQ ID NO: 11964 - DNA, 25 bp, Homo sapiens
caaagttcacgtgactgtggatctc

SEQ ID NO: 11965 - DNA, 25 bp, Homo sapiens
ctgtggatctcaagtactaccggcc

SEQ ID NO: 11966 - DNA, 25 bp, Homo sapiens
tggatctcaagtactaccggccaac

SEQ ID NO: 11967 - DNA, 25 bp, Homo sapiens
tctcaagtactaccggccaactgaa

SEQ ID NO: 11968 - DNA, 25 bp, Homo sapiens
aagtactaccggccaactgaagtgg

SEQ ID NO: 11969 - DNA, 25 bp, Homo sapiens
tgaagtggactttctgcagggcgac

SEQ ID NO: 11970 - DNA, 25 bp, Homo sapiens
tgcagggcgactgcaccaaagcgaa

SEQ ID NO: 11971 - DNA, 25 bp, Homo sapiens
gtcgagaaatcattcttgcacattg

SEQ ID NO: 11972 - DNA, 25 bp, Homo sapiens
acattggaaaaaccattgtgtggga

SEQ ID NO: 11973 - DNA, 25 bp, Homo sapiens
tgtgtgtggacatctctgaccatcc

SEQ ID NO: 11974 - DNA, 25 bp, Homo sapiens
tgaccatccatcgctgtattcaaat

SEQ ID NO: 11975 - DNA, 25 bp, Homo sapiens
gttctattccattctggtctcaggc

SEQ ID NO: 11976 - DNA, 25 bp, Homo sapiens
aggcatgaccacgtccagtgaagac

SEQ ID NO: 11977 - DNA, 25 bp, Homo sapiens
ttgaggcagcacatctcaggaccca

SEQ ID NO: 11978 - DNA, 25 bp, Homo sapiens
ggacccaggcaatagactggcccca

SEQ ID NO: 11979 - DNA, 25 bp, Homo sapiens
ttgtgtggaacagctcaccttgtca

SEQ ID NO: 11980 - DNA, 25 bp, Homo sapiens
gacattcatcttttgagtcctcatc

SEQ ID NO: 11981 - DNA, 25 bp, Homo sapiens
atggagtgctgtgtttggggggctg

SEQ ID NO: 11982 - DNA, 25 bp, Homo sapiens
gggctgcatctgctgaagcgagaac

SEQ ID NO: 11983 - DNA, 25 bp, Homo sapiens
caggacttctccaacttactattag

SEQ ID NO: 11984 - DNA, 25 bp, Homo sapiens
ccaggaggggctgtccaatcacatt

SEQ ID NO: 11985 - DNA, 25 bp, Homo sapiens
aggcatgcgaatgagctgggccctg

SEQ ID NO: 11986 - DNA, 25 bp, Homo sapiens
aaaggactggttaaatcaattctga

SEQ ID NO: 11987 - DNA, 25 bp, Homo sapiens
aatcaattctgatacagccttacaa

SEQ ID NO: 11988 - DNA, 25 bp, Homo sapiens
ctgatacagccttacaatacaatag

SEQ ID NO: 11989 - DNA, 25 bp, Homo sapiens
aatgtgtatagcgcacttcccattt

SEQ ID NO: 11990 - DNA, 25 bp, Homo sapiens
attgcttatgtatgcctattcagaa

SEQ ID NO: 11991 - DNA, 25 bp, Homo sapiens
taacactgattacttttgggagggg

SEQ ID NO: 11992 - DNA, 25 bp, Homo sapiens
gaaccagtaggttgaggacaggaga

SEQ ID NO: 11993 - DNA, 25 bp, Homo sapiens
ttaacacttacacccttttgtacat

SEQ ID NO: 11994 - DNA, 25 bp, Homo sapiens
cacttacacccttttgtacattttg

SEQ ID NO: 11995 - DNA, 25 bp, Homo sapiens
cagagttccctctgtatagcctctg

SEQ ID NO: 11996 - DNA, 25 bp, Homo sapiens
acactggaagatttgggcctcctgc

SEQ ID NO: 11997 - DNA, 25 bp, Homo sapiens
tctctgtctgcttcacctgagaaga

SEQ ID NO: 11998 - DNA, 25 bp, Homo sapiens
caggcctttgctgcaagtgaccctg

SEQ ID NO: 11999 - DNA, 25 bp, Homo sapiens
gaccctgtggcaacagtggattctc

SEQ ID NO: 12000 - DNA, 25 bp, Homo sapiens
tcatcatatttgcaactcttctctc

SEQ ID NO: 12001 - DNA, 25 bp, Homo sapiens
gtggggagaagtttcctgggctcca

SEQ ID NO: 12002 - DNA, 25 bp, Homo sapiens
gctccatcaatggctgcatcttttc

SEQ ID NO: 12003 - DNA, 25 bp, Homo sapiens
gcatcttttctggactcagcagtct

SEQ ID NO: 12004 - DNA, 25 bp, Homo sapiens
gcagtctccttgattccatgtagag

SEQ ID NO: 12005 - DNA, 25 bp, Homo sapiens
ctgattgcatttcctctcattaaca

SEQ ID NO: 12006 - DNA, 25 bp, Homo sapiens
aaaagctgtctctgcttggaggtgc

SEQ ID NO: 12007 - DNA, 25 bp, Homo sapiens
ccctgcccatgtttgagctggtgga

SEQ ID NO: 12008 - DNA, 25 bp, Homo sapiens
tgagctggtggagcagcagccttca

SEQ ID NO: 12009 - DNA, 25 bp, Homo sapiens
cctgtccctagattcttctgatgta

SEQ ID NO: 12010 - DNA, 25 bp, Homo sapiens
gcgactggaaagattcttcgactca

SEQ ID NO: 12011 - DNA, 25 bp, Homo sapiens
gaagactttgaaatcctgtcccttt

SEQ ID NO: 12012 - DNA, 25 bp, Homo sapiens
tcctgtccctttgaaaatcctgggg

SEQ ID NO: 12013 - DNA, 25 bp, Homo sapiens
acctgtgagagcctggggctcctgg

SEQ ID NO: 12014 - DNA, 25 bp, Homo sapiens
ttactgcttggtgtcagactgccca

SEQ ID NO: 12015 - DNA, 25 bp, Homo sapiens
ttaggagcttccagagcgttctctc

SEQ ID NO: 12016 - DNA, 25 bp, Homo sapiens
gccggttctgtggttggtttggaat

SEQ ID NO: 12017 - DNA, 25 bp, Homo sapiens
ggtcttggagcaacatcaccaggct

SEQ ID NO: 12018 - DNA, 25 bp, Homo sapiens
caaggcagctgacacacaagagttc

SEQ ID NO: 12019 - DNA, 25 bp, Homo sapiens
ttcgtgagatcacccaacaccaatt

SEQ ID NO: 12020 - DNA, 25 bp, Homo sapiens
atttcttcaccactgctcatgtgag

SEQ ID NO: 12021 - DNA, 25 bp, Homo sapiens
ggtgaagcagcagctaaccctagaa

SEQ ID NO: 12022 - DNA, 25 bp, Homo sapiens
aggacgcacctgataacagcagcct

SEQ ID NO: 12023 - DNA, 25 bp, Homo sapiens
ctcctagcagataccagcgggcaag

SEQ ID NO: 12024 - DNA, 25 bp, Homo sapiens
agaggagatgcgagctctgcgctct

SEQ ID NO: 12025 - DNA, 25 bp, Homo sapiens
ctagaggaagggagcaccgcgaggc

SEQ ID NO: 12026 - DNA, 25 bp, Homo sapiens
aggtctccaacctgtcagagtggct

SEQ ID NO: 12027 - DNA, 25 bp, Homo sapiens
ggaggctgcgggcagccgttatccc

SEQ ID NO: 12028 - DNA, 25 bp, Homo sapiens
tccagccagagaggagtccctcctg

SEQ ID NO: 12029 - DNA, 25 bp, Homo sapiens
cccatgacgcagaactcctggaggt

SEQ ID NO: 12030 - DNA, 25 bp, Homo sapiens
ctgccccagagtggtgtcctctggc

SEQ ID NO: 12031 - DNA, 25 bp, Homo sapiens
ccccaggctctgtgacagcctagtg

SEQ ID NO: 12032 - DNA, 25 bp, Homo sapiens
cctgcccggaccacagaaggagagt

SEQ ID NO: 12033 - DNA, 25 bp, Homo sapiens
agagttggcggtcacagagggctcc

SEQ ID NO: 12034 - DNA, 25 bp, Homo sapiens
agaagcatggggcgtagccagctcg

SEQ ID NO: 12035 - DNA, 25 bp, Homo sapiens
caaaggccacgactgcctgttgggg

SEQ ID NO: 12036 - DNA, 25 bp, Homo sapiens
gatgcatggacagtgtgctcaagct

SEQ ID NO: 12037 - DNA, 25 bp, Homo sapiens
aagctgtgggcatgtgcttgcctgc

SEQ ID NO: 12038 - DNA, 25 bp, Homo sapiens
gcaagagcatgtgtgtgccacttcc

SEQ ID NO: 12039 - DNA, 25 bp, Homo sapiens
cggctacccatcgtactggtgggta

SEQ ID NO: 12040 - DNA, 25 bp, Homo sapiens
cgtactggtgggtatcacggtgccc

SEQ ID NO: 12041 - DNA, 25 bp, Homo sapiens
gccacgtgtctgaagctgccagtgg

SEQ ID NO: 12042 - DNA, 25 bp, Homo sapiens
ggcggacggtcagcattgaggtagg

SEQ ID NO: 12043 - DNA, 25 bp, Homo sapiens
tgaggtaggggtgcagaacagcctg

SEQ ID NO: 12044 - DNA, 25 bp, Homo sapiens
ccttcattgtggcgctgagcggcac

SEQ ID NO: 12045 - DNA, 25 bp, Homo sapiens
ctggccttggtcattggccacttca

SEQ ID NO: 12046 - DNA, 25 bp, Homo sapiens
actccaccaaagttctcatgcacta

SEQ ID NO: 12047 - DNA, 25 bp, Homo sapiens
aagttctcatgcactatgcactcag

SEQ ID NO: 12048 - DNA, 25 bp, Homo sapiens
gaggccatgctgagttaggtaggtg

SEQ ID NO: 12049 - DNA, 25 bp, Homo sapiens
tgagttaggtaggtgggcgctgccc

SEQ ID NO: 12050 - DNA, 25 bp, Homo sapiens
gcgtaacaacttcggcaaggtcctg

SEQ ID NO: 12051 - DNA, 25 bp, Homo sapiens
aggtcctggagcgtggtgtgaagct

SEQ ID NO: 12052 - DNA, 25 bp, Homo sapiens
tggtgtgaagctggccgaactgcag

SEQ ID NO: 12053 - DNA, 25 bp, Homo sapiens
gaactgcagcagcgttcagaccaac

SEQ ID NO: 12054 - DNA, 25 bp, Homo sapiens
caacaagactacacagaacctggcc

SEQ ID NO: 12055 - DNA, 25 bp, Homo sapiens
gagaacatccgttaccggatctgcg

SEQ ID NO: 12056 - DNA, 25 bp, Homo sapiens
acggacccaggatgcaggcattgcc

SEQ ID NO: 12057 - DNA, 25 bp, Homo sapiens
caggcattgcctcagggcctgggaa

SEQ ID NO: 12058 - DNA, 25 bp, Homo sapiens
gcctgggaactgacccagctggtcc

SEQ ID NO: 12059 - DNA, 25 bp, Homo sapiens
gaatagagttggagcggtgccagca

SEQ ID NO: 12060 - DNA, 25 bp, Homo sapiens
ggtgccagcagcaggcgaacgaggt

SEQ ID NO: 12061 - DNA, 25 bp, Homo sapiens
gattcccatctatttaactttatta

SEQ ID NO: 12062 - DNA, 25 bp, Homo sapiens
tctaccgtgaatgactctgcaagcc

SEQ ID NO: 12063 - DNA, 25 bp, Homo sapiens
tgactctgcaagccttgctggtcca

SEQ ID NO: 12064 - DNA, 25 bp, Homo sapiens
gagaacgggtacattcacccggtca

SEQ ID NO: 12065 - DNA, 25 bp, Homo sapiens
gggaaacccgagagtgacctgaaag

SEQ ID NO: 12066 - DNA, 25 bp, Homo sapiens
gaaagaagtggtgaccgcgagccgc

SEQ ID NO: 12067 - DNA, 25 bp, Homo sapiens
tgaccgcgagccgcttatgtggaac

SEQ ID NO: 12068 - DNA, 25 bp, Homo sapiens
cgtcctgaccttggaggtgcgagtc

SEQ ID NO: 12069 - DNA, 25 bp, Homo sapiens
gtgcgagtctgggaaaggcgcgctc

SEQ ID NO: 12070 - DNA, 25 bp, Homo sapiens
cccgcgagaacactttacaacgacg

SEQ ID NO: 12071 - DNA, 25 bp, Homo sapiens
gaggagattcgtttccaaaccagag

SEQ ID NO: 12072 - DNA, 25 bp, Homo sapiens
gatgtctgcaatggcgctgacttct

SEQ ID NO: 12073 - DNA, 25 bp, Homo sapiens
caagcccaagatgttctgtgctggc

SEQ ID NO: 12074 - DNA, 25 bp, Homo sapiens
ctaccccgagggtggcattgatgcc

SEQ ID NO: 12075 - DNA, 25 bp, Homo sapiens
cattgatgcctgccagggcgacagc

SEQ ID NO: 12076 - DNA, 25 bp, Homo sapiens
cggtggtccctttgtgtgtgaggac

SEQ ID NO: 12077 - DNA, 25 bp, Homo sapiens
gccacgttggcggctgtgtggcatt

SEQ ID NO: 12078 - DNA, 25 bp, Homo sapiens
attgtgagttggggcactggctgtg

SEQ ID NO: 12079 - DNA, 25 bp, Homo sapiens
ccaggcgtctacaccaaagtcagtg

SEQ ID NO: 12080 - DNA, 25 bp, Homo sapiens
ttccgggagtggatcttccaggcca

SEQ ID NO: 12081 - DNA, 25 bp, Homo sapiens
tcactccgaagccagcggcatggtg

SEQ ID NO: 12082 - DNA, 25 bp, Homo sapiens
gtgatcccggtggtgggatccacgc

SEQ ID NO: 12083 - DNA, 25 bp, Homo sapiens
atacctcactcgctcagctataaga

SEQ ID NO: 12084 - DNA, 25 bp, Homo sapiens
gctataagaagagcctcaaccattg

SEQ ID NO: 12085 - DNA, 25 bp, Homo sapiens
gcacgtcaaaagctacagaatctat

SEQ ID NO: 12086 - DNA, 25 bp, Homo sapiens
ttctgtctcatcttaatatgtctct

SEQ ID NO: 12087 - DNA, 25 bp, Homo sapiens
aatatgtctcttgctgatctgtatc

SEQ ID NO: 12088 - DNA, 25 bp, Homo sapiens
gatctgtatcatcgtgatgcttctc

SEQ ID NO: 12089 - DNA, 25 bp, Homo sapiens
tctctgaagttctgctacaacctct

SEQ ID NO: 12090 - DNA, 25 bp, Homo sapiens
tacaacctctagatctgcagcttgc

SEQ ID NO: 12091 - DNA, 25 bp, Homo sapiens
ctgcagcttgccacatcagcttaaa

SEQ ID NO: 12092 - DNA, 25 bp, Homo sapiens
ttctctcgaccacttaaaacttcag

SEQ ID NO: 12093 - DNA, 25 bp, Homo sapiens
tggagaaagtccaatacctcactcg

SEQ ID NO: 12094 - DNA, 25 bp, Homo sapiens
tggcccatctattacatctacagct

SEQ ID NO: 12095 - DNA, 25 bp, Homo sapiens
gttaggggagctgacaattcgtggg

SEQ ID NO: 12096 - DNA, 25 bp, Homo sapiens
gggagctgacaattcgtgggtccgc

SEQ ID NO: 12097 - DNA, 25 bp, Homo sapiens
agctgacaattcgtgggtccgcaaa

SEQ ID NO: 12098 - DNA, 25 bp, Homo sapiens
gacaattcgtgggtccgcaaaatct

SEQ ID NO: 12099 - DNA, 25 bp, Homo sapiens
caattcgtgggtccgcaaaatctta

SEQ ID NO: 12100 - DNA, 25 bp, Homo sapiens
tcgtgggtccgcaaaatcttaacta

SEQ ID NO: 12101 - DNA, 25 bp, Homo sapiens
gtccgcaaaatcttaactacctaat

SEQ ID NO: 12102 - DNA, 25 bp, Homo sapiens
caaaatcttaactacctaatagcct

SEQ ID NO: 12103 - DNA, 25 bp, Homo sapiens
tgaccataaaccttactgataacat

SEQ ID NO: 12104 - DNA, 25 bp, Homo sapiens
atacactatattcctacaataaagt

SEQ ID NO: 12105 - DNA, 25 bp, Homo sapiens
gaaaactggggtttgcatcactcca

SEQ ID NO: 12106 - DNA, 25 bp, Homo sapiens
actgcacagtgttagtgggacctgg

SEQ ID NO: 12107 - DNA, 25 bp, Homo sapiens
tagtgggacctgggggcaagtccct

SEQ ID NO: 12108 - DNA, 25 bp, Homo sapiens
atggagtcacttatgccaaactcta

SEQ ID NO: 12109 - DNA, 25 bp, Homo sapiens
tcacacacacatgcccgtaacagga

SEQ ID NO: 12110 - DNA, 25 bp, Homo sapiens
acaggatttatcaccaagacacgcc

SEQ ID NO: 12111 - DNA, 25 bp, Homo sapiens
gactgtagtattccagatgagctgc

SEQ ID NO: 12112 - DNA, 25 bp, Homo sapiens
caactcctgcgatcagcttgtgact

SEQ ID NO: 12113 - DNA, 25 bp, Homo sapiens
cagcttgtgacttacaaaccttgtt

SEQ ID NO: 12114 - DNA, 25 bp, Homo sapiens
cttacatggacttctgtcctttaaa

SEQ ID NO: 12115 - DNA, 25 bp, Homo sapiens
cttccaagcactcatagcccagata

SEQ ID NO: 12116 - DNA, 25 bp, Homo sapiens
tgtcgggatgttttctgtccaggca

SEQ ID NO: 12117 - DNA, 25 bp, Homo sapiens
tccaggcagctccacatgtgtggtg

SEQ ID NO: 12118 - DNA, 25 bp, Homo sapiens
aatgcctactgtgtgacctgtaatc

SEQ ID NO: 12119 - DNA, 25 bp, Homo sapiens
tgtaatcggatttgcccagagcctg

SEQ ID NO: 12120 - DNA, 25 bp, Homo sapiens
tgatggagtcacctactccagtgcc

SEQ ID NO: 12121 - DNA, 25 bp, Homo sapiens
tgagaaaggctacctgcctgctggg

SEQ ID NO: 12122 - DNA, 25 bp, Homo sapiens
tgttccctctgtgatgagctgtgcc

SEQ ID NO: 12123 - DNA, 25 bp, Homo sapiens
gagctgtgccctgacagtaagtcgg

SEQ ID NO: 12124 - DNA, 25 bp, Homo sapiens
taagtcggatgagcctgtctgtgcc

SEQ ID NO: 12125 - DNA, 25 bp, Homo sapiens
tgacaatgccacttatgccagcgag

SEQ ID NO: 12126 - DNA, 25 bp, Homo sapiens
gtaaagcactccggatcttgcaact

SEQ ID NO: 12127 - DNA, 25 bp, Homo sapiens
gctcagcccttagcaatcggggagt

SEQ ID NO: 12128 - DNA, 25 bp, Homo sapiens
gaggctcttctccatcaatgagtgc

SEQ ID NO: 12129 - DNA, 25 bp, Homo sapiens
gagtgcaagatcttctaaaccccaa

SEQ ID NO: 12130 - DNA, 25 bp, Homo sapiens
cacaacacttatgtatgcaccccaa

SEQ ID NO: 12131 - DNA, 25 bp, Homo sapiens
tgttttctctgggtacaccccaagc

SEQ ID NO: 12132 - DNA, 25 bp, Homo sapiens
gcagcgtctccgttttggatacagt

SEQ ID NO: 12133 - DNA, 25 bp, Homo sapiens
gaggcttggccactggatgttttca

SEQ ID NO: 12134 - DNA, 25 bp, Homo sapiens
gatgttttcactaactacactctac

SEQ ID NO: 12135 - DNA, 25 bp, Homo sapiens
ctacaagtgaactccttgcccaggc

SEQ ID NO: 12136 - DNA, 25 bp, Homo sapiens
attaggagcaacttgccctgtaccc

SEQ ID NO: 12137 - DNA, 25 bp, Homo sapiens
cctcctgcgtcaatgccatggaagg

SEQ ID NO: 12138 - DNA, 25 bp, Homo sapiens
aattctgaactgtatccatatttta

SEQ ID NO: 12139 - DNA, 25 bp, Homo sapiens
gaactttatcagtatgctttgttga

SEQ ID NO: 12140 - DNA, 25 bp, Homo sapiens
taattgagttcaattcgcctctccg

SEQ ID NO: 12141 - DNA, 25 bp, Homo sapiens
cctctccgcattgcctattgataca

SEQ ID NO: 12142 - DNA, 25 bp, Homo sapiens
gcattgcctattgatacactttact

SEQ ID NO: 12143 - DNA, 25 bp, Homo sapiens
aaaacattttcctgcttgtcttaga

SEQ ID NO: 12144 - DNA, 25 bp, Homo sapiens
gcgttaagtcggtaagctagaggat

SEQ ID NO: 12145 - DNA, 25 bp, Homo sapiens
atgtcctctagataaaacacccgat

SEQ ID NO: 12146 - DNA, 25 bp, Homo sapiens
gacacattggagagcttagaggata

SEQ ID NO: 12147 - DNA, 25 bp, Homo sapiens
atcacacacaaaagttacaccaaca

SEQ ID NO: 12148 - DNA, 25 bp, Homo sapiens
acctgtaaaataccttgtgccctat

SEQ ID NO: 12149 - DNA, 25 bp, Homo sapiens
gctcctccctgctagtcagggacac

SEQ ID NO: 12150 - DNA, 25 bp, Homo sapiens
ggatcattgtctgcttagtggccta

SEQ ID NO: 12151 - DNA, 25 bp, Homo sapiens
tggcttgtttatgctttgtgtctca

SEQ ID NO: 12152 - DNA, 25 bp, Homo sapiens
ttcgcagctcacacagtttacctgt

SEQ ID NO: 12153 - DNA, 25 bp, Homo sapiens
ttacctgtgagaccacactcgactc

SEQ ID NO: 12154 - DNA, 25 bp, Homo sapiens
cactcgactcttgccagtgcaaact

SEQ ID NO: 12155 - DNA, 25 bp, Homo sapiens
tcagcaggacctttgtttaccggga

SEQ ID NO: 12156 - DNA, 25 bp, Homo sapiens
cgggatgtgacggactgtaccagcg

SEQ ID NO: 12157 - DNA, 25 bp, Homo sapiens
cttgttggcctgctttgtgatgtgg

SEQ ID NO: 12158 - DNA, 25 bp, Homo sapiens
gtaccaggtcttctatgtgggtgtc

SEQ ID NO: 12159 - DNA, 25 bp, Homo sapiens
gtgggtgtcaggatatgctccctca

SEQ ID NO: 12160 - DNA, 25 bp, Homo sapiens
tgcctgctggggattactcgatcaa

SEQ ID NO: 12161 - DNA, 25 bp, Homo sapiens
ggccttccttttaggtgctggagct

SEQ ID NO: 12162 - DNA, 25 bp, Homo sapiens
gtggggagctagaggccacctatgc

SEQ ID NO: 12163 - DNA, 25 bp, Homo sapiens
ccacctatgccagtgctcaaggtta

SEQ ID NO: 12164 - DNA, 25 bp, Homo sapiens
ggttactgggagtgtgggctgccct

SEQ ID NO: 12165 - DNA, 25 bp, Homo sapiens
aagagatgggatgctccgacagcgt

SEQ ID NO: 12166 - DNA, 25 bp, Homo sapiens
tccgacagcgtctccaattatgaaa

SEQ ID NO: 12167 - DNA, 25 bp, Homo sapiens
aactaatcttaaccctgtgctgtca

SEQ ID NO: 12168 - DNA, 25 bp, Homo sapiens
agataccctggttttctggagtcac

SEQ ID NO: 12169 - DNA, 25 bp, Homo sapiens
gcaggggtgctgtggacatgtgggt

SEQ ID NO: 12170 - DNA, 25 bp, Homo sapiens
gaggaggtgtctggggtgagggagt

SEQ ID NO: 12171 - DNA, 25 bp, Homo sapiens
aggcatggaagttctctgtgataca

SEQ ID NO: 12172 - DNA, 25 bp, Homo sapiens
aatgcgccttatgctacttatctca

SEQ ID NO: 12173 - DNA, 25 bp, Homo sapiens
tagccatggagggtgcggaagggga

SEQ ID NO: 12174 - DNA, 25 bp, Homo sapiens
cgaagattcctaggccttttcatgc

SEQ ID NO: 12175 - DNA, 25 bp, Homo sapiens
aaatgtctctccacaaaccaaactc

SEQ ID NO: 12176 - DNA, 25 bp, Homo sapiens
aaactcaacagaatactttggcttg

SEQ ID NO: 12177 - DNA, 25 bp, Homo sapiens
actttggcttgaagccggcacaccc

SEQ ID NO: 12178 - DNA, 25 bp, Homo sapiens
gcacacccagggttactgaggactt

SEQ ID NO: 12179 - DNA, 25 bp, Homo sapiens
actgaggacttatgctgcctgacct

SEQ ID NO: 12180 - DNA, 25 bp, Homo sapiens
gcctgacctggttagatgtacatgg

SEQ ID NO: 12181 - DNA, 25 bp, Homo sapiens
gtacatggaggtatctcccgaatca

SEQ ID NO: 12182 - DNA, 25 bp, Homo sapiens
cggaggaggtgatgctccgggccag

SEQ ID NO: 12183 - DNA, 25 bp, Homo sapiens
ggtcaccgacagcatgctgatcaag

SEQ ID NO: 12184 - DNA, 25 bp, Homo sapiens
agcatgctgatcaaggctgtctcca

SEQ ID NO: 12185 - DNA, 25 bp, Homo sapiens
ggccacgtgcaggttgctatcaata

SEQ ID NO: 12186 - DNA, 25 bp, Homo sapiens
aggttgctatcaatacccttgtcct

SEQ ID NO: 12187 - DNA, 25 bp, Homo sapiens
ttgtcctcctggtcctctggaggaa

SEQ ID NO: 12188 - DNA, 25 bp, Homo sapiens
cctctggaggaaacctatgccccag

SEQ ID NO: 12189 - DNA, 25 bp, Homo sapiens
aggaaacctatgccccagaggaagg

SEQ ID NO: 12190 - DNA, 25 bp, Homo sapiens
aggacaaagtccggtgaccgctgcc

SEQ ID NO: 12191 - DNA, 25 bp, Homo sapiens
acagggctcttcatggtcatgttct

SEQ ID NO: 12192 - DNA, 25 bp, Homo sapiens
tcatggtcatgttctccatcatctc

SEQ ID NO: 12193 - DNA, 25 bp, Homo sapiens
gatgtcctcaagttcttgtgcaaag

SEQ ID NO: 12194 - DNA, 25 bp, Homo sapiens
tgtgggtggcggtgttccagaagca

SEQ ID NO: 12195 - DNA, 25 bp, Homo sapiens
gaagcagatggacagcctgcgcacc

SEQ ID NO: 12196 - DNA, 25 bp, Homo sapiens
tacgtcctgcaagacaacagcttcc

SEQ ID NO: 12197 - DNA, 25 bp, Homo sapiens
tggaggaagcacccaagttcctggc

SEQ ID NO: 12198 - DNA, 25 bp, Homo sapiens
cgccctctataccctgggcattgag

SEQ ID NO: 12199 - DNA, 25 bp, Homo sapiens
tgggcattgagagcgtggtcaccgc

SEQ ID NO: 12200 - DNA, 25 bp, Homo sapiens
tgcccgtctgtaagttccaggtggt

SEQ ID NO: 12201 - DNA, 25 bp, Homo sapiens
ggtgattccgaaatcctaagcctgc

SEQ ID NO: 12202 - DNA, 25 bp, Homo sapiens
ttcggggtggtcttgggaatcccag

SEQ ID NO: 12203 - DNA, 25 bp, Homo sapiens
cccagctgcggtcaggactgtggtg

SEQ ID NO: 12204 - DNA, 25 bp, Homo sapiens
ctctgcagtgtcctcttgttaatgg

SEQ ID NO: 12205 - DNA, 25 bp, Homo sapiens
gaaggttctttcacctgggagcaaa

SEQ ID NO: 12206 - DNA, 25 bp, Homo sapiens
ccgcgcctgagactggctggaaatg

SEQ ID NO: 12207 - DNA, 25 bp, Homo sapiens
aaatgctctgactcctgtgaaggca

SEQ ID NO: 12208 - DNA, 25 bp, Homo sapiens
cacagccagcgttgtggcctgaggg

SEQ ID NO: 12209 - DNA, 25 bp, Homo sapiens
tgtcccagggcctatgggcaactgc

SEQ ID NO: 12210 - DNA, 25 bp, Homo sapiens
tgaaaggacgttcgccaagggccgt

SEQ ID NO: 12211 - DNA, 25 bp, Homo sapiens
aatacgaactgcgccatggagagga

SEQ ID NO: 12212 - DNA, 25 bp, Homo sapiens
ggagaggagaggcactgccggagcc

SEQ ID NO: 12213 - DNA, 25 bp, Homo sapiens
cctctctctgtgcagtagctgtgtg

SEQ ID NO: 12214 - DNA, 25 bp, Homo sapiens
gtgtgtccgaggtcagtgtgcggaa

SEQ ID NO: 12215 - DNA, 25 bp, Homo sapiens
agaagtgccttcttggttggaaaat

SEQ ID NO: 12216 - DNA, 25 bp, Homo sapiens
caagggtggcagtcgtggacgatct

SEQ ID NO: 12217 - DNA, 25 bp, Homo sapiens
gattcagtggaggatttggtgccag

SEQ ID NO: 12218 - DNA, 25 bp, Homo sapiens
tatcgacaaagtagtggttccagca

SEQ ID NO: 12219 - DNA, 25 bp, Homo sapiens
ggctttggtgctagtcgcggaagca

SEQ ID NO: 12220 - DNA, 25 bp, Homo sapiens
ggctatggaggcttctacaatagtg

SEQ ID NO: 12221 - DNA, 25 bp, Homo sapiens
ggggcaactgaatctgctttgcagc

SEQ ID NO: 12222 - DNA, 25 bp, Homo sapiens
ctttgcagcaaagtcacccttacaa

SEQ ID NO: 12223 - DNA, 25 bp, Homo sapiens
gctgtgattctcctgataattcaag

SEQ ID NO: 12224 - DNA, 25 bp, Homo sapiens
ataattcaagggagctcaaagtcac

SEQ ID NO: 12225 - DNA, 25 bp, Homo sapiens
agatgtaattgctctagtttggatt

SEQ ID NO: 12226 - DNA, 25 bp, Homo sapiens
attctgccatattgactttacaatt

SEQ ID NO: 12227 - DNA, 25 bp, Homo sapiens
gcattttagctttgtatcttgcaag

SEQ ID NO: 12228 - DNA, 25 bp, Homo sapiens
acttcgtgtttgtaaccacattcat

SEQ ID NO: 12229 - DNA, 25 bp, Homo sapiens
tgtgaagctccatatttctgttgct

SEQ ID NO: 12230 - DNA, 25 bp, Homo sapiens
ataacaaagcttccttgatttcctt

SEQ ID NO: 12231 - DNA, 25 bp, Homo sapiens
gatttgttgactagtgcttgggcac

SEQ ID NO: 12232 - DNA, 25 bp, Homo sapiens
atcagtgttatttgctcttggagcc

SEQ ID NO: 12233 - DNA, 25 bp, Homo sapiens
ggcagtgagcagttgaatttatctt

SEQ ID NO: 12234 - DNA, 25 bp, Homo sapiens
tatttctgaagcagctacatagcag

SEQ ID NO: 12235 - DNA, 25 bp, Homo sapiens
agagattctgttagcccacatgttc

SEQ ID NO: 12236 - DNA, 25 bp, Homo sapiens
cacatgttcatgttggttgctgctg

SEQ ID NO: 12237 - DNA, 25 bp, Homo sapiens
gaggtgacactgttggggaccttcc

SEQ ID NO: 12238 - DNA, 25 bp, Homo sapiens
gggctttgctagcctgtacaaccta

SEQ ID NO: 12239 - DNA, 25 bp, Homo sapiens
cttttcttccactgcctgaaagact

SEQ ID NO: 12240 - DNA, 25 bp, Homo sapiens
tataatgcaatccttagtcctaccc

SEQ ID NO: 12241 - DNA, 25 bp, Homo sapiens
ctatgtgtcctctaagtcaggccct

SEQ ID NO: 12242 - DNA, 25 bp, Homo sapiens
gtcaggccctgatctagtgcagtaa

SEQ ID NO: 12243 - DNA, 25 bp, Homo sapiens
tgaacctggagcacttaccgcatta

SEQ ID NO: 12244 - DNA, 25 bp, Homo sapiens
gaagaaaggagctccccgtaatcgt

SEQ ID NO: 12245 - DNA, 25 bp, Homo sapiens
ttcctgacccttgtgtctcatatac

SEQ ID NO: 12246 - DNA, 25 bp, Homo sapiens
gtctcatataccctatcctggtgga

SEQ ID NO: 12247 - DNA, 25 bp, Homo sapiens
gaccctatttgatatgctgtccctt

SEQ ID NO: 12248 - DNA, 25 bp, Homo sapiens
cctgtttcctcctcaatagaattgc

SEQ ID NO: 12249 - DNA, 25 bp, Homo sapiens
gttcttctggacagaccacaactct

SEQ ID NO: 12250 - DNA, 25 bp, Homo sapiens
gaagctagtgctgctatctcatata

SEQ ID NO: 12251 - DNA, 25 bp, Homo sapiens
gatagttaactacctgagaccagct

SEQ ID NO: 12252 - DNA, 25 bp, Homo sapiens
aggaatattgtcttatctccataac

SEQ ID NO: 12253 - DNA, 25 bp, Homo sapiens
caagggcaggttcgattctagctct

SEQ ID NO: 12254 - DNA, 25 bp, Homo sapiens
ttctagctctaattactgtcatgtc

SEQ ID NO: 12255 - DNA, 25 bp, Homo sapiens
tactgtcatgtcatttacccactgg

SEQ ID NO: 12256 - DNA, 25 bp, Homo sapiens
ggtatgtttcacttcttgacaatat

SEQ ID NO: 12257 - DNA, 25 bp, Homo sapiens
aaccgatacctgtcctgcaggtcta

SEQ ID NO: 12258 - DNA, 25 bp, Homo sapiens
caagcacaagtactggggacacatc

SEQ ID NO: 12259 - DNA, 25 bp, Homo sapiens
tgatggtggtatgttttcaggctag

SEQ ID NO: 12260 - DNA, 25 bp, Homo sapiens
gtacttcatgctgtctacactaaga

SEQ ID NO: 12261 - DNA, 25 bp, Homo sapiens
agggtgatattaaccaggggccatg

SEQ ID NO: 12262 - DNA, 25 bp, Homo sapiens
aggggccatgaatcaccttttggtc

SEQ ID NO: 12263 - DNA, 25 bp, Homo sapiens
caccttttggtctggagggaagcct

SEQ ID NO: 12264 - DNA, 25 bp, Homo sapiens
gccttggggctgatcgagttgttgc

SEQ ID NO: 12265 - DNA, 25 bp, Homo sapiens
agttgttgcccacagctgtatgatt

SEQ ID NO: 12266 - DNA, 25 bp, Homo sapiens
cacagcctcttagatgcagttctga

SEQ ID NO: 12267 - DNA, 25 bp, Homo sapiens
gaagatggtaccaccagtctgactg

SEQ ID NO: 12268 - DNA, 25 bp, Homo sapiens
caccagtctgactgtttccatcaag

SEQ ID NO: 12269 - DNA, 25 bp, Homo sapiens
ccatcaagggtacactgccttctca

SEQ ID NO: 12270 - DNA, 25 bp, Homo sapiens
gcccatggtcttgaactgagagtcc

SEQ ID NO: 12271 - DNA, 25 bp, Homo sapiens
gagtcccatttctagatcatcgatt

SEQ ID NO: 12272 - DNA, 25 bp, Homo sapiens
gaggattccaatctgatacccaaag

SEQ ID NO: 12273 - DNA, 25 bp, Homo sapiens
aaagagattctctggcgaccaaaag

SEQ ID NO: 12274 - DNA, 25 bp, Homo sapiens
gcaatgatggcaaatgcagcccaga

SEQ ID NO: 12275 - DNA, 25 bp, Homo sapiens
aggatattactaccgtcaagtcttt

SEQ ID NO: 12276 - DNA, 25 bp, Homo sapiens
tcaagtctttgaacgccattaccca

SEQ ID NO: 12277 - DNA, 25 bp, Homo sapiens
ggctgagccattactggatgcccaa

SEQ ID NO: 12278 - DNA, 25 bp, Homo sapiens
tggatgcccaagtggatcaatgcca

SEQ ID NO: 12279 - DNA, 25 bp, Homo sapiens
gacccactacaagtcagctgtcaaa

SEQ ID NO: 12280 - DNA, 25 bp, Homo sapiens
atatttcttcgtgttggatggggac

SEQ ID NO: 12281 - DNA, 25 bp, Homo sapiens
caggtatgttgcctttatggtttcc

SEQ ID NO: 12282 - DNA, 25 bp, Homo sapiens
tcccccttctacatttcttagacta

SEQ ID NO: 12283 - DNA, 25 bp, Homo sapiens
gagaactgtggccgttatctggaag

SEQ ID NO: 12284 - DNA, 25 bp, Homo sapiens
tgcactggagttctatgctctcgca

SEQ ID NO: 12285 - DNA, 25 bp, Homo sapiens
gtcacccaagagattgttgtttgcc

SEQ ID NO: 12286 - DNA, 25 bp, Homo sapiens
gttgtttgccatactttgtctgaaa

SEQ ID NO: 12287 - DNA, 25 bp, Homo sapiens
gatgtctaggtacttcaggggcact

SEQ ID NO: 12288 - DNA, 25 bp, Homo sapiens
atgtctaggtacttcaggggcactt

SEQ ID NO: 12289 - DNA, 25 bp, Homo sapiens
attcccaagcccatgagtccttgaa

SEQ ID NO: 12290 - DNA, 25 bp, Homo sapiens
aaaggatgttggtgttccacgtgtt

SEQ ID NO: 12291 - DNA, 25 bp, Homo sapiens
gttccacgtgttttattcctgtatg

SEQ ID NO: 12292 - DNA, 25 bp, Homo sapiens
agatgagcaacgttgtcttttctct

SEQ ID NO: 12293 - DNA, 25 bp, Homo sapiens
tgtcttttctctcaaagctgtaatg

SEQ ID NO: 12294 - DNA, 25 bp, Homo sapiens
ccttgttatttgcccttcagaatgc

SEQ ID NO: 12295 - DNA, 25 bp, Homo sapiens
cactctggcaattgtctgcagctgc

SEQ ID NO: 12296 - DNA, 25 bp, Homo sapiens
gccactggtgcaaggccttaccagc

SEQ ID NO: 12297 - DNA, 25 bp, Homo sapiens
ctagcctctagcacttctctaagtg

SEQ ID NO: 12298 - DNA, 25 bp, Homo sapiens
tgtgttcctttcttgatacttagtc

SEQ ID NO: 12299 - DNA, 25 bp, Homo sapiens
gagtagctcactttagtcctgtaac

SEQ ID NO: 12300 - DNA, 25 bp, Homo sapiens
ttgtgttcagtgtaattgtcttctc

SEQ ID NO: 12301 - DNA, 25 bp, Homo sapiens
aaagcatatgcctcacctggttaaa

SEQ ID NO: 12302 - DNA, 25 bp, Homo sapiens
aagctactgaagtgccttgggaaat

SEQ ID NO: 12303 - DNA, 25 bp, Homo sapiens
tatctcctgaggatcactccaagaa

SEQ ID NO: 12304 - DNA, 25 bp, Homo sapiens
gagatccacataccattctcaatcc

SEQ ID NO: 12305 - DNA, 25 bp, Homo sapiens
taccattctcaatcccactgaaatt

SEQ ID NO: 12306 - DNA, 25 bp, Homo sapiens
gctggcattctcaaaggcagggcag

SEQ ID NO: 12307 - DNA, 25 bp, Homo sapiens
gagggagggttctgtctaatctttt

SEQ ID NO: 12308 - DNA, 25 bp, Homo sapiens
agctttcatacttcagcccttaagt

SEQ ID NO: 12309 - DNA, 25 bp, Homo sapiens
tagtggtgttaactgctccaactct

SEQ ID NO: 12310 - DNA, 25 bp, Homo sapiens
ccaactcttgtcttgcttagtttct

SEQ ID NO: 12311 - DNA, 25 bp, Homo sapiens
agatgctgttcatcagtcccaacaa

SEQ ID NO: 12312 - DNA, 25 bp, Homo sapiens
caagttctatttcttcccttatagt

SEQ ID NO: 12313 - DNA, 25 bp, Homo sapiens
gatacaggaaacaccctatctcctc

SEQ ID NO: 12314 - DNA, 25 bp, Homo sapiens
cttttgcgaacctttcagtctccgc

SEQ ID NO: 12315 - DNA, 25 bp, Homo sapiens
ctccgctagctctttcctaatgagc

SEQ ID NO: 12316 - DNA, 25 bp, Homo sapiens
ctgttttatcgttaagtgccccaca

SEQ ID NO: 12317 - DNA, 25 bp, Homo sapiens
gacagtgtgtgagccgagccctgtc

SEQ ID NO: 12318 - DNA, 25 bp, Homo sapiens
gaggagctagagtatcctcctccct

SEQ ID NO: 12319 - DNA, 25 bp, Homo sapiens
tccctttaccattcagaccgagaga

SEQ ID NO: 12320 - DNA, 25 bp, Homo sapiens
gaaaaagcccagcttgtgtgcaccc

SEQ ID NO: 12321 - DNA, 25 bp, Homo sapiens
gtgcaccctcgtggggttaaggcga

SEQ ID NO: 12322 - DNA, 25 bp, Homo sapiens
atggtttctatctgcaattatcgtc

SEQ ID NO: 12323 - DNA, 25 bp, Homo sapiens
gtaaacttttctcagtgtccagact

SEQ ID NO: 12324 - DNA, 25 bp, Homo sapiens
tcacattttaattgccacctcgtat

SEQ ID NO: 12325 - DNA, 25 bp, Homo sapiens
gtatgtggctttctgtagccgtggt

SEQ ID NO: 12326 - DNA, 25 bp, Homo sapiens
taacggccaaactgttcatcctagc

SEQ ID NO: 12327 - DNA, 25 bp, Homo sapiens
tcctggcaggtggcattcatctcag

SEQ ID NO: 12328 - DNA, 25 bp, Homo sapiens
tgagcacaaggcattggccctctgg

SEQ ID NO: 12329 - DNA, 25 bp, Homo sapiens
aagtccagttgaaatctcagcctcc

SEQ ID NO: 12330 - DNA, 25 bp, Homo sapiens
caacattttcttctcgtgtgtggcc

SEQ ID NO: 12331 - DNA, 25 bp, Homo sapiens
ccacttctccaacttctgtttaatc

SEQ ID NO: 12332 - DNA, 25 bp, Homo sapiens
gtttaatctgatcacggctcttttt

SEQ ID NO: 12333 - DNA, 25 bp, Homo sapiens
ttaagccctggcagcattttggtcc

SEQ ID NO: 12334 - DNA, 25 bp, Homo sapiens
ctgctccttgcccatagtaaaacag

SEQ ID NO: 12335 - DNA, 25 bp, Homo sapiens
tagtttcaagtgggcgactctgctc

SEQ ID NO: 12336 - DNA, 25 bp, Homo sapiens
agacggtgcagtcggctgcatactc

SEQ ID NO: 12337 - DNA, 25 bp, Homo sapiens
ggctgcatactcccagtcgggagtg

SEQ ID NO: 12338 - DNA, 25 bp, Homo sapiens
cagtcgggagtgtggtcagtctgcc

SEQ ID NO: 12339 - DNA, 25 bp, Homo sapiens
gattttggcatcttgtttttctaac

SEQ ID NO: 12340 - DNA, 25 bp, Homo sapiens
acagaagattgccttacgctcgtga

SEQ ID NO: 12341 - DNA, 25 bp, Homo sapiens
cgctcgtgagcgtgagaagccataa

SEQ ID NO: 12342 - DNA, 25 bp, Homo sapiens
gagagaccgaattctgtggctcagc

SEQ ID NO: 12343 - DNA, 25 bp, Homo sapiens
tggctcagcacacaggactgaccca

SEQ ID NO: 12344 - DNA, 25 bp, Homo sapiens
gagcccacaggattcagcagcatgg

SEQ ID NO: 12345 - DNA, 25 bp, Homo sapiens
attcagcagcatggacagtcactct

SEQ ID NO: 12346 - DNA, 25 bp, Homo sapiens
cttctccaagccagaaaccacattt

SEQ ID NO: 12347 - DNA, 25 bp, Homo sapiens
ttgtgctgtactttgtgcgtagaaa

SEQ ID NO: 12348 - DNA, 25 bp, Homo sapiens
ttgtattgtcaaccccagtcagtaa

SEQ ID NO: 12349 - DNA, 25 bp, Homo sapiens
tgtagatttctcttaattccatttg

SEQ ID NO: 12350 - DNA, 25 bp, Homo sapiens
aactattgttgtggcttcttgtgta

SEQ ID NO: 12351 - DNA, 25 bp, Homo sapiens
ctgtatatgtatgagtcttcctgtc

SEQ ID NO: 12352 - DNA, 25 bp, Homo sapiens
cttcctgtcattgtatttggcacat

SEQ ID NO: 12353 - DNA, 25 bp, Homo sapiens
actggttttccctcaacaacatata

SEQ ID NO: 12354 - DNA, 25 bp, Homo sapiens
gtttaagacttagctaggtttccat

SEQ ID NO: 12355 - DNA, 25 bp, Homo sapiens
aggtttccatttagatcttcatatc

SEQ ID NO: 12356 - DNA, 25 bp, Homo sapiens
agttgggttcttggcatagagttgc

SEQ ID NO: 12357 - DNA, 25 bp, Homo sapiens
gtatgtacaggcagttttctgtcct

SEQ ID NO: 12358 - DNA, 25 bp, Homo sapiens
tgaattcgcgacaactacaacgact

SEQ ID NO: 12359 - DNA, 25 bp, Homo sapiens
caacgactggagttcttctggggat

SEQ ID NO: 12360 - DNA, 25 bp, Homo sapiens
ggagttcttctggggatcagtagtc

SEQ ID NO: 12361 - DNA, 25 bp, Homo sapiens
ttcatgtggacaatggtgcgggcag

SEQ ID NO: 12362 - DNA, 25 bp, Homo sapiens
gtgcgggcagattcactgctgtcta

SEQ ID NO: 12363 - DNA, 25 bp, Homo sapiens
tgctgtctatgatgctggggttcca

SEQ ID NO: 12364 - DNA, 25 bp, Homo sapiens
gccaacaagatcaaacaccgcattg

SEQ ID NO: 12365 - DNA, 25 bp, Homo sapiens
gatcaaacaccgcattgagctcaca

SEQ ID NO: 12366 - DNA, 25 bp, Homo sapiens
ccgcattgagctcacagtcgatggg

SEQ ID NO: 12367 - DNA, 25 bp, Homo sapiens
agctcacagtcgatgggaaccaggt

SEQ ID NO: 12368 - DNA, 25 bp, Homo sapiens
tgggaaccaggtggaagcccaaagc

SEQ ID NO: 12369 - DNA, 25 bp, Homo sapiens
gagcactgctgtatctgttttatgg

SEQ ID NO: 12370 - DNA, 25 bp, Homo sapiens
accagcaatgctaccagtgatttaa

SEQ ID NO: 12371 - DNA, 25 bp, Homo sapiens
tgatgggcgtgctattgtgcgtgga

SEQ ID NO: 12372 - DNA, 25 bp, Homo sapiens
atggatctgtgatggtcagcaccac

SEQ ID NO: 12373 - DNA, 25 bp, Homo sapiens
gttgggtagtggtgactgggtacgc

SEQ ID NO: 12374 - DNA, 25 bp, Homo sapiens
actgggtacgctacaagctctgcat

SEQ ID NO: 12375 - DNA, 25 bp, Homo sapiens
atgggacgctcttcaaggtgcaagt

SEQ ID NO: 12376 - DNA, 25 bp, Homo sapiens
ggtgcaagtaaccagccagaacatg

SEQ ID NO: 12377 - DNA, 25 bp, Homo sapiens
gggctgccaaatctcagacaacccc

SEQ ID NO: 12378 - DNA, 25 bp, Homo sapiens
gacaacccctgtggaaacactcatt

SEQ ID NO: 12379 - DNA, 25 bp, Homo sapiens
gaaccccagaggtcaccaacatgtt

SEQ ID NO: 12380 - DNA, 25 bp, Homo sapiens
tagagttcggtctgacagtccttgg

SEQ ID NO: 12381 - DNA, 25 bp, Homo sapiens
cagtccttggggttaagtctcctgt

SEQ ID NO: 12382 - DNA, 25 bp, Homo sapiens
aagtctcctgtcttatggtccagaa

SEQ ID NO: 12383 - DNA, 25 bp, Homo sapiens
gctcttgcagttgctctgacgtaga

SEQ ID NO: 12384 - DNA, 25 bp, Homo sapiens
gatccttcgggtgctggaagtctcc

SEQ ID NO: 12385 - DNA, 25 bp, Homo sapiens
catgaagagcttgtgtcctgtcctt

SEQ ID NO: 12386 - DNA, 25 bp, Homo sapiens
cctttcttgcagattctatttcccc

SEQ ID NO: 12387 - DNA, 25 bp, Homo sapiens
tgctaatacctcttactttgcttga

SEQ ID NO: 12388 - DNA, 25 bp, Homo sapiens
ttgagaatcctctcctttcttatta

SEQ ID NO: 12389 - DNA, 25 bp, Homo sapiens
aactggcccgtggagactgagatca

SEQ ID NO: 12390 - DNA, 25 bp, Homo sapiens
gctggctctgacaagatggtccatt

SEQ ID NO: 12391 - DNA, 25 bp, Homo sapiens
aatgctgaactccttgttagccctt

SEQ ID NO: 12392 - DNA, 25 bp, Homo sapiens
aggagtggttctcatttggtctgcc

SEQ ID NO: 12393 - DNA, 25 bp, Homo sapiens
agggggttcttattttgcattccag

SEQ ID NO: 12394 - DNA, 25 bp, Homo sapiens
tcaaagtgttgtgttccctggctga

SEQ ID NO: 12395 - DNA, 25 bp, Homo sapiens
gatccagaacagtggctcgtatccc

SEQ ID NO: 12396 - DNA, 25 bp, Homo sapiens
tcgtatcccaaatctgtcagcatct

SEQ ID NO: 12397 - DNA, 25 bp, Homo sapiens
gatttgattcattttcctgttcagt

SEQ ID NO: 12398 - DNA, 25 bp, Homo sapiens
agaatgcattccctgaatctgtgcc

SEQ ID NO: 12399 - DNA, 25 bp, Homo sapiens
cccccactaagaccctggtctgagg

SEQ ID NO: 12400 - DNA, 25 bp, Homo sapiens
acaggtgggctgtattcacgccatt

SEQ ID NO: 12401 - DNA, 25 bp, Homo sapiens
catccaggtcttgactcatggcagc

SEQ ID NO: 12402 - DNA, 25 bp, Homo sapiens
attattgctccccctgagcgtaaat

SEQ ID NO: 12403 - DNA, 25 bp, Homo sapiens
atactctgtctggattgggggctcc

SEQ ID NO: 12404 - DNA, 25 bp, Homo sapiens
gcaagagtacgatgaggcaggccca

SEQ ID NO: 12405 - DNA, 25 bp, Homo sapiens
ctccatctaccttccagtcaggatg

SEQ ID NO: 12406 - DNA, 25 bp, Homo sapiens
ggatgacggtattatgcttcttgga

SEQ ID NO: 12407 - DNA, 25 bp, Homo sapiens
ttcttggagtctcccaaaccacctt

SEQ ID NO: 12408 - DNA, 25 bp, Homo sapiens
gtacagtttgtttacacacgtgcaa

SEQ ID NO: 12409 - DNA, 25 bp, Homo sapiens
gatggccaagtcatcactatcggca

SEQ ID NO: 12410 - DNA, 25 bp, Homo sapiens
gacattgatatccgcaaggacctgt

SEQ ID NO: 12411 - DNA, 25 bp, Homo sapiens
gtaccctggtattgctgatcgtatg

SEQ ID NO: 12412 - DNA, 25 bp, Homo sapiens
gaaggaaatcactgctctggctcct

SEQ ID NO: 12413 - DNA, 25 bp, Homo sapiens
tgaaaggagtgctgctgaaactgta

SEQ ID NO: 12414 - DNA, 25 bp, Homo sapiens
ccaaaggaggcattatgcttccaga

SEQ ID NO: 12415 - DNA, 25 bp, Homo sapiens
gctacactagagcagagtacgagtc

SEQ ID NO: 12416 - DNA, 25 bp, Homo sapiens
gtattgcaagcaacagtagtcgctg

SEQ ID NO: 12417 - DNA, 25 bp, Homo sapiens
gtcgctgttggatcgggttctaaag

SEQ ID NO: 12418 - DNA, 25 bp, Homo sapiens
ggaggcaccaaagtagttctagatg

SEQ ID NO: 12419 - DNA, 25 bp, Homo sapiens
agtacgagtctgaggcggagggagt

SEQ ID NO: 12420 - DNA, 25 bp, Homo sapiens
gaaatctttcgtcatgtaaataatt

SEQ ID NO: 12421 - DNA, 25 bp, Homo sapiens
gagtaatggcaggacaagcgtttag

SEQ ID NO: 12422 - DNA, 25 bp, Homo sapiens
tagaaagtttcttccactctttgac

SEQ ID NO: 12423 - DNA, 25 bp, Homo sapiens
tcttccactctttgaccgagtattg

SEQ ID NO: 12424 - DNA, 25 bp, Homo sapiens
gataactccaggtacacacacttcc

SEQ ID NO: 12425 - DNA, 25 bp, Homo sapiens
gacccagcactatgatgccaaacca

SEQ ID NO: 12426 - DNA, 25 bp, Homo sapiens
ccaaaccacagggccgggatgacag

SEQ ID NO: 12427 - DNA, 25 bp, Homo sapiens
ctcaccctgcaaagacatcaacaca

SEQ ID NO: 12428 - DNA, 25 bp, Homo sapiens
aacaagcgcagcatcaaggccatct

SEQ ID NO: 12429 - DNA, 25 bp, Homo sapiens
tttccaggtcaccacttgcaagcta

SEQ ID NO: 12430 - DNA, 25 bp, Homo sapiens
taccgagccacagcggggttcagaa

SEQ ID NO: 12431 - DNA, 25 bp, Homo sapiens
gcttacctgtccacttggatcagtc

SEQ ID NO: 12432 - DNA, 25 bp, Homo sapiens
tggatcagtcaattttccgtcgtcc

SEQ ID NO: 12433 - DNA, 25 bp, Homo sapiens
gcaacattcattgccaagggcccaa

SEQ ID NO: 12434 - DNA, 25 bp, Homo sapiens
gaaagagctacctggaccttttgtt

SEQ ID NO: 12435 - DNA, 25 bp, Homo sapiens
tgccagggacagtcgacagggaccg

SEQ ID NO: 12436 - DNA, 25 bp, Homo sapiens
ctgctagggtctgttgccaaggtca

SEQ ID NO: 12437 - DNA, 25 bp, Homo sapiens
gtctgttgccaaggtcaacccatca

SEQ ID NO: 12438 - DNA, 25 bp, Homo sapiens
caacccatcaccaggaactgtcact

SEQ ID NO: 12439 - DNA, 25 bp, Homo sapiens
ggaactgtcactggggacgagtcca

SEQ ID NO: 12440 - DNA, 25 bp, Homo sapiens
tggggacgagtccatgttcccaagg

SEQ ID NO: 12441 - DNA, 25 bp, Homo sapiens
tgtccctcaccacggtgtggacagt

SEQ ID NO: 12442 - DNA, 25 bp, Homo sapiens
tcaccacggtgtggacagtgccgca

SEQ ID NO: 12443 - DNA, 25 bp, Homo sapiens
caccctcaacataggccatgtgggg

SEQ ID NO: 12444 - DNA, 25 bp, Homo sapiens
gggcagaagtgccagatgacagtca

SEQ ID NO: 12445 - DNA, 25 bp, Homo sapiens
gatgacagtcagaggcgcaggagcc

SEQ ID NO: 12446 - DNA, 25 bp, Homo sapiens
cggagacagagaaccgctactgcgt

SEQ ID NO: 12447 - DNA, 25 bp, Homo sapiens
agacagagaaccgctactgcgtgca

SEQ ID NO: 12448 - DNA, 25 bp, Homo sapiens
ggaatacaaaatcctgctggatgtg

SEQ ID NO: 12449 - DNA, 25 bp, Homo sapiens
tacaaaatcctgctggatgtgaaga

SEQ ID NO: 12450 - DNA, 25 bp, Homo sapiens
atgcccacctgactcagtacaagaa

SEQ ID NO: 12451 - DNA, 25 bp, Homo sapiens
gcccacctgactcagtacaagaaag

SEQ ID NO: 12452 - DNA, 25 bp, Homo sapiens
cagtacaagaaagaaccggtgacca

SEQ ID NO: 12453 - DNA, 25 bp, Homo sapiens
gcagagtggcaagagtgagatctcg

SEQ ID NO: 12454 - DNA, 25 bp, Homo sapiens
cgcaccatgcaggccttggagatag

SEQ ID NO: 12455 - DNA, 25 bp, Homo sapiens
accatgcaggccttggagatagagc

SEQ ID NO: 12456 - DNA, 25 bp, Homo sapiens
gccttggagatagagctgcagtccc

SEQ ID NO: 12457 - DNA, 25 bp, Homo sapiens
ggccatagcgagcactagacgtgtt

SEQ ID NO: 12458 - DNA, 25 bp, Homo sapiens
agcactagacgtgttgtcattgcct

SEQ ID NO: 12459 - DNA, 25 bp, Homo sapiens
ctgtgagggtaacccacaggtgcct

SEQ ID NO: 12460 - DNA, 25 bp, Homo sapiens
tgcctgtgcactttgacggttagat

SEQ ID NO: 12461 - DNA, 25 bp, Homo sapiens
gacggttagatgccaccatgtaggg

SEQ ID NO: 12462 - DNA, 25 bp, Homo sapiens
gggattatcgcgagtggttgacctt

SEQ ID NO: 12463 - DNA, 25 bp, Homo sapiens
ttgaccttacacttactccttaaat

SEQ ID NO: 12464 - DNA, 25 bp, Homo sapiens
ttttctctatataactcattctatt

SEQ ID NO: 12465 - DNA, 25 bp, Homo sapiens
ctgtaatgaatgaggctgggctttt

SEQ ID NO: 12466 - DNA, 25 bp, Homo sapiens
atactggtcagcttagtctctcaga

SEQ ID NO: 12467 - DNA, 25 bp, Homo sapiens
gtctctcagatcctatcctgtggaa

SEQ ID NO: 12468 - DNA, 25 bp, Homo sapiens
atcagacatcttatttctagggtga

SEQ ID NO: 12469 - DNA, 25 bp, Homo sapiens
tgagggaggtggaaagcgcaggagg

SEQ ID NO: 12470 - DNA, 25 bp, Homo sapiens
gacattgacttgtgttcctatctgc

SEQ ID NO: 12471 - DNA, 25 bp, Homo sapiens
tcctatctgccatcttgggtgtggg

SEQ ID NO: 12472 - DNA, 25 bp, Homo sapiens
gggtgtgggtctttatatgtggtta

SEQ ID NO: 12473 - DNA, 25 bp, Homo sapiens
atgtggttacagatcctttagtttg

SEQ ID NO: 12474 - DNA, 25 bp, Homo sapiens
taggaggccgatgtcagtcctccca

SEQ ID NO: 12475 - DNA, 25 bp, Homo sapiens
agtcctcccagcaaagctgtgtcat

SEQ ID NO: 12476 - DNA, 25 bp, Homo sapiens
ctcagattcttggctgtctgtttaa

SEQ ID NO: 12477 - DNA, 25 bp, Homo sapiens
ggctgtctgtttaaccaatcacgat

SEQ ID NO: 12478 - DNA, 25 bp, Homo sapiens
atttttattgtccagatcctctact

SEQ ID NO: 12479 - DNA, 25 bp, Homo sapiens
ttcactatctcaggagccagtcacc

SEQ ID NO: 12480 - DNA, 25 bp, Homo sapiens
atctgccctgtgatgctgggtgatg

SEQ ID NO: 12481 - DNA, 25 bp, Homo sapiens
atctttgtcatcgggttcagctacc

SEQ ID NO: 12482 - DNA, 25 bp, Homo sapiens
tccgggtacagatctcagcagtgca

SEQ ID NO: 12483 - DNA, 25 bp, Homo sapiens
aagacattgaccgctgcgtggaggc

SEQ ID NO: 12484 - DNA, 25 bp, Homo sapiens
aaaggaggttttcgatcagcccaga

SEQ ID NO: 12485 - DNA, 25 bp, Homo sapiens
tcagcccagaccagaggctctgagc

SEQ ID NO: 12486 - DNA, 25 bp, Homo sapiens
agccctgaaccaaagtcccagagct

SEQ ID NO: 12487 - DNA, 25 bp, Homo sapiens
tccaaggccctagatctgctgatgg

SEQ ID NO: 12488 - DNA, 25 bp, Homo sapiens
ggggagtaacaccattgtccagtct

SEQ ID NO: 12489 - DNA, 25 bp, Homo sapiens
gccaagacccagaggttccgtagta

SEQ ID NO: 12490 - DNA, 25 bp, Homo sapiens
gagcaggaacctgtacagtggtgac

SEQ ID NO: 12491 - DNA, 25 bp, Homo sapiens
attaccggatccagggccgggcagt

SEQ ID NO: 12492 - DNA, 25 bp, Homo sapiens
tccctatccgctggatgtcttggga

SEQ ID NO: 12493 - DNA, 25 bp, Homo sapiens
gtcttgggagagtatcttgctgggc

SEQ ID NO: 12494 - DNA, 25 bp, Homo sapiens
tttgtcaagaacagccctattccca

SEQ ID NO: 12495 - DNA, 25 bp, Homo sapiens
tactggagagttcttccgagaccaa

SEQ ID NO: 12496 - DNA, 25 bp, Homo sapiens
agggaggcagacttacctccctcaa

SEQ ID NO: 12497 - DNA, 25 bp, Homo sapiens
gagatacgaagaaccgtccctcatt

SEQ ID NO: 12498 - DNA, 25 bp, Homo sapiens
ggcgacgagtgatgctgtcagtgcc

SEQ ID NO: 12499 - DNA, 25 bp, Homo sapiens
ctatgccactccatctggacattta

SEQ ID NO: 12500 - DNA, 25 bp, Homo sapiens
acagaggcttgtttgctttgccctc

SEQ ID NO: 12501 - DNA, 25 bp, Homo sapiens
tttctggccttcacccagacgaaga

SEQ ID NO: 12502 - DNA, 25 bp, Homo sapiens
cgaggccagcgaggactgcatctcg

SEQ ID NO: 12503 - DNA, 25 bp, Homo sapiens
cagactggctcggagaacgacgccc

SEQ ID NO: 12504 - DNA, 25 bp, Homo sapiens
acgacgccctgtatgagtacctgcg

SEQ ID NO: 12505 - DNA, 25 bp, Homo sapiens
gcgccagagcgtgggcaacgaggcc

SEQ ID NO: 12506 - DNA, 25 bp, Homo sapiens
gcatcgcctacaagaactgggagac

SEQ ID NO: 12507 - DNA, 25 bp, Homo sapiens
caacccgatggcggcaagaccgaga

SEQ ID NO: 12508 - DNA, 25 bp, Homo sapiens
agaccgagaactgcgcggtcctgtc

SEQ ID NO: 12509 - DNA, 25 bp, Homo sapiens
acggcaagtggttcgacaagcgctg

SEQ ID NO: 12510 - DNA, 25 bp, Homo sapiens
gccctacatctgccagttcgggatc

SEQ ID NO: 12511 - DNA, 25 bp, Homo sapiens
gccagttcgggatcgtgtagccggc

SEQ ID NO: 12512 - DNA, 25 bp, Homo sapiens
ttcaaactctatcagcgggcaaagc

SEQ ID NO: 12513 - DNA, 25 bp, Homo sapiens
gcgggcaaagcatgtgtacagcgag

SEQ ID NO: 12514 - DNA, 25 bp, Homo sapiens
gcgcgagtgctccagtttaagaaga

SEQ ID NO: 12515 - DNA, 25 bp, Homo sapiens
ccagctgctgggagagttgatgaac

SEQ ID NO: 12516 - DNA, 25 bp, Homo sapiens
gatgaaccagagccacatgagctgc

SEQ ID NO: 12517 - DNA, 25 bp, Homo sapiens
gccacatgagctgccgggacatgta

SEQ ID NO: 12518 - DNA, 25 bp, Homo sapiens
gggacatgtatgagtgcagctgccc

SEQ ID NO: 12519 - DNA, 25 bp, Homo sapiens
gatctgcaggtgtctgggaattagc

SEQ ID NO: 12520 - DNA, 25 bp, Homo sapiens
gggaattagcctggaggaactccga

SEQ ID NO: 12521 - DNA, 25 bp, Homo sapiens
gaactccgaacccaaatcctgagtc

SEQ ID NO: 12522 - DNA, 25 bp, Homo sapiens
gtgctcatcttcaaactctatcagc

SEQ ID NO: 12523 - DNA, 25 bp, Homo sapiens
gggactcatccgaggtcactatgag

SEQ ID NO: 12524 - DNA, 25 bp, Homo sapiens
gcaaagcaaggtgggttcctgccag

SEQ ID NO: 12525 - DNA, 25 bp, Homo sapiens
ggagtctacacagcacaatgacccc

SEQ ID NO: 12526 - DNA, 25 bp, Homo sapiens
ggacctgatgctgactgctttgaga

SEQ ID NO: 12527 - DNA, 25 bp, Homo sapiens
gcaaggtcaagctggcacctgagag

SEQ ID NO: 12528 - DNA, 25 bp, Homo sapiens
ggattgccgatggcaccatggcatt

SEQ ID NO: 12529 - DNA, 25 bp, Homo sapiens
atcatctttaagtctggcggtcaca

SEQ ID NO: 12530 - DNA, 25 bp, Homo sapiens
tcaaggcctccaggtgtttggatga

SEQ ID NO: 12531 - DNA, 25 bp, Homo sapiens
gaactaccacaagtgctgggagcca

SEQ ID NO: 12532 - DNA, 25 bp, Homo sapiens
gaatctcatgctttctggtagtatt

SEQ ID NO: 12533 - DNA, 25 bp, Homo sapiens
gcaaagttctatggctgtcacctta

SEQ ID NO: 12534 - DNA, 25 bp, Homo sapiens
attgctgcctctattatggcacttc

SEQ ID NO: 12535 - DNA, 25 bp, Homo sapiens
ggcacttcaattttgcactgtcttt

SEQ ID NO: 12536 - DNA, 25 bp, Homo sapiens
gtaaatgctgccatgttccaaaccc

SEQ ID NO: 12537 - DNA, 25 bp, Homo sapiens
gtgtttagagctgtgcaccctagaa

SEQ ID NO: 12538 - DNA, 25 bp, Homo sapiens
attatgccagtttctgttctctcac

SEQ ID NO: 12539 - DNA, 25 bp, Homo sapiens
tttttgtgcactacatactcttcag

SEQ ID NO: 12540 - DNA, 25 bp, Homo sapiens
gattaatatgcccttttgccgatgc

SEQ ID NO: 12541 - DNA, 25 bp, Homo sapiens
tactgatgtgactcggttttgtcgc

SEQ ID NO: 12542 - DNA, 25 bp, Homo sapiens
ttttgtcgcagctttgctttgttta

SEQ ID NO: 12543 - DNA, 25 bp, Homo sapiens
cacacttgtaaacctcttttgcact

SEQ ID NO: 12544 - DNA, 25 bp, Homo sapiens
gatgctcgagcacctgtaaacaatt

SEQ ID NO: 12545 - DNA, 25 bp, Homo sapiens
ggtaagtttcagtggagctcagagg

SEQ ID NO: 12546 - DNA, 25 bp, Homo sapiens
ggacggggagatagaactgtggcac

SEQ ID NO: 12547 - DNA, 25 bp, Homo sapiens
gaactgtggcacttaggggagatga

SEQ ID NO: 12548 - DNA, 25 bp, Homo sapiens
agatgacatttgctttgggcagagg

SEQ ID NO: 12549 - DNA, 25 bp, Homo sapiens
ctagccaggacacatttccactata

SEQ ID NO: 12550 - DNA, 25 bp, Homo sapiens
aagtccagctcccttgctaaaaata

SEQ ID NO: 12551 - DNA, 25 bp, Homo sapiens
aattggtattcaggtaactcattta

SEQ ID NO: 12552 - DNA, 25 bp, Homo sapiens
tatgtgggtctgtgaatttctttaa

SEQ ID NO: 12553 - DNA, 25 bp, Homo sapiens
aatccagcttcataatttccatgat

SEQ ID NO: 12554 - DNA, 25 bp, Homo sapiens
ctttgttccttttgctctgatagac

SEQ ID NO: 12555 - DNA, 25 bp, Homo sapiens
tgtatttcaaaatcacccaaaactt

SEQ ID NO: 12556 - DNA, 25 bp, Homo sapiens
gtatcccccaacacggatgagtttt

SEQ ID NO: 12557 - DNA, 25 bp, Homo sapiens
tttttagatcttcttgccagctcac

SEQ ID NO: 12558 - DNA, 25 bp, Homo sapiens
tcacagagtcgccgtctggatgacc

SEQ ID NO: 12559 - DNA, 25 bp, Homo sapiens
cagagggctagtttcagtaatttgc

SEQ ID NO: 12560 - DNA, 25 bp, Homo sapiens
aatttgccagggcttcgtctaacac

SEQ ID NO: 12561 - DNA, 25 bp, Homo sapiens
aaaacagccagtcggtacttagcca

SEQ ID NO: 12562 - DNA, 25 bp, Homo sapiens
agtcggtacttagccacctgatgac

SEQ ID NO: 12563 - DNA, 25 bp, Homo sapiens
agccacctgatgactaatgacaaca

SEQ ID NO: 12564 - DNA, 25 bp, Homo sapiens
gatttctttgacatccttgtaaaat

SEQ ID NO: 12565 - DNA, 25 bp, Homo sapiens
acctgctaccacaaagggtccgaca

SEQ ID NO: 12566 - DNA, 25 bp, Homo sapiens
gggtccgacagtaccagatgaagac

SEQ ID NO: 12567 - DNA, 25 bp, Homo sapiens
atctgcccagacgagctggagaagc

SEQ ID NO: 12568 - DNA, 25 bp, Homo sapiens
cgggacgacgttgaagccatggccc

SEQ ID NO: 12569 - DNA, 25 bp, Homo sapiens
aggacttccacccaagactgttggg

SEQ ID NO: 12570 - DNA, 25 bp, Homo sapiens
caagactgttgggtctgaccggctc

SEQ ID NO: 12571 - DNA, 25 bp, Homo sapiens
gctagtcacagttaccgcgtgtact

SEQ ID NO: 12572 - DNA, 25 bp, Homo sapiens
ttaccgcgtgtactacaatgccggc

SEQ ID NO: 12573 - DNA, 25 bp, Homo sapiens
ctacatcgtggaccactccattgcc

SEQ ID NO: 12574 - DNA, 25 bp, Homo sapiens
gcctcttcacggattactacggccg

SEQ ID NO: 12575 - DNA, 25 bp, Homo sapiens
ggagcagatcggctgagcagatctc

SEQ ID NO: 12576 - DNA, 25 bp, Homo sapiens
cagatctcagacagtgtgcggcggc

SEQ ID NO: 12577 - DNA, 25 bp, Homo sapiens
gcagtgtcctgtcttgagccactgc

SEQ ID NO: 12578 - DNA, 25 bp, Homo sapiens
gaccaggagcaggccagttctggct

SEQ ID NO: 12579 - DNA, 25 bp, Homo sapiens
tggctgggggagtcgcattcgagga

SEQ ID NO: 12580 - DNA, 25 bp, Homo sapiens
gatggtagtggcttcagcctctgac

SEQ ID NO: 12581 - DNA, 25 bp, Homo sapiens
tgggacatggcagggacttcacagt

SEQ ID NO: 12582 - DNA, 25 bp, Homo sapiens
agtgggggtttttagctggctcaca

SEQ ID NO: 12583 - DNA, 25 bp, Homo sapiens
gtacgtgggggtctggctgagagta

SEQ ID NO: 12584 - DNA, 25 bp, Homo sapiens
ggcggtcagtgatgagatcctcgag

SEQ ID NO: 12585 - DNA, 25 bp, Homo sapiens
tagccgggaagaccttggaccaagt

SEQ ID NO: 12586 - DNA, 25 bp, Homo sapiens
tgccaacagccataacctcattgtc

SEQ ID NO: 12587 - DNA, 25 bp, Homo sapiens
gcctgctgagcctgatagtgacgat

SEQ ID NO: 12588 - DNA, 25 bp, Homo sapiens
ccagcctcccagttccaatgggctg

SEQ ID NO: 12589 - DNA, 25 bp, Homo sapiens
ggaacgtagcaatatctgctccttt

SEQ ID NO: 12590 - DNA, 25 bp, Homo sapiens
atctgctccttttcgagttgtttga

SEQ ID NO: 12591 - DNA, 25 bp, Homo sapiens
ggctattttttcagtgtatatccac

SEQ ID NO: 12592 - DNA, 25 bp, Homo sapiens
tttttgatgtacccacactgttctc

SEQ ID NO: 12593 - DNA, 25 bp, Homo sapiens
ggggatgtacatattctctgaaact

SEQ ID NO: 12594 - DNA, 25 bp, Homo sapiens
tgtgttggaagtgtccttggtcgcc

SEQ ID NO: 12595 - DNA, 25 bp, Homo sapiens
cttggtcgccttgtgtgatgtagac

SEQ ID NO: 12596 - DNA, 25 bp, Homo sapiens
ggctgcatgtaaatgggttgcctta

SEQ ID NO: 12597 - DNA, 25 bp, Homo sapiens
tcactccctgagtttagtatggctg

SEQ ID NO: 12598 - DNA, 25 bp, Homo sapiens
gatttgtttggtcattagctcttaa

SEQ ID NO: 12599 - DNA, 25 bp, Homo sapiens
aaatctattctaacgcaaaaccact

SEQ ID NO: 12600 - DNA, 25 bp, Homo sapiens
gtttcccagttcatggcgtgtgagg

SEQ ID NO: 12601 - DNA, 25 bp, Homo sapiens
ttcatggcgtgtgaggagctgcccc

SEQ ID NO: 12602 - DNA, 25 bp, Homo sapiens
ggacccgggcagttagtggggctgc

SEQ ID NO: 12603 - DNA, 25 bp, Homo sapiens
tggctcacccagggatcaaggcgct

SEQ ID NO: 12604 - DNA, 25 bp, Homo sapiens
tcaggaggccctgaccgtggaaggg

SEQ ID NO: 12605 - DNA, 25 bp, Homo sapiens
agggccggcagtaggtggggcctgt

SEQ ID NO: 12606 - DNA, 25 bp, Homo sapiens
tgccctgagggcattagctggtcta

SEQ ID NO: 12607 - DNA, 25 bp, Homo sapiens
ggcattagctggtctaactgcccgg

SEQ ID NO: 12608 - DNA, 25 bp, Homo sapiens
taggcacctcaaggacttttctgct

SEQ ID NO: 12609 - DNA, 25 bp, Homo sapiens
ggacttttctgctatttactgctct

SEQ ID NO: 12610 - DNA, 25 bp, Homo sapiens
gctatttactgctcttattgttaag

SEQ ID NO: 12611 - DNA, 25 bp, Homo sapiens
atggcacaacactttctatttcaca

SEQ ID NO: 12612 - DNA, 25 bp, Homo sapiens
cctggcaggtttagggcccatttgg

SEQ ID NO: 12613 - DNA, 25 bp, Homo sapiens
ctggggtgctctgtctgggaatgag

SEQ ID NO: 12614 - DNA, 25 bp, Homo sapiens
aggaggcccacagatggactgagtg

SEQ ID NO: 12615 - DNA, 25 bp, Homo sapiens
ggcggctgcgaggggtatcaacccc

SEQ ID NO: 12616 - DNA, 25 bp, Homo sapiens
ggagcaccgggcgagtgcatgtgct

SEQ ID NO: 12617 - DNA, 25 bp, Homo sapiens
tgcatgtgctactgctgctacaggc

SEQ ID NO: 12618 - DNA, 25 bp, Homo sapiens
caggcctgtctatctgtttgtctgt

SEQ ID NO: 12619 - DNA, 25 bp, Homo sapiens
gtcagggaaggatgcctcggagctg

SEQ ID NO: 12620 - DNA, 25 bp, Homo sapiens
ggggctgttgacaaaggccttacca

SEQ ID NO: 12621 - DNA, 25 bp, Homo sapiens
gggttaggacactgaccattctaga

SEQ ID NO: 12622 - DNA, 25 bp, Homo sapiens
ttcctaaacgctctcgtctttttgt

SEQ ID NO: 12623 - DNA, 25 bp, Homo sapiens
ctcgtctttttgtgtgtcttggtga

SEQ ID NO: 12624 - DNA, 25 bp, Homo sapiens
cagtggctactggtattgtctcttc

SEQ ID NO: 12625 - DNA, 25 bp, Homo sapiens
tctcttcccacactgaactctgggg

SEQ ID NO: 12626 - DNA, 25 bp, Homo sapiens
gcgctcctttatctgatgtggttta

SEQ ID NO: 12627 - DNA, 25 bp, Homo sapiens
gatgtggtttagtaaaagcctccca

SEQ ID NO: 12628 - DNA, 25 bp, Homo sapiens
ggacgtggctggtagtgtttgtgtg

SEQ ID NO: 12629 - DNA, 25 bp, Homo sapiens
gacgcggaccgcgtgacattaagga

SEQ ID NO: 12630 - DNA, 25 bp, Homo sapiens
taaggagagcgcaagggcggaccgg

SEQ ID NO: 12631 - DNA, 25 bp, Homo sapiens
ttcccgctccgctaaagatttcaaa

SEQ ID NO: 12632 - DNA, 25 bp, Homo sapiens
aatccaggggattccatgctcaatg

SEQ ID NO: 12633 - DNA, 25 bp, Homo sapiens
tatgtgcaggggtgggtatgctcgt

SEQ ID NO: 12634 - DNA, 25 bp, Homo sapiens
gaaacccagatcgctgtgttactaa

SEQ ID NO: 12635 - DNA, 25 bp, Homo sapiens
aatgcgttttgtacatcagccttct

SEQ ID NO: 12636 - DNA, 25 bp, Homo sapiens
tctcctgtctccatgataactgcat

SEQ ID NO: 12637 - DNA, 25 bp, Homo sapiens
gtggattcagttcattcgctttgtc

SEQ ID NO: 12638 - DNA, 25 bp, Homo sapiens
tcattcgctttgtctgtcggtgact

SEQ ID NO: 12639 - DNA, 25 bp, Homo sapiens
tgtcggtgactcctgaaggtttcct

SEQ ID NO: 12640 - DNA, 25 bp, Homo sapiens
atctcattgcggcctgttgggcaga

SEQ ID NO: 12641 - DNA, 25 bp, Homo sapiens
ggaaagctaagtcttgtctcattta

SEQ ID NO: 12642 - DNA, 25 bp, Homo sapiens
tctcatttaggactgggttccccac

SEQ ID NO: 12643 - DNA, 25 bp, Homo sapiens
acagtgacagtcacttccttcagca

SEQ ID NO: 12644 - DNA, 25 bp, Homo sapiens
acaagcacgaacctcctacattgct

SEQ ID NO: 12645 - DNA, 25 bp, Homo sapiens
ctgaggagatccaatggggccaccg

SEQ ID NO: 12646 - DNA, 25 bp, Homo sapiens
gttaaagtagctgctccacggtgca

SEQ ID NO: 12647 - DNA, 25 bp, Homo sapiens
tgagaaaccttccatccttattcag

SEQ ID NO: 12648 - DNA, 25 bp, Homo sapiens
gtgaactgtctcatcaaaattctct

SEQ ID NO: 12649 - DNA, 25 bp, Homo sapiens
ttctctgaggaagcgcaactccatg

SEQ ID NO: 12650 - DNA, 25 bp, Homo sapiens
tccgaaggaacaattcttccctcat

SEQ ID NO: 12651 - DNA, 25 bp, Homo sapiens
cttccctcatggtaccaaaggtgca

SEQ ID NO: 12652 - DNA, 25 bp, Homo sapiens
gacagcaagataaccccaagacagt

SEQ ID NO: 12653 - DNA, 25 bp, Homo sapiens
ttgacggtttatgctgggcactgcc

SEQ ID NO: 12654 - DNA, 25 bp, Homo sapiens
ggcactgccagactgaaccagagct

SEQ ID NO: 12655 - DNA, 25 bp, Homo sapiens
ggagtcaccccatggaaaaccacat

SEQ ID NO: 12656 - DNA, 25 bp, Homo sapiens
gtgacctacttcatgaacctgagcc

SEQ ID NO: 12657 - DNA, 25 bp, Homo sapiens
agccaggcgaatgctcaggggacgc

SEQ ID NO: 12658 - DNA, 25 bp, Homo sapiens
ccgcgctgggagctcgagtaccagc

SEQ ID NO: 12659 - DNA, 25 bp, Homo sapiens
agctcgagtaccagctgaccgaggc

SEQ ID NO: 12660 - DNA, 25 bp, Homo sapiens
ctccatcgacacagtgctggaccgc

SEQ ID NO: 12661 - DNA, 25 bp, Homo sapiens
tgcagcgctactacgtctataactc

SEQ ID NO: 12662 - DNA, 25 bp, Homo sapiens
gtctataactcagtcagctactctg

SEQ ID NO: 12663 - DNA, 25 bp, Homo sapiens
ctgcagcatgcagcacgtgtgtgcc

SEQ ID NO: 12664 - DNA, 25 bp, Homo sapiens
catgcagcacgtgtgtgccatgcgc

SEQ ID NO: 12665 - DNA, 25 bp, Homo sapiens
gtggacattgacgcttacaccacct

SEQ ID NO: 12666 - DNA, 25 bp, Homo sapiens
gctgctccaggcggtcttattggag

SEQ ID NO: 12667 - DNA, 25 bp, Homo sapiens
caaaaattgaccccactttgtgccg

SEQ ID NO: 12668 - DNA, 25 bp, Homo sapiens
cccactttgtgccgggctgacagaa

SEQ ID NO: 12669 - DNA, 25 bp, Homo sapiens
gcaagtacttggtgcagtcggagct

SEQ ID NO: 12670 - DNA, 25 bp, Homo sapiens
gtcggagctttacctgagatattca

SEQ ID NO: 12671 - DNA, 25 bp, Homo sapiens
tatttcctgcttagacggcttctag

SEQ ID NO: 12672 - DNA, 25 bp, Homo sapiens
acggcttctaggtgtacgcactgaa

SEQ ID NO: 12673 - DNA, 25 bp, Homo sapiens
ggtgaacataggatccctgtcaaca

SEQ ID NO: 12674 - DNA, 25 bp, Homo sapiens
gagttagtgctgtcaaggccgattt

SEQ ID NO: 12675 - DNA, 25 bp, Homo sapiens
aaattgcccttagccgaagagttga

SEQ ID NO: 12676 - DNA, 25 bp, Homo sapiens
atgatctgcaatatgctgctccagg

SEQ ID NO: 12677 - DNA, 25 bp, Homo sapiens
tcattcctactgtcacacaggtcac

SEQ ID NO: 12678 - DNA, 25 bp, Homo sapiens
acacaggtcacgagggtggactccc

SEQ ID NO: 12679 - DNA, 25 bp, Homo sapiens
gtggactccctacaatcaacaaagc

SEQ ID NO: 12680 - DNA, 25 bp, Homo sapiens
agcagcagccggctgtttgggggat

SEQ ID NO: 12681 - DNA, 25 bp, Homo sapiens
cagcctcacagtgactttctcagag

SEQ ID NO: 12682 - DNA, 25 bp, Homo sapiens
gcaaggccatacctcggtgagggac

SEQ ID NO: 12683 - DNA, 25 bp, Homo sapiens
ggacaacggtcacctatctgtagcc

SEQ ID NO: 12684 - DNA, 25 bp, Homo sapiens
gtagccaggggcagttgtgtggcca

SEQ ID NO: 12685 - DNA, 25 bp, Homo sapiens
cagctgtctctctgggatgagtcag

SEQ ID NO: 12686 - DNA, 25 bp, Homo sapiens
agaaggagagaacatggcccaggcc

SEQ ID NO: 12687 - DNA, 25 bp, Homo sapiens
ctgtgcttgcgacgtgcatcaataa

SEQ ID NO: 12688 - DNA, 25 bp, Homo sapiens
atggctgctcaggacttagcatcca

SEQ ID NO: 12689 - DNA, 25 bp, Homo sapiens
gaggaactggtaactgggactgtga

SEQ ID NO: 12690 - DNA, 25 bp, Homo sapiens
tgaagggaatgactaccaagctctt

SEQ ID NO: 12691 - DNA, 25 bp, Homo sapiens
cgcatgggctgatattgaacgcttc

SEQ ID NO: 12692 - DNA, 25 bp, Homo sapiens
ccgagacttaaaggaggccctcata

SEQ ID NO: 12693 - DNA, 25 bp, Homo sapiens
ggaggccctcataagctatgcagtc

SEQ ID NO: 12694 - DNA, 25 bp, Homo sapiens
tgcagtcatgcagatcagtatgtgc

SEQ ID NO: 12695 - DNA, 25 bp, Homo sapiens
aatcctgtgaattgaatttctcttc

SEQ ID NO: 12696 - DNA, 25 bp, Homo sapiens
tttctcttcaatcaaagtgccccaa

SEQ ID NO: 12697 - DNA, 25 bp, Homo sapiens
gaagcattgcgggctgtgtgcagga

SEQ ID NO: 12698 - DNA, 25 bp, Homo sapiens
cagtatgacttggagatggctgctc

SEQ ID NO: 12699 - DNA, 25 bp, Homo sapiens
gggtccagggctgtgtgagtgtgtc

SEQ ID NO: 12700 - DNA, 25 bp, Homo sapiens
gtttgggtcaaggactgtccctcca

SEQ ID NO: 12701 - DNA, 25 bp, Homo sapiens
ctccatcctaggctctgagcctcag

SEQ ID NO: 12702 - DNA, 25 bp, Homo sapiens
aggacccagcccatgagagaacggg

SEQ ID NO: 12703 - DNA, 25 bp, Homo sapiens
tgagagaacggggatctggggggcc

SEQ ID NO: 12704 - DNA, 25 bp, Homo sapiens
tgaccttgctcccttttaggtcacc

SEQ ID NO: 12705 - DNA, 25 bp, Homo sapiens
gtacaggcccctgctgagtgggccc

SEQ ID NO: 12706 - DNA, 25 bp, Homo sapiens
acggcttcagtcagggccaggagga

SEQ ID NO: 12707 - DNA, 25 bp, Homo sapiens
gccaggaggaacacgtgaaggagaa

SEQ ID NO: 12708 - DNA, 25 bp, Homo sapiens
ggttccttgggaagagggtgcccat

SEQ ID NO: 12709 - DNA, 25 bp, Homo sapiens
gggtgcccattggacctttggcact

SEQ ID NO: 12710 - DNA, 25 bp, Homo sapiens
cctgcccagctgtaaggaccggggg

SEQ ID NO: 12711 - DNA, 25 bp, Homo sapiens
gccagacaccccggtggaagcattt

SEQ ID NO: 12712 - DNA, 25 bp, Homo sapiens
ggaagcatttagaggggaccacggg

SEQ ID NO: 12713 - DNA, 25 bp, Homo sapiens
gggagggacaaggcttctctgtccg

SEQ ID NO: 12714 - DNA, 25 bp, Homo sapiens
tccagcctcacgttcacttaggcac

SEQ ID NO: 12715 - DNA, 25 bp, Homo sapiens
taggcactgggcattaccatagaga

SEQ ID NO: 12716 - DNA, 25 bp, Homo sapiens
tagacaaatacatctgccctcatgg

SEQ ID NO: 12717 - DNA, 25 bp, Homo sapiens
gccctcatggaaggtgacgttcccg

SEQ ID NO: 12718 - DNA, 25 bp, Homo sapiens
ttcccggagagggcacctacacagt

SEQ ID NO: 12719 - DNA, 25 bp, Homo sapiens
tacacagtcacgcaaacacacacta

SEQ ID NO: 12720 - DNA, 25 bp, Homo sapiens
aaacacacactaattcctggcaggc

SEQ ID NO: 12721 - DNA, 25 bp, Homo sapiens
taaaatggggatcgcctcccaacag

SEQ ID NO: 12722 - DNA, 25 bp, Homo sapiens
cctcccaacagcagatttcgacatt

SEQ ID NO: 12723 - DNA, 25 bp, Homo sapiens
gagagtcttgattttaggcttgttt

SEQ ID NO: 12724 - DNA, 25 bp, Homo sapiens
tttaggcgtcttcggatatcttctc

SEQ ID NO: 12725 - DNA, 25 bp, Homo sapiens
tcacctatgttccctggctaagaag

SEQ ID NO: 12726 - DNA, 25 bp, Homo sapiens
ttaccattggtgcatatgttccaga

SEQ ID NO: 12727 - DNA, 25 bp, Homo sapiens
taatctcaccattgatgacctttgt

SEQ ID NO: 12728 - DNA, 25 bp, Homo sapiens
tgtagttcttgcatcctatactgga

SEQ ID NO: 12729 - DNA, 25 bp, Homo sapiens
actggataagcctgttttaacctgc

SEQ ID NO: 12730 - DNA, 25 bp, Homo sapiens
atgatgggtgcttccattgcttcat

SEQ ID NO: 12731 - DNA, 25 bp, Homo sapiens
gcttccattgcttcataatcttcat

SEQ ID NO: 12732 - DNA, 25 bp, Homo sapiens
ggggttatgggttaagttgctgcct

SEQ ID NO: 12733 - DNA, 25 bp, Homo sapiens
atttgtgcttacatgcactcctggc

SEQ ID NO: 12734 - DNA, 25 bp, Homo sapiens
catgcactcctggcatagtcctatt

SEQ ID NO: 12735 - DNA, 25 bp, Homo sapiens
ttgggtgcagatgtggtgttcctca

SEQ ID NO: 12736 - DNA, 25 bp, Homo sapiens
gacgtggtgttttacatggtgactc

SEQ ID NO: 12737 - DNA, 25 bp, Homo sapiens
agaacattgctgctccttatttatt

SEQ ID NO: 12738 - DNA, 25 bp, Homo sapiens
tagtgtgctgcatggaacgtattta

SEQ ID NO: 12739 - DNA, 25 bp, Homo sapiens
gagaggactgtattctctctgctgc

SEQ ID NO: 12740 - DNA, 25 bp, Homo sapiens
tctctctgctgctgttgaggttata

SEQ ID NO: 12741 - DNA, 25 bp, Homo sapiens
gcaattacagtatgccagttccact

SEQ ID NO: 12742 - DNA, 25 bp, Homo sapiens
accactaatacttctcactgaagct

SEQ ID NO: 12743 - DNA, 25 bp, Homo sapiens
gatcctgagtccagaatggtacaca

SEQ ID NO: 12744 - DNA, 25 bp, Homo sapiens
gtgatgtcactcacctagacaacca

SEQ ID NO: 12745 - DNA, 25 bp, Homo sapiens
ctcacctagacaaccagaggctggc

SEQ ID NO: 12746 - DNA, 25 bp, Homo sapiens
ccagaggctggcattgaggctaacc

SEQ ID NO: 12747 - DNA, 25 bp, Homo sapiens
ggcattgaggctaacctccaacaca

SEQ ID NO: 12748 - DNA, 25 bp, Homo sapiens
taacctccaacacagtgcatctcag

SEQ ID NO: 12749 - DNA, 25 bp, Homo sapiens
tgcatctcagatgcctcagtaggca

SEQ ID NO: 12750 - DNA, 25 bp, Homo sapiens
tcactcactctgatttatgttttga

SEQ ID NO: 12751 - DNA, 25 bp, Homo sapiens
ttggggggtattttggtactgtgat

SEQ ID NO: 12752 - DNA, 25 bp, Homo sapiens
attttggtactgtgatggggtcatc

SEQ ID NO: 12753 - DNA, 25 bp, Homo sapiens
aagaccaggtctacagtgatagagc

SEQ ID NO: 12754 - DNA, 25 bp, Homo sapiens
gagagttccagattgttctgtccag

SEQ ID NO: 12755 - DNA, 25 bp, Homo sapiens
tgttctgtccagtttccaaagggca

SEQ ID NO: 12756 - DNA, 25 bp, Homo sapiens
ttttcgtgccggttttcagctatta

SEQ ID NO: 12757 - DNA, 25 bp, Homo sapiens
gcaactgtgctacacttgcacctgg

SEQ ID NO: 12758 - DNA, 25 bp, Homo sapiens
acttgcacctggtactgcacatttt

SEQ ID NO: 12759 - DNA, 25 bp, Homo sapiens
gtagtcgtcaagttgcagatctttt

SEQ ID NO: 12760 - DNA, 25 bp, Homo sapiens
gtgaaattcaacctgtgtcttatag

SEQ ID NO: 12761 - DNA, 25 bp, Homo sapiens
tgtcttataggtttacactgccaaa

SEQ ID NO: 12762 - DNA, 25 bp, Homo sapiens
acactgccaaaacaatgcccgtaag

SEQ ID NO: 12763 - DNA, 25 bp, Homo sapiens
tgctgcactggtcccaagtagtagt

SEQ ID NO: 12764 - DNA, 25 bp, Homo sapiens
tatctatatctctaaactgctgtta

SEQ ID NO: 12765 - DNA, 25 bp, Homo sapiens
gtgcagcatttacagaccctgacgc

SEQ ID NO: 12766 - DNA, 25 bp, Homo sapiens
gctgaccagcacgaggcttggaacc

SEQ ID NO: 12767 - DNA, 25 bp, Homo sapiens
tggaaccagaccactgtcatacacc

SEQ ID NO: 12768 - DNA, 25 bp, Homo sapiens
caggctgctaaggtgcactgctact

SEQ ID NO: 12769 - DNA, 25 bp, Homo sapiens
gaaccagcgattcagcaggtgctca

SEQ ID NO: 12770 - DNA, 25 bp, Homo sapiens
tgactaactcgggtgactttctcca

SEQ ID NO: 12771 - DNA, 25 bp, Homo sapiens
tggcaagaacagcctacctggacct

SEQ ID NO: 12772 - DNA, 25 bp, Homo sapiens
gctccgcctgatccggaaggatgcc

SEQ ID NO: 12773 - DNA, 25 bp, Homo sapiens
aactgatgcttttgacttcaccgat

SEQ ID NO: 12774 - DNA, 25 bp, Homo sapiens
tggaaacgtctacgaacgcctgttc

SEQ ID NO: 12775 - DNA, 25 bp, Homo sapiens
gcctgttccagtgggctcagaagtc

SEQ ID NO: 12776 - DNA, 25 bp, Homo sapiens
cgccatcaccgagcgcttgatgtgc

SEQ ID NO: 12777 - DNA, 25 bp, Homo sapiens
gatgtgcgcggagagcaatcgccgg

SEQ ID NO: 12778 - DNA, 25 bp, Homo sapiens
ctcgcgcgtttgcggcaaccgcaag

SEQ ID NO: 12779 - DNA, 25 bp, Homo sapiens
gcaaccgcaagaagcccgggatcta

SEQ ID NO: 12780 - DNA, 25 bp, Homo sapiens
gcaagaagcccgggatctacacccg

SEQ ID NO: 12781 - DNA, 25 bp, Homo sapiens
gtgccggggcctgaaggtcagggtc

SEQ ID NO: 12782 - DNA, 25 bp, Homo sapiens
gaaggtcagggtcacccaagcaaca

SEQ ID NO: 12783 - DNA, 25 bp, Homo sapiens
ccaagcaacaaagtcccgagcaatg

SEQ ID NO: 12784 - DNA, 25 bp, Homo sapiens
cgagcaatgaagtcatccactcctg

SEQ ID NO: 12785 - DNA, 25 bp, Homo sapiens
cctgcatctggttggtctttattga

SEQ ID NO: 12786 - DNA, 25 bp, Homo sapiens
gcacctactatatgcagaaggggag

SEQ ID NO: 12787 - DNA, 25 bp, Homo sapiens
ggagagaagtcctacgagtgctaca

SEQ ID NO: 12788 - DNA, 25 bp, Homo sapiens
aaagaagttctctcacaagaccctc

SEQ ID NO: 12789 - DNA, 25 bp, Homo sapiens
ctccgtctgcccagcaaagtttgac

SEQ ID NO: 12790 - DNA, 25 bp, Homo sapiens
cgagcagttcaacgaccacatgagg

SEQ ID NO: 12791 - DNA, 25 bp, Homo sapiens
tgaagaactgttttttgcctgctgg

SEQ ID NO: 12792 - DNA, 25 bp, Homo sapiens
ggtacattacatttccggaggcttg

SEQ ID NO: 12793 - DNA, 25 bp, Homo sapiens
gaataatagttttcccagtctccct

SEQ ID NO: 12794 - DNA, 25 bp, Homo sapiens
ccctcggatggtggccttaaggcct

SEQ ID NO: 12795 - DNA, 25 bp, Homo sapiens
gccttaaggcctggtagtgcttcaa

SEQ ID NO: 12796 - DNA, 25 bp, Homo sapiens
gaggtccactggttggatctctagc

SEQ ID NO: 12797 - DNA, 25 bp, Homo sapiens
atctctagctactggcctctaaata

SEQ ID NO: 12798 - DNA, 25 bp, Homo sapiens
ccagggacaatggcgtctcttggcc

SEQ ID NO: 12799 - DNA, 25 bp, Homo sapiens
ctcttggccacatcttggttttctg

SEQ ID NO: 12800 - DNA, 25 bp, Homo sapiens
tccaaaggaacacgacccgttcact

SEQ ID NO: 12801 - DNA, 25 bp, Homo sapiens
gcatcctcatcgtgctgagcagaag

SEQ ID NO: 12802 - DNA, 25 bp, Homo sapiens
gatgccggtgcaagttcaaccagca

SEQ ID NO: 12803 - DNA, 25 bp, Homo sapiens
gcagcagaggactggggaacccgat

SEQ ID NO: 12804 - DNA, 25 bp, Homo sapiens
agaggagggaactttccgcagctcc

SEQ ID NO: 12805 - DNA, 25 bp, Homo sapiens
tctgtccacccgcaggcggtagaaa

SEQ ID NO: 12806 - DNA, 25 bp, Homo sapiens
cacctggagcgatggaatccggcca

SEQ ID NO: 12807 - DNA, 25 bp, Homo sapiens
ttttgcgtgaccccctgagtgggga

SEQ ID NO: 12808 - DNA, 25 bp, Homo sapiens
tgttgcatggtggcctgagcgagca

SEQ ID NO: 12809 - DNA, 25 bp, Homo sapiens
gattttgggactgttctgtctcatg

SEQ ID NO: 12810 - DNA, 25 bp, Homo sapiens
catgcaagtcatgggtcacacctga

SEQ ID NO: 12811 - DNA, 25 bp, Homo sapiens
gaaggagttcctctaacatttgcaa

SEQ ID NO: 12812 - DNA, 25 bp, Homo sapiens
taatgaatgtcatgcaccgctgcag

SEQ ID NO: 12813 - DNA, 25 bp, Homo sapiens
gggatagtccatatgcaagcagctc

SEQ ID NO: 12814 - DNA, 25 bp, Homo sapiens
gaggaatgtgccctggagatcatca

SEQ ID NO: 12815 - DNA, 25 bp, Homo sapiens
tcatcaaagggggagctctgcgcca

SEQ ID NO: 12816 - DNA, 25 bp, Homo sapiens
attatgacagctcactctggaccac

SEQ ID NO: 12817 - DNA, 25 bp, Homo sapiens
ctctggaccactcttctgatcagaa

SEQ ID NO: 12818 - DNA, 25 bp, Homo sapiens
ggaatttctctactcaacgagctat

SEQ ID NO: 12819 - DNA, 25 bp, Homo sapiens
acaagtaggaactccctgagggctg

SEQ ID NO: 12820 - DNA, 25 bp, Homo sapiens
tgaaaggcaggacctggtcacccca

SEQ ID NO: 12821 - DNA, 25 bp, Homo sapiens
ggtcaccccagcaagtgctatggac

SEQ ID NO: 12822 - DNA, 25 bp, Homo sapiens
gtgctatggacagttcccggaaacg

SEQ ID NO: 12823 - DNA, 25 bp, Homo sapiens
cacttcacaggtccatgggtctgac

SEQ ID NO: 12824 - DNA, 25 bp, Homo sapiens
ccatgggtctgacccttggactctg

SEQ ID NO: 12825 - DNA, 25 bp, Homo sapiens
ttggactctgccaggatcaactgcc

SEQ ID NO: 12826 - DNA, 25 bp, Homo sapiens
gatcaactgcccagagtgccagagt

SEQ ID NO: 12827 - DNA, 25 bp, Homo sapiens
gccaaaggtgtacttacttccttat

SEQ ID NO: 12828 - DNA, 25 bp, Homo sapiens
gggagtcaaagcctattttgctgag

SEQ ID NO: 12829 - DNA, 25 bp, Homo sapiens
ttcccactggatcctctgtagaatt

SEQ ID NO: 12830 - DNA, 25 bp, Homo sapiens
atattagccagccatcgtggtgcgt

SEQ ID NO: 12831 - DNA, 25 bp, Homo sapiens
attgctgctacttatataattgcca

SEQ ID NO: 12832 - DNA, 25 bp, Homo sapiens
aatgacaatcatgtgtgttaaccca

SEQ ID NO: 12833 - DNA, 25 bp, Homo sapiens
acccagtgctttccattcgtgaaaa

SEQ ID NO: 12834 - DNA, 25 bp, Homo sapiens
tagataagtgttctgtctgactttc

SEQ ID NO: 12835 - DNA, 25 bp, Homo sapiens
ttgaatacttgaatgtgtctcacag

SEQ ID NO: 12836 - DNA, 25 bp, Homo sapiens
gtaatacttcttgtgtgtatgcaca

SEQ ID NO: 12837 - DNA, 25 bp, Homo sapiens
ttttcagtattatatgtaccctctg

SEQ ID NO: 12838 - DNA, 25 bp, Homo sapiens
aatgggcacttaaagctttcagaat

SEQ ID NO: 12839 - DNA, 25 bp, Homo sapiens
gtcagtgctgatgtagcatgcttgt

SEQ ID NO: 12840 - DNA, 25 bp, Homo sapiens
atgcttgttgcaattgccttttttc

SEQ ID NO: 12841 - DNA, 25 bp, Homo sapiens
aaatgtctttaatgcaatatactgg

SEQ ID NO: 12842 - DNA, 25 bp, Homo sapiens
ctgacgctgctgtagaacctattga

SEQ ID NO: 12843 - DNA, 25 bp, Homo sapiens
gattttccaattgctcctgtatatg

SEQ ID NO: 12844 - DNA, 25 bp, Homo sapiens
gtatatgctgcatctatggttctta

SEQ ID NO: 12845 - DNA, 25 bp, Homo sapiens
atgaagcctttagtctggttgtact

SEQ ID NO: 12846 - DNA, 25 bp, Homo sapiens
agctgtttctctgggacatccaatt

SEQ ID NO: 12847 - DNA, 25 bp, Homo sapiens
ttggtcatttgactcatgccttgaa

SEQ ID NO: 12848 - DNA, 25 bp, Homo sapiens
ggtgcttctgccatgctaattcaga

SEQ ID NO: 12849 - DNA, 25 bp, Homo sapiens
gaagctgtagacaacctctgctatt

SEQ ID NO: 12850 - DNA, 25 bp, Homo sapiens
aggagacaaccctatgtgaccagaa

SEQ ID NO: 12851 - DNA, 25 bp, Homo sapiens
gctgctctggttctcatgacggcag

SEQ ID NO: 12852 - DNA, 25 bp, Homo sapiens
aagaggctcaatgttacaccactgg

SEQ ID NO: 12853 - DNA, 25 bp, Homo sapiens
ttaacacacactgactttttgaaga

SEQ ID NO: 12854 - DNA, 25 bp, Homo sapiens
aacttgctatttatggtgactctgt

SEQ ID NO: 12855 - DNA, 25 bp, Homo sapiens
ggtgactctgtggttaggcttattt

SEQ ID NO: 12856 - DNA, 25 bp, Homo sapiens
ttaatcatccttttggatctttcaa

SEQ ID NO: 12857 - DNA, 25 bp, Homo sapiens
gatctttcaaaccaaacgtatacca

SEQ ID NO: 12858 - DNA, 25 bp, Homo sapiens
atggctttgtttgtaattcgggtat

SEQ ID NO: 12859 - DNA, 25 bp, Homo sapiens
atggaagtctattgttttattcttt

SEQ ID NO: 12860 - DNA, 25 bp, Homo sapiens
gctaatttctgctgttcttgatttg

SEQ ID NO: 12861 - DNA, 25 bp, Homo sapiens
gctgttcttgatttggttctttatt

SEQ ID NO: 12862 - DNA, 25 bp, Homo sapiens
gtaaactgtggatcacatgattctt

SEQ ID NO: 12863 - DNA, 25 bp, Homo sapiens
atgttgttcttaattgccaaaattg

SEQ ID NO: 12864 - DNA, 25 bp, Homo sapiens
gggacctcagtcaaaacaaccattc

SEQ ID NO: 12865 - DNA, 25 bp, Homo sapiens
gcgagtgaggtacttcttcgatccg

SEQ ID NO: 12866 - DNA, 25 bp, Homo sapiens
taaatccagctctcatcaggactcc

SEQ ID NO: 12867 - DNA, 25 bp, Homo sapiens
caggactcctccagaatgtccagtg

SEQ ID NO: 12868 - DNA, 25 bp, Homo sapiens
gcacgaactctatgtgagcttccgg

SEQ ID NO: 12869 - DNA, 25 bp, Homo sapiens
gagaatgttcttttccacttaacgc

SEQ ID NO: 12870 - DNA, 25 bp, Homo sapiens
ccaccaaccacgctatagttcagac

SEQ ID NO: 12871 - DNA, 25 bp, Homo sapiens
tcatctgatgtttcctgaccacgta

SEQ ID NO: 12872 - DNA, 25 bp, Homo sapiens
cgtaccaaagccttgttgtgctcca

SEQ ID NO: 12873 - DNA, 25 bp, Homo sapiens
taaatgccatctctgttctgtactt

SEQ ID NO: 12874 - DNA, 25 bp, Homo sapiens
tggtagtacgctcatgtggctgcca

SEQ ID NO: 12875 - DNA, 25 bp, Homo sapiens
ggaaagcaggattccatcgctggaa

SEQ ID NO: 12876 - DNA, 25 bp, Homo sapiens
gaaagttgtgtgggtctctaattaa

SEQ ID NO: 12877 - DNA, 25 bp, Homo sapiens
tagatttaccctttatagaacatat

SEQ ID NO: 12878 - DNA, 25 bp, Homo sapiens
ggataatattgattcctcacatctt

SEQ ID NO: 12879 - DNA, 25 bp, Homo sapiens
attcctcacatctttaacttagtat

SEQ ID NO: 12880 - DNA, 25 bp, Homo sapiens
ttacctagcatttcaaaacccaaat

SEQ ID NO: 12881 - DNA, 25 bp, Homo sapiens
acaatggcctggttcaatttctttc

SEQ ID NO: 12882 - DNA, 25 bp, Homo sapiens
ttccccccaaaattatcagtgctct

SEQ ID NO: 12883 - DNA, 25 bp, Homo sapiens
tcagtgctctgcttttagtcacgtg

SEQ ID NO: 12884 - DNA, 25 bp, Homo sapiens
gtcacgtgtattttcattaccactc

SEQ ID NO: 12885 - DNA, 25 bp, Homo sapiens
gaaacactgtacaccatagtttaca

SEQ ID NO: 12886 - DNA, 25 bp, Homo sapiens
gggcaagagaggaccgtctggcacc

SEQ ID NO: 12887 - DNA, 25 bp, Homo sapiens
agactggcctgaacatggctgtcca

SEQ ID NO: 12888 - DNA, 25 bp, Homo sapiens
gaagagatccagtctgttcgacgcc

SEQ ID NO: 12889 - DNA, 25 bp, Homo sapiens
tgtcggagatcatgatcgcctgcct

SEQ ID NO: 12890 - DNA, 25 bp, Homo sapiens
gacatcccgagagtgctggacatgc

SEQ ID NO: 12891 - DNA, 25 bp, Homo sapiens
aatgatgctggtgcagactctctgc

SEQ ID NO: 12892 - DNA, 25 bp, Homo sapiens
gactctctgccagtacacatttgtg

SEQ ID NO: 12893 - DNA, 25 bp, Homo sapiens
taagctcccacaatttcttacgggg

SEQ ID NO: 12894 - DNA, 25 bp, Homo sapiens
aaaagcgcttgcctaactcatactt

SEQ ID NO: 12895 - DNA, 25 bp, Homo sapiens
tcatactttcccgttgacacttgat

SEQ ID NO: 12896 - DNA, 25 bp, Homo sapiens
gtggcgcagtctgaatggcggcacg

SEQ ID NO: 12897 - DNA, 25 bp, Homo sapiens
gccttccgagagggcaatgctgccc

SEQ ID NO: 12898 - DNA, 25 bp, Homo sapiens
ccttccgagagggcaatgctgcccg

SEQ ID NO: 12899 - DNA, 25 bp, Homo sapiens
cgcctgccagtacgtgcaaggtgtt

SEQ ID NO: 12900 - DNA, 25 bp, Homo sapiens
gcctgccagtacgtgcaaggtgtta

SEQ ID NO: 12901 - DNA, 25 bp, Homo sapiens
ctgccagtacgtgcaaggtgttagt

SEQ ID NO: 12902 - DNA, 25 bp, Homo sapiens
gttagtggagagcaaacttcgagga

SEQ ID NO: 12903 - DNA, 25 bp, Homo sapiens
gtggagagcaaacttcgaggacgta

SEQ ID NO: 12904 - DNA, 25 bp, Homo sapiens
cccaggactgggccagagcacttag

SEQ ID NO: 12905 - DNA, 25 bp, Homo sapiens
gccagagcacttaggtttctttttc

SEQ ID NO: 12906 - DNA, 25 bp, Homo sapiens
tctttttccatggtttccaggtaat

SEQ ID NO: 12907 - DNA, 25 bp, Homo sapiens
ttccatggtttccaggtaataaaag

SEQ ID NO: 12908 - DNA, 25 bp, Homo sapiens
ggtccctttttccgaggaagagctg

SEQ ID NO: 12909 - DNA, 25 bp, Homo sapiens
attttttcaccagtacgctctgtgc

SEQ ID NO: 12910 - DNA, 25 bp, Homo sapiens
ctccttggccgtctactggaaaaat

SEQ ID NO: 12911 - DNA, 25 bp, Homo sapiens
actggaaaaatcgagcctctcccac

SEQ ID NO: 12912 - DNA, 25 bp, Homo sapiens
ccaccctcagtcgcatagacttatg

SEQ ID NO: 12913 - DNA, 25 bp, Homo sapiens
gaattagcgtttaatccacttcctt

SEQ ID NO: 12914 - DNA, 25 bp, Homo sapiens
tattgggcactcggttatcttttaa

SEQ ID NO: 12915 - DNA, 25 bp, Homo sapiens
ttccgtttggtagactccttccaat

SEQ ID NO: 12916 - DNA, 25 bp, Homo sapiens
ggtagactccttccaatgaaatctc

SEQ ID NO: 12917 - DNA, 25 bp, Homo sapiens
cccgggccattgccagaagacgtct

SEQ ID NO: 12918 - DNA, 25 bp, Homo sapiens
gccagaagacgtcttctcggggcgc

SEQ ID NO: 12919 - DNA, 25 bp, Homo sapiens
tccctccttttcttgcatgtaagtt

SEQ ID NO: 12920 - DNA, 25 bp, Homo sapiens
agtattccatctacttttctatcgc

SEQ ID NO: 12921 - DNA, 25 bp, Homo sapiens
agccctctctggggatggactgggt

SEQ ID NO: 12922 - DNA, 25 bp, Homo sapiens
tcccactgtaggccactggatggtc

SEQ ID NO: 12923 - DNA, 25 bp, Homo sapiens
tggcatctccgtatatgtgctctgg

SEQ ID NO: 12924 - DNA, 25 bp, Homo sapiens
tgtttcctgggctagtcttggaccc

SEQ ID NO: 12925 - DNA, 25 bp, Homo sapiens
cgagagagaatcgttcctcagcctc

SEQ ID NO: 12926 - DNA, 25 bp, Homo sapiens
tctctgctggtacccagtcctaaaa

SEQ ID NO: 12927 - DNA, 25 bp, Homo sapiens
cttcctcttcctttgaagcatcatc

SEQ ID NO: 12928 - DNA, 25 bp, Homo sapiens
tttatttgtgctattcactcccttc

SEQ ID NO: 12929 - DNA, 25 bp, Homo sapiens
tggatgtaacttctccgttcagttc

SEQ ID NO: 12930 - DNA, 25 bp, Homo sapiens
atgacaacacctggtttgttctctg

SEQ ID NO: 12931 - DNA, 25 bp, Homo sapiens
aaagacagctcctggccatatatca

SEQ ID NO: 12932 - DNA, 25 bp, Homo sapiens
gccaacatcaccatcattgagcacc

SEQ ID NO: 12933 - DNA, 25 bp, Homo sapiens
aggaagggggcaaggactcctgcca

SEQ ID NO: 12934 - DNA, 25 bp, Homo sapiens
gtctcttcaaggcattatctcctgg

SEQ ID NO: 12935 - DNA, 25 bp, Homo sapiens
atctcctggggccaggatccgtgtg

SEQ ID NO: 12936 - DNA, 25 bp, Homo sapiens
gcgatcacccgaaagcctggtgtct

SEQ ID NO: 12937 - DNA, 25 bp, Homo sapiens
gaagaacaattagactggacccacc

SEQ ID NO: 12938 - DNA, 25 bp, Homo sapiens
cctccatttccacttggtgtttggt

SEQ ID NO: 12939 - DNA, 25 bp, Homo sapiens
gaccctctacgaacattctttgggc

SEQ ID NO: 12940 - DNA, 25 bp, Homo sapiens
tctttgggcctcctggactacagga

SEQ ID NO: 12941 - DNA, 25 bp, Homo sapiens
tttgcccaaactcacccagtgagtg

SEQ ID NO: 12942 - DNA, 25 bp, Homo sapiens
agcatcctctgccaagaccaaaagg

SEQ ID NO: 12943 - DNA, 25 bp, Homo sapiens
gtacttgttttcaccattgggctaa

SEQ ID NO: 12944 - DNA, 25 bp, Homo sapiens
attgggctaactttgctgctaggag

SEQ ID NO: 12945 - DNA, 25 bp, Homo sapiens
gctaggagttcaagccatgcctgca

SEQ ID NO: 12946 - DNA, 25 bp, Homo sapiens
aatcgcctctcttgctacagaaaga

SEQ ID NO: 12947 - DNA, 25 bp, Homo sapiens
ggagtagctgacctgacacagattg

SEQ ID NO: 12948 - DNA, 25 bp, Homo sapiens
tgtgagatgatctgttactgcaact

SEQ ID NO: 12949 - DNA, 25 bp, Homo sapiens
ttcagcgaattgctctgctgcccaa

SEQ ID NO: 12950 - DNA, 25 bp, Homo sapiens
tctctttcgtgattccttgcaacaa

SEQ ID NO: 12951 - DNA, 25 bp, Homo sapiens
tctggagaacaccattcctgatttc

SEQ ID NO: 12952 - DNA, 25 bp, Homo sapiens
ttaatgtgccaaggagccgttttct

SEQ ID NO: 12953 - DNA, 25 bp, Homo sapiens
ccgttttctgcctgtcaaaaccaca

SEQ ID NO: 12954 - DNA, 25 bp, Homo sapiens
aaaaccacatcagatctcttgctgg

SEQ ID NO: 12955 - DNA, 25 bp, Homo sapiens
gtgatgtcaaacctctatagtctta

SEQ ID NO: 12956 - DNA, 25 bp, Homo sapiens
tttcctacagtgcccttggttaaat

SEQ ID NO: 12957 - DNA, 25 bp, Homo sapiens
taggcagttcttttacgaaggttca

SEQ ID NO: 12958 - DNA, 25 bp, Homo sapiens
gaattggatcacctcacagtttcag

SEQ ID NO: 12959 - DNA, 25 bp, Homo sapiens
aagggaacggttatcatcattgcaa

SEQ ID NO: 12960 - DNA, 25 bp, Homo sapiens
agaattgatatcccacctggagcag

SEQ ID NO: 12961 - DNA, 25 bp, Homo sapiens
gtctggaaaccttcgcatcttggac

SEQ ID NO: 12962 - DNA, 25 bp, Homo sapiens
actttactatgttactgtaccctgc

SEQ ID NO: 12963 - DNA, 25 bp, Homo sapiens
tttgagttggagtctcgctgtgtcg

SEQ ID NO: 12964 - DNA, 25 bp, Homo sapiens
tgcagtggtgggatcacggctcatt

SEQ ID NO: 12965 - DNA, 25 bp, Homo sapiens
tcccaggttcaagcagttttcctgt

SEQ ID NO: 12966 - DNA, 25 bp, Homo sapiens
gctgagattgcaggcacatgccacc

SEQ ID NO: 12967 - DNA, 25 bp, Homo sapiens
gtagggacggggttacaccatgttg

SEQ ID NO: 12968 - DNA, 25 bp, Homo sapiens
gcctcagtctcccaaagtgctgaga

SEQ ID NO: 12969 - DNA, 25 bp, Homo sapiens
cccatgtctgtctgtcttgatgtgt

SEQ ID NO: 12970 - DNA, 25 bp, Homo sapiens
ctgtcttgatgtgtgagcagcagct

SEQ ID NO: 12971 - DNA, 25 bp, Homo sapiens
gagcagcagctgtggtcattaaacc

SEQ ID NO: 12972 - DNA, 25 bp, Homo sapiens
ccattagtttacccctctagaactg

SEQ ID NO: 12973 - DNA, 25 bp, Homo sapiens
agaactggggtctgcaaactcccac

SEQ ID NO: 12974 - DNA, 25 bp, Homo sapiens
gtcatggctgtttccagacctgaat

SEQ ID NO: 12975 - DNA, 25 bp, Homo sapiens
tgggtgcttcttgccagtattctaa

SEQ ID NO: 12976 - DNA, 25 bp, Homo sapiens
gcacttactgcatggtcagaccacg

SEQ ID NO: 12977 - DNA, 25 bp, Homo sapiens
agaccacgtcactacatttctatgc

SEQ ID NO: 12978 - DNA, 25 bp, Homo sapiens
gggacagcaaggcagcgtggtggtc

SEQ ID NO: 12979 - DNA, 25 bp, Homo sapiens
ggtggtcatggctcttagctaacct

SEQ ID NO: 12980 - DNA, 25 bp, Homo sapiens
gaccttttcctgttgattaatctat

SEQ ID NO: 12981 - DNA, 25 bp, Homo sapiens
aaaggagtcttaatgttctgcccca

SEQ ID NO: 12982 - DNA, 25 bp, Homo sapiens
aatgttctgccccataagactttca

SEQ ID NO: 12983 - DNA, 25 bp, Homo sapiens
agggcctgcttctatgtatttatca

SEQ ID NO: 12984 - DNA, 25 bp, Homo sapiens
cttcctgccatggctggagctttgg

SEQ ID NO: 12985 - DNA, 25 bp, Homo sapiens
ggaatattgctgctggttctcataa

SEQ ID NO: 12986 - DNA, 25 bp, Homo sapiens
aaatgagggagtccagtccccagtg

SEQ ID NO: 12987 - DNA, 25 bp, Homo sapiens
actctccttttgtgcttatcatgtt

SEQ ID NO: 12988 - DNA, 25 bp, Homo sapiens
ggtagccatttcttctgttctacca

SEQ ID NO: 12989 - DNA, 25 bp, Homo sapiens
atagcattcatttccctttatattt

SEQ ID NO: 12990 - DNA, 25 bp, Homo sapiens
ccaggggctcacatcaatgctgttg

SEQ ID NO: 12991 - DNA, 25 bp, Homo sapiens
gttggagccagcagacctgactgga

SEQ ID NO: 12992 - DNA, 25 bp, Homo sapiens
gctgtacgtggattcccaggaggct

SEQ ID NO: 12993 - DNA, 25 bp, Homo sapiens
tggagatgtcctgctgtcaggggcc

SEQ ID NO: 12994 - DNA, 25 bp, Homo sapiens
gtcaggggccgagatctttgctgag

SEQ ID NO: 12995 - DNA, 25 bp, Homo sapiens
gaaaccagcccactgtgagaagacc

SEQ ID NO: 12996 - DNA, 25 bp, Homo sapiens
agtatttcccatttatcgcagacct

SEQ ID NO: 12997 - DNA, 25 bp, Homo sapiens
taaattctctctcttgcaggaagga

SEQ ID NO: 12998 - DNA, 25 bp, Homo sapiens
tgatagattttctgctactttgctg

SEQ ID NO: 12999 - DNA, 25 bp, Homo sapiens
tactttgctgctatggttttctcca

SEQ ID NO: 13000 - DNA, 25 bp, Homo sapiens
cttactatttcacaacagcctgaca

SEQ ID NO: 13001 - DNA, 25 bp, Homo sapiens
agcctgacaacatttctatagccaa

SEQ ID NO: 13002 - DNA, 25 bp, Homo sapiens
gctaaatacctcaatcagtctcaga

SEQ ID NO: 13003 - DNA, 25 bp, Homo sapiens
ggccacataagccattattcactag

SEQ ID NO: 13004 - DNA, 25 bp, Homo sapiens
gtatgactagttgtgtctggcagtt

SEQ ID NO: 13005 - DNA, 25 bp, Homo sapiens
taactctctttatgtctgtggattt

SEQ ID NO: 13006 - DNA, 25 bp, Homo sapiens
ttggattcctgataatgtgcttctg

SEQ ID NO: 13007 - DNA, 25 bp, Homo sapiens
cccttccttgtcagcgtcgggaaga

SEQ ID NO: 13008 - DNA, 25 bp, Homo sapiens
gatggtatgaagtcctctttggggc

SEQ ID NO: 13009 - DNA, 25 bp, Homo sapiens
ggggcagggactctagtagatcttc

SEQ ID NO: 13010 - DNA, 25 bp, Homo sapiens
ggtttctgcagagcacagttagcta

SEQ ID NO: 13011 - DNA, 25 bp, Homo sapiens
gtagccttgaggccagagcaggtag

SEQ ID NO: 13012 - DNA, 25 bp, Homo sapiens
gaggccgatgcataaagtcagcctg

SEQ ID NO: 13013 - DNA, 25 bp, Homo sapiens
agcctgttccaagtgctcagggact

SEQ ID NO: 13014 - DNA, 25 bp, Homo sapiens
gaagatgtgacctgtgccaaaacta

SEQ ID NO: 13015 - DNA, 25 bp, Homo sapiens
atgtgaccatttttctggtatgcca

SEQ ID NO: 13016 - DNA, 25 bp, Homo sapiens
tgtactgtgtagtgtgtctccgtat

SEQ ID NO: 13017 - DNA, 25 bp, Homo sapiens
gtctccgtatgtcatctcagggagc

SEQ ID NO: 13018 - DNA, 25 bp, Homo sapiens
tacaagcacgctctaacatctgggt

SEQ ID NO: 13019 - DNA, 25 bp, Homo sapiens
gatgctgcatgcttctacgatataa

SEQ ID NO: 13020 - DNA, 25 bp, Homo sapiens
agagcaccatgatcacgctgttgtg

SEQ ID NO: 13021 - DNA, 25 bp, Homo sapiens
ggagctgctaagccgtactggcatc

SEQ ID NO: 13022 - DNA, 25 bp, Homo sapiens
tgttctggagtgatttgggccccga

SEQ ID NO: 13023 - DNA, 25 bp, Homo sapiens
tgggccccgatgttggctatgaagc

SEQ ID NO: 13024 - DNA, 25 bp, Homo sapiens
gtttgcccacagttggtgtttttgc

SEQ ID NO: 13025 - DNA, 25 bp, Homo sapiens
aactgcacaagacaaccccaaatct

SEQ ID NO: 13026 - DNA, 25 bp, Homo sapiens
gacagagtccgaggcctcagaaatt

SEQ ID NO: 13027 - DNA, 25 bp, Homo sapiens
tcagaaattactattcctcccagca

SEQ ID NO: 13028 - DNA, 25 bp, Homo sapiens
gtggtcgtggggattgtgctatgga

SEQ ID NO: 13029 - DNA, 25 bp, Homo sapiens
atatattttatcaccaacatttcaa

SEQ ID NO: 13030 - DNA, 25 bp, Homo sapiens
gtctgtcttacccaatgaggcgatc

SEQ ID NO: 13031 - DNA, 25 bp, Homo sapiens
gaggcgatcctacagatacaagttg

SEQ ID NO: 13032 - DNA, 25 bp, Homo sapiens
actgggcatatcaacaggtccaaca

SEQ ID NO: 13033 - DNA, 25 bp, Homo sapiens
gtctctgggaattgtgggattggca

SEQ ID NO: 13034 - DNA, 25 bp, Homo sapiens
gttggctgtgacatctattccatct

SEQ ID NO: 13035 - DNA, 25 bp, Homo sapiens
agctaggaattgtttcccttctact

SEQ ID NO: 13036 - DNA, 25 bp, Homo sapiens
ccttctactgggcacaatacacgca

SEQ ID NO: 13037 - DNA, 25 bp, Homo sapiens
acacgcattgatttttgcctggaat

SEQ ID NO: 13038 - DNA, 25 bp, Homo sapiens
ggtatacacctccaacttttatgat

SEQ ID NO: 13039 - DNA, 25 bp, Homo sapiens
agcatactattcctgccatgcttga

SEQ ID NO: 13040 - DNA, 25 bp, Homo sapiens
tcctccttggcggcaaaagcccatt

SEQ ID NO: 13041 - DNA, 25 bp, Homo sapiens
caagaatgatgggcactaccgtgga

SEQ ID NO: 13042 - DNA, 25 bp, Homo sapiens
actaccgtggagatcccaactggtt

SEQ ID NO: 13043 - DNA, 25 bp, Homo sapiens
agggaattcacagagagccagctgc

SEQ ID NO: 13044 - DNA, 25 bp, Homo sapiens
gaaagcatgtcattggccttcagat

SEQ ID NO: 13045 - DNA, 25 bp, Homo sapiens
caggccggcatgacaggctacggac

SEQ ID NO: 13046 - DNA, 25 bp, Homo sapiens
cgacctcggcagatcatcagttaga

SEQ ID NO: 13047 - DNA, 25 bp, Homo sapiens
ccctggccaagctttgaggctctgt

SEQ ID NO: 13048 - DNA, 25 bp, Homo sapiens
gaggctctgtcactgagcaatggta

SEQ ID NO: 13049 - DNA, 25 bp, Homo sapiens
gagcaatggtaactgcacctgggca

SEQ ID NO: 13050 - DNA, 25 bp, Homo sapiens
ccaacttcttacccgaaagcatcac

SEQ ID NO: 13051 - DNA, 25 bp, Homo sapiens
atatattgtgcatcaactctgttgg

SEQ ID NO: 13052 - DNA, 25 bp, Homo sapiens
gtggacgatttgttctagcaccttt

SEQ ID NO: 13053 - DNA, 25 bp, Homo sapiens
aatggccatcagaatcactatcctc

SEQ ID NO: 13054 - DNA, 25 bp, Homo sapiens
tcctcctgttccatttggttatcca

SEQ ID NO: 13055 - DNA, 25 bp, Homo sapiens
aaataaaccatatcgcccaattcca

SEQ ID NO: 13056 - DNA, 25 bp, Homo sapiens
aattccagtgacatgggtacctcct

SEQ ID NO: 13057 - DNA, 25 bp, Homo sapiens
tcctcctggaatgcattgtgaccgg

SEQ ID NO: 13058 - DNA, 25 bp, Homo sapiens
gaccggaatcactggattaatcctc

SEQ ID NO: 13059 - DNA, 25 bp, Homo sapiens
ttaatcctcacatgttagcacctca

SEQ ID NO: 13060 - DNA, 25 bp, Homo sapiens
gcacctcactaacttcgtttttgat

SEQ ID NO: 13061 - DNA, 25 bp, Homo sapiens
tgggccaaaccatcaaacttatttt

SEQ ID NO: 13062 - DNA, 25 bp, Homo sapiens
gagatggtcaggaggctcccgatgt

SEQ ID NO: 13063 - DNA, 25 bp, Homo sapiens
ctcccgatgtggttgcattcgtggc

SEQ ID NO: 13064 - DNA, 25 bp, Homo sapiens
gctcccggtgaatctcagcaagagg

SEQ ID NO: 13065 - DNA, 25 bp, Homo sapiens
gagagagaaggaacacctccgatcg

SEQ ID NO: 13066 - DNA, 25 bp, Homo sapiens
ggaacacctccgatcgaagaacgta

SEQ ID NO: 13067 - DNA, 25 bp, Homo sapiens
gactcggagtgagcgtggagatggc

SEQ ID NO: 13068 - DNA, 25 bp, Homo sapiens
aagagaagactccacctaatcctaa

SEQ ID NO: 13069 - DNA, 25 bp, Homo sapiens
gaagctacacacatggctgatgtca

SEQ ID NO: 13070 - DNA, 25 bp, Homo sapiens
caagttcttcagttcacgatcttct

SEQ ID NO: 13071 - DNA, 25 bp, Homo sapiens
gttcacgatcttctagttgcagcga

SEQ ID NO: 13072 - DNA, 25 bp, Homo sapiens
gttgcagcgatgagtgcacgagtga

SEQ ID NO: 13073 - DNA, 25 bp, Homo sapiens
aatgcagctgacgatccgttggtgc

SEQ ID NO: 13074 - DNA, 25 bp, Homo sapiens
aagtcttctaaccattccaaaatct

SEQ ID NO: 13075 - DNA, 25 bp, Homo sapiens
gagaacgtcatgtttgtgctgcctc

SEQ ID NO: 13076 - DNA, 25 bp, Homo sapiens
gccacttgggcttctttgagggctc

SEQ ID NO: 13077 - DNA, 25 bp, Homo sapiens
tctttgagggctctgtgctgttccc

SEQ ID NO: 13078 - DNA, 25 bp, Homo sapiens
ccgagcccctgacatggatggataa

SEQ ID NO: 13079 - DNA, 25 bp, Homo sapiens
acgccaacgccatttgccaatggga

SEQ ID NO: 13080 - DNA, 25 bp, Homo sapiens
tgcacacctgtctcggagtaggcag

SEQ ID NO: 13081 - DNA, 25 bp, Homo sapiens
ggagctccaggctatttttgtgctt

SEQ ID NO: 13082 - DNA, 25 bp, Homo sapiens
gttactggttttctccattgcattg

SEQ ID NO: 13083 - DNA, 25 bp, Homo sapiens
gtgacagagttcttgccctctgtcc

SEQ ID NO: 13084 - DNA, 25 bp, Homo sapiens
gtggaatgtgctaataatgccctga

SEQ ID NO: 13085 - DNA, 25 bp, Homo sapiens
gaacagtgccttgctacgtgggaat

SEQ ID NO: 13086 - DNA, 25 bp, Homo sapiens
ggaatcattccttacatcacagacc

SEQ ID NO: 13087 - DNA, 25 bp, Homo sapiens
cacagaccaaccttcacttggaaga

SEQ ID NO: 13088 - DNA, 25 bp, Homo sapiens
accttaatcccattgaggacttctg

SEQ ID NO: 13089 - DNA, 25 bp, Homo sapiens
aggacttctgtttgatctttgggag

SEQ ID NO: 13090 - DNA, 25 bp, Homo sapiens
aagttattctttctggatctgccgt

SEQ ID NO: 13091 - DNA, 25 bp, Homo sapiens
ggatctgccgtgtccttataaagtg

SEQ ID NO: 13092 - DNA, 25 bp, Homo sapiens
gaaaaatgttttgtacccatctgga

SEQ ID NO: 13093 - DNA, 25 bp, Homo sapiens
caggtattccaggtcactgacatga

SEQ ID NO: 13094 - DNA, 25 bp, Homo sapiens
gagagatatctggcttggttttaat

SEQ ID NO: 13095 - DNA, 25 bp, Homo sapiens
cagcccgcgctatatatttgtacaa

SEQ ID NO: 13096 - DNA, 25 bp, Homo sapiens
caataggactgtttactgcccacct

SEQ ID NO: 13097 - DNA, 25 bp, Homo sapiens
tgggggctggatagcttcccagcac

SEQ ID NO: 13098 - DNA, 25 bp, Homo sapiens
gccccgtctgaccaaagttataata

SEQ ID NO: 13099 - DNA, 25 bp, Homo sapiens
atcaagctggatggaggcaaagcac

SEQ ID NO: 13100 - DNA, 25 bp, Homo sapiens
cagcaacaaatacagcacgttctct

SEQ ID NO: 13101 - DNA, 25 bp, Homo sapiens
aaatacagcacgttctctggcttca

SEQ ID NO: 13102 - DNA, 25 bp, Homo sapiens
cttcatcatctactccgactgagct

SEQ ID NO: 13103 - DNA, 25 bp, Homo sapiens
cgggcggggcagacgatgactcgcc

SEQ ID NO: 13104 - DNA, 25 bp, Homo sapiens
ggcggggcagacgatgactcgcccc

SEQ ID NO: 13105 - DNA, 25 bp, Homo sapiens
cccaccggctcgctgcagagccggg

SEQ ID NO: 13106 - DNA, 25 bp, Homo sapiens
tgcctccctgctgagaatattctcc

SEQ ID NO: 13107 - DNA, 25 bp, Homo sapiens
gctgagaatattctccctttagcag

SEQ ID NO: 13108 - DNA, 25 bp, Homo sapiens
tccctttagcagccaaagattcgct

SEQ ID NO: 13109 - DNA, 25 bp, Homo sapiens
aagattcgctggaacggaggctgcc

SEQ ID NO: 13110 - DNA, 25 bp, Homo sapiens
ctgcctgttggggtcggaagacaag

SEQ ID NO: 13111 - DNA, 25 bp, Homo sapiens
aagacaaggggcttctgaaatggga

SEQ ID NO: 13112 - DNA, 25 bp, Homo sapiens
aatgggagttcctgagatacaacaa

SEQ ID NO: 13113 - DNA, 25 bp, Homo sapiens
gtgtgccttcaaagaaactgacagc

SEQ ID NO: 13114 - DNA, 25 bp, Homo sapiens
tggttttaattatactccatgtgta

SEQ ID NO: 13115 - DNA, 25 bp, Homo sapiens
gaagcagtattgtacagaacacggt

SEQ ID NO: 13116 - DNA, 25 bp, Homo sapiens
tctctgtaccacgtgcacatgaggt

SEQ ID NO: 13117 - DNA, 25 bp, Homo sapiens
aacgaggagcacatgaccctgctga

SEQ ID NO: 13118 - DNA, 25 bp, Homo sapiens
gatatctctaacgaggtccgtccaa

SEQ ID NO: 13119 - DNA, 25 bp, Homo sapiens
ggaagtcgcagagccttgggtggac

SEQ ID NO: 13120 - DNA, 25 bp, Homo sapiens
gcaccgttcatggaccgagacaaag

SEQ ID NO: 13121 - DNA, 25 bp, Homo sapiens
aagtttgtcctgatcccaatgtttg

SEQ ID NO: 13122 - DNA, 25 bp, Homo sapiens
agctcttccccatggttgaggagat

SEQ ID NO: 13123 - DNA, 25 bp, Homo sapiens
tgggaatcccgagatcgctacgagg

SEQ ID NO: 13124 - DNA, 25 bp, Homo sapiens
agactgacagcttgacgtctggggc

SEQ ID NO: 13125 - DNA, 25 bp, Homo sapiens
tgaggaaagcggggggcgtggctgc

SEQ ID NO: 13126 - DNA, 25 bp, Homo sapiens
ctgcgcgggatccttgtgcagggaa

SEQ ID NO: 13127 - DNA, 25 bp, Homo sapiens
ggcaccacaagaccatgttttctaa

SEQ ID NO: 13128 - DNA, 25 bp, Homo sapiens
ctcatgcgaaacattgtcagggtgg

SEQ ID NO: 13129 - DNA, 25 bp, Homo sapiens
gaaacattgtcagggtggtcgtcct

SEQ ID NO: 13130 - DNA, 25 bp, Homo sapiens
gtcagggtggtcgtcctggacaaag

SEQ ID NO: 13131 - DNA, 25 bp, Homo sapiens
ggtcgtcctggacaaagtcacagac

SEQ ID NO: 13132 - DNA, 25 bp, Homo sapiens
tggacaaagtcacagacctgctgct

SEQ ID NO: 13133 - DNA, 25 bp, Homo sapiens
cccacctcaactattactggctgcc

SEQ ID NO: 13134 - DNA, 25 bp, Homo sapiens
tattactggctgcccatcatgacct

SEQ ID NO: 13135 - DNA, 25 bp, Homo sapiens
cttcttcagcgttttcggcatgtgt

SEQ ID NO: 13136 - DNA, 25 bp, Homo sapiens
tcagcgttttcggcatgtgtgtgga

SEQ ID NO: 13137 - DNA, 25 bp, Homo sapiens
acatgtccaagagccttctaaagat

SEQ ID NO: 13138 - DNA, 25 bp, Homo sapiens
tgtccaagagccttctaaagattct

SEQ ID NO: 13139 - DNA, 25 bp, Homo sapiens
agagcagcctgatcttacacggtgc

SEQ ID NO: 13140 - DNA, 25 bp, Homo sapiens
gtgcaaatgtgccctcatgttaaca

SEQ ID NO: 13141 - DNA, 25 bp, Homo sapiens
tcaaagggcccagttactccttacg

SEQ ID NO: 13142 - DNA, 25 bp, Homo sapiens
tactccttacgttccacaactatga

SEQ ID NO: 13143 - DNA, 25 bp, Homo sapiens
gcaaacaatattgtctcccttccag

SEQ ID NO: 13144 - DNA, 25 bp, Homo sapiens
ggttcttgaccgtgaatctggagcc

SEQ ID NO: 13145 - DNA, 25 bp, Homo sapiens
aatctggagccgtttgagttcacaa

SEQ ID NO: 13146 - DNA, 25 bp, Homo sapiens
gtctctacttggggtgacagtgctc

SEQ ID NO: 13147 - DNA, 25 bp, Homo sapiens
tgctcacgtggctcgactatagaaa

SEQ ID NO: 13148 - DNA, 25 bp, Homo sapiens
aaaactccactgactgtcgggcttt

SEQ ID NO: 13149 - DNA, 25 bp, Homo sapiens
gcttgctgtgcttcaaactactact

SEQ ID NO: 13150 - DNA, 25 bp, Homo sapiens
ccccagggcattgtgttcactgtac

SEQ ID NO: 13151 - DNA, 25 bp, Homo sapiens
tgtgttcactgtactctgtgggcaa

SEQ ID NO: 13152 - DNA, 25 bp, Homo sapiens
gtactctgtgggcaaggatgggtcc

SEQ ID NO: 13153 - DNA, 25 bp, Homo sapiens
ggatgggtccagaagaccccacttc

SEQ ID NO: 13154 - DNA, 25 bp, Homo sapiens
accccacttcaggcactaagagggg

SEQ ID NO: 13155 - DNA, 25 bp, Homo sapiens
tcaggcactaagaggggctggacct

SEQ ID NO: 13156 - DNA, 25 bp, Homo sapiens
gactgggcctaggccaggagttccc

SEQ ID NO: 13157 - DNA, 25 bp, Homo sapiens
ctaggccaggagttcccaaatgtga

SEQ ID NO: 13158 - DNA, 25 bp, Homo sapiens
gactcttccaggttcactgaggggc

SEQ ID NO: 13159 - DNA, 25 bp, Homo sapiens
ccaggttcactgaggggccctggtc

SEQ ID NO: 13160 - DNA, 25 bp, Homo sapiens
tttccatcccacataaatacagtat

SEQ ID NO: 13161 - DNA, 25 bp, Homo sapiens
agcgtgactgggccgagtccacgct

SEQ ID NO: 13162 - DNA, 25 bp, Homo sapiens
gagtccacgctgatgacgcagaaga

SEQ ID NO: 13163 - DNA, 25 bp, Homo sapiens
aagacggggattgtgagcggcttcg

SEQ ID NO: 13164 - DNA, 25 bp, Homo sapiens
gcaacagctgcaagctgtccagcag

SEQ ID NO: 13165 - DNA, 25 bp, Homo sapiens
acacctacttcgtgacaggcatcgt

SEQ ID NO: 13166 - DNA, 25 bp, Homo sapiens
gagggctgtgcccgtaaggggaagt

SEQ ID NO: 13167 - DNA, 25 bp, Homo sapiens
gtacgggatctacaccaaggtcacc

SEQ ID NO: 13168 - DNA, 25 bp, Homo sapiens
tccatgaaaaccaggggcttgccca

SEQ ID NO: 13169 - DNA, 25 bp, Homo sapiens
ccaggggcttgcccaaggccaagag

SEQ ID NO: 13170 - DNA, 25 bp, Homo sapiens
ggcggtgcacgaggtggaggtggtc

SEQ ID NO: 13171 - DNA, 25 bp, Homo sapiens
ggtggtcatcaagcacaaccggttc

SEQ ID NO: 13172 - DNA, 25 bp, Homo sapiens
tatgaaacccgctacatctatggcc

SEQ ID NO: 13173 - DNA, 25 bp, Homo sapiens
cccgatatcaggttcttctttagac

SEQ ID NO: 13174 - DNA, 25 bp, Homo sapiens
acatttgcctttgagctccgagata

SEQ ID NO: 13175 - DNA, 25 bp, Homo sapiens
actgccctctgtttggaataagcca

SEQ ID NO: 13176 - DNA, 25 bp, Homo sapiens
tccttttttgtgcctttcatcagaa

SEQ ID NO: 13177 - DNA, 25 bp, Homo sapiens
gtcaatcttcagttatccccaaatg

SEQ ID NO: 13178 - DNA, 25 bp, Homo sapiens
caaatgcagcttctatttcacctga

SEQ ID NO: 13179 - DNA, 25 bp, Homo sapiens
aatccttctcttgctcatttaagtc

SEQ ID NO: 13180 - DNA, 25 bp, Homo sapiens
aagtcccatgttactgctgtttgct

SEQ ID NO: 13181 - DNA, 25 bp, Homo sapiens
tgctgtttgcttttacttactttca

SEQ ID NO: 13182 - DNA, 25 bp, Homo sapiens
gattttcaccatgtggcttcatcaa

SEQ ID NO: 13183 - DNA, 25 bp, Homo sapiens
gatgtactgtattctcagccaccat

SEQ ID NO: 13184 - DNA, 25 bp, Homo sapiens
ctgctgcaagtgggccagcttctgc

SEQ ID NO: 13185 - DNA, 25 bp, Homo sapiens
cagcttctgcggcaaccatgaaacc

SEQ ID NO: 13186 - DNA, 25 bp, Homo sapiens
aaaccgcatccaacagtccaaaagc

SEQ ID NO: 13187 - DNA, 25 bp, Homo sapiens
gccattcaaactgctatccgcaaaa

SEQ ID NO: 13188 - DNA, 25 bp, Homo sapiens
aagaggcaaacgcagtgctggctcg

SEQ ID NO: 13189 - DNA, 25 bp, Homo sapiens
ggctgaacagtgagctccagcagca

SEQ ID NO: 13190 - DNA, 25 bp, Homo sapiens
attggaacaacttcgtccggtcact

SEQ ID NO: 13191 - DNA, 25 bp, Homo sapiens
gtccggtcactgtgttgtgaccccc

SEQ ID NO: 13192 - DNA, 25 bp, Homo sapiens
gtgacagtgggtgaccttgtctgcc

SEQ ID NO: 13193 - DNA, 25 bp, Homo sapiens
gttttgaacccaactacttgtcata

SEQ ID NO: 13194 - DNA, 25 bp, Homo sapiens
tcaaaggagctttctcaatgtcttc

SEQ ID NO: 13195 - DNA, 25 bp, Homo sapiens
gtcttcccacaaatggtcccaatta

SEQ ID NO: 13196 - DNA, 25 bp, Homo sapiens
aagcagaatcaactgcccctgactt

SEQ ID NO: 13197 - DNA, 25 bp, Homo sapiens
gtggttttacagctaccacccttag

SEQ ID NO: 13198 - DNA, 25 bp, Homo sapiens
gaatggctttcaatacccttttaag

SEQ ID NO: 13199 - DNA, 25 bp, Homo sapiens
caaggtggggacgtgtgtcctttgg

SEQ ID NO: 13200 - DNA, 25 bp, Homo sapiens
gtgtcctttggtactatggtgtgtt

SEQ ID NO: 13201 - DNA, 25 bp, Homo sapiens
gggattgctttgcattactgtcccc

SEQ ID NO: 13202 - DNA, 25 bp, Homo sapiens
tgcattactgtccccttgatataaa

SEQ ID NO: 13203 - DNA, 25 bp, Homo sapiens
gagagttccttctcacttagaatct

SEQ ID NO: 13204 - DNA, 25 bp, Homo sapiens
atggtctggcaatattctgtaacta

SEQ ID NO: 13205 - DNA, 25 bp, Homo sapiens
ccacagacctgcacattgttgtcac

SEQ ID NO: 13206 - DNA, 25 bp, Homo sapiens
gtccctgcagactcagtgcagcact

SEQ ID NO: 13207 - DNA, 25 bp, Homo sapiens
tttggggacacctatgagacccagg

SEQ ID NO: 13208 - DNA, 25 bp, Homo sapiens
gagacccaggtgatcgcctatgggc

SEQ ID NO: 13209 - DNA, 25 bp, Homo sapiens
gcagcagcgaaggcctgagacagaa

SEQ ID NO: 13210 - DNA, 25 bp, Homo sapiens
agaatgtggacgtgtggctgtggca

SEQ ID NO: 13211 - DNA, 25 bp, Homo sapiens
gctcctcggtggtgacaatgggggg

SEQ ID NO: 13212 - DNA, 25 bp, Homo sapiens
acctcgtatgcctgggagcgaacac

SEQ ID NO: 13213 - DNA, 25 bp, Homo sapiens
agcgaacacaaggctctgtggccct

SEQ ID NO: 13214 - DNA, 25 bp, Homo sapiens
cctgcaagaagcccctggggtgacc

SEQ ID NO: 13215 - DNA, 25 bp, Homo sapiens
gaagcagccacaggttggccaagca

SEQ ID NO: 13216 - DNA, 25 bp, Homo sapiens
gaagggactattccaaaacccagct

SEQ ID NO: 13217 - DNA, 25 bp, Homo sapiens
cagctgttcagttccactcaaagga

SEQ ID NO: 13218 - DNA, 25 bp, Homo sapiens
aaggagctatatgtggctgctgatg

SEQ ID NO: 13219 - DNA, 25 bp, Homo sapiens
tggctgctgatgaagcctccatcgc

SEQ ID NO: 13220 - DNA, 25 bp, Homo sapiens
ccaggcccactttggacgtaggctt

SEQ ID NO: 13221 - DNA, 25 bp, Homo sapiens
tggacgtaggcttggcctgggttcc

SEQ ID NO: 13222 - DNA, 25 bp, Homo sapiens
taccctgactggggcagcaactact

SEQ ID NO: 13223 - DNA, 25 bp, Homo sapiens
ggtgaagctgactctagactcagag

SEQ ID NO: 13224 - DNA, 25 bp, Homo sapiens
ctacatgcccaacgctgtggagcag

SEQ ID NO: 13225 - DNA, 25 bp, Homo sapiens
cgctgtggagcaggccagtgaggct

SEQ ID NO: 13226 - DNA, 25 bp, Homo sapiens
ggctgtatacaaactcgctgaatca

SEQ ID NO: 13227 - DNA, 25 bp, Homo sapiens
atagctggtggtgggcgctaatcct

SEQ ID NO: 13228 - DNA, 25 bp, Homo sapiens
tgacgcaaaataccaccttggcgcc

SEQ ID NO: 13229 - DNA, 25 bp, Homo sapiens
ctacacgggagacgacgtccgcatc

SEQ ID NO: 13230 - DNA, 25 bp, Homo sapiens
tccgcatcgtccgtgacgacatgct

SEQ ID NO: 13231 - DNA, 25 bp, Homo sapiens
catgctgtgtgccgggaacacccgg

SEQ ID NO: 13232 - DNA, 25 bp, Homo sapiens
tggtcagctggggcgagggctgtgc

SEQ ID NO: 13233 - DNA, 25 bp, Homo sapiens
cgtgtcacctactacttggactgga

SEQ ID NO: 13234 - DNA, 25 bp, Homo sapiens
ttggactggatccaccactatgtcc

SEQ ID NO: 13235 - DNA, 25 bp, Homo sapiens
atgtccccaaaaagccgtgagtcag

SEQ ID NO: 13236 - DNA, 25 bp, Homo sapiens
gtgagtcaggcctgggttggccacc

SEQ ID NO: 13237 - DNA, 25 bp, Homo sapiens
gccacctgggtcactggaggaccaa

SEQ ID NO: 13238 - DNA, 25 bp, Homo sapiens
ggattggcactaaagagcggactga

SEQ ID NO: 13239 - DNA, 25 bp, Homo sapiens
gactgagaaattgcccatgggctcc

SEQ ID NO: 13240 - DNA, 25 bp, Homo sapiens
gtggtcagtgaacctatcgaaggac

SEQ ID NO: 13241 - DNA, 25 bp, Homo sapiens
gactaccacatgatggcgtttcagt

SEQ ID NO: 13242 - DNA, 25 bp, Homo sapiens
atgatggcgtttcagttgggcccca

SEQ ID NO: 13243 - DNA, 25 bp, Homo sapiens
gaagcctcttactactgggtgtact

SEQ ID NO: 13244 - DNA, 25 bp, Homo sapiens
gggtgtactgggttccaactcaata

SEQ ID NO: 13245 - DNA, 25 bp, Homo sapiens
agcatccctggatttcagagttctg

SEQ ID NO: 13246 - DNA, 25 bp, Homo sapiens
gatgtactttcaccattagcttaat

SEQ ID NO: 13247 - DNA, 25 bp, Homo sapiens
cctttcttgcagtcagcttcatacc

SEQ ID NO: 13248 - DNA, 25 bp, Homo sapiens
gcagtcagcttcataccatttttaa

SEQ ID NO: 13249 - DNA, 25 bp, Homo sapiens
tccttcgatttccctatgattcatg

SEQ ID NO: 13250 - DNA, 25 bp, Homo sapiens
gtggtagaggagccatcgccacaac

SEQ ID NO: 13251 - DNA, 25 bp, Homo sapiens
acaactcccagcagacaagttctct

SEQ ID NO: 13252 - DNA, 25 bp, Homo sapiens
gttgactttacctcacagtgcttaa

SEQ ID NO: 13253 - DNA, 25 bp, Homo sapiens
caaagaacggcctacatacccagag

SEQ ID NO: 13254 - DNA, 25 bp, Homo sapiens
atacccagagctaatgcaacatcca

SEQ ID NO: 13255 - DNA, 25 bp, Homo sapiens
catccatttttcaccctacatgaat

SEQ ID NO: 13256 - DNA, 25 bp, Homo sapiens
gcagtggacttaatcggttgaccct

SEQ ID NO: 13257 - DNA, 25 bp, Homo sapiens
ggttgaccctactgtggattggtgg

SEQ ID NO: 13258 - DNA, 25 bp, Homo sapiens
gagataatttaaccctgcctctcag

SEQ ID NO: 13259 - DNA, 25 bp, Homo sapiens
agggggccttggaatctatagtata

SEQ ID NO: 13260 - DNA, 25 bp, Homo sapiens
acccttggccatcaggcgaggggct

SEQ ID NO: 13261 - DNA, 25 bp, Homo sapiens
accatggaggtcattggcctgaggc

SEQ ID NO: 13262 - DNA, 25 bp, Homo sapiens
gaggcaagttccccggagagtcggg

SEQ ID NO: 13263 - DNA, 25 bp, Homo sapiens
ccccctcaggcctatgtctgtgagg

SEQ ID NO: 13264 - DNA, 25 bp, Homo sapiens
ccccaagagggcctccatgtttcga

SEQ ID NO: 13265 - DNA, 25 bp, Homo sapiens
ttcgaggtgcctcaacatggagcct

SEQ ID NO: 13266 - DNA, 25 bp, Homo sapiens
cactgtctgaactcctgactgtcag

SEQ ID NO: 13267 - DNA, 25 bp, Homo sapiens
actccgtgggggtacaggagcccag

SEQ ID NO: 13268 - DNA, 25 bp, Homo sapiens
gtcaagagacgcagagggcccctgc

SEQ ID NO: 13269 - DNA, 25 bp, Homo sapiens
gtggccagggacggcatgagcagga

SEQ ID NO: 13270 - DNA, 25 bp, Homo sapiens
ggccttctggtttggtgtcaacagc

SEQ ID NO: 13271 - DNA, 25 bp, Homo sapiens
atcctacaacccaccttgaaggtat

SEQ ID NO: 13272 - DNA, 25 bp, Homo sapiens
accttgaaggtataactggatccag

SEQ ID NO: 13273 - DNA, 25 bp, Homo sapiens
gatatgtttctctctgaaattactg

SEQ ID NO: 13274 - DNA, 25 bp, Homo sapiens
taacaaacacttacttgatctatgt

SEQ ID NO: 13275 - DNA, 25 bp, Homo sapiens
gcaaaatgtcttgtaccttttctaa

SEQ ID NO: 13276 - DNA, 25 bp, Homo sapiens
gttttaagattgcacctggcagtgt

SEQ ID NO: 13277 - DNA, 25 bp, Homo sapiens
gcacttggagctgcttttaatttta

SEQ ID NO: 13278 - DNA, 25 bp, Homo sapiens
gcaaaatgttttatgcaaggcacaa

SEQ ID NO: 13279 - DNA, 25 bp, Homo sapiens
ggcacaataggaagtcagttctcct

SEQ ID NO: 13280 - DNA, 25 bp, Homo sapiens
cacttcctcctcatgtagtctggag

SEQ ID NO: 13281 - DNA, 25 bp, Homo sapiens
tagtctggagtactttctaaagggc

SEQ ID NO: 13282 - DNA, 25 bp, Homo sapiens
ccccccacttttggagatgcgtcag

SEQ ID NO: 13283 - DNA, 25 bp, Homo sapiens
gtcagtcattgcccttgaattacta

SEQ ID NO: 13284 - DNA, 25 bp, Homo sapiens
aattcaggtctgtcatctcctataa

SEQ ID NO: 13285 - DNA, 25 bp, Homo sapiens
tcttttcccttaataccgttgcaag

SEQ ID NO: 13286 - DNA, 25 bp, Homo sapiens
acaatctggccaacatcatctacta

SEQ ID NO: 13287 - DNA, 25 bp, Homo sapiens
gaaggagtccaccactagtgagcag

SEQ ID NO: 13288 - DNA, 25 bp, Homo sapiens
gcagagtgccaggatgacagccatg

SEQ ID NO: 13289 - DNA, 25 bp, Homo sapiens
gacagccatggacaatgccagcaag

SEQ ID NO: 13290 - DNA, 25 bp, Homo sapiens
aaattatctctggtgctgcagctct

SEQ ID NO: 13291 - DNA, 25 bp, Homo sapiens
tactgctgcctttgtccgaagaaac

SEQ ID NO: 13292 - DNA, 25 bp, Homo sapiens
gaagaaactgttcctccattatttg

SEQ ID NO: 13293 - DNA, 25 bp, Homo sapiens
gaaaagccccaagtctttatacaga

SEQ ID NO: 13294 - DNA, 25 bp, Homo sapiens
gaacaaagggcgggtcttatcattc

SEQ ID NO: 13295 - DNA, 25 bp, Homo sapiens
cttcccggactcaactgtaactgga

SEQ ID NO: 13296 - DNA, 25 bp, Homo sapiens
ctggaaactgtgttgctctaaccct

SEQ ID NO: 13297 - DNA, 25 bp, Homo sapiens
agtcatcattcgtgttctgtgtata

SEQ ID NO: 13298 - DNA, 25 bp, Homo sapiens
gagtcagactgcttgtatattatca

SEQ ID NO: 13299 - DNA, 25 bp, Homo sapiens
aggacatggggttccagtacagctg

SEQ ID NO: 13300 - DNA, 25 bp, Homo sapiens
gattaccgaccagtgaagctcttac

SEQ ID NO: 13301 - DNA, 25 bp, Homo sapiens
tacagtgcgtggaccacagcaccca

SEQ ID NO: 13302 - DNA, 25 bp, Homo sapiens
gtgccttaaagtcggcagcagccgc

SEQ ID NO: 13303 - DNA, 25 bp, Homo sapiens
gcagcagccgctactcaaagaaaag

SEQ ID NO: 13304 - DNA, 25 bp, Homo sapiens
ttgaacaaaccctcactgagcacct

SEQ ID NO: 13305 - DNA, 25 bp, Homo sapiens
ctgagcacctctgatgttgagcacc

SEQ ID NO: 13306 - DNA, 25 bp, Homo sapiens
gagcacctgctgaatactgagcact

SEQ ID NO: 13307 - DNA, 25 bp, Homo sapiens
agcacggggtgagtcaacctgggac

SEQ ID NO: 13308 - DNA, 25 bp, Homo sapiens
tgggactcggtctcagggatatgcc

SEQ ID NO: 13309 - DNA, 25 bp, Homo sapiens
agggatatgcctaccaatagcgggt

SEQ ID NO: 13310 - DNA, 25 bp, Homo sapiens
tagagcagacccaggaaagctttct

SEQ ID NO: 13311 - DNA, 25 bp, Homo sapiens
ttctcatgtaggatgtcagccctcc

SEQ ID NO: 13312 - DNA, 25 bp, Homo sapiens
ttttggccaatgtcttttcactttc

SEQ ID NO: 13313 - DNA, 25 bp, Homo sapiens
tccccagccagacgcaatcatggaa

SEQ ID NO: 13314 - DNA, 25 bp, Homo sapiens
ggaagttgccttattgtcactggtt

SEQ ID NO: 13315 - DNA, 25 bp, Homo sapiens
attaccaggagctcggacggtgctt

SEQ ID NO: 13316 - DNA, 25 bp, Homo sapiens
tcggacggtgcttttggtggatgcg

SEQ ID NO: 13317 - DNA, 25 bp, Homo sapiens
ggtggatgcgtctagatggataaca

SEQ ID NO: 13318 - DNA, 25 bp, Homo sapiens
ttcttctaccctaaaatattcctat

SEQ ID NO: 13319 - DNA, 25 bp, Homo sapiens
taatactttgagctgttctggttcc

SEQ ID NO: 13320 - DNA, 25 bp, Homo sapiens
ttctggttcctccagggtgcatggt

SEQ ID NO: 13321 - DNA, 25 bp, Homo sapiens
ggtgcatggtacccattaacccaaa

SEQ ID NO: 13322 - DNA, 25 bp, Homo sapiens
gaatgttctctgtgaaccacagttg

SEQ ID NO: 13323 - DNA, 25 bp, Homo sapiens
cacatttctttctgtcaccacagag

SEQ ID NO: 13324 - DNA, 25 bp, Homo sapiens
gtcaccacagagattggcctacggt

SEQ ID NO: 13325 - DNA, 25 bp, Homo sapiens
tggcctacggtttctgttttgaggg

SEQ ID NO: 13326 - DNA, 25 bp, Homo sapiens
taggggcccaattagcatcatctag

SEQ ID NO: 13327 - DNA, 25 bp, Homo sapiens
aggggaatctctattactctgtact

SEQ ID NO: 13328 - DNA, 25 bp, Homo sapiens
actcaagcctcctagcattcaaact

SEQ ID NO: 13329 - DNA, 25 bp, Homo sapiens
agcattcaaacttccatcctattag

SEQ ID NO: 13330 - DNA, 25 bp, Homo sapiens
gcatcattcatctccatttatttct

SEQ ID NO: 13331 - DNA, 25 bp, Homo sapiens
ttttgttcccgctcagtgtgaagtt

SEQ ID NO: 13332 - DNA, 25 bp, Homo sapiens
ggatggctgctggtttcacagaagt

SEQ ID NO: 13333 - DNA, 25 bp, Homo sapiens
gtttggatgccttactcttatctta

SEQ ID NO: 13334 - DNA, 25 bp, Homo sapiens
tccctctctgatgccacatgcaaaa

SEQ ID NO: 13335 - DNA, 25 bp, Homo sapiens
gtagatcatatgactgcctttctgt

SEQ ID NO: 13336 - DNA, 25 bp, Homo sapiens
atgctctttgcctctaattcagtat

SEQ ID NO: 13337 - DNA, 25 bp, Homo sapiens
cctagcactgtcctcaaagaccatc

SEQ ID NO: 13338 - DNA, 25 bp, Homo sapiens
ctcaaagaccatctgtatgccctgc

SEQ ID NO: 13339 - DNA, 25 bp, Homo sapiens
agctccgtgtgatgcccagtaaagc

SEQ ID NO: 13340 - DNA, 25 bp, Homo sapiens
tgcccagtaaagcctgaaccatgcc

SEQ ID NO: 13341 - DNA, 25 bp, Homo sapiens
ctgaggctcccttgaactcaggact

SEQ ID NO: 13342 - DNA, 25 bp, Homo sapiens
ggggtggtgatcaggcaggttcata

SEQ ID NO: 13343 - DNA, 25 bp, Homo sapiens
ctcctgtaggccgtctagaactggc

SEQ ID NO: 13344 - DNA, 25 bp, Homo sapiens
ctcccaggcagactgccttctttca

SEQ ID NO: 13345 - DNA, 25 bp, Homo sapiens
tctttcaccctgtcctgatagactt

SEQ ID NO: 13346 - DNA, 25 bp, Homo sapiens
agacttccctgatctagatatcctt

SEQ ID NO: 13347 - DNA, 25 bp, Homo sapiens
atctagatatccttcgtcatgacac

SEQ ID NO: 13348 - DNA, 25 bp, Homo sapiens
atgtgccagatcatgagggtcgcat

SEQ ID NO: 13349 - DNA, 25 bp, Homo sapiens
tgagggtcgcattggcatggcctcc

SEQ ID NO: 13350 - DNA, 25 bp, Homo sapiens
gcattggcatggcctccatcaaaat

SEQ ID NO: 13351 - DNA, 25 bp, Homo sapiens
aagaaactctttcagcacattgctg

SEQ ID NO: 13352 - DNA, 25 bp, Homo sapiens
acctacctagttatgcaaggccccg

SEQ ID NO: 13353 - DNA, 25 bp, Homo sapiens
atgcaaggccccggtttctaagaat

SEQ ID NO: 13354 - DNA, 25 bp, Homo sapiens
aatacaggacaccattgagatcact

SEQ ID NO: 13355 - DNA, 25 bp, Homo sapiens
ggaggataactcaacatttccagaa

SEQ ID NO: 13356 - DNA, 25 bp, Homo sapiens
gacagccacttgatataatccaact

SEQ ID NO: 13357 - DNA, 25 bp, Homo sapiens
taggaaatttgcatacccgtaaagg

SEQ ID NO: 13358 - DNA, 25 bp, Homo sapiens
ttcagtgtgcacctactgtttgtat

SEQ ID NO: 13359 - DNA, 25 bp, Homo sapiens
gactctcagtttcatattgcccaga

SEQ ID NO: 13360 - DNA, 25 bp, Homo sapiens
tccatttgtattaactcatctccct

SEQ ID NO: 13361 - DNA, 25 bp, Homo sapiens
ctcttccttgtggtaatccctagac

SEQ ID NO: 13362 - DNA, 25 bp, Homo sapiens
gggagctcaggtactcttttagtca

SEQ ID NO: 13363 - DNA, 25 bp, Homo sapiens
gtcatctttgtatgtctttagcaga

SEQ ID NO: 13364 - DNA, 25 bp, Homo sapiens
gagttcttgacatgtggtaggtgct

SEQ ID NO: 13365 - DNA, 25 bp, Homo sapiens
gggagagtaagtcagcatcggtata

SEQ ID NO: 13366 - DNA, 25 bp, Homo sapiens
aaatcgcttactccacgtaactctt

SEQ ID NO: 13367 - DNA, 25 bp, Homo sapiens
tccacgtaactcttcttctgatagg

SEQ ID NO: 13368 - DNA, 25 bp, Homo sapiens
gacattttgtttcacttgctattca

SEQ ID NO: 13369 - DNA, 25 bp, Homo sapiens
ttagcccttttccttaggaaccatg

SEQ ID NO: 13370 - DNA, 25 bp, Homo sapiens
cctatggctctgcaattgtcaccgg

SEQ ID NO: 13371 - DNA, 25 bp, Homo sapiens
ttgtcaccggttaactgtggcctgt

SEQ ID NO: 13372 - DNA, 25 bp, Homo sapiens
gccacacggcaggtagcagggggag

SEQ ID NO: 13373 - DNA, 25 bp, Homo sapiens
gtacgcccctgtgtgatatgttgat

SEQ ID NO: 13374 - DNA, 25 bp, Homo sapiens
atccctcggcaaagaatctactgga

SEQ ID NO: 13375 - DNA, 25 bp, Homo sapiens
gtttcatggacggtttcaccacact

SEQ ID NO: 13376 - DNA, 25 bp, Homo sapiens
tgaggttctggagatccccgaaccc

SEQ ID NO: 13377 - DNA, 25 bp, Homo sapiens
gtcctgcgaacaggtgctgctggcg

SEQ ID NO: 13378 - DNA, 25 bp, Homo sapiens
gcctgctgctgttatctttttaact

SEQ ID NO: 13379 - DNA, 25 bp, Homo sapiens
gttttctcatgatgcctttttatat

SEQ ID NO: 13380 - DNA, 25 bp, Homo sapiens
aaaccccgagatagtgctggaacac

SEQ ID NO: 13381 - DNA, 25 bp, Homo sapiens
atccattcctggtagtataagtcac

SEQ ID NO: 13382 - DNA, 25 bp, Homo sapiens
aatttgctctagttacacaccttta

SEQ ID NO: 13383 - DNA, 25 bp, Homo sapiens
agttacacacctttagaattctaga

SEQ ID NO: 13384 - DNA, 25 bp, Homo sapiens
tattaaaactgtaaggggcctccat

SEQ ID NO: 13385 - DNA, 25 bp, Homo sapiens
catccctcttactcatttgtagtct

SEQ ID NO: 13386 - DNA, 25 bp, Homo sapiens
tgatacacctaaggtcacgcagctg

SEQ ID NO: 13387 - DNA, 25 bp, Homo sapiens
ggtcacgcagctgggtagatataca

SEQ ID NO: 13388 - DNA, 25 bp, Homo sapiens
tacagctgtcacaagagtctagatc

SEQ ID NO: 13389 - DNA, 25 bp, Homo sapiens
acatgctttctactcttcgattatt

SEQ ID NO: 13390 - DNA, 25 bp, Homo sapiens
gctaatggtctttggcatgtttttg

SEQ ID NO: 13391 - DNA, 25 bp, Homo sapiens
atgtgactatgtcttggcaatgcac

SEQ ID NO: 13392 - DNA, 25 bp, Homo sapiens
aggcaacactttagcttgggtccac

SEQ ID NO: 13393 - DNA, 25 bp, Homo sapiens
tagcttgggtccaccatgcagaaca

SEQ ID NO: 13394 - DNA, 25 bp, Homo sapiens
caatattaacacgctgcctggtctg

SEQ ID NO: 13395 - DNA, 25 bp, Homo sapiens
tctgtctggatcccgaggtatggca

SEQ ID NO: 13396 - DNA, 25 bp, Homo sapiens
ggcagaggtgcaagacctagtcccc

SEQ ID NO: 13397 - DNA, 25 bp, Homo sapiens
aactcactgcctaggaggctggcca

SEQ ID NO: 13398 - DNA, 25 bp, Homo sapiens
atcaaacatgcacacgggcgagctt

SEQ ID NO: 13399 - DNA, 25 bp, Homo sapiens
ggacaagcagtcccttaatattgag

SEQ ID NO: 13400 - DNA, 25 bp, Homo sapiens
aaacagtgccttctagagccgggct

SEQ ID NO: 13401 - DNA, 25 bp, Homo sapiens
gccgggctgggaatggggacacggt

SEQ ID NO: 13402 - DNA, 25 bp, Homo sapiens
tgatggaagatggtccgtgcccagg

SEQ ID NO: 13403 - DNA, 25 bp, Homo sapiens
ggatcattcttgctgcttaagatga

SEQ ID NO: 13404 - DNA, 25 bp, Homo sapiens
atttaaatttttggtgtgttcacat

SEQ ID NO: 13405 - DNA, 25 bp, Homo sapiens
aagggatgtagctaaaatgttttca

SEQ ID NO: 13406 - DNA, 25 bp, Homo sapiens
tcataggctattatatattctcgca

SEQ ID NO: 13407 - DNA, 25 bp, Homo sapiens
tattatatattctcgcagcatttcc

SEQ ID NO: 13408 - DNA, 25 bp, Homo sapiens
atattctcgcagcatttccagttaa

SEQ ID NO: 13409 - DNA, 25 bp, Homo sapiens
ctcgcagcatttccagttaagagga

SEQ ID NO: 13410 - DNA, 25 bp, Homo sapiens
ggtatataattctcttcttaaccga

SEQ ID NO: 13411 - DNA, 25 bp, Homo sapiens
ttctcttcttaaccgaatgtcagat

SEQ ID NO: 13412 - DNA, 25 bp, Homo sapiens
gaatgtcagatggtcttacgccaca

SEQ ID NO: 13413 - DNA, 25 bp, Homo sapiens
tcagatggtcttacgccacagggtg

SEQ ID NO: 13414 - DNA, 25 bp, Homo sapiens
gtattacaccacagggccagattgc

SEQ ID NO: 13415 - DNA, 25 bp, Homo sapiens
ttcattggcccgccaatacctcaga

SEQ ID NO: 13416 - DNA, 25 bp, Homo sapiens
acctcagaaccagcgattcattccc

SEQ ID NO: 13417 - DNA, 25 bp, Homo sapiens
aatggatacccaatacctcctggat

SEQ ID NO: 13418 - DNA, 25 bp, Homo sapiens
tacctcctggatatgcagcgtttcc

SEQ ID NO: 13419 - DNA, 25 bp, Homo sapiens
gtcctcccagagtgattcagcactg

SEQ ID NO: 13420 - DNA, 25 bp, Homo sapiens
aagcagtgccagtgggtcgactagc

SEQ ID NO: 13421 - DNA, 25 bp, Homo sapiens
gtcgactagcactggccatgtgact

SEQ ID NO: 13422 - DNA, 25 bp, Homo sapiens
atattcctttactaccacacatgtc

SEQ ID NO: 13423 - DNA, 25 bp, Homo sapiens
atgggtatcaccgtttttggcaaca

SEQ ID NO: 13424 - DNA, 25 bp, Homo sapiens
gacatcgcaacaagtaccttctgtg

SEQ ID NO: 13425 - DNA, 25 bp, Homo sapiens
cagtgagggcaagttccaggcattt

SEQ ID NO: 13426 - DNA, 25 bp, Homo sapiens
ccactttaccccagacgaggtgact

SEQ ID NO: 13427 - DNA, 25 bp, Homo sapiens
ctctctcccatgatggcatcttaaa

SEQ ID NO: 13428 - DNA, 25 bp, Homo sapiens
gcatcttaaacctggaagcacctcg

SEQ ID NO: 13429 - DNA, 25 bp, Homo sapiens
tcggggtggccgacatttggacaca

SEQ ID NO: 13430 - DNA, 25 bp, Homo sapiens
gtcaatgaggtctacatctccctgc

SEQ ID NO: 13431 - DNA, 25 bp, Homo sapiens
aggaggcagccatagttgagccctg

SEQ ID NO: 13432 - DNA, 25 bp, Homo sapiens
ctctctacctcccaaggtgatatgg

SEQ ID NO: 13433 - DNA, 25 bp, Homo sapiens
agaggtagcagcatccttgggggaa

SEQ ID NO: 13434 - DNA, 25 bp, Homo sapiens
ggtccacaatgtatggtttggtccc

SEQ ID NO: 13435 - DNA, 25 bp, Homo sapiens
ggtcccatgggacatgtcatagcct

SEQ ID NO: 13436 - DNA, 25 bp, Homo sapiens
cgccccgtaggcagctgagggtatc

SEQ ID NO: 13437 - DNA, 25 bp, Homo sapiens
agagaacggatggcgagtcccgagc

SEQ ID NO: 13438 - DNA, 25 bp, Homo sapiens
cgccctgctggcaagatacatccag

SEQ ID NO: 13439 - DNA, 25 bp, Homo sapiens
gaaagctccttctggacgaatgtcc

SEQ ID NO: 13440 - DNA, 25 bp, Homo sapiens
gaatgtccatcgttaagaacctgca

SEQ ID NO: 13441 - DNA, 25 bp, Homo sapiens
gctggatggattttggccgtcgcag

SEQ ID NO: 13442 - DNA, 25 bp, Homo sapiens
ccgtcgcagtgccgaggagtatgag

SEQ ID NO: 13443 - DNA, 25 bp, Homo sapiens
gtatgagtacccctcctagaggacc

SEQ ID NO: 13444 - DNA, 25 bp, Homo sapiens
gacaacaatcacactcataactcat

SEQ ID NO: 13445 - DNA, 25 bp, Homo sapiens
aagattgtccagtgcaaccacacac

SEQ ID NO: 13446 - DNA, 25 bp, Homo sapiens
ccacacacgctcaccagaagttgtg

SEQ ID NO: 13447 - DNA, 25 bp, Homo sapiens
caacatctgcctcatgctgaaactt

SEQ ID NO: 13448 - DNA, 25 bp, Homo sapiens
gaaacttagctatctgacctgggtg

SEQ ID NO: 13449 - DNA, 25 bp, Homo sapiens
gtatttcggctatggcatccggcat

SEQ ID NO: 13450 - DNA, 25 bp, Homo sapiens
gctgaactccacacactacgtggta

SEQ ID NO: 13451 - DNA, 25 bp, Homo sapiens
tacgtggtattccccaggggcagcc

SEQ ID NO: 13452 - DNA, 25 bp, Homo sapiens
aggaccctggccatatggagtagct

SEQ ID NO: 13453 - DNA, 25 bp, Homo sapiens
gcctgggtttgcaggcctgcacagg

SEQ ID NO: 13454 - DNA, 25 bp, Homo sapiens
gagtcctcaggaccttaggaccttc

SEQ ID NO: 13455 - DNA, 25 bp, Homo sapiens
ggcttcgggtcttcaggagtgggcc

SEQ ID NO: 13456 - DNA, 25 bp, Homo sapiens
gcccagagccttcttgtttatgatc

SEQ ID NO: 13457 - DNA, 25 bp, Homo sapiens
gtttatgatcagctccagctacctg

SEQ ID NO: 13458 - DNA, 25 bp, Homo sapiens
taaatcctgaccaatccaactctga

SEQ ID NO: 13459 - DNA, 25 bp, Homo sapiens
ctctcctctgcctcagtaagtatct

SEQ ID NO: 13460 - DNA, 25 bp, Homo sapiens
atgaagtcaaactgtgccacacatg

SEQ ID NO: 13461 - DNA, 25 bp, Homo sapiens
gtcacacagggcagtcattcagcac

SEQ ID NO: 13462 - DNA, 25 bp, Homo sapiens
gagcacgtgatggtctgagactctc

SEQ ID NO: 13463 - DNA, 25 bp, Homo sapiens
gagactctcttaggagcagagctct

SEQ ID NO: 13464 - DNA, 25 bp, Homo sapiens
ctctgccgcaatggccatgtgggga

SEQ ID NO: 13465 - DNA, 25 bp, Homo sapiens
gccatgtggggatccacacctggtc

SEQ ID NO: 13466 - DNA, 25 bp, Homo sapiens
gtctgaggggcaactgagtctgcgg

SEQ ID NO: 13467 - DNA, 25 bp, Homo sapiens
agcggccctatgcatggtgtagatg

SEQ ID NO: 13468 - DNA, 25 bp, Homo sapiens
gaacatctgtcctgtgaaagactca

SEQ ID NO: 13469 - DNA, 25 bp, Homo sapiens
caccagtgctctggatggtgccttc

SEQ ID NO: 13470 - DNA, 25 bp, Homo sapiens
tggtgccttctgtgtggatagcatc

SEQ ID NO: 13471 - DNA, 25 bp, Homo sapiens
gtgtggatagcatcactgcgctgaa

SEQ ID NO: 13472 - DNA, 25 bp, Homo sapiens
tgaaggccctggagcgagcaagcag

SEQ ID NO: 13473 - DNA, 25 bp, Homo sapiens
ccctcagaacacggcccaaggaaga

SEQ ID NO: 13474 - DNA, 25 bp, Homo sapiens
acacggctgagggtgatgtcctggc

SEQ ID NO: 13475 - DNA, 25 bp, Homo sapiens
ggcccatgtatggggtcacagcctc

SEQ ID NO: 13476 - DNA, 25 bp, Homo sapiens
gcctctgctaggaccaagccaagac

SEQ ID NO: 13477 - DNA, 25 bp, Homo sapiens
gaccaagccaagaccatctgctgtc

SEQ ID NO: 13478 - DNA, 25 bp, Homo sapiens
atcctgaccttggcagtagccacac

SEQ ID NO: 13479 - DNA, 25 bp, Homo sapiens
cacactgtatggactatccctggcc

SEQ ID NO: 13480 - DNA, 25 bp, Homo sapiens
aggaccacaatctcagttgcttgct

SEQ ID NO: 13481 - DNA, 25 bp, Homo sapiens
taagccaccttctactatgcaattt

SEQ ID NO: 13482 - DNA, 25 bp, Homo sapiens
taacccatttagtcatctcacagaa

SEQ ID NO: 13483 - DNA, 25 bp, Homo sapiens
gaattactctcagatgacgcttcat

SEQ ID NO: 13484 - DNA, 25 bp, Homo sapiens
gacgcttcatctgtttcacaaattc

SEQ ID NO: 13485 - DNA, 25 bp, Homo sapiens
aaactcagtcaccgcaaaatgtccc

SEQ ID NO: 13486 - DNA, 25 bp, Homo sapiens
gctgttttccaagagcttcatctcc

SEQ ID NO: 13487 - DNA, 25 bp, Homo sapiens
tcatctccatggaagtgcctgtcat

SEQ ID NO: 13488 - DNA, 25 bp, Homo sapiens
aagaagtcctgtcacctgaaggctc

SEQ ID NO: 13489 - DNA, 25 bp, Homo sapiens
tgaaggctccccttcaaaatcgcca

SEQ ID NO: 13490 - DNA, 25 bp, Homo sapiens
agaagaaattccgcactccttcttt

SEQ ID NO: 13491 - DNA, 25 bp, Homo sapiens
catcatccccattccgaagggtcag

SEQ ID NO: 13492 - DNA, 25 bp, Homo sapiens
ggtggattcacgagttgcggacaac

SEQ ID NO: 13493 - DNA, 25 bp, Homo sapiens
ttgcggacaactcctttgatgccaa

SEQ ID NO: 13494 - DNA, 25 bp, Homo sapiens
tgatgccaagcgaggtgcagccgga

SEQ ID NO: 13495 - DNA, 25 bp, Homo sapiens
ggggagagcgagccaatcaggtttt

SEQ ID NO: 13496 - DNA, 25 bp, Homo sapiens
agaagaagcggggcagctaccgggg

SEQ ID NO: 13497 - DNA, 25 bp, Homo sapiens
gctcaatctctgtccaggtcaattc

SEQ ID NO: 13498 - DNA, 25 bp, Homo sapiens
acagcgagtgacctgaggccatctt

SEQ ID NO: 13499 - DNA, 25 bp, Homo sapiens
gagactacttactttctccagtgga

SEQ ID NO: 13500 - DNA, 25 bp, Homo sapiens
ggaaccctcaggtctctaggtgagg

SEQ ID NO: 13501 - DNA, 25 bp, Homo sapiens
tacagtgtaacatcctctctggtcc

SEQ ID NO: 13502 - DNA, 25 bp, Homo sapiens
cggcaaaacaccatcctgagcagcc

SEQ ID NO: 13503 - DNA, 25 bp, Homo sapiens
cctgagcagccctatgtgaccaagg

SEQ ID NO: 13504 - DNA, 25 bp, Homo sapiens
agacgtggcggatgcatctgttcac

SEQ ID NO: 13505 - DNA, 25 bp, Homo sapiens
acggtgcctctgaggcattgccttc

SEQ ID NO: 13506 - DNA, 25 bp, Homo sapiens
tgcaggcgctggactcggaagatgc

SEQ ID NO: 13507 - DNA, 25 bp, Homo sapiens
gatgctgaaccaaacttcgatgagg

SEQ ID NO: 13508 - DNA, 25 bp, Homo sapiens
tgagctgcacatgccagtgtgaccc

SEQ ID NO: 13509 - DNA, 25 bp, Homo sapiens
cagtgtgaccctgaagacagtgccc

SEQ ID NO: 13510 - DNA, 25 bp, Homo sapiens
ccttagggattgacacctgggcctc

SEQ ID NO: 13511 - DNA, 25 bp, Homo sapiens
ggacctagagatgtgcctggaacca

SEQ ID NO: 13512 - DNA, 25 bp, Homo sapiens
accactcctgatgccatggctagag

SEQ ID NO: 13513 - DNA, 25 bp, Homo sapiens
cacactgaaagctctgttgcaatta

SEQ ID NO: 13514 - DNA, 25 bp, Homo sapiens
gaaggtctcattcttccaagctgag

SEQ ID NO: 13515 - DNA, 25 bp, Homo sapiens
gagtctagcactcattttctataac

SEQ ID NO: 13516 - DNA, 25 bp, Homo sapiens
gatatggcagcttagaggtgttggc

SEQ ID NO: 13517 - DNA, 25 bp, Homo sapiens
gttggctttgtttggatgtaatttt

SEQ ID NO: 13518 - DNA, 25 bp, Homo sapiens
atatcatatcatcacattgagctga

SEQ ID NO: 13519 - DNA, 25 bp, Homo sapiens
gctgatataaattctgtgggtccga

SEQ ID NO: 13520 - DNA, 25 bp, Homo sapiens
gtgggtccgataatatctttgtgat

SEQ ID NO: 13521 - DNA, 25 bp, Homo sapiens
gctaaccagttaccacacatctatg

SEQ ID NO: 13522 - DNA, 25 bp, Homo sapiens
taccctaatgtcttcataaagtact

SEQ ID NO: 13523 - DNA, 25 bp, Homo sapiens
gtgtaatgtttgttacctccaacag

SEQ ID NO: 13524 - DNA, 25 bp, Homo sapiens
tctcccaacctctactgtaaacttt

SEQ ID NO: 13525 - DNA, 25 bp, Homo sapiens
ctactgtaaactttctggtccgaga

SEQ ID NO: 13526 - DNA, 25 bp, Homo sapiens
tggtccgagaacgagccgaacacag

SEQ ID NO: 13527 - DNA, 25 bp, Homo sapiens
gaacacagcgcgacgcagggactag

SEQ ID NO: 13528 - DNA, 25 bp, Homo sapiens
ggtgaccgcgcggattcaggattgc

SEQ ID NO: 13529 - DNA, 25 bp, Homo sapiens
gcaaggctcctgtttatttattcta

SEQ ID NO: 13530 - DNA, 25 bp, Homo sapiens
taatcaaaacaccgcgtaggctcct

SEQ ID NO: 13531 - DNA, 25 bp, Homo sapiens
gctcctccgtttatcagtattaatg

SEQ ID NO: 13532 - DNA, 25 bp, Homo sapiens
gagtgcagcatttgtgacacgtatt

SEQ ID NO: 13533 - DNA, 25 bp, Homo sapiens
gaaatttccttctgcactgtataaa

SEQ ID NO: 13534 - DNA, 25 bp, Homo sapiens
ggatgttttgccttttgtgtatttt

SEQ ID NO: 13535 - DNA, 25 bp, Homo sapiens
aggtacccacagaagtctcagtgcc

SEQ ID NO: 13536 - DNA, 25 bp, Homo sapiens
gggcaggggaaatgtacgctgggac

SEQ ID NO: 13537 - DNA, 25 bp, Homo sapiens
acgctgggacaaggaccatctctgt

SEQ ID NO: 13538 - DNA, 25 bp, Homo sapiens
ggtcccagtaggtatcaggtctttc

SEQ ID NO: 13539 - DNA, 25 bp, Homo sapiens
ggtctttctatgcagctcagggaga

SEQ ID NO: 13540 - DNA, 25 bp, Homo sapiens
gcagtccctattagctaaaagccca

SEQ ID NO: 13541 - DNA, 25 bp, Homo sapiens
ggatcctgtccaggagcctgggggc

SEQ ID NO: 13542 - DNA, 25 bp, Homo sapiens
gatgttccagggcccagaggggaag

SEQ ID NO: 13543 - DNA, 25 bp, Homo sapiens
gagaggaggccaaggaacttccagg

SEQ ID NO: 13544 - DNA, 25 bp, Homo sapiens
gaaacactggagtctaagaacaccc

SEQ ID NO: 13545 - DNA, 25 bp, Homo sapiens
atgactttgaggtgcacattgttca

SEQ ID NO: 13546 - DNA, 25 bp, Homo sapiens
gagtagtgttttttctccgtggatc

SEQ ID NO: 13547 - DNA, 25 bp, Homo sapiens
ggatccagggagcatgtgtattcac

SEQ ID NO: 13548 - DNA, 25 bp, Homo sapiens
tgtgtattcacacaccatttacccc

SEQ ID NO: 13549 - DNA, 25 bp, Homo sapiens
cgttttgagccgacttctatcttgc

SEQ ID NO: 13550 - DNA, 25 bp, Homo sapiens
tcttgcaaacactctccaagtaccc

SEQ ID NO: 13551 - DNA, 25 bp, Homo sapiens
gtcttctgttcagcaccaactgtat

SEQ ID NO: 13552 - DNA, 25 bp, Homo sapiens
caattacccctgacgtgactgaaaa

SEQ ID NO: 13553 - DNA, 25 bp, Homo sapiens
acaagacgggcctggatatctacga

SEQ ID NO: 13554 - DNA, 25 bp, Homo sapiens
caatgggaaaaccttctcctgcttt

SEQ ID NO: 13555 - DNA, 25 bp, Homo sapiens
gatttgacaccctcagatgtgatgt

SEQ ID NO: 13556 - DNA, 25 bp, Homo sapiens
atacctcagatacgggctgggcaaa

SEQ ID NO: 13557 - DNA, 25 bp, Homo sapiens
aaccttggatttaccagactgtctt

SEQ ID NO: 13558 - DNA, 25 bp, Homo sapiens
gactgtcttttcactgtttgtgggt

SEQ ID NO: 13559 - DNA, 25 bp, Homo sapiens
cttctatacaagtactcactccctt

SEQ ID NO: 13560 - DNA, 25 bp, Homo sapiens
atacaagtactcactccctttttat

SEQ ID NO: 13561 - DNA, 25 bp, Homo sapiens
aatctcacagtctacattgtgctac

SEQ ID NO: 13562 - DNA, 25 bp, Homo sapiens
attgtgctacattatccagcttctt

SEQ ID NO: 13563 - DNA, 25 bp, Homo sapiens
ccagcttctttggaacaatgtgtgc

SEQ ID NO: 13564 - DNA, 25 bp, Homo sapiens
atgtgtgctctgtatggtttttttt

SEQ ID NO: 13565 - DNA, 25 bp, Homo sapiens
atgacaactaattaagcaactgaca

SEQ ID NO: 13566 - DNA, 25 bp, Homo sapiens
gcaactgacattgaactgagaattc

SEQ ID NO: 13567 - DNA, 25 bp, Homo sapiens
tttagttttgtggctgggcattcag

SEQ ID NO: 13568 - DNA, 25 bp, Homo sapiens
tgctctgaccgtgtgggtggtgatc

SEQ ID NO: 13569 - DNA, 25 bp, Homo sapiens
tgtcaggatgtacagtccttgctcc

SEQ ID NO: 13570 - DNA, 25 bp, Homo sapiens
cctgtccctgactattgagtcctgt

SEQ ID NO: 13571 - DNA, 25 bp, Homo sapiens
acagcccattgcagcactgtgctgg

SEQ ID NO: 13572 - DNA, 25 bp, Homo sapiens
gccctgccactgttgctagtcaggg

SEQ ID NO: 13573 - DNA, 25 bp, Homo sapiens
ttgctagtcaggggcttggttctcc

SEQ ID NO: 13574 - DNA, 25 bp, Homo sapiens
ttctcccacttacactgttgacatc

SEQ ID NO: 13575 - DNA, 25 bp, Homo sapiens
taagcagttgaaggttccccaccat

SEQ ID NO: 13576 - DNA, 25 bp, Homo sapiens
ccagcctctgctggtagcatgtcgc

SEQ ID NO: 13577 - DNA, 25 bp, Homo sapiens
atgtcgcagtttccatgtgtttcag

SEQ ID NO: 13578 - DNA, 25 bp, Homo sapiens
tgtgtttcaggatcttcgggctgtc

SEQ ID NO: 13579 - DNA, 25 bp, Homo sapiens
gcctgtgtcttcgggctgaatttga

SEQ ID NO: 13580 - DNA, 25 bp, Homo sapiens
gtgtcttcgggctgaatttgatctg

SEQ ID NO: 13581 - DNA, 25 bp, Homo sapiens
tgaatttgatctggccatcccaggg

SEQ ID NO: 13582 - DNA, 25 bp, Homo sapiens
agtcccctgatggcagccagaagac

SEQ ID NO: 13583 - DNA, 25 bp, Homo sapiens
tgatggcagccagaagacgtctcta

SEQ ID NO: 13584 - DNA, 25 bp, Homo sapiens
ggcagccagaagacgtctctagtgt

SEQ ID NO: 13585 - DNA, 25 bp, Homo sapiens
gccagaagacgtctctagtgttgcg

SEQ ID NO: 13586 - DNA, 25 bp, Homo sapiens
gaagacgtctctagtgttgcgaaca

SEQ ID NO: 13587 - DNA, 25 bp, Homo sapiens
gtctctagtgttgcgaacactctgt

SEQ ID NO: 13588 - DNA, 25 bp, Homo sapiens
tgtgcacttgtatgttttgtaaact

SEQ ID NO: 13589 - DNA, 25 bp, Homo sapiens
ttgtaaacttggcatctgtaaaaat

SEQ ID NO: 13590 - DNA, 25 bp, Homo sapiens
agatgcaccatgcatgctcacagtc

SEQ ID NO: 13591 - DNA, 25 bp, Homo sapiens
cacagtcccttgcctatgtgtggca

SEQ ID NO: 13592 - DNA, 25 bp, Homo sapiens
ctatgtgtggcagagtgtcccagcc

SEQ ID NO: 13593 - DNA, 25 bp, Homo sapiens
cccaccccatgtccatttacatgtc

SEQ ID NO: 13594 - DNA, 25 bp, Homo sapiens
aatgcccacctcaaaaggtacctct

SEQ ID NO: 13595 - DNA, 25 bp, Homo sapiens
caaaaggtacctcttctgtaaagct

SEQ ID NO: 13596 - DNA, 25 bp, Homo sapiens
ttctgtaaagctttccctggtatca

SEQ ID NO: 13597 - DNA, 25 bp, Homo sapiens
atcagggatcttttcacactgctgt

SEQ ID NO: 13598 - DNA, 25 bp, Homo sapiens
tttggtccttctatcactaaaactc

SEQ ID NO: 13599 - DNA, 25 bp, Homo sapiens
ctcatctcattcagccttacagcat

SEQ ID NO: 13600 - DNA, 25 bp, Homo sapiens
atttgttttcctcactacattgtac

SEQ ID NO: 13601 - DNA, 25 bp, Homo sapiens
ggatcatcgccatcagtttgttggt

SEQ ID NO: 13602 - DNA, 25 bp, Homo sapiens
ttgttggtgggaatcctcatcttcc

SEQ ID NO: 13603 - DNA, 25 bp, Homo sapiens
tctggaagatgggcttctttcgccg

SEQ ID NO: 13604 - DNA, 25 bp, Homo sapiens
cacaccagtcacatgacctgatcac

SEQ ID NO: 13605 - DNA, 25 bp, Homo sapiens
atgacctgatcactagcctgtcatc

SEQ ID NO: 13606 - DNA, 25 bp, Homo sapiens
tctccagatttttcggaggccccac

SEQ ID NO: 13607 - DNA, 25 bp, Homo sapiens
ttcattctatcaagcccaggtgcca

SEQ ID NO: 13608 - DNA, 25 bp, Homo sapiens
gcaccacttcgctttaaagactctg

SEQ ID NO: 13609 - DNA, 25 bp, Homo sapiens
taggatgcaacacgcatggtcaccc

SEQ ID NO: 13610 - DNA, 25 bp, Homo sapiens
gcatggtcaccctcaggggaaaact

SEQ ID NO: 13611 - DNA, 25 bp, Homo sapiens
tcactcaagcactgattctggccta

SEQ ID NO: 13612 - DNA, 25 bp, Homo sapiens
cgtgtaccccgtgtttgtgaatgag

SEQ ID NO: 13613 - DNA, 25 bp, Homo sapiens
aagtattcgctgctgtttacattag

SEQ ID NO: 13614 - DNA, 25 bp, Homo sapiens
cttccagcttacatcttacacggtg

SEQ ID NO: 13615 - DNA, 25 bp, Homo sapiens
acacggtgtcttacaaattctgcta

SEQ ID NO: 13616 - DNA, 25 bp, Homo sapiens
aattctgctagtctgtaagctcctt

SEQ ID NO: 13617 - DNA, 25 bp, Homo sapiens
ggttgtgccttattcaactgcatac

SEQ ID NO: 13618 - DNA, 25 bp, Homo sapiens
actgcatacatagctcctagcacag

SEQ ID NO: 13619 - DNA, 25 bp, Homo sapiens
gatacttgggtagctcaacattctt

SEQ ID NO: 13620 - DNA, 25 bp, Homo sapiens
agaaattgctgctatcatccatcct

SEQ ID NO: 13621 - DNA, 25 bp, Homo sapiens
aagacgatcccactgggcggagact

SEQ ID NO: 13622 - DNA, 25 bp, Homo sapiens
tgggcggagactgtaccgtgtaccc

SEQ ID NO: 13623 - DNA, 25 bp, Homo sapiens
ggtggaagtccaagtcaaacgcaga

SEQ ID NO: 13624 - DNA, 25 bp, Homo sapiens
acgcagaaggactgcctcactgagc

SEQ ID NO: 13625 - DNA, 25 bp, Homo sapiens
caagagtgtcagttgtacccgaggc

SEQ ID NO: 13626 - DNA, 25 bp, Homo sapiens
ggcgttctcagcagcagcaagtacc

SEQ ID NO: 13627 - DNA, 25 bp, Homo sapiens
gcaagtacctgtggtggatttccag

SEQ ID NO: 13628 - DNA, 25 bp, Homo sapiens
ggatttccaggctgaactgaggcag

SEQ ID NO: 13629 - DNA, 25 bp, Homo sapiens
ggcaggcattcttagctgagacacc

SEQ ID NO: 13630 - DNA, 25 bp, Homo sapiens
atgcctgacgcatctgtctgaggag

SEQ ID NO: 13631 - DNA, 25 bp, Homo sapiens
gaggagcggtcagtgacgcgatgga

SEQ ID NO: 13632 - DNA, 25 bp, Homo sapiens
gacgcgatggagcgggcaagggatc

SEQ ID NO: 13633 - DNA, 25 bp, Homo sapiens
gggatcgcttacacctgagacgaac

SEQ ID NO: 13634 - DNA, 25 bp, Homo sapiens
ctcagtgctggcccagaacaggttt

SEQ ID NO: 13635 - DNA, 25 bp, Homo sapiens
ggcccagaacaggtttctcctggag

SEQ ID NO: 13636 - DNA, 25 bp, Homo sapiens
gtttctcctggagctacagataagc

SEQ ID NO: 13637 - DNA, 25 bp, Homo sapiens
caacaggctggaggatgcgggcgtg

SEQ ID NO: 13638 - DNA, 25 bp, Homo sapiens
gttggccgactgcgatgtgagtgac

SEQ ID NO: 13639 - DNA, 25 bp, Homo sapiens
gccgactgcgatgtgagtgacagca

SEQ ID NO: 13640 - DNA, 25 bp, Homo sapiens
tcagcaacaactgcctgggggacgc

SEQ ID NO: 13641 - DNA, 25 bp, Homo sapiens
ctggtcctgtacgacatttactggt

SEQ ID NO: 13642 - DNA, 25 bp, Homo sapiens
ctcaccctgcatatcctaggtttga

SEQ ID NO: 13643 - DNA, 25 bp, Homo sapiens
agagaaacgctcagatccgcttatt

SEQ ID NO: 13644 - DNA, 25 bp, Homo sapiens
aacgctcagatccgcttatttctgc

SEQ ID NO: 13645 - DNA, 25 bp, Homo sapiens
aataatgtatcacctctttccagaa

SEQ ID NO: 13646 - DNA, 25 bp, Homo sapiens
gttactgtaattgggcctggctcac

SEQ ID NO: 13647 - DNA, 25 bp, Homo sapiens
gatgctttcgccaactgaaactact

SEQ ID NO: 13648 - DNA, 25 bp, Homo sapiens
aggatcctgtgtgtgttcaaactca

SEQ ID NO: 13649 - DNA, 25 bp, Homo sapiens
gcacgaggatgttctcagctctggc

SEQ ID NO: 13650 - DNA, 25 bp, Homo sapiens
cttggctctggatgtggcctagata

SEQ ID NO: 13651 - DNA, 25 bp, Homo sapiens
agcaccctttctttgtacagtgggg

SEQ ID NO: 13652 - DNA, 25 bp, Homo sapiens
gtcacagctgcttagtacaaccatc

SEQ ID NO: 13653 - DNA, 25 bp, Homo sapiens
gactgactggaatcaagctgccgac

SEQ ID NO: 13654 - DNA, 25 bp, Homo sapiens
gctttctccatccagattgtgacgg

SEQ ID NO: 13655 - DNA, 25 bp, Homo sapiens
ttgtgacggttgctacctggatcca

SEQ ID NO: 13656 - DNA, 25 bp, Homo sapiens
gcacagcttgcaaaggatattgcca

SEQ ID NO: 13657 - DNA, 25 bp, Homo sapiens
gatattgccaggagaagcaaaactt

SEQ ID NO: 13658 - DNA, 25 bp, Homo sapiens
gatgtataataataggccctcttgg

SEQ ID NO: 13659 - DNA, 25 bp, Homo sapiens
aataataggccctcttggaacaagt

SEQ ID NO: 13660 - DNA, 25 bp, Homo sapiens
ggaacaagtcttgcttttcgaacat

SEQ ID NO: 13661 - DNA, 25 bp, Homo sapiens
gtcttgcttttcgaacatggtataa

SEQ ID NO: 13662 - DNA, 25 bp, Homo sapiens
catggtataatagccttgtttgtgt

SEQ ID NO: 13663 - DNA, 25 bp, Homo sapiens
atagccttgtttgtgttagcaaagt

SEQ ID NO: 13664 - DNA, 25 bp, Homo sapiens
aaagtggaatctatcagcattgttg

SEQ ID NO: 13665 - DNA, 25 bp, Homo sapiens
ggaatctatcagcattgttgaaatg

SEQ ID NO: 13666 - DNA, 25 bp, Homo sapiens
aaatctaaatgtcaattttctacaa

SEQ ID NO: 13667 - DNA, 25 bp, Homo sapiens
ctgccccttaagtgtcggtgaatag

SEQ ID NO: 13668 - DNA, 25 bp, Homo sapiens
gctggaggccggaatctcagccagc

SEQ ID NO: 13669 - DNA, 25 bp, Homo sapiens
tgagacagagtttcgctttgtcgcc

SEQ ID NO: 13670 - DNA, 25 bp, Homo sapiens
tgcaatgcacgatctcagttcactg

SEQ ID NO: 13671 - DNA, 25 bp, Homo sapiens
cctctgcctcctaagttcaggcgat

SEQ ID NO: 13672 - DNA, 25 bp, Homo sapiens
tgcctcagcttcccgagtaactgag

SEQ ID NO: 13673 - DNA, 25 bp, Homo sapiens
taactgagattacaggcacccacca

SEQ ID NO: 13674 - DNA, 25 bp, Homo sapiens
ccatgcccagctgcttttttgtatt

SEQ ID NO: 13675 - DNA, 25 bp, Homo sapiens
gagattacagacatgagcctccgcg

SEQ ID NO: 13676 - DNA, 25 bp, Homo sapiens
tcttcactctgaatcctcatgaggc

SEQ ID NO: 13677 - DNA, 25 bp, Homo sapiens
acaactagcgcctgggcagggcagg

SEQ ID NO: 13678 - DNA, 25 bp, Homo sapiens
tggagcgtgcaccctataagggaga

SEQ ID NO: 13679 - DNA, 25 bp, Homo sapiens
agaagtcgccacactgaaatccaga

SEQ ID NO: 13680 - DNA, 25 bp, Homo sapiens
tgccacagcagggaccaggaaacag

SEQ ID NO: 13681 - DNA, 25 bp, Homo sapiens
acccctgaagtgtgtgccatcggta

SEQ ID NO: 13682 - DNA, 25 bp, Homo sapiens
ttcacagccaaacattgtcaaccca

SEQ ID NO: 13683 - DNA, 25 bp, Homo sapiens
gtcaacccatggagaagcaggcctt

SEQ ID NO: 13684 - DNA, 25 bp, Homo sapiens
agaagcaggccttattcaactccct

SEQ ID NO: 13685 - DNA, 25 bp, Homo sapiens
ttcaactccctaggatcctttagaa

SEQ ID NO: 13686 - DNA, 25 bp, Homo sapiens
aaattcaccactataggcttctttg

SEQ ID NO: 13687 - DNA, 25 bp, Homo sapiens
gcttgtactagatttcttacttaga

SEQ ID NO: 13688 - DNA, 25 bp, Homo sapiens
aaaatagctctgtgattttactttt

SEQ ID NO: 13689 - DNA, 25 bp, Homo sapiens
tgtctgcggggttccagactgctga

SEQ ID NO: 13690 - DNA, 25 bp, Homo sapiens
tccagactgctgaggaactcctaga

SEQ ID NO: 13691 - DNA, 25 bp, Homo sapiens
agaggtgaaaccctccgagcttagc

SEQ ID NO: 13692 - DNA, 25 bp, Homo sapiens
atatgctggtacatctgagtcacac

SEQ ID NO: 13693 - DNA, 25 bp, Homo sapiens
gtacagcactggaacttcttgagca

SEQ ID NO: 13694 - DNA, 25 bp, Homo sapiens
gatgcgcgggaagacgttccgcttt

SEQ ID NO: 13695 - DNA, 25 bp, Homo sapiens
acttcttgagcaggagcatacccag

SEQ ID NO: 13696 - DNA, 25 bp, Homo sapiens
gcatacccagggcttcataatcacc

SEQ ID NO: 13697 - DNA, 25 bp, Homo sapiens
tcataatcaccttctgttcagcact

SEQ ID NO: 13698 - DNA, 25 bp, Homo sapiens
aatgcagcgggatttggtgagtttc

SEQ ID NO: 13699 - DNA, 25 bp, Homo sapiens
gtctccagcggtgcgggtgaagctg

SEQ ID NO: 13700 - DNA, 25 bp, Homo sapiens
ctgagcatactcaacaaaacccatg

SEQ ID NO: 13701 - DNA, 25 bp, Homo sapiens
aaacccatgcatttcataaactaat

SEQ ID NO: 13702 - DNA, 25 bp, Homo sapiens
gaatctatttcacttattttggctg

SEQ ID NO: 13703 - DNA, 25 bp, Homo sapiens
attttggctgtggtttccatctgaa

SEQ ID NO: 13704 - DNA, 25 bp, Homo sapiens
ttgtatacaccatatactgttcttc

SEQ ID NO: 13705 - DNA, 25 bp, Homo sapiens
agtgtacgattcttaaccatggagt

SEQ ID NO: 13706 - DNA, 25 bp, Homo sapiens
aaacataaagccacaactcctacat

SEQ ID NO: 13707 - DNA, 25 bp, Homo sapiens
gccacaactcctacatgatgttatg

SEQ ID NO: 13708 - DNA, 25 bp, Homo sapiens
gttatgtaccatatgatctgttttg

SEQ ID NO: 13709 - DNA, 25 bp, Homo sapiens
attatttatttctggtaactcactc

SEQ ID NO: 13710 - DNA, 25 bp, Homo sapiens
ggtaactcactcagtttatgctgtg

SEQ ID NO: 13711 - DNA, 25 bp, Homo sapiens
ctcccaaatttagttcctcatcaca

SEQ ID NO: 13712 - DNA, 25 bp, Homo sapiens
atcccggctgctgcatttaggtgga

SEQ ID NO: 13713 - DNA, 25 bp, Homo sapiens
ttaggtggagacttcttcccattcc

SEQ ID NO: 13714 - DNA, 25 bp, Homo sapiens
tttagggggttggtatctcgtgctc

SEQ ID NO: 13715 - DNA, 25 bp, Homo sapiens
gaggacccaatctataggagcagtg

SEQ ID NO: 13716 - DNA, 25 bp, Homo sapiens
tggtcgcttacatcactttactcca

SEQ ID NO: 13717 - DNA, 25 bp, Homo sapiens
actttactccataagcgcttcagtg

SEQ ID NO: 13718 - DNA, 25 bp, Homo sapiens
tcagtggggttatcctagtggctct

SEQ ID NO: 13719 - DNA, 25 bp, Homo sapiens
catgtcttactgatctaaccctaaa

SEQ ID NO: 13720 - DNA, 25 bp, Homo sapiens
aatccaactcatttatacttttatt

SEQ ID NO: 13721 - DNA, 25 bp, Homo sapiens
caacatgctgtgctccatagctggt

SEQ ID NO: 13722 - DNA, 25 bp, Homo sapiens
catggtgacaggtctggaccccgag

SEQ ID NO: 13723 - DNA, 25 bp, Homo sapiens
gaagttgatcagcctgcacacagtg

SEQ ID NO: 13724 - DNA, 25 bp, Homo sapiens
cacacagtggagcttcgggggaacc

SEQ ID NO: 13725 - DNA, 25 bp, Homo sapiens
agcaccctgggaatcaatcttccta

SEQ ID NO: 13726 - DNA, 25 bp, Homo sapiens
ctaagctgaagaacctctacctggc

SEQ ID NO: 13727 - DNA, 25 bp, Homo sapiens
ctacctggcccaaaacatgctgaag

SEQ ID NO: 13728 - DNA, 25 bp, Homo sapiens
gaggatctgagcaatctcaccacct

SEQ ID NO: 13729 - DNA, 25 bp, Homo sapiens
accttgcatcttcgagacaaccaga

SEQ ID NO: 13730 - DNA, 25 bp, Homo sapiens
atcattgcagtacctcaacctgagg

SEQ ID NO: 13731 - DNA, 25 bp, Homo sapiens
tcagacctgatcagactcccagggg

SEQ ID NO: 13732 - DNA, 25 bp, Homo sapiens
ggaaattcatcacaacctgaggccc

SEQ ID NO: 13733 - DNA, 25 bp, Homo sapiens
atgatgaggtggtctaccctacctg

SEQ ID NO: 13734 - DNA, 25 bp, Homo sapiens
ccctacctggctccatgaagatgcc

SEQ ID NO: 13735 - DNA, 25 bp, Homo sapiens
cagggaggcgagcacgccatcttga

SEQ ID NO: 13736 - DNA, 25 bp, Homo sapiens
gccatcttgagacatccttttttta

SEQ ID NO: 13737 - DNA, 25 bp, Homo sapiens
ttaaggaaatcgactgggcccagct

SEQ ID NO: 13738 - DNA, 25 bp, Homo sapiens
gaaccatcgccaaatagaaccgcct

SEQ ID NO: 13739 - DNA, 25 bp, Homo sapiens
tcagacccagaatcaaatcccgaga

SEQ ID NO: 13740 - DNA, 25 bp, Homo sapiens
agaaacttttcctatgtgtctccag

SEQ ID NO: 13741 - DNA, 25 bp, Homo sapiens
gtgtctccagaattgcaaccatagc

SEQ ID NO: 13742 - DNA, 25 bp, Homo sapiens
ccaggaatttcctctatcggacctt

SEQ ID NO: 13743 - DNA, 25 bp, Homo sapiens
cttcccagcatcagccttagaacaa

SEQ ID NO: 13744 - DNA, 25 bp, Homo sapiens
cgccgtggggaagacatgcttgctg

SEQ ID NO: 13745 - DNA, 25 bp, Homo sapiens
cttgctgatcagctacacgaccaac

SEQ ID NO: 13746 - DNA, 25 bp, Homo sapiens
cccaccgtttttgacaactactctg

SEQ ID NO: 13747 - DNA, 25 bp, Homo sapiens
gacaactactctgccaacgtgatgg

SEQ ID NO: 13748 - DNA, 25 bp, Homo sapiens
gaaaccagtcaacttggggctgtgg

SEQ ID NO: 13749 - DNA, 25 bp, Homo sapiens
gtcaggaggactacgatcggctgcg

SEQ ID NO: 13750 - DNA, 25 bp, Homo sapiens
ggcctccttcgagaatgttcgtgcc

SEQ ID NO: 13751 - DNA, 25 bp, Homo sapiens
gccaagtggtacccggaggtgcggc

SEQ ID NO: 13752 - DNA, 25 bp, Homo sapiens
gacaaggacaccattgagcggctgc

SEQ ID NO: 13753 - DNA, 25 bp, Homo sapiens
ggctgcgggacaagaagctggcacc

SEQ ID NO: 13754 - DNA, 25 bp, Homo sapiens
tggcccgggagattggctctgtgaa

SEQ ID NO: 13755 - DNA, 25 bp, Homo sapiens
cacctgagaggggactctcgttgcc

SEQ ID NO: 13756 - DNA, 25 bp, Homo sapiens
cctgagaggggactctcgttgccac

SEQ ID NO: 13757 - DNA, 25 bp, Homo sapiens
catcccaaggcatccatcagagcag

SEQ ID NO: 13758 - DNA, 25 bp, Homo sapiens
tcccaaggcatccatcagagcagac

SEQ ID NO: 13759 - DNA, 25 bp, Homo sapiens
aaggcatccatcagagcagacgccc

SEQ ID NO: 13760 - DNA, 25 bp, Homo sapiens
ccggtgctctcagaaacctcagagc

SEQ ID NO: 13761 - DNA, 25 bp, Homo sapiens
cagagctggtggggctccagatcag

SEQ ID NO: 13762 - DNA, 25 bp, Homo sapiens
agagctggtggggctccagatcagg

SEQ ID NO: 13763 - DNA, 25 bp, Homo sapiens
cccagcctggaatgtaaatcagctg

SEQ ID NO: 13764 - DNA, 25 bp, Homo sapiens
gcctggaatgtaaatcagctgtgtg

SEQ ID NO: 13765 - DNA, 25 bp, Homo sapiens
gtggctggaaggaaatagacccttt

SEQ ID NO: 13766 - DNA, 25 bp, Homo sapiens
gccagagaacattccctttgaagcc

SEQ ID NO: 13767 - DNA, 25 bp, Homo sapiens
ttttctctgacttctgctgacagtg

SEQ ID NO: 13768 - DNA, 25 bp, Homo sapiens
gactgccttgtaggtaagcctgtgg

SEQ ID NO: 13769 - DNA, 25 bp, Homo sapiens
ggcatttttccgtaagcattgagtg

SEQ ID NO: 13770 - DNA, 25 bp, Homo sapiens
aaaagttccttcgtgtattgctctc

SEQ ID NO: 13771 - DNA, 25 bp, Homo sapiens
tccgcagcccggttttgaccggatg

SEQ ID NO: 13772 - DNA, 25 bp, Homo sapiens
accggatggtgcttctaattttctg

SEQ ID NO: 13773 - DNA, 25 bp, Homo sapiens
aattttctgctaacctgtactgtgg

SEQ ID NO: 13774 - DNA, 25 bp, Homo sapiens
tatatttcttgccaacacgccagaa

SEQ ID NO: 13775 - DNA, 25 bp, Homo sapiens
gattttgggcctgcttaaaccactt

SEQ ID NO: 13776 - DNA, 25 bp, Homo sapiens
aaagtcttctggagaaagcccgcca

SEQ ID NO: 13777 - DNA, 25 bp, Homo sapiens
actagtacttctgggagagtccgct

SEQ ID NO: 13778 - DNA, 25 bp, Homo sapiens
ggagagtccgctgttggcaaatcaa

SEQ ID NO: 13779 - DNA, 25 bp, Homo sapiens
aatcaagcctagtgcttcgttttgt

SEQ ID NO: 13780 - DNA, 25 bp, Homo sapiens
agtaccattggggctgcttttctaa

SEQ ID NO: 13781 - DNA, 25 bp, Homo sapiens
gcttttctaacccaaactgtatgtc

SEQ ID NO: 13782 - DNA, 25 bp, Homo sapiens
gataccatagcctagcaccaatgta

SEQ ID NO: 13783 - DNA, 25 bp, Homo sapiens
agaggagcacaagcagccatagttg

SEQ ID NO: 13784 - DNA, 25 bp, Homo sapiens
gaggcaagcaagtcctaacattgta

SEQ ID NO: 13785 - DNA, 25 bp, Homo sapiens
gggaaacaaggccgacctagcaaat

SEQ ID NO: 13786 - DNA, 25 bp, Homo sapiens
tggagacatccgctaaaacatcaat

SEQ ID NO: 13787 - DNA, 25 bp, Homo sapiens
acccacacaaccaaccaggaatcag

SEQ ID NO: 13788 - DNA, 25 bp, Homo sapiens
ctcgctccttctggtatatgcatgt

SEQ ID NO: 13789 - DNA, 25 bp, Homo sapiens
ggtatatgcatgtcactgcatgata

SEQ ID NO: 13790 - DNA, 25 bp, Homo sapiens
gcatgataattgagttttcctttgt

SEQ ID NO: 13791 - DNA, 25 bp, Homo sapiens
gttgccaaaaggttgtgctatccag

SEQ ID NO: 13792 - DNA, 25 bp, Homo sapiens
aaaaggttgtgctatccagattttt

SEQ ID NO: 13793 - DNA, 25 bp, Homo sapiens
atccagattttttatatgtctgcat

SEQ ID NO: 13794 - DNA, 25 bp, Homo sapiens
aatgcactctaacttatgtgaactg

SEQ ID NO: 13795 - DNA, 25 bp, Homo sapiens
ggaaaacctatggggaatgatattt

SEQ ID NO: 13796 - DNA, 25 bp, Homo sapiens
tatttcttggatttatagtacctta

SEQ ID NO: 13797 - DNA, 25 bp, Homo sapiens
ttcatttgctcctttgtcatattgt

SEQ ID NO: 13798 - DNA, 25 bp, Homo sapiens
atgttgtaccatttgcactgtgagc

SEQ ID NO: 13799 - DNA, 25 bp, Homo sapiens
gcacattgctgaagatgccgaccgc

SEQ ID NO: 13800 - DNA, 25 bp, Homo sapiens
ttgctgaagatgccgaccgcaaata

SEQ ID NO: 13801 - DNA, 25 bp, Homo sapiens
tggcccgtaagctggtcatcattga

SEQ ID NO: 13802 - DNA, 25 bp, Homo sapiens
gtcatcattgagagcgacctggaac

SEQ ID NO: 13803 - DNA, 25 bp, Homo sapiens
gcgacctggaacgtgcagaggagcg

SEQ ID NO: 13804 - DNA, 25 bp, Homo sapiens
agaggagcgggctgagctctcagaa

SEQ ID NO: 13805 - DNA, 25 bp, Homo sapiens
ggaagagatcaaggtcctttccgac

SEQ ID NO: 13806 - DNA, 25 bp, Homo sapiens
caaggtcctttccgacaagctgaag

SEQ ID NO: 13807 - DNA, 25 bp, Homo sapiens
aaggaggctgagactcgggctgagt

SEQ ID NO: 13808 - DNA, 25 bp, Homo sapiens
gagactcgggctgagtttgcggaga

SEQ ID NO: 13809 - DNA, 25 bp, Homo sapiens
gtttgcggagaggtcagtaactaaa

SEQ ID NO: 13810 - DNA, 25 bp, Homo sapiens
ctctcttagcatcctgccttagagc

SEQ ID NO: 13811 - DNA, 25 bp, Homo sapiens
ccttagagccaggcacacactgtgc

SEQ ID NO: 13812 - DNA, 25 bp, Homo sapiens
gcacacactgtgctttctattgtac

SEQ ID NO: 13813 - DNA, 25 bp, Homo sapiens
ttgtacagaagctcttcgtttcagt

SEQ ID NO: 13814 - DNA, 25 bp, Homo sapiens
ggcaaatgtgccgagcttgaagaag

SEQ ID NO: 13815 - DNA, 25 bp, Homo sapiens
aagtcactggaggctcaggctgaga

SEQ ID NO: 13816 - DNA, 25 bp, Homo sapiens
ggctcaggctgagaagtactcgcag

SEQ ID NO: 13817 - DNA, 25 bp, Homo sapiens
gaagacgagctgtacgctcagaaac

SEQ ID NO: 13818 - DNA, 25 bp, Homo sapiens
accacgctctcaacgatatgacttc

SEQ ID NO: 13819 - DNA, 25 bp, Homo sapiens
ctctctgagctctgcatttgtctat

SEQ ID NO: 13820 - DNA, 25 bp, Homo sapiens
tgcatttgtctattctccagctgac

SEQ ID NO: 13821 - DNA, 25 bp, Homo sapiens
gatggtcttggattgtctgacctca

SEQ ID NO: 13822 - DNA, 25 bp, Homo sapiens
gtctgacctcagtagctattaaata

SEQ ID NO: 13823 - DNA, 25 bp, Homo sapiens
gtaacatctgtatcaggccctacat

SEQ ID NO: 13824 - DNA, 25 bp, Homo sapiens
tcaggccctacatagaacatacagt

SEQ ID NO: 13825 - DNA, 25 bp, Homo sapiens
gttaatggctgttcgagagaaatcg

SEQ ID NO: 13826 - DNA, 25 bp, Homo sapiens
gagtaaacatcaatgctcagagtta

SEQ ID NO: 13827 - DNA, 25 bp, Homo sapiens
gaaagagcaactgaagtcctagaaa

SEQ ID NO: 13828 - DNA, 25 bp, Homo sapiens
ttgagtcagaccagtaagcccgtcc

SEQ ID NO: 13829 - DNA, 25 bp, Homo sapiens
ccgtcctgggttccttgaacatgtt

SEQ ID NO: 13830 - DNA, 25 bp, Homo sapiens
tgggttccttgaacatgttcccatg

SEQ ID NO: 13831 - DNA, 25 bp, Homo sapiens
aaccaattctggaagtgtctatgaa

SEQ ID NO: 13832 - DNA, 25 bp, Homo sapiens
aaatttgcactctattccaaccagt

SEQ ID NO: 13833 - DNA, 25 bp, Homo sapiens
ggaattggtcagcccatcattgtga

SEQ ID NO: 13834 - DNA, 25 bp, Homo sapiens
gaagaaccaccagctaagagacaat

SEQ ID NO: 13835 - DNA, 25 bp, Homo sapiens
tgctttgccgcagtcatccaaaata

SEQ ID NO: 13836 - DNA, 25 bp, Homo sapiens
gtgcgtagtattttcattttgttta

SEQ ID NO: 13837 - DNA, 25 bp, Homo sapiens
gtttggaaactcttctacatcagta

SEQ ID NO: 13838 - DNA, 25 bp, Homo sapiens
gctgccttagctgaagcatctgctc

SEQ ID NO: 13839 - DNA, 25 bp, Homo sapiens
ctgctccattgtccaattcttcaga

SEQ ID NO: 13840 - DNA, 25 bp, Homo sapiens
gaaactccagtagtggccacagaag

SEQ ID NO: 13841 - DNA, 25 bp, Homo sapiens
gaatctgtggatggtgccattcagc

SEQ ID NO: 13842 - DNA, 25 bp, Homo sapiens
gttcagggggtcagcaagtcatcac

SEQ ID NO: 13843 - DNA, 25 bp, Homo sapiens
ctgttcgagccgcattctggagaag

SEQ ID NO: 13844 - DNA, 25 bp, Homo sapiens
gtgatgaggaccacatcgctcacat

SEQ ID NO: 13845 - DNA, 25 bp, Homo sapiens
agcttctgggggacatccccccagc

SEQ ID NO: 13846 - DNA, 25 bp, Homo sapiens
cggagaggagagctgcggcacatcc

SEQ ID NO: 13847 - DNA, 25 bp, Homo sapiens
gcacatccacaatctcaagcactgg

SEQ ID NO: 13848 - DNA, 25 bp, Homo sapiens
caagcactggggcctgtacgaggta

SEQ ID NO: 13849 - DNA, 25 bp, Homo sapiens
aaaagtacgagtggcccctagagca

SEQ ID NO: 13850 - DNA, 25 bp, Homo sapiens
cagctctccgtgccttaagggaaaa

SEQ ID NO: 13851 - DNA, 25 bp, Homo sapiens
gttctccacaaccacagggcagaga

SEQ ID NO: 13852 - DNA, 25 bp, Homo sapiens
ggcagagagacgctggagccaggcc

SEQ ID NO: 13853 - DNA, 25 bp, Homo sapiens
gctctcagagcgtgttctgcctgag

SEQ ID NO: 13854 - DNA, 25 bp, Homo sapiens
gatgctgcatctaaggtcacggaac

SEQ ID NO: 13855 - DNA, 25 bp, Homo sapiens
ggaaccagcgccagagtgaacaagt

SEQ ID NO: 13856 - DNA, 25 bp, Homo sapiens
acaaccgggcatccgaggaggcttt

SEQ ID NO: 13857 - DNA, 25 bp, Homo sapiens
ggagaaggtggcccagctatgtgac

SEQ ID NO: 13858 - DNA, 25 bp, Homo sapiens
gctatgtgacttcaaccccaagagc

SEQ ID NO: 13859 - DNA, 25 bp, Homo sapiens
aagcagtgcaaagatgtgtcccgcc

SEQ ID NO: 13860 - DNA, 25 bp, Homo sapiens
tgctcatgtccctgaagcagacgcc

SEQ ID NO: 13861 - DNA, 25 bp, Homo sapiens
ctaggtgcctgctaggtgcatggcc

SEQ ID NO: 13862 - DNA, 25 bp, Homo sapiens
cacagagcatgggctgggcctgggc

SEQ ID NO: 13863 - DNA, 25 bp, Homo sapiens
tggagactcgcagcagctgctaccc

SEQ ID NO: 13864 - DNA, 25 bp, Homo sapiens
gtctactcaattgtgactgtccctc

SEQ ID NO: 13865 - DNA, 25 bp, Homo sapiens
ggctatttctgtatgatccaataac

SEQ ID NO: 13866 - DNA, 25 bp, Homo sapiens
gtcacagggcttaatttgccatttt

SEQ ID NO: 13867 - DNA, 25 bp, Homo sapiens
gccatttttggggatttgtcgactc

SEQ ID NO: 13868 - DNA, 25 bp, Homo sapiens
gtcgactcattttgtctgaattttc

SEQ ID NO: 13869 - DNA, 25 bp, Homo sapiens
gtattatgtcactagctacctgata

SEQ ID NO: 13870 - DNA, 25 bp, Homo sapiens
ggctatttcccttataactcaatag

SEQ ID NO: 13871 - DNA, 25 bp, Homo sapiens
gtttagatgccttaactgtgccaca

SEQ ID NO: 13872 - DNA, 25 bp, Homo sapiens
gtctatttctcacagcatattttca

SEQ ID NO: 13873 - DNA, 25 bp, Homo sapiens
cagattacttgtgggtatacctacc

SEQ ID NO: 13874 - DNA, 25 bp, Homo sapiens
gttttctcattcacagcattagcat

SEQ ID NO: 13875 - DNA, 25 bp, Homo sapiens
gcattagcatattcagcaaatccat

SEQ ID NO: 13876 - DNA, 25 bp, Homo sapiens
ccttcccttccggataataatgcct

SEQ ID NO: 13877 - DNA, 25 bp, Homo sapiens
ttcccttccggataataatgccttg

SEQ ID NO: 13878 - DNA, 25 bp, Homo sapiens
cttccggataataatgccttgtttg

SEQ ID NO: 13879 - DNA, 25 bp, Homo sapiens
ataatgccttgtttgtaaccgctgc

SEQ ID NO: 13880 - DNA, 25 bp, Homo sapiens
aatgccttgtttgtaaccgctgcac

SEQ ID NO: 13881 - DNA, 25 bp, Homo sapiens
acctctgggttgccatctagtgtaa

SEQ ID NO: 13882 - DNA, 25 bp, Homo sapiens
tctgggttgccatctagtgtaagat

SEQ ID NO: 13883 - DNA, 25 bp, Homo sapiens
atgtgcagtctcatggggagaggct

SEQ ID NO: 13884 - DNA, 25 bp, Homo sapiens
gcagtctcatggggagaggcttctt

SEQ ID NO: 13885 - DNA, 25 bp, Homo sapiens
tcatggggagaggcttctttcgttt

SEQ ID NO: 13886 - DNA, 25 bp, Homo sapiens
tttcgtttcctcgtcaaacatctga

SEQ ID NO: 13887 - DNA, 25 bp, Homo sapiens
atcaatcagctttgctcacaaacta

SEQ ID NO: 13888 - DNA, 25 bp, Homo sapiens
gtgaatggggtgtttgaggtacata

SEQ ID NO: 13889 - DNA, 25 bp, Homo sapiens
ggaagtggtggtgcatggacgactg

SEQ ID NO: 13890 - DNA, 25 bp, Homo sapiens
ggaataccggggagttgagatctgt

SEQ ID NO: 13891 - DNA, 25 bp, Homo sapiens
gagatctgtaattcatagtcacatc

SEQ ID NO: 13892 - DNA, 25 bp, Homo sapiens
agaaagacatactcaatcctgattc

SEQ ID NO: 13893 - DNA, 25 bp, Homo sapiens
ctaaaatctggatgtcattgacgat

SEQ ID NO: 13894 - DNA, 25 bp, Homo sapiens
tacaacactatacatacacaccacc

SEQ ID NO: 13895 - DNA, 25 bp, Homo sapiens
tacacaccaccatatatactagctg

SEQ ID NO: 13896 - DNA, 25 bp, Homo sapiens
atactagctgttaatcctatggaat

SEQ ID NO: 13897 - DNA, 25 bp, Homo sapiens
ggcatattttgcatctacaacttct

SEQ ID NO: 13898 - DNA, 25 bp, Homo sapiens
ctactttgcctctgtgtcatatttg

SEQ ID NO: 13899 - DNA, 25 bp, Homo sapiens
gtgctttggacgatcttcagctggc

SEQ ID NO: 13900 - DNA, 25 bp, Homo sapiens
ttcagctggccaacagcaccatcat

SEQ ID NO: 13901 - DNA, 25 bp, Homo sapiens
gcaccatcattgcatttacctcgga

SEQ ID NO: 13902 - DNA, 25 bp, Homo sapiens
ttacctcggatcatggtttcctcat

SEQ ID NO: 13903 - DNA, 25 bp, Homo sapiens
tgatgagtttctacttcctctggtt

SEQ ID NO: 13904 - DNA, 25 bp, Homo sapiens
tgaaaacgtcagccagtcctttctt

SEQ ID NO: 13905 - DNA, 25 bp, Homo sapiens
tcttcctggccgttgggtatcataa

SEQ ID NO: 13906 - DNA, 25 bp, Homo sapiens
ggcaacgggaagacgtccaagcctt

SEQ ID NO: 13907 - DNA, 25 bp, Homo sapiens
tcagtgtgccgtatggtccaattcc

SEQ ID NO: 13908 - DNA, 25 bp, Homo sapiens
ccaattcctgtggactttcagcgga

SEQ ID NO: 13909 - DNA, 25 bp, Homo sapiens
gacacagatgacctctacgggagtc

SEQ ID NO: 13910 - DNA, 25 bp, Homo sapiens
aacgccaagatttagtctcaggatt

SEQ ID NO: 13911 - DNA, 25 bp, Homo sapiens
gattaaccttgcttgcacagaagtt

SEQ ID NO: 13912 - DNA, 25 bp, Homo sapiens
gaacactctcagttttttgtcatgt

SEQ ID NO: 13913 - DNA, 25 bp, Homo sapiens
tgtaagatactaacctagccaccct

SEQ ID NO: 13914 - DNA, 25 bp, Homo sapiens
gagagaacagaaagctgtccctggc

SEQ ID NO: 13915 - DNA, 25 bp, Homo sapiens
tagctacaggctgctgggggtcatc

SEQ ID NO: 13916 - DNA, 25 bp, Homo sapiens
gcagctgtacggtttcaggcagcgg

SEQ ID NO: 13917 - DNA, 25 bp, Homo sapiens
cagcggcagcgagccaggaaggagt

SEQ ID NO: 13918 - DNA, 25 bp, Homo sapiens
cttggaggagagagccgtttccaga

SEQ ID NO: 13919 - DNA, 25 bp, Homo sapiens
ggtgcagcagcaaggcggagtgtcc

SEQ ID NO: 13920 - DNA, 25 bp, Homo sapiens
aaaacagccccatcaggcttgtgtt

SEQ ID NO: 13921 - DNA, 25 bp, Homo sapiens
gaatgagtgcgtgctgggtggggtg

SEQ ID NO: 13922 - DNA, 25 bp, Homo sapiens
gacttgatgaccacacggggcagag

SEQ ID NO: 13923 - DNA, 25 bp, Homo sapiens
agcacctccgtcggaagcatttggc

SEQ ID NO: 13924 - DNA, 25 bp, Homo sapiens
acacacaccttcaatacacgtcaag

SEQ ID NO: 13925 - DNA, 25 bp, Homo sapiens
tcaatacacgtcaaggtcgcttcca

SEQ ID NO: 13926 - DNA, 25 bp, Homo sapiens
cagaaatctgcatctcagcctgaga

SEQ ID NO: 13927 - DNA, 25 bp, Homo sapiens
gagacgcacagagaggtctcttcct

SEQ ID NO: 13928 - DNA, 25 bp, Homo sapiens
cactcacgagccaggtcctgggggt

SEQ ID NO: 13929 - DNA, 25 bp, Homo sapiens
taacctgcgccagagagttcaccgt

SEQ ID NO: 13930 - DNA, 25 bp, Homo sapiens
gagagttcaccgtaggcatctttaa

SEQ ID NO: 13931 - DNA, 25 bp, Homo sapiens
catagagattccagtgcgttaccag

SEQ ID NO: 13932 - DNA, 25 bp, Homo sapiens
tgctttatatgcactgcctgggcca

SEQ ID NO: 13933 - DNA, 25 bp, Homo sapiens
gaggaaaaccagggcagcgcagtct

SEQ ID NO: 13934 - DNA, 25 bp, Homo sapiens
cctccagtggactcagcggcagaga

SEQ ID NO: 13935 - DNA, 25 bp, Homo sapiens
agacgccaccccgagaaggcaaatc

SEQ ID NO: 13936 - DNA, 25 bp, Homo sapiens
aagacatcatcattcagaccttcga

SEQ ID NO: 13937 - DNA, 25 bp, Homo sapiens
gaccttcgaaggctggctactgata

SEQ ID NO: 13938 - DNA, 25 bp, Homo sapiens
agcttcacccgacagtacaaactac

SEQ ID NO: 13939 - DNA, 25 bp, Homo sapiens
caaagatttgtctgcagtcctctgt

SEQ ID NO: 13940 - DNA, 25 bp, Homo sapiens
acatcgtatcggttcctgttcagat

SEQ ID NO: 13941 - DNA, 25 bp, Homo sapiens
gatggttcagccactggtactacga

SEQ ID NO: 13942 - DNA, 25 bp, Homo sapiens
gttggtcactgttatttgcctactg

SEQ ID NO: 13943 - DNA, 25 bp, Homo sapiens
gaaggacaaccgctggcaaggtagc

SEQ ID NO: 13944 - DNA, 25 bp, Homo sapiens
ggtagcgttccccaatctgaatacc

SEQ ID NO: 13945 - DNA, 25 bp, Homo sapiens
ccaatctgaatacctgcaggctccc

SEQ ID NO: 13946 - DNA, 25 bp, Homo sapiens
aaggcatcaacgtgtatctgtggga

SEQ ID NO: 13947 - DNA, 25 bp, Homo sapiens
gatcttcgttgccttcagtaatcag

SEQ ID NO: 13948 - DNA, 25 bp, Homo sapiens
caagaaagcctcttcttgttgccta

SEQ ID NO: 13949 - DNA, 25 bp, Homo sapiens
tgttgcctagctgagtgggagagtc

SEQ ID NO: 13950 - DNA, 25 bp, Homo sapiens
ttccccagacactacatttggatac

SEQ ID NO: 13951 - DNA, 25 bp, Homo sapiens
acaaggttgttttctaccaccatat

SEQ ID NO: 13952 - DNA, 25 bp, Homo sapiens
gaccgtgtatactcacactttgctt

SEQ ID NO: 13953 - DNA, 25 bp, Homo sapiens
acagtggttctacaatctatttatt

SEQ ID NO: 13954 - DNA, 25 bp, Homo sapiens
ggaaacagtcatttgcgcacaactt

SEQ ID NO: 13955 - DNA, 25 bp, Homo sapiens
aaaagtctgcattacattccttgat

SEQ ID NO: 13956 - DNA, 25 bp, Homo sapiens
tgttgtggtttgttgccgttgccaa

SEQ ID NO: 13957 - DNA, 25 bp, Homo sapiens
tgcagtggacatgtcgggcgggacg

SEQ ID NO: 13958 - DNA, 25 bp, Homo sapiens
gcgggacggtcacagtccttgaaaa

SEQ ID NO: 13959 - DNA, 25 bp, Homo sapiens
aggtccctgtatcaaaaggccaact

SEQ ID NO: 13960 - DNA, 25 bp, Homo sapiens
gaagcaatacttctacgagaccaag

SEQ ID NO: 13961 - DNA, 25 bp, Homo sapiens
gagaccaagtgcaatcccatgggtt

SEQ ID NO: 13962 - DNA, 25 bp, Homo sapiens
acaaaaggcattggaactcccagtg

SEQ ID NO: 13963 - DNA, 25 bp, Homo sapiens
cgggcccttaccatggatagcaaaa

SEQ ID NO: 13964 - DNA, 25 bp, Homo sapiens
ttaggcgcaatgatcgaggtcccgg

SEQ ID NO: 13965 - DNA, 25 bp, Homo sapiens
gtcccggtggtccacgtggaattgt

SEQ ID NO: 13966 - DNA, 25 bp, Homo sapiens
ctcctccaaggggtggcatggcaca

SEQ ID NO: 13967 - DNA, 25 bp, Homo sapiens
gtggcatggcacagaaacttggctc

SEQ ID NO: 13968 - DNA, 25 bp, Homo sapiens
ccgggcaaatggagggccgcttcac

SEQ ID NO: 13969 - DNA, 25 bp, Homo sapiens
ccgcttcacaggacagcgtcgctga

SEQ ID NO: 13970 - DNA, 25 bp, Homo sapiens
tcgctgaagctccactgttggcaaa

SEQ ID NO: 13971 - DNA, 25 bp, Homo sapiens
ggcaaagtcttggcagtggtacatt

SEQ ID NO: 13972 - DNA, 25 bp, Homo sapiens
tattcatcgtgtttgcattcttgtt

SEQ ID NO: 13973 - DNA, 25 bp, Homo sapiens
gacacagcctttttgatcatttctt

SEQ ID NO: 13974 - DNA, 25 bp, Homo sapiens
attgaggtggacattatttccccaa

SEQ ID NO: 13975 - DNA, 25 bp, Homo sapiens
aaagcccttcatctaatatttgttg

SEQ ID NO: 13976 - DNA, 25 bp, Homo sapiens
tatacggtagttgctttagggggtg

SEQ ID NO: 13977 - DNA, 25 bp, Homo sapiens
aaatgcttgccgctttagaggtgga

SEQ ID NO: 13978 - DNA, 25 bp, Homo sapiens
tggtgctcataaaaggccccagtcg

SEQ ID NO: 13979 - DNA, 25 bp, Homo sapiens
gctagtagaatggcagcacgctgta

SEQ ID NO: 13980 - DNA, 25 bp, Homo sapiens
ttactgtattgtgtactggctataa

SEQ ID NO: 13981 - DNA, 25 bp, Homo sapiens
gtagacacctttcagtaagccaatc

SEQ ID NO: 13982 - DNA, 25 bp, Homo sapiens
aagccaatcatttgtaaccattcta

SEQ ID NO: 13983 - DNA, 25 bp, Homo sapiens
gtaaccattctagcagtgtcatatt

SEQ ID NO: 13984 - DNA, 25 bp, Homo sapiens
gcattcattgacacatagctctaat

SEQ ID NO: 13985 - DNA, 25 bp, Homo sapiens
accatacactggatgacctagtcga

SEQ ID NO: 13986 - DNA, 25 bp, Homo sapiens
gaggatcactcgattcgtgttaccc

SEQ ID NO: 13987 - DNA, 25 bp, Homo sapiens
ttcgtgttacccgttggtgcaacaa

SEQ ID NO: 13988 - DNA, 25 bp, Homo sapiens
ggaccgcgctctatgaagcagtggc

SEQ ID NO: 13989 - DNA, 25 bp, Homo sapiens
atgacctggacttgggcattgggca

SEQ ID NO: 13990 - DNA, 25 bp, Homo sapiens
gggcattgggcagatcatcaccatc

SEQ ID NO: 13991 - DNA, 25 bp, Homo sapiens
cacatctgccagcatcggagctgct

SEQ ID NO: 13992 - DNA, 25 bp, Homo sapiens
atggtgattgtgctgagtgccgtgg

SEQ ID NO: 13993 - DNA, 25 bp, Homo sapiens
ggaccggttcaggaccatggtcaac

SEQ ID NO: 13994 - DNA, 25 bp, Homo sapiens
atggtcaacgtccttggtgatgctt

SEQ ID NO: 13995 - DNA, 25 bp, Homo sapiens
caacattgtgaatccctttgccttg

SEQ ID NO: 13996 - DNA, 25 bp, Homo sapiens
agacaagtctgacaccatctcattc

SEQ ID NO: 13997 - DNA, 25 bp, Homo sapiens
gcagcatcgacatggtagactcgcc

SEQ ID NO: 13998 - DNA, 25 bp, Homo sapiens
gctagctgacgaggtgtctgcctcc

SEQ ID NO: 13999 - DNA, 25 bp, Homo sapiens
aggtggcagtggtccgtactccacc

SEQ ID NO: 14000 - DNA, 25 bp, Homo sapiens
gtccaagatcggctccactgagaac

SEQ ID NO: 14001 - DNA, 25 bp, Homo sapiens
actgagaacctgaagcaccagccgg

SEQ ID NO: 14002 - DNA, 25 bp, Homo sapiens
gacctgagcaaggtgacctccaagt

SEQ ID NO: 14003 - DNA, 25 bp, Homo sapiens
ggctcattaggcaacatccatcata

SEQ ID NO: 14004 - DNA, 25 bp, Homo sapiens
gagtccagtcgaagattgggtccct

SEQ ID NO: 14005 - DNA, 25 bp, Homo sapiens
tccctggacaatatcacccacgtcc

SEQ ID NO: 14006 - DNA, 25 bp, Homo sapiens
cggagatcgtgtacaagtcgccagt

SEQ ID NO: 14007 - DNA, 25 bp, Homo sapiens
agtcgccagtggtgtctggggacac

SEQ ID NO: 14008 - DNA, 25 bp, Homo sapiens
gctgctggatgacagatcccttcac

SEQ ID NO: 14009 - DNA, 25 bp, Homo sapiens
tgtagaggtgggtcctgcagtggtc

SEQ ID NO: 14010 - DNA, 25 bp, Homo sapiens
agtggtctcgtgggtattactgctt

SEQ ID NO: 14011 - DNA, 25 bp, Homo sapiens
attactgcttgtgtctgattgtcct

SEQ ID NO: 14012 - DNA, 25 bp, Homo sapiens
tgtgtctgattgtcctgtattttgt

SEQ ID NO: 14013 - DNA, 25 bp, Homo sapiens
cagtaattctctttctccatagtat

SEQ ID NO: 14014 - DNA, 25 bp, Homo sapiens
gtgtcaggtcgtcctattaaccagg

SEQ ID NO: 14015 - DNA, 25 bp, Homo sapiens
aatagcaccttgacatctacaactt

SEQ ID NO: 14016 - DNA, 25 bp, Homo sapiens
gtacggggtgatcgtgtgctttgga

SEQ ID NO: 14017 - DNA, 25 bp, Homo sapiens
aggtgttcctggtaatgaaggcatg

SEQ ID NO: 14018 - DNA, 25 bp, Homo sapiens
atatctttaagtgtgctgtatgctg

SEQ ID NO: 14019 - DNA, 25 bp, Homo sapiens
agggccatcaaactcattgtcactg

SEQ ID NO: 14020 - DNA, 25 bp, Homo sapiens
cactcctagtaaccttctgcttgtg

SEQ ID NO: 14021 - DNA, 25 bp, Homo sapiens
agggccagagccatgtctatgccct

SEQ ID NO: 14022 - DNA, 25 bp, Homo sapiens
gcaaagaacgctctcctttgccgaa

SEQ ID NO: 14023 - DNA, 25 bp, Homo sapiens
ctttgccgaagtgtccgcactgtaa

SEQ ID NO: 14024 - DNA, 25 bp, Homo sapiens
aaagcagatgcaagtatccctcacc

SEQ ID NO: 14025 - DNA, 25 bp, Homo sapiens
gaaacactccaggaaatccagctct

SEQ ID NO: 14026 - DNA, 25 bp, Homo sapiens
ccagctcttactcttcaagttcaac

SEQ ID NO: 14027 - DNA, 25 bp, Homo sapiens
caagttcaaccactgttaagacctc

SEQ ID NO: 14028 - DNA, 25 bp, Homo sapiens
agacatgttcaattacttcctctct

SEQ ID NO: 14029 - DNA, 25 bp, Homo sapiens
tcacagcctctgcctatgtgctgat

SEQ ID NO: 14030 - DNA, 25 bp, Homo sapiens
cagagacagcaagacccaccttgcc

SEQ ID NO: 14031 - DNA, 25 bp, Homo sapiens
caccttgccagactgagctcagcaa

SEQ ID NO: 14032 - DNA, 25 bp, Homo sapiens
ggggtaaagaagctcctaggacagt

SEQ ID NO: 14033 - DNA, 25 bp, Homo sapiens
taggacagtatatccccctgtgtga

SEQ ID NO: 14034 - DNA, 25 bp, Homo sapiens
gatctccggagattttgctagtggc

SEQ ID NO: 14035 - DNA, 25 bp, Homo sapiens
gctagtggcgattttcatgaatgga

SEQ ID NO: 14036 - DNA, 25 bp, Homo sapiens
gtggtgatgaccatgatgtatacat

SEQ ID NO: 14037 - DNA, 25 bp, Homo sapiens
gacttgatacaaactatgacctgct

SEQ ID NO: 14038 - DNA, 25 bp, Homo sapiens
gacctgctattggaccagtcagagc

SEQ ID NO: 14039 - DNA, 25 bp, Homo sapiens
cagagctcagaagcatttaccttga

SEQ ID NO: 14040 - DNA, 25 bp, Homo sapiens
gtgtaccaaggcattcttcaattct

SEQ ID NO: 14041 - DNA, 25 bp, Homo sapiens
aataagaatcatttgctttgagttt

SEQ ID NO: 14042 - DNA, 25 bp, Homo sapiens
gaaaatacatatgcagtctagtcag

SEQ ID NO: 14043 - DNA, 25 bp, Homo sapiens
acagctagtgcttgggatcgtacat

SEQ ID NO: 14044 - DNA, 25 bp, Homo sapiens
gtgcttgggatcgtacatgttaatt

SEQ ID NO: 14045 - DNA, 25 bp, Homo sapiens
gcatttccaaagtagcatcttgcta

SEQ ID NO: 14046 - DNA, 25 bp, Homo sapiens
gcatcttgctagacctagatgagtc

SEQ ID NO: 14047 - DNA, 25 bp, Homo sapiens
aagtgacaattgtagagtcctcaat

SEQ ID NO: 14048 - DNA, 25 bp, Homo sapiens
ggaaaaccatggattctgaaagtta

SEQ ID NO: 14049 - DNA, 25 bp, Homo sapiens
aaatttagttgttctccccaatgtg

SEQ ID NO: 14050 - DNA, 25 bp, Homo sapiens
tgttctccccaatgtgtattttaat

SEQ ID NO: 14051 - DNA, 25 bp, Homo sapiens
gtattttaatttggatggcagtctc

SEQ ID NO: 14052 - DNA, 25 bp, Homo sapiens
caccatcgacctggacttcaagggc

SEQ ID NO: 14053 - DNA, 25 bp, Homo sapiens
tcaagggccagctgtgcgagctgtc

SEQ ID NO: 14054 - DNA, 25 bp, Homo sapiens
ggggagggcacatcgtgactgtgtt

SEQ ID NO: 14055 - DNA, 25 bp, Homo sapiens
tggaccccaaacagctggtcaccaa

SEQ ID NO: 14056 - DNA, 25 bp, Homo sapiens
ggaggtggacatctataccgtcaag

SEQ ID NO: 14057 - DNA, 25 bp, Homo sapiens
cccgttctgcctgcaagtgaagcgg

SEQ ID NO: 14058 - DNA, 25 bp, Homo sapiens
aagcggaatgactacgtgcacgccc

SEQ ID NO: 14059 - DNA, 25 bp, Homo sapiens
tggcctacttcaacatcgagttcac

SEQ ID NO: 14060 - DNA, 25 bp, Homo sapiens
agttcacacgctgccacaagaggac

SEQ ID NO: 14061 - DNA, 25 bp, Homo sapiens
tccccgtacacgcactggaagcaga

SEQ ID NO: 14062 - DNA, 25 bp, Homo sapiens
tggaggactacctgaccgtgaagac

SEQ ID NO: 14063 - DNA, 25 bp, Homo sapiens
gagagggcatatgcatcctctgtcc

SEQ ID NO: 14064 - DNA, 25 bp, Homo sapiens
tcctctgtcctgatctaggtgtcta

SEQ ID NO: 14065 - DNA, 25 bp, Homo sapiens
aggttgttgtagttgtcctggtgcc

SEQ ID NO: 14066 - DNA, 25 bp, Homo sapiens
tccctacttgtcccatatttgcaag

SEQ ID NO: 14067 - DNA, 25 bp, Homo sapiens
agctgaggtggcttctcattaaccc

SEQ ID NO: 14068 - DNA, 25 bp, Homo sapiens
cttgctggtgggttagtggtcctca

SEQ ID NO: 14069 - DNA, 25 bp, Homo sapiens
ggcgggcagtgaacgagtgtgggga

SEQ ID NO: 14070 - DNA, 25 bp, Homo sapiens
ccgtttggctgcactaactttggta

SEQ ID NO: 14071 - DNA, 25 bp, Homo sapiens
gagggagctaagcttgggctgggct

SEQ ID NO: 14072 - DNA, 25 bp, Homo sapiens
gctgcttggggcttggcatagggtg

SEQ ID NO: 14073 - DNA, 25 bp, Homo sapiens
tatgtgtggagggtgccctcccgtc

SEQ ID NO: 14074 - DNA, 25 bp, Homo sapiens
aagaaactgtgcaagctccctgatt

SEQ ID NO: 14075 - DNA, 25 bp, Homo sapiens
ctgatttcccgctctggagatttga

SEQ ID NO: 14076 - DNA, 25 bp, Homo sapiens
taaagtacgtagttgaggctccttt

SEQ ID NO: 14077 - DNA, 25 bp, Homo sapiens
cttcccgacacttcttggtgtgcaa

SEQ ID NO: 14078 - DNA, 25 bp, Homo sapiens
gggtacctgtagagagcttcttttt

SEQ ID NO: 14079 - DNA, 25 bp, Homo sapiens
tctttttgtttctacctggccaaag

SEQ ID NO: 14080 - DNA, 25 bp, Homo sapiens
aaaatcttaggctaccacattctat

SEQ ID NO: 14081 - DNA, 25 bp, Homo sapiens
accacattctattattgagagcctg

SEQ ID NO: 14082 - DNA, 25 bp, Homo sapiens
gcctgagatgttagccatagtggac

SEQ ID NO: 14083 - DNA, 25 bp, Homo sapiens
agccatagtggacaaggttccattc

SEQ ID NO: 14084 - DNA, 25 bp, Homo sapiens
tctctaccattctcaacctgtattg

SEQ ID NO: 14085 - DNA, 25 bp, Homo sapiens
tcatgtgctgtggccgagggtacga

SEQ ID NO: 14086 - DNA, 25 bp, Homo sapiens
agggtacgacacaactcgagtcacc

SEQ ID NO: 14087 - DNA, 25 bp, Homo sapiens
tgtggacgtccatacttgcaaagcc

SEQ ID NO: 14088 - DNA, 25 bp, Homo sapiens
aaggcagagtggctggaccagacct

SEQ ID NO: 14089 - DNA, 25 bp, Homo sapiens
taataaccgctgtggtcgcacggct

SEQ ID NO: 14090 - DNA, 25 bp, Homo sapiens
gccatggcgtgagtggttcctgtac

SEQ ID NO: 14091 - DNA, 25 bp, Homo sapiens
tggcgtgcactctcagatttccgcc

SEQ ID NO: 14092 - DNA, 25 bp, Homo sapiens
ggcgacgctatgatggggctgtgca

SEQ ID NO: 14093 - DNA, 25 bp, Homo sapiens
gatggccacccaagatggtgccaac

SEQ ID NO: 14094 - DNA, 25 bp, Homo sapiens
cccggactgatcttgtctactttga

SEQ ID NO: 14095 - DNA, 25 bp, Homo sapiens
acaactctccagattactgtgtctt

SEQ ID NO: 14096 - DNA, 25 bp, Homo sapiens
tcgtggacgcctttaatcaagcctg

SEQ ID NO: 14097 - DNA, 25 bp, Homo sapiens
tcaagcctggcatttggttgctcac

SEQ ID NO: 14098 - DNA, 25 bp, Homo sapiens
aaggctcttctgtaacatcttttgt

SEQ ID NO: 14099 - DNA, 25 bp, Homo sapiens
ggactgaggttctatgccttcaacc

SEQ ID NO: 14100 - DNA, 25 bp, Homo sapiens
ggatgggaaacagcctgtgggccgc

SEQ ID NO: 14101 - DNA, 25 bp, Homo sapiens
gccgcttctttgggaatacctgggc

SEQ ID NO: 14102 - DNA, 25 bp, Homo sapiens
gagcaccactttgagggcattgccc

SEQ ID NO: 14103 - DNA, 25 bp, Homo sapiens
ttgccctggtggagaaggccctgca

SEQ ID NO: 14104 - DNA, 25 bp, Homo sapiens
caccctccggtggatgtaccaccac

SEQ ID NO: 14105 - DNA, 25 bp, Homo sapiens
ccaccactcacagctgcagggtgcc

SEQ ID NO: 14106 - DNA, 25 bp, Homo sapiens
gagcagaacttggcagcggcagagg

SEQ ID NO: 14107 - DNA, 25 bp, Homo sapiens
aagagggcccagcaaggtaatttat

SEQ ID NO: 14108 - DNA, 25 bp, Homo sapiens
gagctgatgtcaattggttcttgtc

SEQ ID NO: 14109 - DNA, 25 bp, Homo sapiens
ttggttcttgtcttgagtcgactca

SEQ ID NO: 14110 - DNA, 25 bp, Homo sapiens
gtcgactcaatttagcccaagtgct

SEQ ID NO: 14111 - DNA, 25 bp, Homo sapiens
ttttcatcaaagacaccagggcaga

SEQ ID NO: 14112 - DNA, 25 bp, Homo sapiens
caagccatgtaatccattggttttg

SEQ ID NO: 14113 - DNA, 25 bp, Homo sapiens
aattgtacctgagttgaccatcctt

SEQ ID NO: 14114 - DNA, 25 bp, Homo sapiens
tgagttgaccatcctttctttttat

SEQ ID NO: 14115 - DNA, 25 bp, Homo sapiens
tattttgtaaagctctcacctggtt

SEQ ID NO: 14116 - DNA, 25 bp, Homo sapiens
ggcaactccagtgtatttatgtgaa

SEQ ID NO: 14117 - DNA, 25 bp, Homo sapiens
gcatattaatatgttcctccacaca

SEQ ID NO: 14118 - DNA, 25 bp, Homo sapiens
aaagcacatgtagccgctgagacct

SEQ ID NO: 14119 - DNA, 25 bp, Homo sapiens
cgacctctcaggttagaccctgggc

SEQ ID NO: 14120 - DNA, 25 bp, Homo sapiens
ctccttccctaatgctttgaggttt

SEQ ID NO: 14121 - DNA, 25 bp, Homo sapiens
ttctgcatcgacatgctcaacgcca

SEQ ID NO: 14122 - DNA, 25 bp, Homo sapiens
acgccaagctggctgtccaaaagta

SEQ ID NO: 14123 - DNA, 25 bp, Homo sapiens
atgaggagctgttcccagctttctc

SEQ ID NO: 14124 - DNA, 25 bp, Homo sapiens
gctttctctgattcccgggaatgca

SEQ ID NO: 14125 - DNA, 25 bp, Homo sapiens
aaaattgctagaggcccacgaggag

SEQ ID NO: 14126 - DNA, 25 bp, Homo sapiens
gaatgtggacagctacaccgagtcg

SEQ ID NO: 14127 - DNA, 25 bp, Homo sapiens
tgaaggaatacgactccatctcccg

SEQ ID NO: 14128 - DNA, 25 bp, Homo sapiens
caccatgctgctgcgcatcaagaag

SEQ ID NO: 14129 - DNA, 25 bp, Homo sapiens
aagagttttctttagtatagccaca

SEQ ID NO: 14130 - DNA, 25 bp, Homo sapiens
gtatagccacaaatgccttgaactg

SEQ ID NO: 14131 - DNA, 25 bp, Homo sapiens
atgccttgaactgttgtctgggatt

SEQ ID NO: 14132 - DNA, 25 bp, Homo sapiens
aggtaggactatcagttccctctaa

SEQ ID NO: 14133 - DNA, 25 bp, Homo sapiens
atcagttccctctaaatgtatatgt

SEQ ID NO: 14134 - DNA, 25 bp, Homo sapiens
ctcttgacattccactgtgcgtttt

SEQ ID NO: 14135 - DNA, 25 bp, Homo sapiens
gttttaacttttatacctatctgag

SEQ ID NO: 14136 - DNA, 25 bp, Homo sapiens
gacaacctatcatttattctgcttc

SEQ ID NO: 14137 - DNA, 25 bp, Homo sapiens
atcatttattctgcttcgagggtcc

SEQ ID NO: 14138 - DNA, 25 bp, Homo sapiens
gtacaaccgacagctcttactttta

SEQ ID NO: 14139 - DNA, 25 bp, Homo sapiens
atgcaatctcttttctacatacatt

SEQ ID NO: 14140 - DNA, 25 bp, Homo sapiens
gacagggactttgaacctaggccat

SEQ ID NO: 14141 - DNA, 25 bp, Homo sapiens
agggactttgaacctaggccatctc

SEQ ID NO: 14142 - DNA, 25 bp, Homo sapiens
aacctaggccatctcctgaggcctt

SEQ ID NO: 14143 - DNA, 25 bp, Homo sapiens
ccctcgcccatgtgggtcagtggga

SEQ ID NO: 14144 - DNA, 25 bp, Homo sapiens
gggagctgcaggtgtcagcttttcg

SEQ ID NO: 14145 - DNA, 25 bp, Homo sapiens
aggtgtcagcttttcgtctagtaac

SEQ ID NO: 14146 - DNA, 25 bp, Homo sapiens
gtcagcttttcgtctagtaacttaa

SEQ ID NO: 14147 - DNA, 25 bp, Homo sapiens
gaaagggcagcgccacagaagcccc

SEQ ID NO: 14148 - DNA, 25 bp, Homo sapiens
cccgtaatgccctcatgtgaatgtt

SEQ ID NO: 14149 - DNA, 25 bp, Homo sapiens
atgccctcatgtgaatgttcttcgg

SEQ ID NO: 14150 - DNA, 25 bp, Homo sapiens
tgttcttcgggaaatatttctgctt

SEQ ID NO: 14151 - DNA, 25 bp, Homo sapiens
tccttcagcaggtttctgagacgag

SEQ ID NO: 14152 - DNA, 25 bp, Homo sapiens
cagcagctgccacgattgaaatcca

SEQ ID NO: 14153 - DNA, 25 bp, Homo sapiens
agagagtagcaaactttttccagat

SEQ ID NO: 14154 - DNA, 25 bp, Homo sapiens
aaaatggatgtgcccacggggagcg

SEQ ID NO: 14155 - DNA, 25 bp, Homo sapiens
ggacctgcttgatggactcggagga

SEQ ID NO: 14156 - DNA, 25 bp, Homo sapiens
acaggagagtcgggtgaccgggcca

SEQ ID NO: 14157 - DNA, 25 bp, Homo sapiens
tgccatggtatgggccacaggacac

SEQ ID NO: 14158 - DNA, 25 bp, Homo sapiens
gacacacttgctcgagaaccaaagt

SEQ ID NO: 14159 - DNA, 25 bp, Homo sapiens
gcaaagaatgctctggctggttacc

SEQ ID NO: 14160 - DNA, 25 bp, Homo sapiens
tcccctgggcagaagaaacgcatgt

SEQ ID NO: 14161 - DNA, 25 bp, Homo sapiens
gcatgtggaccagaagactttccct

SEQ ID NO: 14162 - DNA, 25 bp, Homo sapiens
cctacaccaactgctctcaaaatgt

SEQ ID NO: 14163 - DNA, 25 bp, Homo sapiens
ttgccaaccctgtgtcacttagtga

SEQ ID NO: 14164 - DNA, 25 bp, Homo sapiens
agtgaggacctgacacaatccctac

SEQ ID NO: 14165 - DNA, 25 bp, Homo sapiens
atccctacagggtgtctgtcagtgg

SEQ ID NO: 14166 - DNA, 25 bp, Homo sapiens
gtcagtgggcctcatggtaagagtc

SEQ ID NO: 14167 - DNA, 25 bp, Homo sapiens
accgtgggtcatgcagcgaaggggc

SEQ ID NO: 14168 - DNA, 25 bp, Homo sapiens
cactcagctatacctcattcacagc

SEQ ID NO: 14169 - DNA, 25 bp, Homo sapiens
cacagctccttgtgagtgtgtgcac

SEQ ID NO: 14170 - DNA, 25 bp, Homo sapiens
ggagataccaccgacatttttcaat

SEQ ID NO: 14171 - DNA, 25 bp, Homo sapiens
ttgtgtctaccttgttattaacttt

SEQ ID NO: 14172 - DNA, 25 bp, Homo sapiens
aaggctatcggagcagttcaataac

SEQ ID NO: 14173 - DNA, 25 bp, Homo sapiens
tcactggcactgcccgatatgctag

SEQ ID NO: 14174 - DNA, 25 bp, Homo sapiens
tagcatcaatgcacatcttggtatt

SEQ ID NO: 14175 - DNA, 25 bp, Homo sapiens
cttggtattgagcagagtcgccgag

SEQ ID NO: 14176 - DNA, 25 bp, Homo sapiens
gagtcgccgagatgacatggaatca

SEQ ID NO: 14177 - DNA, 25 bp, Homo sapiens
tttaatagaaccagcctgccatggc

SEQ ID NO: 14178 - DNA, 25 bp, Homo sapiens
ggcaagggctaaaggctgcaacaaa

SEQ ID NO: 14179 - DNA, 25 bp, Homo sapiens
gaaaagaagatgtccacgcctgttg

SEQ ID NO: 14180 - DNA, 25 bp, Homo sapiens
gtccacgcctgttgaagttttatgt

SEQ ID NO: 14181 - DNA, 25 bp, Homo sapiens
ggggtttcctgcagaatttgcgatg

SEQ ID NO: 14182 - DNA, 25 bp, Homo sapiens
gaggaagccccagattacatgtatc

SEQ ID NO: 14183 - DNA, 25 bp, Homo sapiens
tatctgaggcagctattccgcattc

SEQ ID NO: 14184 - DNA, 25 bp, Homo sapiens
gaggtaacgaggagggcggactcca

SEQ ID NO: 14185 - DNA, 25 bp, Homo sapiens
taacgaggagggcggactccaggcc

SEQ ID NO: 14186 - DNA, 25 bp, Homo sapiens
agagatttggacttggctggcttgc

SEQ ID NO: 14187 - DNA, 25 bp, Homo sapiens
gctggcttgcaggggtcctaagaaa

SEQ ID NO: 14188 - DNA, 25 bp, Homo sapiens
gcttgcaggggtcctaagaaactcc

SEQ ID NO: 14189 - DNA, 25 bp, Homo sapiens
ggtcctaagaaactccactctggac

SEQ ID NO: 14190 - DNA, 25 bp, Homo sapiens
taagaaactccactctggacagcgc

SEQ ID NO: 14191 - DNA, 25 bp, Homo sapiens
ctaactctgcctcaaactgtacatt

SEQ ID NO: 14192 - DNA, 25 bp, Homo sapiens
ctctgcctcaaactgtacatttgga

SEQ ID NO: 14193 - DNA, 25 bp, Homo sapiens
aaactgtacatttggataagcccta

SEQ ID NO: 14194 - DNA, 25 bp, Homo sapiens
tggataagccctagtagttccctgg

SEQ ID NO: 14195 - DNA, 25 bp, Homo sapiens
tgtgggagtactctcatcactacag

SEQ ID NO: 14196 - DNA, 25 bp, Homo sapiens
agtggactcagtgggttaacatcag

SEQ ID NO: 14197 - DNA, 25 bp, Homo sapiens
atcagttttgtttactcatcctcca

SEQ ID NO: 14198 - DNA, 25 bp, Homo sapiens
tcatcctccaggaactgcaggtcaa

SEQ ID NO: 14199 - DNA, 25 bp, Homo sapiens
gactttaggaatggttctctcaaca

SEQ ID NO: 14200 - DNA, 25 bp, Homo sapiens
tgtctcaaggcagttaattctcatt

SEQ ID NO: 14201 - DNA, 25 bp, Homo sapiens
taatactcttattatcctatttctg

SEQ ID NO: 14202 - DNA, 25 bp, Homo sapiens
gggaggatgtacgtggccatgtatg

SEQ ID NO: 14203 - DNA, 25 bp, Homo sapiens
tcagatatactggaacccttttaaa

SEQ ID NO: 14204 - DNA, 25 bp, Homo sapiens
gttgtaccaaaattcatctgtctat

SEQ ID NO: 14205 - DNA, 25 bp, Homo sapiens
ggggaacatggtttgactcatctta

SEQ ID NO: 14206 - DNA, 25 bp, Homo sapiens
tcccatctaagcattccacactgca

SEQ ID NO: 14207 - DNA, 25 bp, Homo sapiens
aggagtggtacttaagctcccctgc

SEQ ID NO: 14208 - DNA, 25 bp, Homo sapiens
gaccaacctgacctaacctaggagg

SEQ ID NO: 14209 - DNA, 25 bp, Homo sapiens
aggagggctctgagccaaccttgct

SEQ ID NO: 14210 - DNA, 25 bp, Homo sapiens
gccaaccttgctcttggggaagggg

SEQ ID NO: 14211 - DNA, 25 bp, Homo sapiens
cctatatctggagtgagaggccccc

SEQ ID NO: 14212 - DNA, 25 bp, Homo sapiens
tcctgccttcttccttgaggggcag

SEQ ID NO: 14213 - DNA, 25 bp, Homo sapiens
gactgagttcaggttaccagaacca

SEQ ID NO: 14214 - DNA, 25 bp, Homo sapiens
gcatactgagaatctaggccacccc

SEQ ID NO: 14215 - DNA, 25 bp, Homo sapiens
acccagttcttcatttggaggaatc

SEQ ID NO: 14216 - DNA, 25 bp, Homo sapiens
ggaatcaccccatttcagagttatc

SEQ ID NO: 14217 - DNA, 25 bp, Homo sapiens
gctccttgcacttggaacagggctc

SEQ ID NO: 14218 - DNA, 25 bp, Homo sapiens
ggtggagcagtaaggcactacccag

SEQ ID NO: 14219 - DNA, 25 bp, Homo sapiens
cactacccagagagcttgctgctgc

SEQ ID NO: 14220 - DNA, 25 bp, Homo sapiens
ataacgtgcggtcatacctttcttc

SEQ ID NO: 14221 - DNA, 25 bp, Homo sapiens
ggccagcggtgagagccgtgttagc

SEQ ID NO: 14222 - DNA, 25 bp, Homo sapiens
aaagcttgttgactctagcggctca

SEQ ID NO: 14223 - DNA, 25 bp, Homo sapiens
tctttctgtgaatatctccgtgctg

SEQ ID NO: 14224 - DNA, 25 bp, Homo sapiens
tctccgtgctgaccatgctggaatt

SEQ ID NO: 14225 - DNA, 25 bp, Homo sapiens
ggatgattctgcaattcgggaccta

SEQ ID NO: 14226 - DNA, 25 bp, Homo sapiens
gacctactgcaggggtccgtttagt

SEQ ID NO: 14227 - DNA, 25 bp, Homo sapiens
tgatctttgttcttgacctctagac

SEQ ID NO: 14228 - DNA, 25 bp, Homo sapiens
aaacctctcttagatctggaaccaa

SEQ ID NO: 14229 - DNA, 25 bp, Homo sapiens
agccaccgatccagattcattaaga

SEQ ID NO: 14230 - DNA, 25 bp, Homo sapiens
ttcattaagaccttctgacaccctg

SEQ ID NO: 14231 - DNA, 25 bp, Homo sapiens
acaccctgcgagaagtcactgttac

SEQ ID NO: 14232 - DNA, 25 bp, Homo sapiens
ggggccccttgatctgtaaaggtgt

SEQ ID NO: 14233 - DNA, 25 bp, Homo sapiens
aaaggtgtcttccacgctatagtct

SEQ ID NO: 14234 - DNA, 25 bp, Homo sapiens
gtggtgttgccacaaagcctggaat

SEQ ID NO: 14235 - DNA, 25 bp, Homo sapiens
ggaatctacaccctgttaaccaaga

SEQ ID NO: 14236 - DNA, 25 bp, Homo sapiens
tggatcaaaagcaaccttgtcccgc

SEQ ID NO: 14237 - DNA, 25 bp, Homo sapiens
gtcccgcctcatacaaattaagtta

SEQ ID NO: 14238 - DNA, 25 bp, Homo sapiens
tatggggtccatttttgcacttgta

SEQ ID NO: 14239 - DNA, 25 bp, Homo sapiens
tcaagttcatgtcacgctgggtaat

SEQ ID NO: 14240 - DNA, 25 bp, Homo sapiens
accgaggaggtggcgttcctttgag

SEQ ID NO: 14241 - DNA, 25 bp, Homo sapiens
atgtattcaactgcaccaagacctc

SEQ ID NO: 14242 - DNA, 25 bp, Homo sapiens
accaagacctcgtgttgagacctcc

SEQ ID NO: 14243 - DNA, 25 bp, Homo sapiens
attgcccatatcacgtctttacgca

SEQ ID NO: 14244 - DNA, 25 bp, Homo sapiens
agacctgaagctgtattccctagag

SEQ ID NO: 14245 - DNA, 25 bp, Homo sapiens
acaacaccaaccacgaggctgatga

SEQ ID NO: 14246 - DNA, 25 bp, Homo sapiens
cgtccccagcagagaacccaaagac

SEQ ID NO: 14247 - DNA, 25 bp, Homo sapiens
aagacatgacgacgttccgcagtgc

SEQ ID NO: 14248 - DNA, 25 bp, Homo sapiens
gtgcctagacacactggggacatcg

SEQ ID NO: 14249 - DNA, 25 bp, Homo sapiens
gagccactatggaacaccatgccaa

SEQ ID NO: 14250 - DNA, 25 bp, Homo sapiens
tacctcaatctcatcaactactaca

SEQ ID NO: 14251 - DNA, 25 bp, Homo sapiens
ccagtacatcctcacactgtcagag

SEQ ID NO: 14252 - DNA, 25 bp, Homo sapiens
gccatgagcgggccatgctcaagcg

SEQ ID NO: 14253 - DNA, 25 bp, Homo sapiens
tgcggatcgactccaagtgtctgca

SEQ ID NO: 14254 - DNA, 25 bp, Homo sapiens
gcacttcactcccaaggactggagc

SEQ ID NO: 14255 - DNA, 25 bp, Homo sapiens
gaagtggtgaccagacactgcccac

SEQ ID NO: 14256 - DNA, 25 bp, Homo sapiens
tgcccactgcagtgccaagacggca

SEQ ID NO: 14257 - DNA, 25 bp, Homo sapiens
gaccaactccaaggtcagctggcca

SEQ ID NO: 14258 - DNA, 25 bp, Homo sapiens
agggagccaggcagctgtgtacagt

SEQ ID NO: 14259 - DNA, 25 bp, Homo sapiens
gatccggatgggggagctctgtaca

SEQ ID NO: 14260 - DNA, 25 bp, Homo sapiens
ggctgcaaaaatttctggcttctct

SEQ ID NO: 14261 - DNA, 25 bp, Homo sapiens
cttgcttcatcccgttcagaagaca

SEQ ID NO: 14262 - DNA, 25 bp, Homo sapiens
aagacagctttcatgcagttttaca

SEQ ID NO: 14263 - DNA, 25 bp, Homo sapiens
gtggctgttcagtttctatttctgc

SEQ ID NO: 14264 - DNA, 25 bp, Homo sapiens
ctatttctgcttgccattggccatc

SEQ ID NO: 14265 - DNA, 25 bp, Homo sapiens
attggccatcactgcatttttttat

SEQ ID NO: 14266 - DNA, 25 bp, Homo sapiens
gcaggattctgaagctcactcttta

SEQ ID NO: 14267 - DNA, 25 bp, Homo sapiens
tgagctttctgttggtattggacta

SEQ ID NO: 14268 - DNA, 25 bp, Homo sapiens
tattggtatcaacatggcttcactg

SEQ ID NO: 14269 - DNA, 25 bp, Homo sapiens
gcttcactgaattcctgcattaacc

SEQ ID NO: 14270 - DNA, 25 bp, Homo sapiens
aaaactgctttaaggctgggccaca

SEQ ID NO: 14271 - DNA, 25 bp, Homo sapiens
ttatctgcgaatctgcttgcttcat

SEQ ID NO: 14272 - DNA, 25 bp, Homo sapiens
tgcctctctgaatctctgttatgga

SEQ ID NO: 14273 - DNA, 25 bp, Homo sapiens
tatggatcccccactatatttgatg

SEQ ID NO: 14274 - DNA, 25 bp, Homo sapiens
atgggaacccagtgagccaggggcc

SEQ ID NO: 14275 - DNA, 25 bp, Homo sapiens
agccaggggccagttttgacagggt

SEQ ID NO: 14276 - DNA, 25 bp, Homo sapiens
ttgacagggtagcatcacgcccaca

SEQ ID NO: 14277 - DNA, 25 bp, Homo sapiens
gctacctcccacgtgaggatgtggt

SEQ ID NO: 14278 - DNA, 25 bp, Homo sapiens
tactgtggagtggtgggcttccttg

SEQ ID NO: 14279 - DNA, 25 bp, Homo sapiens
tctttctggtttgaacttgctcgga

SEQ ID NO: 14280 - DNA, 25 bp, Homo sapiens
gagaccaattacaggccgtctctct

SEQ ID NO: 14281 - DNA, 25 bp, Homo sapiens
ccgtctctctgcacagcacagaaat

SEQ ID NO: 14282 - DNA, 25 bp, Homo sapiens
gattgtactgttctcatgctataaa

SEQ ID NO: 14283 - DNA, 25 bp, Homo sapiens
tctgcatggtaactccgtctgagtc

SEQ ID NO: 14284 - DNA, 25 bp, Homo sapiens
gcatggtaactccgtctgagtctac

SEQ ID NO: 14285 - DNA, 25 bp, Homo sapiens
ggtaactccgtctgagtctaccatt

SEQ ID NO: 14286 - DNA, 25 bp, Homo sapiens
aactccgtctgagtctaccattttc

SEQ ID NO: 14287 - DNA, 25 bp, Homo sapiens
cctttacccagctcttggggtgtct

SEQ ID NO: 14288 - DNA, 25 bp, Homo sapiens
tttacccagctcttggggtgtctct

SEQ ID NO: 14289 - DNA, 25 bp, Homo sapiens
cagccttatctcaaggaggtgacac

SEQ ID NO: 14290 - DNA, 25 bp, Homo sapiens
caaggaggtgacaccttctctcctt

SEQ ID NO: 14291 - DNA, 25 bp, Homo sapiens
cctgctggtcctatggggggaaggc

SEQ ID NO: 14292 - DNA, 25 bp, Homo sapiens
gctggtcctatggggggaaggctac

SEQ ID NO: 14293 - DNA, 25 bp, Homo sapiens
ctatggggggaaggctactccgcat

SEQ ID NO: 14294 - DNA, 25 bp, Homo sapiens
atagcagctgctgccgtgtcattat

SEQ ID NO: 14295 - DNA, 25 bp, Homo sapiens
gccgtgtcattatgcaaagcctctg

SEQ ID NO: 14296 - DNA, 25 bp, Homo sapiens
gctgcagcatttacatctgccctaa

SEQ ID NO: 14297 - DNA, 25 bp, Homo sapiens
tctgccctaatcagaggggccacct

SEQ ID NO: 14298 - DNA, 25 bp, Homo sapiens
ggctggagtctggactggctgagat

SEQ ID NO: 14299 - DNA, 25 bp, Homo sapiens
taagagcctggcaaccagcaagagc

SEQ ID NO: 14300 - DNA, 25 bp, Homo sapiens
gggctgtatttggagatcatgggct

SEQ ID NO: 14301 - DNA, 25 bp, Homo sapiens
attccatgttcttgggcaacagtcc

SEQ ID NO: 14302 - DNA, 25 bp, Homo sapiens
ggcctgggatgtttctgaactttgg

SEQ ID NO: 14303 - DNA, 25 bp, Homo sapiens
ctctgctctcaggctgaaatctggc

SEQ ID NO: 14304 - DNA, 25 bp, Homo sapiens
aaatctggcatcatctcaggttccc

SEQ ID NO: 14305 - DNA, 25 bp, Homo sapiens
ggaccctgaactcagactctacaga

SEQ ID NO: 14306 - DNA, 25 bp, Homo sapiens
ctctacagattgccctccaagtgag

SEQ ID NO: 14307 - DNA, 25 bp, Homo sapiens
cctccaagtgaggacttggctcccc

SEQ ID NO: 14308 - DNA, 25 bp, Homo sapiens
atggcattttacaaactgtgaccgt

SEQ ID NO: 14309 - DNA, 25 bp, Homo sapiens
aactgtgaccgtttctgtgtgaaga

SEQ ID NO: 14310 - DNA, 25 bp, Homo sapiens
gtgaccgtttctgtgtgaagatttt

SEQ ID NO: 14311 - DNA, 25 bp, Homo sapiens
ttagctgtatttgtggtctctgtat

SEQ ID NO: 14312 - DNA, 25 bp, Homo sapiens
ctgtatttgtggtctctgtatttat

SEQ ID NO: 14313 - DNA, 25 bp, Homo sapiens
tatatttatgtttagcaccgtcagt

SEQ ID NO: 14314 - DNA, 25 bp, Homo sapiens
gtttagcaccgtcagtgttcctatc

SEQ ID NO: 14315 - DNA, 25 bp, Homo sapiens
gtgttcctatccaatttcaaaaaag

SEQ ID NO: 14316 - DNA, 25 bp, Homo sapiens
tcatcatcccttttgcttatggtag

SEQ ID NO: 14317 - DNA, 25 bp, Homo sapiens
gggctaacataacagcccctttctc

SEQ ID NO: 14318 - DNA, 25 bp, Homo sapiens
cccctttctcaagcagagacctggc

SEQ ID NO: 14319 - DNA, 25 bp, Homo sapiens
ggcctatcttagccagctggagctt

SEQ ID NO: 14320 - DNA, 25 bp, Homo sapiens
ccagccatctttgctcacatggaaa

SEQ ID NO: 14321 - DNA, 25 bp, Homo sapiens
tgccattcaaaggccactggtgctt

SEQ ID NO: 14322 - DNA, 25 bp, Homo sapiens
tcccaaccaccactgtaattttcaa

SEQ ID NO: 14323 - DNA, 25 bp, Homo sapiens
cacacacgcatttgcacagacacac

SEQ ID NO: 14324 - DNA, 25 bp, Homo sapiens
taatctctggtgggggcaagtgtct

SEQ ID NO: 14325 - DNA, 25 bp, Homo sapiens
aaggcctgaggggcacttcagatga

SEQ ID NO: 14326 - DNA, 25 bp, Homo sapiens
gagaggtagggagccaggtgcagca

SEQ ID NO: 14327 - DNA, 25 bp, Homo sapiens
gaagggtctctgatttcttgagcat

SEQ ID NO: 14328 - DNA, 25 bp, Homo sapiens
gaagccaaattctgtccaagtatta

SEQ ID NO: 14329 - DNA, 25 bp, Homo sapiens
gagagttccagttctaatagtcttt

SEQ ID NO: 14330 - DNA, 25 bp, Homo sapiens
aatggctgtattgttgctattccgt

SEQ ID NO: 14331 - DNA, 25 bp, Homo sapiens
gctattccgttgctgacatgttttt

SEQ ID NO: 14332 - DNA, 25 bp, Homo sapiens
aaagctttaacattcctgctactaa

SEQ ID NO: 14333 - DNA, 25 bp, Homo sapiens
gcggagagtgtttgccaggtttcaa

SEQ ID NO: 14334 - DNA, 25 bp, Homo sapiens
aggtttcaatgtgggctgcagcttt

SEQ ID NO: 14335 - DNA, 25 bp, Homo sapiens
ctccttctctggtttgcagtgtaat

SEQ ID NO: 14336 - DNA, 25 bp, Homo sapiens
gattatgcctcttatctacttgaga

SEQ ID NO: 14337 - DNA, 25 bp, Homo sapiens
gagagcaacatgtcttttcaatcat

SEQ ID NO: 14338 - DNA, 25 bp, Homo sapiens
caattttgtgttcttggtattctta

SEQ ID NO: 14339 - DNA, 25 bp, Homo sapiens
ggtattcttagtctagctcacctca

SEQ ID NO: 14340 - DNA, 25 bp, Homo sapiens
agctcacctcaatagccttgaatcc

SEQ ID NO: 14341 - DNA, 25 bp, Homo sapiens
aatagccttgaatcctgcatatgaa

SEQ ID NO: 14342 - DNA, 25 bp, Homo sapiens
tagacattcatcactggcatattta

SEQ ID NO: 14343 - DNA, 25 bp, Homo sapiens
ttttctatgtttcaaagtgttctaa

SEQ ID NO: 14344 - DNA, 25 bp, Homo sapiens
gatggtgttgacttctgactctaaa

SEQ ID NO: 14345 - DNA, 25 bp, Homo sapiens
gacagtgaccaagaattatagtacc

SEQ ID NO: 14346 - DNA, 25 bp, Homo sapiens
cgctccgtactttacacactgggac

SEQ ID NO: 14347 - DNA, 25 bp, Homo sapiens
tactgggaacgctgcggactgcatc

SEQ ID NO: 14348 - DNA, 25 bp, Homo sapiens
cccagcgcggtgatgtggctgcggt

SEQ ID NO: 14349 - DNA, 25 bp, Homo sapiens
gttcaagaaggtgtctcctaggggc

SEQ ID NO: 14350 - DNA, 25 bp, Homo sapiens
tcctaggggcagcctgaatgcctcc

SEQ ID NO: 14351 - DNA, 25 bp, Homo sapiens
gacagaggggcacgtctgggcagaa

SEQ ID NO: 14352 - DNA, 25 bp, Homo sapiens
gattccttcataaaactctagcatt

SEQ ID NO: 14353 - DNA, 25 bp, Homo sapiens
ctgaacatacagagcccacatttcc

SEQ ID NO: 14354 - DNA, 25 bp, Homo sapiens
cccacatttccacaccagaactgga

SEQ ID NO: 14355 - DNA, 25 bp, Homo sapiens
gaaggggtcaccccagcatgagtgc

SEQ ID NO: 14356 - DNA, 25 bp, Homo sapiens
ggggccgaacgcttgtaattggaat

SEQ ID NO: 14357 - DNA, 25 bp, Homo sapiens
aatatttgtcttctcaggcctatgt

SEQ ID NO: 14358 - DNA, 25 bp, Homo sapiens
ctcaggcctatgtttgcggaatgca

SEQ ID NO: 14359 - DNA, 25 bp, Homo sapiens
ggtactaagcacagaaactcactat

SEQ ID NO: 14360 - DNA, 25 bp, Homo sapiens
ctccttcctgtcacctgggaatgga

SEQ ID NO: 14361 - DNA, 25 bp, Homo sapiens
ccagaagcattttccctctgcaaaa

SEQ ID NO: 14362 - DNA, 25 bp, Homo sapiens
tctgcaaaatgacgtttcttcccac

SEQ ID NO: 14363 - DNA, 25 bp, Homo sapiens
cctcctatacccacctgtaaggtga

SEQ ID NO: 14364 - DNA, 25 bp, Homo sapiens
taaggtgaaatctgctcttcttcca

SEQ ID NO: 14365 - DNA, 25 bp, Homo sapiens
ttccttcctatctatctgcaaaatg

SEQ ID NO: 14366 - DNA, 25 bp, Homo sapiens
gtgccagtacaatacatgcctcagc

SEQ ID NO: 14367 - DNA, 25 bp, Homo sapiens
tagaaggacctctagtctccttcct

SEQ ID NO: 14368 - DNA, 25 bp, Homo sapiens
actcactcatgctgtactaggtgct

SEQ ID NO: 14369 - DNA, 25 bp, Homo sapiens
gaagcctggacacccttggtgggtg

SEQ ID NO: 14370 - DNA, 25 bp, Homo sapiens
ttcctcctttgtcccaataaagtat

SEQ ID NO: 14371 - DNA, 25 bp, Homo sapiens
ggagccagcgtggtggccatagaca

SEQ ID NO: 14372 - DNA, 25 bp, Homo sapiens
acaagttcgaacaggccatggatct

SEQ ID NO: 14373 - DNA, 25 bp, Homo sapiens
gaagaactcccagctagagcgtgag

SEQ ID NO: 14374 - DNA, 25 bp, Homo sapiens
gtgagaacaccctgttgaagaccct

SEQ ID NO: 14375 - DNA, 25 bp, Homo sapiens
tgaagaccctggcaagcccagagca

SEQ ID NO: 14376 - DNA, 25 bp, Homo sapiens
tggagaagttccagtcctgtctgag

SEQ ID NO: 14377 - DNA, 25 bp, Homo sapiens
ccgtgcgcgcttgggagaaggccgg

SEQ ID NO: 14378 - DNA, 25 bp, Homo sapiens
gtctgagccctgaagagccagctcc

SEQ ID NO: 14379 - DNA, 25 bp, Homo sapiens
ggttctgcggtgtaagtcgctctgt

SEQ ID NO: 14380 - DNA, 25 bp, Homo sapiens
ggagaaggccggaagcttaccagcc

SEQ ID NO: 14381 - DNA, 25 bp, Homo sapiens
attcctagctagcttcagagccggt

SEQ ID NO: 14382 - DNA, 25 bp, Homo sapiens
ccatggcctacagcttgcagggagt

SEQ ID NO: 14383 - DNA, 25 bp, Homo sapiens
tttccagtgactccaccagtttgat

SEQ ID NO: 14384 - DNA, 25 bp, Homo sapiens
ggaagtgttagcttcctttccttct

SEQ ID NO: 14385 - DNA, 25 bp, Homo sapiens
gtcaaatccaatccagtctctaacc

SEQ ID NO: 14386 - DNA, 25 bp, Homo sapiens
gtatttaacgatcttctgcttctta

SEQ ID NO: 14387 - DNA, 25 bp, Homo sapiens
tgcttcttaaccgtaccagttttct

SEQ ID NO: 14388 - DNA, 25 bp, Homo sapiens
aagtctccacttgctgttatttaca

SEQ ID NO: 14389 - DNA, 25 bp, Homo sapiens
tgagccctgacagatgccgtatttc

SEQ ID NO: 14390 - DNA, 25 bp, Homo sapiens
gatgccgtatttctgagtgcttcca

SEQ ID NO: 14391 - DNA, 25 bp, Homo sapiens
tgagtgcttccatgtgaatgctgcc

SEQ ID NO: 14392 - DNA, 25 bp, Homo sapiens
aactagttacctttggactgcaaca

SEQ ID NO: 14393 - DNA, 25 bp, Homo sapiens
tccagcggaggccacaagtcctcct

SEQ ID NO: 14394 - DNA, 25 bp, Homo sapiens
gggcgagtcttcatctaagggacca

SEQ ID NO: 14395 - DNA, 25 bp, Homo sapiens
ttattgaagaggtggcgcccgacgg

SEQ ID NO: 14396 - DNA, 25 bp, Homo sapiens
tggcgcccgacggtagagttctttc

SEQ ID NO: 14397 - DNA, 25 bp, Homo sapiens
gagttctttcatctacggttgaatc

SEQ ID NO: 14398 - DNA, 25 bp, Homo sapiens
gaaacactactattaaactgcatga

SEQ ID NO: 14399 - DNA, 25 bp, Homo sapiens
taaactgcatgaatctcccttcaca

SEQ ID NO: 14400 - DNA, 25 bp, Homo sapiens
tcccttcacacagaccattatttac

SEQ ID NO: 14401 - DNA, 25 bp, Homo sapiens
aacacttctgtcttgatggtctatg

SEQ ID NO: 14402 - DNA, 25 bp, Homo sapiens
gtatttcttcttttcactttaccag

SEQ ID NO: 14403 - DNA, 25 bp, Homo sapiens
caactttctgttctcatttactaat

SEQ ID NO: 14404 - DNA, 25 bp, Homo sapiens
tttgacagccacagcatgttccgaa

SEQ ID NO: 14405 - DNA, 25 bp, Homo sapiens
gttgtacaacatgccctacagctac

SEQ ID NO: 14406 - DNA, 25 bp, Homo sapiens
ctacagctactctttaaatctccaa

SEQ ID NO: 14407 - DNA, 25 bp, Homo sapiens
gaatgggatgagcactcctacaaaa

SEQ ID NO: 14408 - DNA, 25 bp, Homo sapiens
aaggattccagagagctcgcttgct

SEQ ID NO: 14409 - DNA, 25 bp, Homo sapiens
gaaagtgggtccccaccagacattg

SEQ ID NO: 14410 - DNA, 25 bp, Homo sapiens
agacattgaatctgccgcatcttga

SEQ ID NO: 14411 - DNA, 25 bp, Homo sapiens
ctgccgcatcttgatactggacttc

SEQ ID NO: 14412 - DNA, 25 bp, Homo sapiens
ttattacctgtccagtatctttggt

SEQ ID NO: 14413 - DNA, 25 bp, Homo sapiens
gaaaacaccagaggccatacctaat

SEQ ID NO: 14414 - DNA, 25 bp, Homo sapiens
tgttgggaattggtactggctagaa

SEQ ID NO: 14415 - DNA, 25 bp, Homo sapiens
gcactgagggtctggtgccaatcct

SEQ ID NO: 14416 - DNA, 25 bp, Homo sapiens
gaagtttctacattctctatttttg

SEQ ID NO: 14417 - DNA, 25 bp, Homo sapiens
gatcacaggacgttgctttttcact

SEQ ID NO: 14418 - DNA, 25 bp, Homo sapiens
gctttttcactgtttcctattaatc

SEQ ID NO: 14419 - DNA, 25 bp, Homo sapiens
tcctcttacgctctgctcaatgaaa

SEQ ID NO: 14420 - DNA, 25 bp, Homo sapiens
caatgaaaccttcctcttgagggtc

SEQ ID NO: 14421 - DNA, 25 bp, Homo sapiens
gagggtcattttcctttctgtatta

SEQ ID NO: 14422 - DNA, 25 bp, Homo sapiens
ctccccttttccttcagagtgaatc

SEQ ID NO: 14423 - DNA, 25 bp, Homo sapiens
agtgaatcatccagactcctcatgg

SEQ ID NO: 14424 - DNA, 25 bp, Homo sapiens
gactcctcatggataggtcgggtgt

SEQ ID NO: 14425 - DNA, 25 bp, Homo sapiens
gagacctttgttgggaggcggtttg

SEQ ID NO: 14426 - DNA, 25 bp, Homo sapiens
gaagagggtgtcctcacactgtggc

SEQ ID NO: 14427 - DNA, 25 bp, Homo sapiens
tactcccaatccaagcagttcttac

SEQ ID NO: 14428 - DNA, 25 bp, Homo sapiens
ttcttactggactcaggctacttct

SEQ ID NO: 14429 - DNA, 25 bp, Homo sapiens
ccacttctgtgccagcatgatcagc

SEQ ID NO: 14430 - DNA, 25 bp, Homo sapiens
agcatgatcagcggtcttgtcacca

SEQ ID NO: 14431 - DNA, 25 bp, Homo sapiens
gccaagacccgaatccagaacatgc

SEQ ID NO: 14432 - DNA, 25 bp, Homo sapiens
agaacgggctggacgtgctgttcaa

SEQ ID NO: 14433 - DNA, 25 bp, Homo sapiens
gtgctgttcaaagttgtccgctacg

SEQ ID NO: 14434 - DNA, 25 bp, Homo sapiens
agcctgtggaagggcttcacgccgt

SEQ ID NO: 14435 - DNA, 25 bp, Homo sapiens
gtttcagggcacacaggacagcaga

SEQ ID NO: 14436 - DNA, 25 bp, Homo sapiens
acagcagaagatcccctttgtcagt

SEQ ID NO: 14437 - DNA, 25 bp, Homo sapiens
ggcctgatgcactcacaacacggcc

SEQ ID NO: 14438 - DNA, 25 bp, Homo sapiens
cggctggaaggcgttgtcccaggac

SEQ ID NO: 14439 - DNA, 25 bp, Homo sapiens
tggaaggcgttgtcccaggacgagc

SEQ ID NO: 14440 - DNA, 25 bp, Homo sapiens
aaggcgttgtcccaggacgagctgt

SEQ ID NO: 14441 - DNA, 25 bp, Homo sapiens
cgttgtcccaggacgagctgtgggg

SEQ ID NO: 14442 - DNA, 25 bp, Homo sapiens
gtcccaggacgagctgtgggggctg

SEQ ID NO: 14443 - DNA, 25 bp, Homo sapiens
atgcctcgacaggctgttcgtgtgc

SEQ ID NO: 14444 - DNA, 25 bp, Homo sapiens
tcgccggcggctcatgaagaggctc

SEQ ID NO: 14445 - DNA, 25 bp, Homo sapiens
gccggcggctcatgaagaggctctg

SEQ ID NO: 14446 - DNA, 25 bp, Homo sapiens
ggcggctcatgaagaggctctgccc

SEQ ID NO: 14447 - DNA, 25 bp, Homo sapiens
agcagctgcgacttctgctacgaat

SEQ ID NO: 14448 - DNA, 25 bp, Homo sapiens
gcactatggtttgttgcctacctag

SEQ ID NO: 14449 - DNA, 25 bp, Homo sapiens
ttgcctacctagctgcatctataat

SEQ ID NO: 14450 - DNA, 25 bp, Homo sapiens
gcatctataatgtcagcttatccta

SEQ ID NO: 14451 - DNA, 25 bp, Homo sapiens
gcttatcctaaggctgtccacgtac

SEQ ID NO: 14452 - DNA, 25 bp, Homo sapiens
ggctgtccacgtacttaatttactt

SEQ ID NO: 14453 - DNA, 25 bp, Homo sapiens
agtaacgtgctcactgtgtatagga

SEQ ID NO: 14454 - DNA, 25 bp, Homo sapiens
tttggaggtgcttgatctatctaca

SEQ ID NO: 14455 - DNA, 25 bp, Homo sapiens
aatgctcctagaagtcttaattgtg

SEQ ID NO: 14456 - DNA, 25 bp, Homo sapiens
ccccatcccaaggcaagcatgaata

SEQ ID NO: 14457 - DNA, 25 bp, Homo sapiens
gtggcatcgcagtctcttagaattt

SEQ ID NO: 14458 - DNA, 25 bp, Homo sapiens
ctgtctgtatctttggttatcctgt

SEQ ID NO: 14459 - DNA, 25 bp, Homo sapiens
agtctgggcctaatcatcttctgac

SEQ ID NO: 14460 - DNA, 25 bp, Homo sapiens
aatcatcttctgacagtgcactcat

SEQ ID NO: 14461 - DNA, 25 bp, Homo sapiens
gacagtgcactcatgtatacctgag

SEQ ID NO: 14462 - DNA, 25 bp, Homo sapiens
ggagcttagagtttattgcagtgta

SEQ ID NO: 14463 - DNA, 25 bp, Homo sapiens
ttaggggagcaacccatggctcaca

SEQ ID NO: 14464 - DNA, 25 bp, Homo sapiens
atggctcacaggtcactaagcgtct

SEQ ID NO: 14465 - DNA, 25 bp, Homo sapiens
aggtcactaagcgtctccaatatga

SEQ ID NO: 14466 - DNA, 25 bp, Homo sapiens
aactgtcacctctggaaatacacta

SEQ ID NO: 14467 - DNA, 25 bp, Homo sapiens
atacactagtgtgagccttcagcac

SEQ ID NO: 14468 - DNA, 25 bp, Homo sapiens
gccttcagcactgcgagaatacctt

SEQ ID NO: 14469 - DNA, 25 bp, Homo sapiens
taccttcaagtacagtatttttctt

SEQ ID NO: 14470 - DNA, 25 bp, Homo sapiens
gcccaggcagctggtggtgggcgct

SEQ ID NO: 14471 - DNA, 25 bp, Homo sapiens
tgacgcaaaataccaccttggcgcc

SEQ ID NO: 14472 - DNA, 25 bp, Homo sapiens
ctacacgggagacgacgtccgcatc

SEQ ID NO: 14473 - DNA, 25 bp, Homo sapiens
tccgcatcgtccgtgacgacatgct

SEQ ID NO: 14474 - DNA, 25 bp, Homo sapiens
catgctgtgtgccgggaacacccgg

SEQ ID NO: 14475 - DNA, 25 bp, Homo sapiens
tggtcagctggggcgagggctgtgc

SEQ ID NO: 14476 - DNA, 25 bp, Homo sapiens
cgtgtcacctactacttggactgga

SEQ ID NO: 14477 - DNA, 25 bp, Homo sapiens
ttggactggatccaccactatgtcc

SEQ ID NO: 14478 - DNA, 25 bp, Homo sapiens
atgtccccaaaaagccgtgagtcag

SEQ ID NO: 14479 - DNA, 25 bp, Homo sapiens
gtgagtcaggcctgggttggccacc

SEQ ID NO: 14480 - DNA, 25 bp, Homo sapiens
gccacctgggtcactggaggaccaa

SEQ ID NO: 14481 - DNA, 25 bp, Homo sapiens
ctccagcgtcgccgctatgaagaaa

SEQ ID NO: 14482 - DNA, 25 bp, Homo sapiens
gctccggctggaggccggactcaac

SEQ ID NO: 14483 - DNA, 25 bp, Homo sapiens
gctgcagacttgaaacagttctgtc

SEQ ID NO: 14484 - DNA, 25 bp, Homo sapiens
ttctgtctgcagaatgctcaacatg

SEQ ID NO: 14485 - DNA, 25 bp, Homo sapiens
cagaatgctcaacatgaccctctgc

SEQ ID NO: 14486 - DNA, 25 bp, Homo sapiens
gaccctctgctgactggagtatctt

SEQ ID NO: 14487 - DNA, 25 bp, Homo sapiens
gtatcttcaagtacaaatcccttca

SEQ ID NO: 14488 - DNA, 25 bp, Homo sapiens
aatcccttcagaccccagaaagtct

SEQ ID NO: 14489 - DNA, 25 bp, Homo sapiens
gagagctacatttgaagcctgtaca

SEQ ID NO: 14490 - DNA, 25 bp, Homo sapiens
gcctgtacaaaagcttatccctgta

SEQ ID NO: 14491 - DNA, 25 bp, Homo sapiens
atccctgtaacacatgtgccataat

SEQ ID NO: 14492 - DNA, 25 bp, Homo sapiens
ccccttcactcctactgggaggtgg

SEQ ID NO: 14493 - DNA, 25 bp, Homo sapiens
tactgggaggtgggacccctttcat

SEQ ID NO: 14494 - DNA, 25 bp, Homo sapiens
gttggcattactgttgttaagcact

SEQ ID NO: 14495 - DNA, 25 bp, Homo sapiens
taagcactgtgttccagaccgtgtc

SEQ ID NO: 14496 - DNA, 25 bp, Homo sapiens
ccgtgtctgacttagtgtaacctag

SEQ ID NO: 14497 - DNA, 25 bp, Homo sapiens
aaccctgattgacgcacagcagtgg

SEQ ID NO: 14498 - DNA, 25 bp, Homo sapiens
acctgtcaccgaagccaggaagccc

SEQ ID NO: 14499 - DNA, 25 bp, Homo sapiens
gaagccccgtttgtaagcgtgtgtt

SEQ ID NO: 14500 - DNA, 25 bp, Homo sapiens
tttattgtacatcctccagtggcgt

SEQ ID NO: 14501 - DNA, 25 bp, Homo sapiens
ggttactttttgtcttattgatgga

SEQ ID NO: 14502 - DNA, 25 bp, Homo sapiens
aagcagaatctgttgtccttaatta

SEQ ID NO: 14503 - DNA, 25 bp, Homo sapiens
gtagtattgtttgtgaccctgagaa

SEQ ID NO: 14504 - DNA, 25 bp, Homo sapiens
cacagaagcctttgatattgccacc

SEQ ID NO: 14505 - DNA, 25 bp, Homo sapiens
ccaccctccagaatcctgatggtat

SEQ ID NO: 14506 - DNA, 25 bp, Homo sapiens
ttatcccccgcaaagacatcaaacc

SEQ ID NO: 14507 - DNA, 25 bp, Homo sapiens
gtatcagtacatgcctagacctggg

SEQ ID NO: 14508 - DNA, 25 bp, Homo sapiens
agcgcccaacagcgtggatgtcgat

SEQ ID NO: 14509 - DNA, 25 bp, Homo sapiens
acaggaggcagacaatgaccccacg

SEQ ID NO: 14510 - DNA, 25 bp, Homo sapiens
tgactccattcaaatctacggttat

SEQ ID NO: 14511 - DNA, 25 bp, Homo sapiens
agtcggccaccacagattcagactt

SEQ ID NO: 14512 - DNA, 25 bp, Homo sapiens
tctacagaactggggacctcgtttt

SEQ ID NO: 14513 - DNA, 25 bp, Homo sapiens
aagaactgtgtctggcgttctcaag

SEQ ID NO: 14514 - DNA, 25 bp, Homo sapiens
aatctcttctagagcacctgctatc

SEQ ID NO: 14515 - DNA, 25 bp, Homo sapiens
acctgctccaaactagtgactagga

SEQ ID NO: 14516 - DNA, 25 bp, Homo sapiens
gctgctaacagcattgcctgtgctc

SEQ ID NO: 14517 - DNA, 25 bp, Homo sapiens
tcctctcaggggcagcatgctaacg

SEQ ID NO: 14518 - DNA, 25 bp, Homo sapiens
cgacgtcctaatccaactgggagaa

SEQ ID NO: 14519 - DNA, 25 bp, Homo sapiens
gaagcctcagtggtggaattccagg

SEQ ID NO: 14520 - DNA, 25 bp, Homo sapiens
ttccaggcactgtgactgtcaagct

SEQ ID NO: 14521 - DNA, 25 bp, Homo sapiens
attgggggaatggagctggggctta

SEQ ID NO: 14522 - DNA, 25 bp, Homo sapiens
tgctccttgctgttttctgatgatt

SEQ ID NO: 14523 - DNA, 25 bp, Homo sapiens
tttctccccaactatgcatctgttg

SEQ ID NO: 14524 - DNA, 25 bp, Homo sapiens
aactatgcatctgttgtctgctcct

SEQ ID NO: 14525 - DNA, 25 bp, Homo sapiens
gaaggtggttcccatgtctatacat

SEQ ID NO: 14526 - DNA, 25 bp, Homo sapiens
ggagcgtatctgctgaggagccact

SEQ ID NO: 14527 - DNA, 25 bp, Homo sapiens
gagccactgtgcccatttttggctc

SEQ ID NO: 14528 - DNA, 25 bp, Homo sapiens
gctccttcaattccacctaatggtg

SEQ ID NO: 14529 - DNA, 25 bp, Homo sapiens
aaggtgtcttgagcatctgtccttt

SEQ ID NO: 14530 - DNA, 25 bp, Homo sapiens
ctcaggcactactgatgctccagtc

SEQ ID NO: 14531 - DNA, 25 bp, Homo sapiens
ggggaggccaaataagccctcactc

SEQ ID NO: 14532 - DNA, 25 bp, Homo sapiens
aacgctctacttcgtaaaagcatta

SEQ ID NO: 14533 - DNA, 25 bp, Homo sapiens
gtcctatggttcacatcttgtttcc

SEQ ID NO: 14534 - DNA, 25 bp, Homo sapiens
tcctcttcgtagaccgcaagttaca

SEQ ID NO: 14535 - DNA, 25 bp, Homo sapiens
agaacgtttccttttttgatgctga

SEQ ID NO: 14536 - DNA, 25 bp, Homo sapiens
ccacctgccgcacttagcaggggga

SEQ ID NO: 14537 - DNA, 25 bp, Homo sapiens
ccctcaatccttgtctggtactaga

SEQ ID NO: 14538 - DNA, 25 bp, Homo sapiens
gtctggtactagatttgctcctgtc

SEQ ID NO: 14539 - DNA, 25 bp, Homo sapiens
ggagggcgatgtgcgccctctttca

SEQ ID NO: 14540 - DNA, 25 bp, Homo sapiens
tcaccttttttcttctaggtctcca

SEQ ID NO: 14541 - DNA, 25 bp, Homo sapiens
gaggggatttgtggacctctcttgt

SEQ ID NO: 14542 - DNA, 25 bp, Homo sapiens
tggctcctagaagccccattcaata

SEQ ID NO: 14543 - DNA, 25 bp, Homo sapiens
ccccattcaatatcactactcttta

SEQ ID NO: 14544 - DNA, 25 bp, Homo sapiens
acgagtgccaaatcttttcccactt

SEQ ID NO: 14545 - DNA, 25 bp, Homo sapiens
gcaggtttggtgaaagccaccgtcc

SEQ ID NO: 14546 - DNA, 25 bp, Homo sapiens
cactcccaggagaaactcccggtgt

SEQ ID NO: 14547 - DNA, 25 bp, Homo sapiens
tccttcgtggatgcaacctcaacca

SEQ ID NO: 14548 - DNA, 25 bp, Homo sapiens
caaccatatattctacagcaccctg

SEQ ID NO: 14549 - DNA, 25 bp, Homo sapiens
ctacagcccgcatcaatgatcagcc

SEQ ID NO: 14550 - DNA, 25 bp, Homo sapiens
gccctctggcccagcagatgagtca

SEQ ID NO: 14551 - DNA, 25 bp, Homo sapiens
gagtcatctgtcactaggcagcacc

SEQ ID NO: 14552 - DNA, 25 bp, Homo sapiens
tacatgcctgcaacgtcagctatgc

SEQ ID NO: 14553 - DNA, 25 bp, Homo sapiens
agcctacttgccacagtatgcacat

SEQ ID NO: 14554 - DNA, 25 bp, Homo sapiens
gcagacgacagcggttcctgttgag

SEQ ID NO: 14555 - DNA, 25 bp, Homo sapiens
agcaggtggctgtcgagacgtctaa

SEQ ID NO: 14556 - DNA, 25 bp, Homo sapiens
tgaccattctccatatacctttcaa

SEQ ID NO: 14557 - DNA, 25 bp, Homo sapiens
caagtatcggggctctgctatcaag

SEQ ID NO: 14558 - DNA, 25 bp, Homo sapiens
gagatctttttaaatccctgctact

SEQ ID NO: 14559 - DNA, 25 bp, Homo sapiens
cacaggcattcacagaacccttctg

SEQ ID NO: 14560 - DNA, 25 bp, Homo sapiens
tacgaaactcatgttcttctccagt

SEQ ID NO: 14561 - DNA, 25 bp, Homo sapiens
tcccctgtggtttctgttggagcat

SEQ ID NO: 14562 - DNA, 25 bp, Homo sapiens
gggagggcagatccaactcagaacc

SEQ ID NO: 14563 - DNA, 25 bp, Homo sapiens
aaggagcctctggcaaatgggtgct

SEQ ID NO: 14564 - DNA, 25 bp, Homo sapiens
agaacgcgtggattctctttcatgg

SEQ ID NO: 14565 - DNA, 25 bp, Homo sapiens
agagttacctggatcagccatgctc

SEQ ID NO: 14566 - DNA, 25 bp, Homo sapiens
ggatcagccatgctcagctgtgacg

SEQ ID NO: 14567 - DNA, 25 bp, Homo sapiens
tgtctactttatcttcactgaacca

SEQ ID NO: 14568 - DNA, 25 bp, Homo sapiens
gaaccactcactctgtgtaaaggcc

SEQ ID NO: 14569 - DNA, 25 bp, Homo sapiens
gagcagctgcacatcgtgaaagact

SEQ ID NO: 14570 - DNA, 25 bp, Homo sapiens
cactggattaattttcaccggaaca

SEQ ID NO: 14571 - DNA, 25 bp, Homo sapiens
ggaacaattgcgaattctctctgcc

SEQ ID NO: 14572 - DNA, 25 bp, Homo sapiens
atcttgtccgtgtgggcacacactg

SEQ ID NO: 14573 - DNA, 25 bp, Homo sapiens
tgagtgttgagttgccgtgtggagt

SEQ ID NO: 14574 - DNA, 25 bp, Homo sapiens
taatgtatgacgctccactgtggat

SEQ ID NO: 14575 - DNA, 25 bp, Homo sapiens
ccactgtggatatctaatgccctgt

SEQ ID NO: 14576 - DNA, 25 bp, Homo sapiens
aatgccctgttgagagtagccttgc

SEQ ID NO: 14577 - DNA, 25 bp, Homo sapiens
gccttgctcagtactaaaatgcccc

SEQ ID NO: 14578 - DNA, 25 bp, Homo sapiens
gccccaaagttctatacagcatttc

SEQ ID NO: 14579 - DNA, 25 bp, Homo sapiens
ttatagcattcaaacctcacatcct

SEQ ID NO: 14580 - DNA, 25 bp, Homo sapiens
acaggtgtcaccatcatttctagta

SEQ ID NO: 14581 - DNA, 25 bp, Homo sapiens
aacttccctctagttggcaagtctc

SEQ ID NO: 14582 - DNA, 25 bp, Homo sapiens
gatgggttcatgtctctgattgggt

SEQ ID NO: 14583 - DNA, 25 bp, Homo sapiens
tggcttcctagcctaagctgggatc

SEQ ID NO: 14584 - DNA, 25 bp, Homo sapiens
agctgggatctgaataccccttctc

SEQ ID NO: 14585 - DNA, 25 bp, Homo sapiens
ccccttctctgtagctgctagtgag

SEQ ID NO: 14586 - DNA, 25 bp, Homo sapiens
tagtgagccttcccatttagattaa

SEQ ID NO: 14587 - DNA, 25 bp, Homo sapiens
taactctccagttatcagtactccc

SEQ ID NO: 14588 - DNA, 25 bp, Homo sapiens
agtactcccacaattggccagggca

SEQ ID NO: 14589 - DNA, 25 bp, Homo sapiens
tggagttcatactgatgccctgagg

SEQ ID NO: 14590 - DNA, 25 bp, Homo sapiens
aaagtgccttctgagctgtctaaaa

SEQ ID NO: 14591 - DNA, 25 bp, Homo sapiens
aggggctgaattctccaaatcggag

SEQ ID NO: 14592 - DNA, 25 bp, Homo sapiens
aatcggaggctcatacagctgacgg

SEQ ID NO: 14593 - DNA, 25 bp, Homo sapiens
tcatacagctgacgggatctccatc

SEQ ID NO: 14594 - DNA, 25 bp, Homo sapiens
gctgcacccgaatccgagatgataa

SEQ ID NO: 14595 - DNA, 25 bp, Homo sapiens
ggactggaaatctgccactaacctt

SEQ ID NO: 14596 - DNA, 25 bp, Homo sapiens
ccccaactcaaggaactgtaccagt

SEQ ID NO: 14597 - DNA, 25 bp, Homo sapiens
agatgaggggagctccactacaggg

SEQ ID NO: 14598 - DNA, 25 bp, Homo sapiens
agagaataagggtccctcagggtct

SEQ ID NO: 14599 - DNA, 25 bp, Homo sapiens
actgcaaagccttccgctatgaagg

SEQ ID NO: 14600 - DNA, 25 bp, Homo sapiens
ggccacaaagtcttctccagtgaaa

SEQ ID NO: 14601 - DNA, 25 bp, Homo sapiens
ctgctgatgagacgctgtgccaaac

SEQ ID NO: 14602 - DNA, 25 bp, Homo sapiens
tggactggtgtcgagccaagactcg

SEQ ID NO: 14603 - DNA, 25 bp, Homo sapiens
ctacgagcacgtcgacatccagaac

SEQ ID NO: 14604 - DNA, 25 bp, Homo sapiens
tctgtgccctggtgcacaacttctt

SEQ ID NO: 14605 - DNA, 25 bp, Homo sapiens
tccctgaggccttcgactatgggca

SEQ ID NO: 14606 - DNA, 25 bp, Homo sapiens
ggccttcgactatgggcagcttagc

SEQ ID NO: 14607 - DNA, 25 bp, Homo sapiens
tatgggcagcttagccctcagaacc

SEQ ID NO: 14608 - DNA, 25 bp, Homo sapiens
ctcagaaccgacgccagaacttcga

SEQ ID NO: 14609 - DNA, 25 bp, Homo sapiens
acgccagaacttcgaggtggccttc

SEQ ID NO: 14610 - DNA, 25 bp, Homo sapiens
accccaagtgtgtcttcacctatgt

SEQ ID NO: 14611 - DNA, 25 bp, Homo sapiens
gcggcaagaatgtctagcctgcccg

SEQ ID NO: 14612 - DNA, 25 bp, Homo sapiens
cccacatacacacgcagcgttttga

SEQ ID NO: 14613 - DNA, 25 bp, Homo sapiens
tcgacctgatgcagagccttctgag

SEQ ID NO: 14614 - DNA, 25 bp, Homo sapiens
aacaggaggcattctgtggccagcc

SEQ ID NO: 14615 - DNA, 25 bp, Homo sapiens
gccagccaaaaggtaccccgatggc

SEQ ID NO: 14616 - DNA, 25 bp, Homo sapiens
atggccaagcaattcctctgaacaa

SEQ ID NO: 14617 - DNA, 25 bp, Homo sapiens
gcattgttaatcatccatcacttcc

SEQ ID NO: 14618 - DNA, 25 bp, Homo sapiens
tctgcccttcagaagactcgttttt

SEQ ID NO: 14619 - DNA, 25 bp, Homo sapiens
aagcctacatgacacagttggattt

SEQ ID NO: 14620 - DNA, 25 bp, Homo sapiens
tctgcttgatcaattcccttgaata

SEQ ID NO: 14621 - DNA, 25 bp, Homo sapiens
ctcccctgtttgacgacagtgcatt

SEQ ID NO: 14622 - DNA, 25 bp, Homo sapiens
acagtgcatttgccttgtcacctgt

SEQ ID NO: 14623 - DNA, 25 bp, Homo sapiens
gtcacctgtgagctggagagaaccc

SEQ ID NO: 14624 - DNA, 25 bp, Homo sapiens
cacggccgtggacatgtggtcagtg

SEQ ID NO: 14625 - DNA, 25 bp, Homo sapiens
agctgctgactcagaagcctctgtt

SEQ ID NO: 14626 - DNA, 25 bp, Homo sapiens
gcctctgttccccgggaagtcagaa

SEQ ID NO: 14627 - DNA, 25 bp, Homo sapiens
ggtgttcaaggatctggggacccct

SEQ ID NO: 14628 - DNA, 25 bp, Homo sapiens
cgagctcccagcagtcaagaagatg

SEQ ID NO: 14629 - DNA, 25 bp, Homo sapiens
ggcttcgacctcatgaacaagttcc

SEQ ID NO: 14630 - DNA, 25 bp, Homo sapiens
tgacctacttccccgggaggaggat

SEQ ID NO: 14631 - DNA, 25 bp, Homo sapiens
gaggatcagcgctgaggacggcctc

SEQ ID NO: 14632 - DNA, 25 bp, Homo sapiens
caagcatgagtatttccgcgagacc

SEQ ID NO: 14633 - DNA, 25 bp, Homo sapiens
gagcagcagcgtgtgaagcggggca

SEQ ID NO: 14634 - DNA, 25 bp, Homo sapiens
gggctacagccagctgggtgacgac

SEQ ID NO: 14635 - DNA, 25 bp, Homo sapiens
gtacctgtctataaggagtcctgct

SEQ ID NO: 14636 - DNA, 25 bp, Homo sapiens
aaccaggaaatgcatggatctcaaa

SEQ ID NO: 14637 - DNA, 25 bp, Homo sapiens
acaaacacccaataaactcggagtg

SEQ ID NO: 14638 - DNA, 25 bp, Homo sapiens
aaactcggagtggcagactgacaac

SEQ ID NO: 14639 - DNA, 25 bp, Homo sapiens
cggagtggcagactgacaactgtga

SEQ ID NO: 14640 - DNA, 25 bp, Homo sapiens
gtggcagactgacaactgtgagaca

SEQ ID NO: 14641 - DNA, 25 bp, Homo sapiens
aactgtgagacatgcacttgctacg

SEQ ID NO: 14642 - DNA, 25 bp, Homo sapiens
gtgagacatgcacttgctacgaaac

SEQ ID NO: 14643 - DNA, 25 bp, Homo sapiens
acatgcacttgctacgaaacagaaa

SEQ ID NO: 14644 - DNA, 25 bp, Homo sapiens
tgcacttgctacgaaacagaaattt

SEQ ID NO: 14645 - DNA, 25 bp, Homo sapiens
taaggagtcctgcttatcacaatga

SEQ ID NO: 14646 - DNA, 25 bp, Homo sapiens
gagagatggtgctggagtaaatatc

SEQ ID NO: 14647 - DNA, 25 bp, Homo sapiens
cattagtgccaaagggattcttctc

SEQ ID NO: 14648 - DNA, 25 bp, Homo sapiens
aaagctatttctagtttatttcact

SEQ ID NO: 14649 - DNA, 25 bp, Homo sapiens
aacttactcatattatgggcctctg

SEQ ID NO: 14650 - DNA, 25 bp, Homo sapiens
tgggcctctgaatttacttaccttc

SEQ ID NO: 14651 - DNA, 25 bp, Homo sapiens
acttaccttcaatgtgggttatcat

SEQ ID NO: 14652 - DNA, 25 bp, Homo sapiens
taatgaacatcatgatttccccaac

SEQ ID NO: 14653 - DNA, 25 bp, Homo sapiens
tcatgatttccccaacattcctgga

SEQ ID NO: 14654 - DNA, 25 bp, Homo sapiens
ggaaaaagtcttccactggtgagga

SEQ ID NO: 14655 - DNA, 25 bp, Homo sapiens
ctgaatactatgacaacctccctca

SEQ ID NO: 14656 - DNA, 25 bp, Homo sapiens
gatgatacaataagtccctactcaa

SEQ ID NO: 14657 - DNA, 25 bp, Homo sapiens
tggactcgtcattggtgctgtctac

SEQ ID NO: 14658 - DNA, 25 bp, Homo sapiens
caccgtggagacctcatcacggagc

SEQ ID NO: 14659 - DNA, 25 bp, Homo sapiens
ccgtggagacctcatcacggagccc

SEQ ID NO: 14660 - DNA, 25 bp, Homo sapiens
tggtggctgtggttgtcaagtacgc

SEQ ID NO: 14661 - DNA, 25 bp, Homo sapiens
tggctgtggttgtcaagtacgctga

SEQ ID NO: 14662 - DNA, 25 bp, Homo sapiens
tcaagtacgctgacaatatcctcaa

SEQ ID NO: 14663 - DNA, 25 bp, Homo sapiens
gtacgctgacaatatcctcaagggc

SEQ ID NO: 14664 - DNA, 25 bp, Homo sapiens
acgctgacaatatcctcaagggctt

SEQ ID NO: 14665 - DNA, 25 bp, Homo sapiens
gacaatatcctcaagggctttgcca

SEQ ID NO: 14666 - DNA, 25 bp, Homo sapiens
aatatcctcaagggctttgccacct

SEQ ID NO: 14667 - DNA, 25 bp, Homo sapiens
cttccacgtggacccattatttgcc

SEQ ID NO: 14668 - DNA, 25 bp, Homo sapiens
caggcaccgtgaagagactccgtgg

SEQ ID NO: 14669 - DNA, 25 bp, Homo sapiens
agtgccaactcagcgaggagacctc

SEQ ID NO: 14670 - DNA, 25 bp, Homo sapiens
agacagatccttaagcagcacctac

SEQ ID NO: 14671 - DNA, 25 bp, Homo sapiens
gctccaccaagcgcatgaagatcac

SEQ ID NO: 14672 - DNA, 25 bp, Homo sapiens
cctgatgggcgaactgtgcgcaccg

SEQ ID NO: 14673 - DNA, 25 bp, Homo sapiens
gatcctgcacatagtcatcaagcgt

SEQ ID NO: 14674 - DNA, 25 bp, Homo sapiens
aaagaaggcgacgccacacctgaca

SEQ ID NO: 14675 - DNA, 25 bp, Homo sapiens
tgctcaaagacaagccccatgcaca

SEQ ID NO: 14676 - DNA, 25 bp, Homo sapiens
ggcaccaacgtgctctacagtgccc

SEQ ID NO: 14677 - DNA, 25 bp, Homo sapiens
tgcactgtgaacattcccactatcg

SEQ ID NO: 14678 - DNA, 25 bp, Homo sapiens
tcccactatcgacggccgagtgatc

SEQ ID NO: 14679 - DNA, 25 bp, Homo sapiens
ttgttcctccataaatgtgtccttt

SEQ ID NO: 14680 - DNA, 25 bp, Homo sapiens
acagatctttatagttcgtgcttca

SEQ ID NO: 14681 - DNA, 25 bp, Homo sapiens
gttcgtgcttcataagccaattctt

SEQ ID NO: 14682 - DNA, 25 bp, Homo sapiens
agcaggagcttcttccaggagttct

SEQ ID NO: 14683 - DNA, 25 bp, Homo sapiens
ggagttctgagccttggttgtggac

SEQ ID NO: 14684 - DNA, 25 bp, Homo sapiens
taagttgggcagctttcctcaacac

SEQ ID NO: 14685 - DNA, 25 bp, Homo sapiens
gagttcggtctattaattgtttcat

SEQ ID NO: 14686 - DNA, 25 bp, Homo sapiens
gatattctatgtgtttacctcaatt

SEQ ID NO: 14687 - DNA, 25 bp, Homo sapiens
gtttttgctagtatcagatctgctg

SEQ ID NO: 14688 - DNA, 25 bp, Homo sapiens
tcagcacgtgttcctcactagaaga

SEQ ID NO: 14689 - DNA, 25 bp, Homo sapiens
aatgctgttacctttaagctttgtc

SEQ ID NO: 14690 - DNA, 25 bp, Homo sapiens
cgcgcagtcccgaagagtgtaagat

SEQ ID NO: 14691 - DNA, 25 bp, Homo sapiens
cctctctgatccgagctggatccag

SEQ ID NO: 14692 - DNA, 25 bp, Homo sapiens
gcatacagaccaatttctgcatcag

SEQ ID NO: 14693 - DNA, 25 bp, Homo sapiens
tgcatcagtgttatctcgaccagag

SEQ ID NO: 14694 - DNA, 25 bp, Homo sapiens
atctcgaccagaggctagtaggact

SEQ ID NO: 14695 - DNA, 25 bp, Homo sapiens
tggggcccagaatggtgtgtctcag

SEQ ID NO: 14696 - DNA, 25 bp, Homo sapiens
gtgtctcagctaatccaaagggagt

SEQ ID NO: 14697 - DNA, 25 bp, Homo sapiens
ttgtttgatggttgctttcttgatt

SEQ ID NO: 14698 - DNA, 25 bp, Homo sapiens
actgcttgacatgttggcattcata

SEQ ID NO: 14699 - DNA, 25 bp, Homo sapiens
tgtgtatcttactgtgactccgaaa

SEQ ID NO: 14700 - DNA, 25 bp, Homo sapiens
aaaactgtagtattggtgtcatggg

SEQ ID NO: 14701 - DNA, 25 bp, Homo sapiens
gtaggactggagagggctctacggt

SEQ ID NO: 14702 - DNA, 25 bp, Homo sapiens
tggagagggctctacggtatttaat

SEQ ID NO: 14703 - DNA, 25 bp, Homo sapiens
agaccagtgcaatcagcagagacat

SEQ ID NO: 14704 - DNA, 25 bp, Homo sapiens
gagacattgatactgctgccaaatt

SEQ ID NO: 14705 - DNA, 25 bp, Homo sapiens
tactgctgccaaatttattggtgca

SEQ ID NO: 14706 - DNA, 25 bp, Homo sapiens
ggtgcaggtgctgcaacagtaggag

SEQ ID NO: 14707 - DNA, 25 bp, Homo sapiens
gttatgccagaaacccttcgctgaa

SEQ ID NO: 14708 - DNA, 25 bp, Homo sapiens
gaaacccttcgctgaagcagcagct

SEQ ID NO: 14709 - DNA, 25 bp, Homo sapiens
ggatttgccttgtctgaagctatgg

SEQ ID NO: 14710 - DNA, 25 bp, Homo sapiens
tcttgattttgtttgccatgtaaca

SEQ ID NO: 14711 - DNA, 25 bp, Homo sapiens
tacggatgtaattctgtgtatctta

SEQ ID NO: 14712 - DNA, 25 bp, Homo sapiens
acttactgcctgaccttggaatcgt

SEQ ID NO: 14713 - DNA, 25 bp, Homo sapiens
ttactgcctgaccttggaatcgtcc

SEQ ID NO: 14714 - DNA, 25 bp, Homo sapiens
ctgaccttggaatcgtccctatatc

SEQ ID NO: 14715 - DNA, 25 bp, Homo sapiens
tggaatcgtccctatatcagggcct

SEQ ID NO: 14716 - DNA, 25 bp, Homo sapiens
tgcaaagtggcagggaccggcagag

SEQ ID NO: 14717 - DNA, 25 bp, Homo sapiens
gcagcccctaagtgcaaacacagca

SEQ ID NO: 14718 - DNA, 25 bp, Homo sapiens
gcaaacacagcatgggtccagaaga

SEQ ID NO: 14719 - DNA, 25 bp, Homo sapiens
gcatgggtccagaagacgtggtcta

SEQ ID NO: 14720 - DNA, 25 bp, Homo sapiens
agacgtggtctagaccagggctgct

SEQ ID NO: 14721 - DNA, 25 bp, Homo sapiens
tctgcatatatgtctctttggagtt

SEQ ID NO: 14722 - DNA, 25 bp, Homo sapiens
gcatatatgtctctttggagttgga

SEQ ID NO: 14723 - DNA, 25 bp, Homo sapiens
gggtctcagatggacgagggctctc

SEQ ID NO: 14724 - DNA, 25 bp, Homo sapiens
gagggctctccaagggaatgcctgg

SEQ ID NO: 14725 - DNA, 25 bp, Homo sapiens
gcctggggattcacccagtggtccc

SEQ ID NO: 14726 - DNA, 25 bp, Homo sapiens
tccccagaggtgctccatggaggca

SEQ ID NO: 14727 - DNA, 25 bp, Homo sapiens
ggtagaagggacctcaagcaccacg

SEQ ID NO: 14728 - DNA, 25 bp, Homo sapiens
tgcagacgaccttggttcacttttc

SEQ ID NO: 14729 - DNA, 25 bp, Homo sapiens
tcacttttcaggggtcgtcccaact

SEQ ID NO: 14730 - DNA, 25 bp, Homo sapiens
tctccagccactccaactgtggagg

SEQ ID NO: 14731 - DNA, 25 bp, Homo sapiens
ttccagtctcctttgcagcttagga

SEQ ID NO: 14732 - DNA, 25 bp, Homo sapiens
gaagtctacctgggcttctgggaaa

SEQ ID NO: 14733 - DNA, 25 bp, Homo sapiens
ccctatcattatttcaccaagccaa

SEQ ID NO: 14734 - DNA, 25 bp, Homo sapiens
gttgcagtaatttgtgttgtcccgt

SEQ ID NO: 14735 - DNA, 25 bp, Homo sapiens
gttgtcccgtacagatatcttcaaa

SEQ ID NO: 14736 - DNA, 25 bp, Homo sapiens
gagctgaatatgccacttaccagac

SEQ ID NO: 14737 - DNA, 25 bp, Homo sapiens
taccagactaaatcaaccactccag

SEQ ID NO: 14738 - DNA, 25 bp, Homo sapiens
tatagttgtgatcctgcacctggac

SEQ ID NO: 14739 - DNA, 25 bp, Homo sapiens
ggaccagatccattttcacttattg

SEQ ID NO: 14740 - DNA, 25 bp, Homo sapiens
agtgtggagtcgtgctgctccagag

SEQ ID NO: 14741 - DNA, 25 bp, Homo sapiens
gtttttacctcgatggcagcgacac

SEQ ID NO: 14742 - DNA, 25 bp, Homo sapiens
gtaacagtacttgggatcccccagt

SEQ ID NO: 14743 - DNA, 25 bp, Homo sapiens
gtcctaggcctacttacaagcctcc

SEQ ID NO: 14744 - DNA, 25 bp, Homo sapiens
tacaagcctccagtctcaaattatc

SEQ ID NO: 14745 - DNA, 25 bp, Homo sapiens
agcgtgttcccaatagtgtactctg

SEQ ID NO: 14746 - DNA, 25 bp, Homo sapiens
tactctggctgttgcgttttccagc

SEQ ID NO: 14747 - DNA, 25 bp, Homo sapiens
gccccagaaccgtatcattttttca

SEQ ID NO: 14748 - DNA, 25 bp, Homo sapiens
gaggaacacgtcaggagaggccagc

SEQ ID NO: 14749 - DNA, 25 bp, Homo sapiens
ggacactccactctgtaatgggcac

SEQ ID NO: 14750 - DNA, 25 bp, Homo sapiens
gatggatgtcctctgggcagggacc

SEQ ID NO: 14751 - DNA, 25 bp, Homo sapiens
acccccatggtgactatgccaggag

SEQ ID NO: 14752 - DNA, 25 bp, Homo sapiens
aggagagactcttgcttctcgagtt

SEQ ID NO: 14753 - DNA, 25 bp, Homo sapiens
atcccagctcacttgcttaggttgt

SEQ ID NO: 14754 - DNA, 25 bp, Homo sapiens
gagcggctctatctacagatgtggg

SEQ ID NO: 14755 - DNA, 25 bp, Homo sapiens
tgcagctggcaacaaacctgaccac

SEQ ID NO: 14756 - DNA, 25 bp, Homo sapiens
tggactgctcaatgccttggatggt

SEQ ID NO: 14757 - DNA, 25 bp, Homo sapiens
cttggatggtgtggcttccaccgag

SEQ ID NO: 14758 - DNA, 25 bp, Homo sapiens
tcgtgttcatgaccaccaaccacgt

SEQ ID NO: 14759 - DNA, 25 bp, Homo sapiens
ccaaccacgttgacaggctggaccc

SEQ ID NO: 14760 - DNA, 25 bp, Homo sapiens
gccctgatacgcccggggcgagtgg

SEQ ID NO: 14761 - DNA, 25 bp, Homo sapiens
gaaggagtacgtgggctactgctca

SEQ ID NO: 14762 - DNA, 25 bp, Homo sapiens
ctggcagctgacccagatgttccag

SEQ ID NO: 14763 - DNA, 25 bp, Homo sapiens
tgttccagaggttctatccagggca

SEQ ID NO: 14764 - DNA, 25 bp, Homo sapiens
gcaccttccttagctgagaactttg

SEQ ID NO: 14765 - DNA, 25 bp, Homo sapiens
gaacatgtccttcgagctacaaacc

SEQ ID NO: 14766 - DNA, 25 bp, Homo sapiens
tctcctcctctagctcaataaacat

SEQ ID NO: 14767 - DNA, 25 bp, Homo sapiens
cgtgccccactgaagaacattactg

SEQ ID NO: 14768 - DNA, 25 bp, Homo sapiens
cattactgagggggctaaccttggg

SEQ ID NO: 14769 - DNA, 25 bp, Homo sapiens
ggggactccaatttgccaatgatga

SEQ ID NO: 14770 - DNA, 25 bp, Homo sapiens
actgcaaattgtccttgccagctct

SEQ ID NO: 14771 - DNA, 25 bp, Homo sapiens
gctcttgggatccttggatacctgg

SEQ ID NO: 14772 - DNA, 25 bp, Homo sapiens
gacatccgaaagctacaccacagat

SEQ ID NO: 14773 - DNA, 25 bp, Homo sapiens
ggaccagggacatgggaaccaagcc

SEQ ID NO: 14774 - DNA, 25 bp, Homo sapiens
ggaaccaagccatagggatcagagg

SEQ ID NO: 14775 - DNA, 25 bp, Homo sapiens
gtccttgaacactactggggtatat

SEQ ID NO: 14776 - DNA, 25 bp, Homo sapiens
tggggtatattcaggctcatccacg

SEQ ID NO: 14777 - DNA, 25 bp, Homo sapiens
ccctgcaacatccgtcttggaggag

SEQ ID NO: 14778 - DNA, 25 bp, Homo sapiens
agagtaactgtctttgacttggacc

SEQ ID NO: 14779 - DNA, 25 bp, Homo sapiens
ttgacttggaccttgtttactctaa

SEQ ID NO: 14780 - DNA, 25 bp, Homo sapiens
gagatgcagcagtcctacttattgc

SEQ ID NO: 14781 - DNA, 25 bp, Homo sapiens
gcagtcctacttattgccatgtgga

SEQ ID NO: 14782 - DNA, 25 bp, Homo sapiens
gacttgtgggaaggacacgtgtgac

SEQ ID NO: 14783 - DNA, 25 bp, Homo sapiens
tgatcacacttaccgagcttacttt

SEQ ID NO: 14784 - DNA, 25 bp, Homo sapiens
ccgagcttactttgatctgtttgtc

SEQ ID NO: 14785 - DNA, 25 bp, Homo sapiens
gctgcccgggagtgtcgcaggaaga

SEQ ID NO: 14786 - DNA, 25 bp, Homo sapiens
aatcgtgtggctgtgcttgaaaacc

SEQ ID NO: 14787 - DNA, 25 bp, Homo sapiens
ggaactcaaggccctcaaagatctt

SEQ ID NO: 14788 - DNA, 25 bp, Homo sapiens
ggccctcaaagatctttattgccat

SEQ ID NO: 14789 - DNA, 25 bp, Homo sapiens
cagccacccaccgaatcagatggca

SEQ ID NO: 14790 - DNA, 25 bp, Homo sapiens
cagtcacccccgggagaagggacag

SEQ ID NO: 14791 - DNA, 25 bp, Homo sapiens
aagagccaggatgtcagcctgtgct

SEQ ID NO: 14792 - DNA, 25 bp, Homo sapiens
ccttccccagtgtgcgaagttctga

SEQ ID NO: 14793 - DNA, 25 bp, Homo sapiens
agttctgatgtgactgccaacaccc

SEQ ID NO: 14794 - DNA, 25 bp, Homo sapiens
cagatccccatcctatagttcatag

SEQ ID NO: 14795 - DNA, 25 bp, Homo sapiens
ccccacattcctcaactagtattat

SEQ ID NO: 14796 - DNA, 25 bp, Homo sapiens
attatttgggctctgggcagcagca

SEQ ID NO: 14797 - DNA, 25 bp, Homo sapiens
tctgaccctagaaatgttcccttta

SEQ ID NO: 14798 - DNA, 25 bp, Homo sapiens
gttccctttaatcttcaagttcgag

SEQ ID NO: 14799 - DNA, 25 bp, Homo sapiens
ttaagtacctttctgttgcagccca

SEQ ID NO: 14800 - DNA, 25 bp, Homo sapiens
tgcctcagccagtgcatctaatcag

SEQ ID NO: 14801 - DNA, 25 bp, Homo sapiens
atcaggcgggatcttctcaggatga

SEQ ID NO: 14802 - DNA, 25 bp, Homo sapiens
accagctgagtttctatttcttcta

SEQ ID NO: 14803 - DNA, 25 bp, Homo sapiens
ctataaatgtttttccctgcacaac

SEQ ID NO: 14804 - DNA, 25 bp, Homo sapiens
ttgtatgcatcttggtggacttgtc

SEQ ID NO: 14805 - DNA, 25 bp, Homo sapiens
ggtggacttgtcattggtattctag

SEQ ID NO: 14806 - DNA, 25 bp, Homo sapiens
tctgctataagtttcatctgttgtg

SEQ ID NO: 14807 - DNA, 25 bp, Homo sapiens
gggatttggctcttacatcagtgaa

SEQ ID NO: 14808 - DNA, 25 bp, Homo sapiens
gaagaaaggccagttctcgtttgga

SEQ ID NO: 14809 - DNA, 25 bp, Homo sapiens
gaaaaccttggcattcctgaagaag

SEQ ID NO: 14810 - DNA, 25 bp, Homo sapiens
attggcccaacaggaatggcttcaa

SEQ ID NO: 14811 - DNA, 25 bp, Homo sapiens
gaatactgcttttctggtacctaca

SEQ ID NO: 14812 - DNA, 25 bp, Homo sapiens
gattcctgggagcacatccatttca

SEQ ID NO: 14813 - DNA, 25 bp, Homo sapiens
ggactttgggctacatgctgaacct

SEQ ID NO: 14814 - DNA, 25 bp, Homo sapiens
tgaacctgaccaacatgatcccagc

SEQ ID NO: 14815 - DNA, 25 bp, Homo sapiens
tgatcccagctgagcaaccattgtc

SEQ ID NO: 14816 - DNA, 25 bp, Homo sapiens
acctatgtcttcctcatggttctat

SEQ ID NO: 14817 - DNA, 25 bp, Homo sapiens
gccatcataggcttgcttatctttc

SEQ ID NO: 14818 - DNA, 25 bp, Homo sapiens
aaatcgtccagggagcattttcctc

SEQ ID NO: 14819 - DNA, 25 bp, Homo sapiens
tccatcgcagtgttcaaggccatcc

SEQ ID NO: 14820 - DNA, 25 bp, Homo sapiens
gtgaagcttccttggcttttactga

SEQ ID NO: 14821 - DNA, 25 bp, Homo sapiens
ggtattcaatatcctttgcctcaag

SEQ ID NO: 14822 - DNA, 25 bp, Homo sapiens
gagggccagcagaacgagcagtgac

SEQ ID NO: 14823 - DNA, 25 bp, Homo sapiens
gcccccaactccaacaggattattt

SEQ ID NO: 14824 - DNA, 25 bp, Homo sapiens
aggaggagttacagatgcagccaca

SEQ ID NO: 14825 - DNA, 25 bp, Homo sapiens
tcatctgccttaacgtgatcggaga

SEQ ID NO: 14826 - DNA, 25 bp, Homo sapiens
atctactgtccagctgaaagcactc

SEQ ID NO: 14827 - DNA, 25 bp, Homo sapiens
ttggacctgtgatgatgcctcaagc

SEQ ID NO: 14828 - DNA, 25 bp, Homo sapiens
gatgcctcaagcaatacgtggtccc

SEQ ID NO: 14829 - DNA, 25 bp, Homo sapiens
acgtggtcccctaaattgttgcaca

SEQ ID NO: 14830 - DNA, 25 bp, Homo sapiens
gtgtggcatgtgagctggtccatca

SEQ ID NO: 14831 - DNA, 25 bp, Homo sapiens
cagccaacatcctggctgtctctgg

SEQ ID NO: 14832 - DNA, 25 bp, Homo sapiens
ggctccgtatcagcatcagtgacag

SEQ ID NO: 14833 - DNA, 25 bp, Homo sapiens
gagattgccaaggctcaggtcgctc

SEQ ID NO: 14834 - DNA, 25 bp, Homo sapiens
ctggtggcgacacgatctttgggaa

SEQ ID NO: 14835 - DNA, 25 bp, Homo sapiens
ttttgaggatgaccggtgccttgct

SEQ ID NO: 14836 - DNA, 25 bp, Homo sapiens
cctcaagcaccaacacattttctgg

SEQ ID NO: 14837 - DNA, 25 bp, Homo sapiens
atatatcccagatttctgtggcaga

SEQ ID NO: 14838 - DNA, 25 bp, Homo sapiens
agaaatgtgctgctgatctgggcct

SEQ ID NO: 14839 - DNA, 25 bp, Homo sapiens
tggacagtctgtctatcacgttcat

SEQ ID NO: 14840 - DNA, 25 bp, Homo sapiens
tcacgttcatctccatgttcttgga

SEQ ID NO: 14841 - DNA, 25 bp, Homo sapiens
caaatgcattggcctcctggttaag

SEQ ID NO: 14842 - DNA, 25 bp, Homo sapiens
ggggataattttctcttctttagca

SEQ ID NO: 14843 - DNA, 25 bp, Homo sapiens
tctcctctggtcgcgcggggaggag

SEQ ID NO: 14844 - DNA, 25 bp, Homo sapiens
ttttgttcctgtccgtttatcagga

SEQ ID NO: 14845 - DNA, 25 bp, Homo sapiens
gttcctgtccgtttatcaggacacg

SEQ ID NO: 14846 - DNA, 25 bp, Homo sapiens
tccgtttatcaggacacgggcccca

SEQ ID NO: 14847 - DNA, 25 bp, Homo sapiens
ggcttgagttctgcgcacgcaggat

SEQ ID NO: 14848 - DNA, 25 bp, Homo sapiens
tgagttctgcgcacgcaggattcag

SEQ ID NO: 14849 - DNA, 25 bp, Homo sapiens
cccaggtggtgagcggtttgcagtg

SEQ ID NO: 14850 - DNA, 25 bp, Homo sapiens
aggtggtgagcggtttgcagtgtcc

SEQ ID NO: 14851 - DNA, 25 bp, Homo sapiens
tgagcggtttgcagtgtccgttctc

SEQ ID NO: 14852 - DNA, 25 bp, Homo sapiens
ccctgcagcccaagatgggactcag

SEQ ID NO: 14853 - DNA, 25 bp, Homo sapiens
agcccaagatgggactcagaccctg

SEQ ID NO: 14854 - DNA, 25 bp, Homo sapiens
accatgcccccagatgattttttta

SEQ ID NO: 14855 - DNA, 25 bp, Homo sapiens
tgaaaaaaatctttgcttgtttatt

SEQ ID NO: 14856 - DNA, 25 bp, Homo sapiens
aagaactgtatttagtgattatttt

SEQ ID NO: 14857 - DNA, 25 bp, Homo sapiens
atattatagcattcatctgtgtgta

SEQ ID NO: 14858 - DNA, 25 bp, Homo sapiens
agcattcatctgtgtgtaaattatt

SEQ ID NO: 14859 - DNA, 25 bp, Homo sapiens
gatgtgcatttctgtgatgttatga

SEQ ID NO: 14860 - DNA, 25 bp, Homo sapiens
gatgttatgaatacatttctacttt

SEQ ID NO: 14861 - DNA, 25 bp, Homo sapiens
gttaaagaactgcttagtattagaa

SEQ ID NO: 14862 - DNA, 25 bp, Homo sapiens
gaagcagatcatttcccaaaattct

SEQ ID NO: 14863 - DNA, 25 bp, Homo sapiens
gcagatcatttcccaaaattctaag

SEQ ID NO: 14864 - DNA, 25 bp, Homo sapiens
ttagactaacttccatggtgccctg

SEQ ID NO: 14865 - DNA, 25 bp, Homo sapiens
gtaccctgctgtataataaacaatc

SEQ ID NO: 14866 - DNA, 25 bp, Homo sapiens
ttattcttagcgtcactggtctggc

SEQ ID NO: 14867 - DNA, 25 bp, Homo sapiens
acaaggttgccacacctagttctgc

SEQ ID NO: 14868 - DNA, 25 bp, Homo sapiens
ctgcattccagttctcaagtcttaa

SEQ ID NO: 14869 - DNA, 25 bp, Homo sapiens
ttaggtatcctaggtaagagcccct

SEQ ID NO: 14870 - DNA, 25 bp, Homo sapiens
aagagcccctaaacatcaagcaatc

SEQ ID NO: 14871 - DNA, 25 bp, Homo sapiens
acatcaagcaatctgtgagtctgta

SEQ ID NO: 14872 - DNA, 25 bp, Homo sapiens
ttatctaattccacccctgttggaa

SEQ ID NO: 14873 - DNA, 25 bp, Homo sapiens
atttctttgttctttgcaactatgg

SEQ ID NO: 14874 - DNA, 25 bp, Homo sapiens
gaaaatcatcacaagtgcctctgaa

SEQ ID NO: 14875 - DNA, 25 bp, Homo sapiens
caagtgcctctgaaagcgagtgtta

SEQ ID NO: 14876 - DNA, 25 bp, Homo sapiens
gcgagtgttaggttggttagagggt

SEQ ID NO: 14877 - DNA, 25 bp, Homo sapiens
ggagtcacaagacactgttgcagag

SEQ ID NO: 14878 - DNA, 25 bp, Homo sapiens
gagggacagtcatctagggcctcat

SEQ ID NO: 14879 - DNA, 25 bp, Homo sapiens
atcgctctacacctgagtcacgagc

SEQ ID NO: 14880 - DNA, 25 bp, Homo sapiens
cctgagtcacgagctgctgtccagg

SEQ ID NO: 14881 - DNA, 25 bp, Homo sapiens
gtccaggaactttccagcagtatcc

SEQ ID NO: 14882 - DNA, 25 bp, Homo sapiens
agcagtatcctcgctggtgaagacc

SEQ ID NO: 14883 - DNA, 25 bp, Homo sapiens
gtgttctggttggtaaagcctcagc

SEQ ID NO: 14884 - DNA, 25 bp, Homo sapiens
ggaacacaaccatagcctgtttcgt

SEQ ID NO: 14885 - DNA, 25 bp, Homo sapiens
tagcctgtttcgtagccatattaat

SEQ ID NO: 14886 - DNA, 25 bp, Homo sapiens
tgccttacattattactccttgcca

SEQ ID NO: 14887 - DNA, 25 bp, Homo sapiens
gccacagattatcttgtacagcctt

SEQ ID NO: 14888 - DNA, 25 bp, Homo sapiens
caaatgacgtcttcaccaagtgatc

SEQ ID NO: 14889 - DNA, 25 bp, Homo sapiens
gataagtcattcagatttgttctag

SEQ ID NO: 14890 - DNA, 25 bp, Homo sapiens
aaaacatccagcaaactcaagttga

SEQ ID NO: 14891 - DNA, 25 bp, Homo sapiens
acattctacaaaatatccctggggt

SEQ ID NO: 14892 - DNA, 25 bp, Homo sapiens
gaaacaatcacagaccacatgagac

SEQ ID NO: 14893 - DNA, 25 bp, Homo sapiens
gtgagccaaatgcaatgtgcttctt

SEQ ID NO: 14894 - DNA, 25 bp, Homo sapiens
tgtgcttcttggatcagatcctgga

SEQ ID NO: 14895 - DNA, 25 bp, Homo sapiens
gtagtgttgatttcttaatcttgac

SEQ ID NO: 14896 - DNA, 25 bp, Homo sapiens
gagaaactgaaactgggtgagggct

SEQ ID NO: 14897 - DNA, 25 bp, Homo sapiens
gtgagggctatctaggaattctctg

SEQ ID NO: 14898 - DNA, 25 bp, Homo sapiens
ctctgtactatcttaccaaattttc

SEQ ID NO: 14899 - DNA, 25 bp, Homo sapiens
cccaccagtgtaatctccctggatt

SEQ ID NO: 14900 - DNA, 25 bp, Homo sapiens
tctttcacaaattaggccacggccc

SEQ ID NO: 14901 - DNA, 25 bp, Homo sapiens
gtgggcggaagttattctggcaggt

SEQ ID NO: 14902 - DNA, 25 bp, Homo sapiens
tgtggagttcggctctgtgaacacc

SEQ ID NO: 14903 - DNA, 25 bp, Homo sapiens
cccagaacttccagtcactgcataa

SEQ ID NO: 14904 - DNA, 25 bp, Homo sapiens
gaatgtgacagtgatccgcaggggg

SEQ ID NO: 14905 - DNA, 25 bp, Homo sapiens
ccagcttagacttgttccaacacgc

SEQ ID NO: 14906 - DNA, 25 bp, Homo sapiens
aaaaggactgctgggctgcaacatt

SEQ ID NO: 14907 - DNA, 25 bp, Homo sapiens
gggtctagggatttccaacttgtct

SEQ ID NO: 14908 - DNA, 25 bp, Homo sapiens
agaggcttgtaacctgaacttctgt

SEQ ID NO: 14909 - DNA, 25 bp, Homo sapiens
gtgtggtggcagtactgtggcccac

SEQ ID NO: 14910 - DNA, 25 bp, Homo sapiens
gtggcttcacatttaaaccagtatc

SEQ ID NO: 14911 - DNA, 25 bp, Homo sapiens
gtgggacatattttcctgagagcag

SEQ ID NO: 14912 - DNA, 25 bp, Homo sapiens
cagctgcagtctgtcaggatgagat

SEQ ID NO: 14913 - DNA, 25 bp, Homo sapiens
ggtggggaaatctgaagtgggtaca

SEQ ID NO: 14914 - DNA, 25 bp, Homo sapiens
gtgggtcacacaaggtctacattac

SEQ ID NO: 14915 - DNA, 25 bp, Homo sapiens
catagttttccttgaatccaacttt

SEQ ID NO: 14916 - DNA, 25 bp, Homo sapiens
taaggaggtaagattgccacgtgcc

SEQ ID NO: 14917 - DNA, 25 bp, Homo sapiens
cgtgcctgctggtactgtgatgcat

SEQ ID NO: 14918 - DNA, 25 bp, Homo sapiens
ggcagttttatcacgtttgaatcta

SEQ ID NO: 14919 - DNA, 25 bp, Homo sapiens
gaatctaccattcatagccagatgt

SEQ ID NO: 14920 - DNA, 25 bp, Homo sapiens
gtatcagatgtttcactgacagttt

SEQ ID NO: 14921 - DNA, 25 bp, Homo sapiens
cagcagtatgtcatgaccagcctcc

SEQ ID NO: 14922 - DNA, 25 bp, Homo sapiens
tgtggatgccaaaaacttactcgat

SEQ ID NO: 14923 - DNA, 25 bp, Homo sapiens
aaacttactcgatgtcattgaccaa

SEQ ID NO: 14924 - DNA, 25 bp, Homo sapiens
atgcttgggcagacgagaccacact

SEQ ID NO: 14925 - DNA, 25 bp, Homo sapiens
tcttgctaccctcttttgaagatgt

SEQ ID NO: 14926 - DNA, 25 bp, Homo sapiens
tgaagatgttctctagccttccacc

SEQ ID NO: 14927 - DNA, 25 bp, Homo sapiens
aggaattaaccctgtgtcctcagtc

SEQ ID NO: 14928 - DNA, 25 bp, Homo sapiens
accacactttgatttgggttcattt

SEQ ID NO: 14929 - DNA, 25 bp, Homo sapiens
ggatccaaaatgtggcgtttttcta

SEQ ID NO: 14930 - DNA, 25 bp, Homo sapiens
gatacgttctaaagggggatggcca

SEQ ID NO: 14931 - DNA, 25 bp, Homo sapiens
ggccaaggggtgacatcttaattcc

SEQ ID NO: 14932 - DNA, 25 bp, Homo sapiens
tgcgctcacatgacggcgctgtgca

SEQ ID NO: 14933 - DNA, 25 bp, Homo sapiens
aactgctcccactgtggcaagagct

SEQ ID NO: 14934 - DNA, 25 bp, Homo sapiens
atcacctcaacagtcacgtcagaca

SEQ ID NO: 14935 - DNA, 25 bp, Homo sapiens
caagtgcactcaacagaacggccct

SEQ ID NO: 14936 - DNA, 25 bp, Homo sapiens
aaatgtgaggcagctttcgccacga

SEQ ID NO: 14937 - DNA, 25 bp, Homo sapiens
tcgccacgaaggatcggctgcgggc

SEQ ID NO: 14938 - DNA, 25 bp, Homo sapiens
ggcgcacacagtacgacacgaggag

SEQ ID NO: 14939 - DNA, 25 bp, Homo sapiens
gagctcggcttatatttcggaccac

SEQ ID NO: 14940 - DNA, 25 bp, Homo sapiens
ggtcctcaccatgtctgtgagctct

SEQ ID NO: 14941 - DNA, 25 bp, Homo sapiens
accctggtgagctccaagttggttg

SEQ ID NO: 14942 - DNA, 25 bp, Homo sapiens
tagagtcccttggtacaagctcctc

SEQ ID NO: 14943 - DNA, 25 bp, Homo sapiens
ctgatcatgccaggtttgcaccagc

SEQ ID NO: 14944 - DNA, 25 bp, Homo sapiens
gagtctcccatgttgtagtacattc

SEQ ID NO: 14945 - DNA, 25 bp, Homo sapiens
agtacattctccaagatgcagccca

SEQ ID NO: 14946 - DNA, 25 bp, Homo sapiens
gtctggttacgatggtctgagcttc

SEQ ID NO: 14947 - DNA, 25 bp, Homo sapiens
atggtctgagcttccttagaacctt

SEQ ID NO: 14948 - DNA, 25 bp, Homo sapiens
gcagatgaagcatagcctccttgga

SEQ ID NO: 14949 - DNA, 25 bp, Homo sapiens
ttccctgaatgtgccttcttgtggc

SEQ ID NO: 14950 - DNA, 25 bp, Homo sapiens
gccattctccttgcagacttggctc

SEQ ID NO: 14951 - DNA, 25 bp, Homo sapiens
ctcagtgcagttagcctgagctccc

SEQ ID NO: 14952 - DNA, 25 bp, Homo sapiens
agagcatttaccccattgtgttgtg

SEQ ID NO: 14953 - DNA, 25 bp, Homo sapiens
atttctgtattctctgcaactttgc

SEQ ID NO: 14954 - DNA, 25 bp, Homo sapiens
gaggctacttctcagggctggaagt

SEQ ID NO: 14955 - DNA, 25 bp, Homo sapiens
acttctcagggctggaagtcccgtc

SEQ ID NO: 14956 - DNA, 25 bp, Homo sapiens
tctcagggctggaagtcccgtcagt

SEQ ID NO: 14957 - DNA, 25 bp, Homo sapiens
caggtgtgtgatggcggctgcaatc

SEQ ID NO: 14958 - DNA, 25 bp, Homo sapiens
gctgcaatctgtcttgtgggtatta

SEQ ID NO: 14959 - DNA, 25 bp, Homo sapiens
gcaatctgtcttgtgggtattaatg

SEQ ID NO: 14960 - DNA, 25 bp, Homo sapiens
gtcttgtgggtattaatgcaatctt

SEQ ID NO: 14961 - DNA, 25 bp, Homo sapiens
tgcaatcttcagtggtggctactgt

SEQ ID NO: 14962 - DNA, 25 bp, Homo sapiens
atcttcagtggtggctactgttctc

SEQ ID NO: 14963 - DNA, 25 bp, Homo sapiens
tctctagctgttctacaaaactgga

SEQ ID NO: 14964 - DNA, 25 bp, Homo sapiens
ctagctgttctacaaaactggagca

SEQ ID NO: 14965 - DNA, 25 bp, Homo sapiens
gggactaaggacagccatgaccccc

SEQ ID NO: 14966 - DNA, 25 bp, Homo sapiens
gcaggagggcttgactttctttggc

SEQ ID NO: 14967 - DNA, 25 bp, Homo sapiens
ttctttggcacagagctagccccag

SEQ ID NO: 14968 - DNA, 25 bp, Homo sapiens
tagccccagtgcggcaacaggagct

SEQ ID NO: 14969 - DNA, 25 bp, Homo sapiens
aagaacatacttggcacggctgccc

SEQ ID NO: 14970 - DNA, 25 bp, Homo sapiens
gtgaggatggcatcttccgtcatga

SEQ ID NO: 14971 - DNA, 25 bp, Homo sapiens
cgcctccgattccgggattttgtgg

SEQ ID NO: 14972 - DNA, 25 bp, Homo sapiens
gactttgaggacttcatcttcagcc

SEQ ID NO: 14973 - DNA, 25 bp, Homo sapiens
atcttcagccacttctttggagaca

SEQ ID NO: 14974 - DNA, 25 bp, Homo sapiens
agcactcacagagcccaagagctgc

SEQ ID NO: 14975 - DNA, 25 bp, Homo sapiens
cccacagggaatggccttggccttg

SEQ ID NO: 14976 - DNA, 25 bp, Homo sapiens
cgaggtgcggatgcgcaccttcctg

SEQ ID NO: 14977 - DNA, 25 bp, Homo sapiens
aagctgctgcgcacacacaattatc

SEQ ID NO: 14978 - DNA, 25 bp, Homo sapiens
acaattatctgtacgcagcctgcga

SEQ ID NO: 14979 - DNA, 25 bp, Homo sapiens
cagcctgcgagtgcaaggccgggtg

SEQ ID NO: 14980 - DNA, 25 bp, Homo sapiens
gtcctggccattcggagtcgatatg

SEQ ID NO: 14981 - DNA, 25 bp, Homo sapiens
tggaagctgcagtctacaccttcac

SEQ ID NO: 14982 - DNA, 25 bp, Homo sapiens
tgttcttctccacggtatgcggtgg

SEQ ID NO: 14983 - DNA, 25 bp, Homo sapiens
tgcggtggtgtctgcatcttatcac

SEQ ID NO: 14984 - DNA, 25 bp, Homo sapiens
gcatcttatcactgggtgcttgtgc

SEQ ID NO: 14985 - DNA, 25 bp, Homo sapiens
ggtgggtcacagtctgtatttccac

SEQ ID NO: 14986 - DNA, 25 bp, Homo sapiens
gtgcttcccaaactgtcatgcatag

SEQ ID NO: 14987 - DNA, 25 bp, Homo sapiens
aggcctaaggaagccagtcaccttc

SEQ ID NO: 14988 - DNA, 25 bp, Homo sapiens
atccatggcactaaaccacttctct

SEQ ID NO: 14989 - DNA, 25 bp, Homo sapiens
gaagagattcctattactgcagtac

SEQ ID NO: 14990 - DNA, 25 bp, Homo sapiens
acatacgtctgccaggggtaacctg

SEQ ID NO: 14991 - DNA, 25 bp, Homo sapiens
ttccatctagcagctggcctaatca

SEQ ID NO: 14992 - DNA, 25 bp, Homo sapiens
ggcctaatcactctgagtcacaggt

SEQ ID NO: 14993 - DNA, 25 bp, Homo sapiens
gagaggcacttaatctgtaaccccc

SEQ ID NO: 14994 - DNA, 25 bp, Homo sapiens
taggggtagctggtggttgtgcctt

SEQ ID NO: 14995 - DNA, 25 bp, Homo sapiens
ccagattcccagaccttaagacact

SEQ ID NO: 14996 - DNA, 25 bp, Homo sapiens
gtctctgttggtccactgtgtttag

SEQ ID NO: 14997 - DNA, 25 bp, Homo sapiens
aagggtgcccatttgtgatcagcat

SEQ ID NO: 14998 - DNA, 25 bp, Homo sapiens
gctggaggtgacgctactgagaact

SEQ ID NO: 14999 - DNA, 25 bp, Homo sapiens
gatgtcgggcactctacagatgcca

SEQ ID NO: 15000 - DNA, 25 bp, Homo sapiens
cattggggagctccatccagatgac

SEQ ID NO: 15001 - DNA, 25 bp, Homo sapiens
taaacaagcctccagaaccttaaag

SEQ ID NO: 15002 - DNA, 25 bp, Homo sapiens
ttggtggaccaactgggtgatccct

SEQ ID NO: 15003 - DNA, 25 bp, Homo sapiens
gactgaacacctcctcagaagtcag

SEQ ID NO: 15004 - DNA, 25 bp, Homo sapiens
aggaagagcctgctttggacacggg

SEQ ID NO: 15005 - DNA, 25 bp, Homo sapiens
gccattgctaactacttcaactgac

SEQ ID NO: 15006 - DNA, 25 bp, Homo sapiens
taatatatctctttctttttcttcc

SEQ ID NO: 15007 - DNA, 25 bp, Homo sapiens
tcctttctgcgctcaaatttttcga

SEQ ID NO: 15008 - DNA, 25 bp, Homo sapiens
gtgtgcctttttattcatctacttt

SEQ ID NO: 15009 - DNA, 25 bp, Homo sapiens
ctgcgaggccagggaagccctgagt

SEQ ID NO: 15010 - DNA, 25 bp, Homo sapiens
ggaagccctgagtttctggcggggc

SEQ ID NO: 15011 - DNA, 25 bp, Homo sapiens
ggggagcattgtgttgtgggtgtct

SEQ ID NO: 15012 - DNA, 25 bp, Homo sapiens
gtgtgaggtcaccctcaaactgcac

SEQ ID NO: 15013 - DNA, 25 bp, Homo sapiens
gtggctacaaccccagagttttaag

SEQ ID NO: 15014 - DNA, 25 bp, Homo sapiens
cacatggaccggcctgagcgatgtg

SEQ ID NO: 15015 - DNA, 25 bp, Homo sapiens
ttaaaatggttgcacggctctgccc

SEQ ID NO: 15016 - DNA, 25 bp, Homo sapiens
gggccttttttacacactgcgaggc

SEQ ID NO: 15017 - DNA, 25 bp, Homo sapiens
ggcccagctttctaggggacttttg

SEQ ID NO: 15018 - DNA, 25 bp, Homo sapiens
taggggacttttgcacatgtcatgc

SEQ ID NO: 15019 - DNA, 25 bp, Homo sapiens
tgcacatgtcatgcagctcagctgg

SEQ ID NO: 15020 - DNA, 25 bp, Homo sapiens
gtggttcccatgtctatacattcag

SEQ ID NO: 15021 - DNA, 25 bp, Homo sapiens
ttcaggagcgtctctgctgaggagc

SEQ ID NO: 15022 - DNA, 25 bp, Homo sapiens
gctccttcaattccacctaatggtg

SEQ ID NO: 15023 - DNA, 25 bp, Homo sapiens
aaggtgtcttgagcatctgtccttt

SEQ ID NO: 15024 - DNA, 25 bp, Homo sapiens
ctcaggcactactgatgctccagtc

SEQ ID NO: 15025 - DNA, 25 bp, Homo sapiens
tggggaggccaaataagccgccact

SEQ ID NO: 15026 - DNA, 25 bp, Homo sapiens
taattattgccaccatccaactcat

SEQ ID NO: 15027 - DNA, 25 bp, Homo sapiens
tatggttcacatcttgtttcctata

SEQ ID NO: 15028 - DNA, 25 bp, Homo sapiens
aatgttctgtattctcggatcaatt

SEQ ID NO: 15029 - DNA, 25 bp, Homo sapiens
ctgactttcctcttagtagaccgca

SEQ ID NO: 15030 - DNA, 25 bp, Homo sapiens
agaacgtttccttttttgatgctga

SEQ ID NO: 15031 - DNA, 25 bp, Homo sapiens
gccgctgtgtttggagacggccaag

SEQ ID NO: 15032 - DNA, 25 bp, Homo sapiens
gacggccaagtgaaggagccagtgc

SEQ ID NO: 15033 - DNA, 25 bp, Homo sapiens
cttccttcgcagcttttagaccaaa

SEQ ID NO: 15034 - DNA, 25 bp, Homo sapiens
tatgaaagacttacaggcctcgcta

SEQ ID NO: 15035 - DNA, 25 bp, Homo sapiens
cttacaggcctcgctacaagaacct

SEQ ID NO: 15036 - DNA, 25 bp, Homo sapiens
gcctcgctacaagaacctgctaagg

SEQ ID NO: 15037 - DNA, 25 bp, Homo sapiens
aacctgaaggtgctgacaaagatga

SEQ ID NO: 15038 - DNA, 25 bp, Homo sapiens
gctgacaaagatgacctgctgctgt

SEQ ID NO: 15039 - DNA, 25 bp, Homo sapiens
tccttggaagagggcgagttcagca

SEQ ID NO: 15040 - DNA, 25 bp, Homo sapiens
agggcgagttcagcaaagagtgggc

SEQ ID NO: 15041 - DNA, 25 bp, Homo sapiens
caaagagtgggccgctgtgtttgga

SEQ ID NO: 15042 - DNA, 25 bp, Homo sapiens
ttgctggcttctcttatactaaccc

SEQ ID NO: 15043 - DNA, 25 bp, Homo sapiens
gtgtaggtgaatgcaaactccatcg

SEQ ID NO: 15044 - DNA, 25 bp, Homo sapiens
caaactccatcgttgagcctggggt

SEQ ID NO: 15045 - DNA, 25 bp, Homo sapiens
gagcctggggtgtaagacttcaagc

SEQ ID NO: 15046 - DNA, 25 bp, Homo sapiens
gacttcaagccaagcgtatgtatca

SEQ ID NO: 15047 - DNA, 25 bp, Homo sapiens
tagtcttccaggattcacggtgcac

SEQ ID NO: 15048 - DNA, 25 bp, Homo sapiens
ttcacggtgcacatgctggcattca

SEQ ID NO: 15049 - DNA, 25 bp, Homo sapiens
gtgtagcttgctagtttgttttcta

SEQ ID NO: 15050 - DNA, 25 bp, Homo sapiens
gaggtacaattttccaaacttccag

SEQ ID NO: 15051 - DNA, 25 bp, Homo sapiens
aaaactactgtgtctgataccaaaa

SEQ ID NO: 15052 - DNA, 25 bp, Homo sapiens
gaagctgatgttcctggtaaaagtt

SEQ ID NO: 15053 - DNA, 25 bp, Homo sapiens
gtgacggtgctgaagaaggccctgg

SEQ ID NO: 15054 - DNA, 25 bp, Homo sapiens
aggccctggatgaagagacgcggtc

SEQ ID NO: 15055 - DNA, 25 bp, Homo sapiens
ggcggtggaggagctcacagagcag

SEQ ID NO: 15056 - DNA, 25 bp, Homo sapiens
ggaggcgcaggtgcagacactgagt

SEQ ID NO: 15057 - DNA, 25 bp, Homo sapiens
gtccctggcaattctgtttacatga

SEQ ID NO: 15058 - DNA, 25 bp, Homo sapiens
aagtcaccgaaatgggtgccgccgg

SEQ ID NO: 15059 - DNA, 25 bp, Homo sapiens
tcaggcctttgagaattctttcccc

SEQ ID NO: 15060 - DNA, 25 bp, Homo sapiens
agttcaccaagtgccttctgtagtc

SEQ ID NO: 15061 - DNA, 25 bp, Homo sapiens
tgaaaaggagacgctgctcccacgg

SEQ ID NO: 15062 - DNA, 25 bp, Homo sapiens
aggaatgctgcactgtttacaccct

SEQ ID NO: 15063 - DNA, 25 bp, Homo sapiens
tgtttacaccctgactgtgcttaaa

SEQ ID NO: 15064 - DNA, 25 bp, Homo sapiens
tagtggccgtgaggagcatcttcag

SEQ ID NO: 15065 - DNA, 25 bp, Homo sapiens
ggggaacccacggagtgctggtggg

SEQ ID NO: 15066 - DNA, 25 bp, Homo sapiens
gggaggagatcaacagggctggcat

SEQ ID NO: 15067 - DNA, 25 bp, Homo sapiens
gaatggtaccagacgtgctccaaca

SEQ ID NO: 15068 - DNA, 25 bp, Homo sapiens
agacgtgctccaacaatgggctggt

SEQ ID NO: 15069 - DNA, 25 bp, Homo sapiens
tggtggcaggattccagagccgcta

SEQ ID NO: 15070 - DNA, 25 bp, Homo sapiens
ccgctacttcgagtcagtgctggat

SEQ ID NO: 15071 - DNA, 25 bp, Homo sapiens
gtggcagttttactgttgtcgctac

SEQ ID NO: 15072 - DNA, 25 bp, Homo sapiens
gtcgctacagcaagaggtgcccata

SEQ ID NO: 15073 - DNA, 25 bp, Homo sapiens
tgcccatattcctgctggctaacaa

SEQ ID NO: 15074 - DNA, 25 bp, Homo sapiens
gtgccggatgactgaatacgactgt

SEQ ID NO: 15075 - DNA, 25 bp, Homo sapiens
aatgtcatagacactgatttcatcg

SEQ ID NO: 15076 - DNA, 25 bp, Homo sapiens
tagacactgatttcatcgacgagga

SEQ ID NO: 15077 - DNA, 25 bp, Homo sapiens
gatttcatcgacgaggaagttctta

SEQ ID NO: 15078 - DNA, 25 bp, Homo sapiens
ggaagttcttatgtccttggtgata

SEQ ID NO: 15079 - DNA, 25 bp, Homo sapiens
tcttatgtccttggtgatagaaatg

SEQ ID NO: 15080 - DNA, 25 bp, Homo sapiens
gaaatgggtttggaccgcatcaagg

SEQ ID NO: 15081 - DNA, 25 bp, Homo sapiens
ctctggctggggcaaaacgagtttg

SEQ ID NO: 15082 - DNA, 25 bp, Homo sapiens
gtttgattttatgacggacttcgtg

SEQ ID NO: 15083 - DNA, 25 bp, Homo sapiens
gacggacttcgtgtgcaaacagcag

SEQ ID NO: 15084 - DNA, 25 bp, Homo sapiens
agcagcccagcagagtgagctgttg

SEQ ID NO: 15085 - DNA, 25 bp, Homo sapiens
gagctgttgactcgatcgaaacccc

SEQ ID NO: 15086 - DNA, 25 bp, Homo sapiens
gcgccatttacactgtagtctgtac

SEQ ID NO: 15087 - DNA, 25 bp, Homo sapiens
acaacctgtggttccacgtgcatgt

SEQ ID NO: 15088 - DNA, 25 bp, Homo sapiens
ctgtgcctctggcaccaggttgtgt

SEQ ID NO: 15089 - DNA, 25 bp, Homo sapiens
atcagccctcatttcttataatacc

SEQ ID NO: 15090 - DNA, 25 bp, Homo sapiens
ttataataccctgatcccagactcc

SEQ ID NO: 15091 - DNA, 25 bp, Homo sapiens
gcccccctgccataacttggggagg

SEQ ID NO: 15092 - DNA, 25 bp, Homo sapiens
aatgctgtcctagatgtacttgggc

SEQ ID NO: 15093 - DNA, 25 bp, Homo sapiens
tcccagttcttccaagtgtctaact

SEQ ID NO: 15094 - DNA, 25 bp, Homo sapiens
ctaactagtcttcgctgcagcgtca

SEQ ID NO: 15095 - DNA, 25 bp, Homo sapiens
cgctgcagcgtcagccaaagctggc

SEQ ID NO: 15096 - DNA, 25 bp, Homo sapiens
gtgtgcccatttcctagggaagggg

SEQ ID NO: 15097 - DNA, 25 bp, Homo sapiens
aatgatatgcatcaccaccttgtag

SEQ ID NO: 15098 - DNA, 25 bp, Homo sapiens
gcctcaggtggggcgcaggagagcc

SEQ ID NO: 15099 - DNA, 25 bp, Homo sapiens
taggaacaggtcccaagcggttgag

SEQ ID NO: 15100 - DNA, 25 bp, Homo sapiens
agcggttgagcctggcagagtacca

SEQ ID NO: 15101 - DNA, 25 bp, Homo sapiens
cccgccctctcacagaggatgggtg

SEQ ID NO: 15102 - DNA, 25 bp, Homo sapiens
ccctgccccattgtccagatgggca

SEQ ID NO: 15103 - DNA, 25 bp, Homo sapiens
agatgggcactgctgtggagtctgc

SEQ ID NO: 15104 - DNA, 25 bp, Homo sapiens
cccacccaactgaaggcatggcggc

SEQ ID NO: 15105 - DNA, 25 bp, Homo sapiens
tacctcagccatcggtctagcatat

SEQ ID NO: 15106 - DNA, 25 bp, Homo sapiens
ggtctagcatatcagtcactgggcc

SEQ ID NO: 15107 - DNA, 25 bp, Homo sapiens
tcactgggcccaacatatccatttt

SEQ ID NO: 15108 - DNA, 25 bp, Homo sapiens
cctacgtgtcgctgagccaggaagg

SEQ ID NO: 15109 - DNA, 25 bp, Homo sapiens
ggcaaagggcggtacctgcagatga

SEQ ID NO: 15110 - DNA, 25 bp, Homo sapiens
gtgtccagtcacttagaagttcccc

SEQ ID NO: 15111 - DNA, 25 bp, Homo sapiens
acagtgttaacctgtactctctcct

SEQ ID NO: 15112 - DNA, 25 bp, Homo sapiens
gcaaacctacacaccaaagctttat

SEQ ID NO: 15113 - DNA, 25 bp, Homo sapiens
atgctacacagtgttgtcccgagcg

SEQ ID NO: 15114 - DNA, 25 bp, Homo sapiens
ggaggcgttgggcagaaaccctcgg

SEQ ID NO: 15115 - DNA, 25 bp, Homo sapiens
tgcttccgagcacgctgtagggtat

SEQ ID NO: 15116 - DNA, 25 bp, Homo sapiens
tctcgggacgcatgaccttcacgag

SEQ ID NO: 15117 - DNA, 25 bp, Homo sapiens
gatcgaggtgttggtggacgccgac

SEQ ID NO: 15118 - DNA, 25 bp, Homo sapiens
tgtggacagctctcagaagcgctac

SEQ ID NO: 15119 - DNA, 25 bp, Homo sapiens
ttccccaccaaatattcacttttct

SEQ ID NO: 15120 - DNA, 25 bp, Homo sapiens
ggcatcatacgtgactgtagaattg

SEQ ID NO: 15121 - DNA, 25 bp, Homo sapiens
cagatattgtggacacggccatgcc

SEQ ID NO: 15122 - DNA, 25 bp, Homo sapiens
atagcttattttaacaattgcctga

SEQ ID NO: 15123 - DNA, 25 bp, Homo sapiens
caaaaatgagcacgctttcctaccg

SEQ ID NO: 15124 - DNA, 25 bp, Homo sapiens
accgcccctcagataatgtaagctc

SEQ ID NO: 15125 - DNA, 25 bp, Homo sapiens
aagaagcctgcaccatgttttgagg

SEQ ID NO: 15126 - DNA, 25 bp, Homo sapiens
gtgacatgttcgaaacctgtccata

SEQ ID NO: 15127 - DNA, 25 bp, Homo sapiens
tctgcagcacttcactaccaaatga

SEQ ID NO: 15128 - DNA, 25 bp, Homo sapiens
gcattatgtggactgaaccgacttt

SEQ ID NO: 15129 - DNA, 25 bp, Homo sapiens
gaaccgacttttctaaagctctgaa

SEQ ID NO: 15130 - DNA, 25 bp, Homo sapiens
gcagcccccatgcagaagaggctcc

SEQ ID NO: 15131 - DNA, 25 bp, Homo sapiens
tgctgcccagtgtgaccagaaaggc

SEQ ID NO: 15132 - DNA, 25 bp, Homo sapiens
cccagtgtgaccagaaaggcagccc

SEQ ID NO: 15133 - DNA, 25 bp, Homo sapiens
gtgtgaccagaaaggcagccctgtc

SEQ ID NO: 15134 - DNA, 25 bp, Homo sapiens
tgaccagaaaggcagccctgtccca

SEQ ID NO: 15135 - DNA, 25 bp, Homo sapiens
gtctgggcagagttcatcttcttga

SEQ ID NO: 15136 - DNA, 25 bp, Homo sapiens
tgggcagagttcatcttcttgacct

SEQ ID NO: 15137 - DNA, 25 bp, Homo sapiens
gacttgctgtcaaaccctaggatag

SEQ ID NO: 15138 - DNA, 25 bp, Homo sapiens
gctgtcaaaccctaggatagtctca

SEQ ID NO: 15139 - DNA, 25 bp, Homo sapiens
tgtcaaaccctaggatagtctcata

SEQ ID NO: 15140 - DNA, 25 bp, Homo sapiens
gagtgaggctgggggttctcacacc

SEQ ID NO: 15141 - DNA, 25 bp, Homo sapiens
attttctccatggcctgaattaaga

SEQ ID NO: 15142 - DNA, 25 bp, Homo sapiens
aagaccattagaaagcaccaggccg

SEQ ID NO: 15143 - DNA, 25 bp, Homo sapiens
ctgactgttcttgtggatcttgtgt

SEQ ID NO: 15144 - DNA, 25 bp, Homo sapiens
tgtggatcttgtgtccagggacatg

SEQ ID NO: 15145 - DNA, 25 bp, Homo sapiens
acatggggtgacatgcctcgtatgt

SEQ ID NO: 15146 - DNA, 25 bp, Homo sapiens
gtgacatgcctcgtatgtgttagag

SEQ ID NO: 15147 - DNA, 25 bp, Homo sapiens
gtggaatggatgtgtttggcgctgc

SEQ ID NO: 15148 - DNA, 25 bp, Homo sapiens
ttggcgctgcatgggatctggtgcc

SEQ ID NO: 15149 - DNA, 25 bp, Homo sapiens
tgccctagattggttcaaggaggtc

SEQ ID NO: 15150 - DNA, 25 bp, Homo sapiens
ggttcaaggaggtcatccaactgac

SEQ ID NO: 15151 - DNA, 25 bp, Homo sapiens
gaggtcatccaactgactttatcaa

SEQ ID NO: 15152 - DNA, 25 bp, Homo sapiens
gtgggcccaacaggcccttggtaga

SEQ ID NO: 15153 - DNA, 25 bp, Homo sapiens
cccaacaggcccttggtagagctgg

SEQ ID NO: 15154 - DNA, 25 bp, Homo sapiens
actgattggccagccgagcgagaac

SEQ ID NO: 15155 - DNA, 25 bp, Homo sapiens
agccgagcgagaaccaggctgctgc

SEQ ID NO: 15156 - DNA, 25 bp, Homo sapiens
tgaaaagtccttaaccgtggactct

SEQ ID NO: 15157 - DNA, 25 bp, Homo sapiens
tcctttaccccacatatgcaatgac

SEQ ID NO: 15158 - DNA, 25 bp, Homo sapiens
tcacttttgtagtttaatcctttgt

SEQ ID NO: 15159 - DNA, 25 bp, Homo sapiens
gttgcatatatggacaccgacttgg

SEQ ID NO: 15160 - DNA, 25 bp, Homo sapiens
caccgacttgggaggacaggtcctg

SEQ ID NO: 15161 - DNA, 25 bp, Homo sapiens
tcctgaatgtcctttctccagtgta

SEQ ID NO: 15162 - DNA, 25 bp, Homo sapiens
tccagtgtaacatgttttactcaca

SEQ ID NO: 15163 - DNA, 25 bp, Homo sapiens
atccagaaccgggcaggcaagacgc

SEQ ID NO: 15164 - DNA, 25 bp, Homo sapiens
gcgcctggccaagtggtacatgcag

SEQ ID NO: 15165 - DNA, 25 bp, Homo sapiens
gccaagtggtacatgcagtttgatg

SEQ ID NO: 15166 - DNA, 25 bp, Homo sapiens
gatcgaggaggtgcatgccgtggtc

SEQ ID NO: 15167 - DNA, 25 bp, Homo sapiens
gacgccaaacacaccaactttgtgg

SEQ ID NO: 15168 - DNA, 25 bp, Homo sapiens
aaacgaatatttccacaatgtctgt

SEQ ID NO: 15169 - DNA, 25 bp, Homo sapiens
caatgtctgtgaactggacctggtg

SEQ ID NO: 15170 - DNA, 25 bp, Homo sapiens
gacctggtgttcaacttctacaagg

SEQ ID NO: 15171 - DNA, 25 bp, Homo sapiens
tctacaaggtttacacggtcgtgga

SEQ ID NO: 15172 - DNA, 25 bp, Homo sapiens
ctgatgctacagtccctggagtgag

SEQ ID NO: 15173 - DNA, 25 bp, Homo sapiens
gtccctggagtgagggcaggcgagc

SEQ ID NO: 15174 - DNA, 25 bp, Homo sapiens
catttactacagtgtctcagccttg

SEQ ID NO: 15175 - DNA, 25 bp, Homo sapiens
gtgtctcagccttgataaagggcag

SEQ ID NO: 15176 - DNA, 25 bp, Homo sapiens
tgcctgttgttcggtgttgtgaata

SEQ ID NO: 15177 - DNA, 25 bp, Homo sapiens
gtgttgtgaatagcacctctgaata

SEQ ID NO: 15178 - DNA, 25 bp, Homo sapiens
aatcggaatgtttgttgtatgcctt

SEQ ID NO: 15179 - DNA, 25 bp, Homo sapiens
tttcacttatatgtgcatgtccata

SEQ ID NO: 15180 - DNA, 25 bp, Homo sapiens
ggaaaactcctgaaatcctagaatg

SEQ ID NO: 15181 - DNA, 25 bp, Homo sapiens
gtcttgttatttttagctgactgta

SEQ ID NO: 15182 - DNA, 25 bp, Homo sapiens
gaacagtctttgtgtattgtgctta

SEQ ID NO: 15183 - DNA, 25 bp, Homo sapiens
atatttcatccttgtcatgctcaaa

SEQ ID NO: 15184 - DNA, 25 bp, Homo sapiens
gttacatgcttgttattcagagtat

SEQ ID NO: 15185 - DNA, 25 bp, Homo sapiens
atattgcagggttcagtctagattg

SEQ ID NO: 15186 - DNA, 25 bp, Homo sapiens
ggaagagtattgagcccgtttcatc

SEQ ID NO: 15187 - DNA, 25 bp, Homo sapiens
tgagcccgtttcatcatggtttggt

SEQ ID NO: 15188 - DNA, 25 bp, Homo sapiens
atggtttggtccaggttctgttctg

SEQ ID NO: 15189 - DNA, 25 bp, Homo sapiens
gtcagcactctttcagctatctatg

SEQ ID NO: 15190 - DNA, 25 bp, Homo sapiens
gaagaccttggattgccagtgtggg

SEQ ID NO: 15191 - DNA, 25 bp, Homo sapiens
caactctgttttccggactgttatt

SEQ ID NO: 15192 - DNA, 25 bp, Homo sapiens
ccggactgttattaggactctgtat

SEQ ID NO: 15193 - DNA, 25 bp, Homo sapiens
tgtggcagattgcctttgtccttca

SEQ ID NO: 15194 - DNA, 25 bp, Homo sapiens
acaaagactttccacagaatgccat

SEQ ID NO: 15195 - DNA, 25 bp, Homo sapiens
agaatgccataagacaacgctctct

SEQ ID NO: 15196 - DNA, 25 bp, Homo sapiens
gccaggaaccaagagcactcatggt

SEQ ID NO: 15197 - DNA, 25 bp, Homo sapiens
aagagcactcatggttcactctctg

SEQ ID NO: 15198 - DNA, 25 bp, Homo sapiens
gttcactctctggtctaggactgat

SEQ ID NO: 15199 - DNA, 25 bp, Homo sapiens
cactctctggtctaggactgatggg

SEQ ID NO: 15200 - DNA, 25 bp, Homo sapiens
ccaggcctgtgttcgtgagtcggcc

SEQ ID NO: 15201 - DNA, 25 bp, Homo sapiens
aggcctgtgttcgtgagtcggcctg

SEQ ID NO: 15202 - DNA, 25 bp, Homo sapiens
ccatttcttaccccttgtaggcaat

SEQ ID NO: 15203 - DNA, 25 bp, Homo sapiens
ttaccccttgtaggcaatggcaaag

SEQ ID NO: 15204 - DNA, 25 bp, Homo sapiens
gcaatggcaaagaatgtggtcaggc

SEQ ID NO: 15205 - DNA, 25 bp, Homo sapiens
agaatgtggtcaggctgtagcctcc

SEQ ID NO: 15206 - DNA, 25 bp, Homo sapiens
atatggcatgtataagttttcaata

SEQ ID NO: 15207 - DNA, 25 bp, Homo sapiens
ggggagcagggacaaaaccagccca

SEQ ID NO: 15208 - DNA, 25 bp, Homo sapiens
aaaccagcccaatatgtaatcccct

SEQ ID NO: 15209 - DNA, 25 bp, Homo sapiens
tccttcctcctctgtttagcaaagg

SEQ ID NO: 15210 - DNA, 25 bp, Homo sapiens
gcagctcacttggatgtccttacaa

SEQ ID NO: 15211 - DNA, 25 bp, Homo sapiens
ctggcccccaggttgagcaataaga

SEQ ID NO: 15212 - DNA, 25 bp, Homo sapiens
ataagaaaccagaaccttgcgccca

SEQ ID NO: 15213 - DNA, 25 bp, Homo sapiens
ggtggagcaccaggtaccacacagc

SEQ ID NO: 15214 - DNA, 25 bp, Homo sapiens
gctcggagtctgcaggaactggcct

SEQ ID NO: 15215 - DNA, 25 bp, Homo sapiens
gtgaggatggatgcgggcgctgtcc

SEQ ID NO: 15216 - DNA, 25 bp, Homo sapiens
tccttgccgggaagtcactgttgaa

SEQ ID NO: 15217 - DNA, 25 bp, Homo sapiens
aagttgcagtggcttgttcacacct

SEQ ID NO: 15218 - DNA, 25 bp, Homo sapiens
ccccccaattgctgccaatagtgga

SEQ ID NO: 15219 - DNA, 25 bp, Homo sapiens
ataacatgtatcactcactgccaaa

SEQ ID NO: 15220 - DNA, 25 bp, Homo sapiens
tgccttaaggccacactggcatctc

SEQ ID NO: 15221 - DNA, 25 bp, Homo sapiens
gcaggagtaagtttctcatcccatg

SEQ ID NO: 15222 - DNA, 25 bp, Homo sapiens
ccccactcacagggagctggcaatg

SEQ ID NO: 15223 - DNA, 25 bp, Homo sapiens
acagggagctggcaatgccctacct

SEQ ID NO: 15224 - DNA, 25 bp, Homo sapiens
tacctgcctgttctccagatggaga

SEQ ID NO: 15225 - DNA, 25 bp, Homo sapiens
gaaacaggctctgagatttcacagg

SEQ ID NO: 15226 - DNA, 25 bp, Homo sapiens
gatttcacaggtcttgcccaaagtc

SEQ ID NO: 15227 - DNA, 25 bp, Homo sapiens
aacacagtgtttcctgagtagcagt

SEQ ID NO: 15228 - DNA, 25 bp, Homo sapiens
gtgattgttatgccttgctatttta

SEQ ID NO: 15229 - DNA, 25 bp, Homo sapiens
gaaatttttgtcactcccagaggtg

SEQ ID NO: 15230 - DNA, 25 bp, Homo sapiens
gacaagccatccacgtggggaatca

SEQ ID NO: 15231 - DNA, 25 bp, Homo sapiens
acagtacagtcagttaagccatggt

SEQ ID NO: 15232 - DNA, 25 bp, Homo sapiens
taaggttctgatctacaatggccaa

SEQ ID NO: 15233 - DNA, 25 bp, Homo sapiens
caatggccaactggacatcatcgtg

SEQ ID NO: 15234 - DNA, 25 bp, Homo sapiens
acagagcactccttgatgggcatgg

SEQ ID NO: 15235 - DNA, 25 bp, Homo sapiens
gtgaagtggctggttacatccggca

SEQ ID NO: 15236 - DNA, 25 bp, Homo sapiens
ttacatccggcaagcgggtgactcc

SEQ ID NO: 15237 - DNA, 25 bp, Homo sapiens
gggtgactcccatcaggtaattatt

SEQ ID NO: 15238 - DNA, 25 bp, Homo sapiens
gacatattttaccctatgaccagcc

SEQ ID NO: 15239 - DNA, 25 bp, Homo sapiens
tatgttggataaactaccttcccga

SEQ ID NO: 15240 - DNA, 25 bp, Homo sapiens
tacttagtgctctgaatttactttt

SEQ ID NO: 15241 - DNA, 25 bp, Homo sapiens
gtaagttgcactcatgtaagtatca

SEQ ID NO: 15242 - DNA, 25 bp, Homo sapiens
aaaaggaggccttgtgcatttcaag

SEQ ID NO: 15243 - DNA, 25 bp, Homo sapiens
tcaagtttgcaaagtacctgtgtac

SEQ ID NO: 15244 - DNA, 25 bp, Homo sapiens
atgtgtggagacctactgtacagta

SEQ ID NO: 15245 - DNA, 25 bp, Homo sapiens
tgtacagtagttttgcccctttaat

SEQ ID NO: 15246 - DNA, 25 bp, Homo sapiens
ccctttaattggggcacattcatct

SEQ ID NO: 15247 - DNA, 25 bp, Homo sapiens
ggggcacattcatcttaaatcttat

SEQ ID NO: 15248 - DNA, 25 bp, Homo sapiens
aatcttatagtatttatccacccaa

SEQ ID NO: 15249 - DNA, 25 bp, Homo sapiens
aaaccccagactgagatactgctcc

SEQ ID NO: 15250 - DNA, 25 bp, Homo sapiens
gctgccagtccgtgattttaattgc

SEQ ID NO: 15251 - DNA, 25 bp, Homo sapiens
agcaggtctcccacgagtaatggtg

SEQ ID NO: 15252 - DNA, 25 bp, Homo sapiens
gacgacctctatgaccaagacgact

SEQ ID NO: 15253 - DNA, 25 bp, Homo sapiens
gaccaagacgactcgagggacttcc

SEQ ID NO: 15254 - DNA, 25 bp, Homo sapiens
cactacgacgacttcaggtctcggg

SEQ ID NO: 15255 - DNA, 25 bp, Homo sapiens
ctcccctatgatgggcggctactgg

SEQ ID NO: 15256 - DNA, 25 bp, Homo sapiens
tgatgggcggctactggaggaggct

SEQ ID NO: 15257 - DNA, 25 bp, Homo sapiens
gcaggctcaagaagaacttggccct

SEQ ID NO: 15258 - DNA, 25 bp, Homo sapiens
agaacttggccctgagtcgggaaag

SEQ ID NO: 15259 - DNA, 25 bp, Homo sapiens
gtcgggaaagtttagtcgtctgatc

SEQ ID NO: 15260 - DNA, 25 bp, Homo sapiens
gtcgtctgatctgacgttttctacg

SEQ ID NO: 15261 - DNA, 25 bp, Homo sapiens
gacgttttctacgtagcttttgtat

SEQ ID NO: 15262 - DNA, 25 bp, Homo sapiens
ggtccttatgttgtcaccatagagc

SEQ ID NO: 15263 - DNA, 25 bp, Homo sapiens
acaaaggtatagggctgccttcctc

SEQ ID NO: 15264 - DNA, 25 bp, Homo sapiens
atttggagtaactgagcctgtaact

SEQ ID NO: 15265 - DNA, 25 bp, Homo sapiens
cctgtaactcaggtttatggctgtt

SEQ ID NO: 15266 - DNA, 25 bp, Homo sapiens
gaatctttattatgtcttctcctaa

SEQ ID NO: 15267 - DNA, 25 bp, Homo sapiens
cttctcctaagcagtttaaccaaat

SEQ ID NO: 15268 - DNA, 25 bp, Homo sapiens
gaacgtcaaagctctgtatacctac

SEQ ID NO: 15269 - DNA, 25 bp, Homo sapiens
ggaaaacaagaccatcatctaagtg

SEQ ID NO: 15270 - DNA, 25 bp, Homo sapiens
tagtgactacacagcaataattaca

SEQ ID NO: 15271 - DNA, 25 bp, Homo sapiens
aaggcagacaagggctaagatttcc

SEQ ID NO: 15272 - DNA, 25 bp, Homo sapiens
aaatgtatcacctgttccttaactg

SEQ ID NO: 15273 - DNA, 25 bp, Homo sapiens
ccaacggtaccttcttcatggtttg

SEQ ID NO: 15274 - DNA, 25 bp, Homo sapiens
ccttcttcatggtttggagtgtgtg

SEQ ID NO: 15275 - DNA, 25 bp, Homo sapiens
ggagtgtgtggtagcaatgcatcaa

SEQ ID NO: 15276 - DNA, 25 bp, Homo sapiens
gtagcaatgcatcaagctcagctta

SEQ ID NO: 15277 - DNA, 25 bp, Homo sapiens
gctcagcttatctccaagattccac

SEQ ID NO: 15278 - DNA, 25 bp, Homo sapiens
agattccacatatcttgaaggagat

SEQ ID NO: 15279 - DNA, 25 bp, Homo sapiens
ggagatgtacgatgcagacctttta

SEQ ID NO: 15280 - DNA, 25 bp, Homo sapiens
ggtcatcatcagctggtcggaaaag

SEQ ID NO: 15281 - DNA, 25 bp, Homo sapiens
tcagctggtcggaaaaggcctctaa

SEQ ID NO: 15282 - DNA, 25 bp, Homo sapiens
aggcctctaagaaatatgtctccaa

SEQ ID NO: 15283 - DNA, 25 bp, Homo sapiens
agagattcgtgtcaaagcagaacca

SEQ ID NO: 15284 - DNA, 25 bp, Homo sapiens
ctgctgccacataaggtctttgaag

SEQ ID NO: 15285 - DNA, 25 bp, Homo sapiens
tcgcccaaccaactctattgtgttc

SEQ ID NO: 15286 - DNA, 25 bp, Homo sapiens
attgtgttcaccaagctcacaccat

SEQ ID NO: 15287 - DNA, 25 bp, Homo sapiens
gctcacaccattcatgcttggagcc

SEQ ID NO: 15288 - DNA, 25 bp, Homo sapiens
ggtcgccatgtatgagcacaagatc

SEQ ID NO: 15289 - DNA, 25 bp, Homo sapiens
caagatcttcgttcagggcatcatc

SEQ ID NO: 15290 - DNA, 25 bp, Homo sapiens
tgatggcagtgctcaagtgacctct

SEQ ID NO: 15291 - DNA, 25 bp, Homo sapiens
acgcttctaccaatgggctcatcaa

SEQ ID NO: 15292 - DNA, 25 bp, Homo sapiens
cagcgcgaggccagagtccaataaa

SEQ ID NO: 15293 - DNA, 25 bp, Homo sapiens
gtccaataaactcgtgctcatctgc

SEQ ID NO: 15294 - DNA, 25 bp, Homo sapiens
cctctggttgtgggcttggaccacg

SEQ ID NO: 15295 - DNA, 25 bp, Homo sapiens
aggcacatcgaacctgagttagcag

SEQ ID NO: 15296 - DNA, 25 bp, Homo sapiens
gagttagcaggaagggattctccaa

SEQ ID NO: 15297 - DNA, 25 bp, Homo sapiens
tatggaagatttcttaccggaccct

SEQ ID NO: 15298 - DNA, 25 bp, Homo sapiens
ggacccttgaacctcaatgatccag

SEQ ID NO: 15299 - DNA, 25 bp, Homo sapiens
gaagagctccatttaatcgtttata

SEQ ID NO: 15300 - DNA, 25 bp, Homo sapiens
taatcgtttataaggccatgagtgc

SEQ ID NO: 15301 - DNA, 25 bp, Homo sapiens
ccatgagtgcggctgtgtgctttat

SEQ ID NO: 15302 - DNA, 25 bp, Homo sapiens
tctgtccacccaacgttggattttt

SEQ ID NO: 15303 - DNA, 25 bp, Homo sapiens
aacgttggatttttgccgaagactg

SEQ ID NO: 15304 - DNA, 25 bp, Homo sapiens
gccgaagactggacagcatcgttgg

SEQ ID NO: 15305 - DNA, 25 bp, Homo sapiens
gtctgagaaagaaccccagtttaag

SEQ ID NO: 15306 - DNA, 25 bp, Homo sapiens
gcaacactggccccacagtaaaaga

SEQ ID NO: 15307 - DNA, 25 bp, Homo sapiens
gcaggcccatctagagctattgctc

SEQ ID NO: 15308 - DNA, 25 bp, Homo sapiens
gaatccattctctggtcttctgaaa

SEQ ID NO: 15309 - DNA, 25 bp, Homo sapiens
ataccaagggcagatgtcacctcct

SEQ ID NO: 15310 - DNA, 25 bp, Homo sapiens
tgactctgggctctacaaccagctc

SEQ ID NO: 15311 - DNA, 25 bp, Homo sapiens
tcccagtcaccatatccagtgttgt

SEQ ID NO: 15312 - DNA, 25 bp, Homo sapiens
agagactggccaacaggaccaacca

SEQ ID NO: 15313 - DNA, 25 bp, Homo sapiens
agatgaccctctgagcttttcattt

SEQ ID NO: 15314 - DNA, 25 bp, Homo sapiens
caagctctgtggtacagcctttttt

SEQ ID NO: 15315 - DNA, 25 bp, Homo sapiens
ccacccttgcctgtttacattaatt

SEQ ID NO: 15316 - DNA, 25 bp, Homo sapiens
ggctgtatgtacaatcctgggcatt

SEQ ID NO: 15317 - DNA, 25 bp, Homo sapiens
gggaagcattatcttgaccagctga

SEQ ID NO: 15318 - DNA, 25 bp, Homo sapiens
ttgggtattcttggatccccatcac

SEQ ID NO: 15319 - DNA, 25 bp, Homo sapiens
ggatccccatcacaagaagacctga

SEQ ID NO: 15320 - DNA, 25 bp, Homo sapiens
gcccacccatatctggagcagtatt

SEQ ID NO: 15321 - DNA, 25 bp, Homo sapiens
gagcagtattacgacccgagtgacg

SEQ ID NO: 15322 - DNA, 25 bp, Homo sapiens
gagactgctagattccagccaggat

SEQ ID NO: 15323 - DNA, 25 bp, Homo sapiens
agggctcagaggactggacgtgctc

SEQ ID NO: 15324 - DNA, 25 bp, Homo sapiens
ctggacgtgctcagacatcggtgtt

SEQ ID NO: 15325 - DNA, 25 bp, Homo sapiens
cgtcttggcttatccactttgactc

SEQ ID NO: 15326 - DNA, 25 bp, Homo sapiens
gagccgtttggaggggcggtttctg

SEQ ID NO: 15327 - DNA, 25 bp, Homo sapiens
ggtagttgtggcttttatgctttca

SEQ ID NO: 15328 - DNA, 25 bp, Homo sapiens
gatgtattaacctacctgtgaatca

SEQ ID NO: 15329 - DNA, 25 bp, Homo sapiens
gtaggaaaagctgttcccatgtcta

SEQ ID NO: 15330 - DNA, 25 bp, Homo sapiens
gttcccatgtctaacaggacttgaa

SEQ ID NO: 15331 - DNA, 25 bp, Homo sapiens
gtggatagtagatctgtggcgatat

SEQ ID NO: 15332 - DNA, 25 bp, Homo sapiens
tatgagagggatgcagtgcctttcc

SEQ ID NO: 15333 - DNA, 25 bp, Homo sapiens
ctagttgtaatgtgtatgtctggta

SEQ ID NO: 15334 - DNA, 25 bp, Homo sapiens
tatattttggccttacaataccgta

SEQ ID NO: 15335 - DNA, 25 bp, Homo sapiens
tctcaaaccctgtttacggtacttg

SEQ ID NO: 15336 - DNA, 25 bp, Homo sapiens
gagggagccggtttgggagagacca

SEQ ID NO: 15337 - DNA, 25 bp, Homo sapiens
tgggagagaccattgcatcgctgtc

SEQ ID NO: 15338 - DNA, 25 bp, Homo sapiens
gcatcgctgtccaagtgtttcttgt

SEQ ID NO: 15339 - DNA, 25 bp, Homo sapiens
tggtgccatggctgttagtttttag

SEQ ID NO: 15340 - DNA, 25 bp, Homo sapiens
aaaataggcagaattccattcctcc

SEQ ID NO: 15341 - DNA, 25 bp, Homo sapiens
ttccattcctcccaaggtggcaaaa

SEQ ID NO: 15342 - DNA, 25 bp, Homo sapiens
gggtatgaattccctgacacacatt

SEQ ID NO: 15343 - DNA, 25 bp, Homo sapiens
tgagcactgctctaacaacaagcat

SEQ ID NO: 15344 - DNA, 25 bp, Homo sapiens
aagtctacaaatgagctcttgcaac

SEQ ID NO: 15345 - DNA, 25 bp, Homo sapiens
ttttcccctaactttagcaatgtag

SEQ ID NO: 15346 - DNA, 25 bp, Homo sapiens
atgttcttctatcaaataccttatt

SEQ ID NO: 15347 - DNA, 25 bp, Homo sapiens
atttgttgcacaggcagatactgct

SEQ ID NO: 15348 - DNA, 25 bp, Homo sapiens
aactgcaaaaccaatctgtatcatg

SEQ ID NO: 15349 - DNA, 25 bp, Homo sapiens
atctgtatcatgtaccaaactgact

SEQ ID NO: 15350 - DNA, 25 bp, Homo sapiens
aaatgcttgggtacacttctcttaa

SEQ ID NO: 15351 - DNA, 25 bp, Homo sapiens
aggaacctcaagtcatgcttttgct

SEQ ID NO: 15352 - DNA, 25 bp, Homo sapiens
gtcatgcttttgctatcaccaatca

SEQ ID NO: 15353 - DNA, 25 bp, Homo sapiens
accaatcatagtgtacccatcttta

SEQ ID NO: 15354 - DNA, 25 bp, Homo sapiens
agctgtcggagctaatgtcacaatt

SEQ ID NO: 15355 - DNA, 25 bp, Homo sapiens
gtgtgcttcctgctgtatgtgagct

SEQ ID NO: 15356 - DNA, 25 bp, Homo sapiens
gaaacttggccagtttgttcctcta

SEQ ID NO: 15357 - DNA, 25 bp, Homo sapiens
agaatctgtattcagacccctgggg

SEQ ID NO: 15358 - DNA, 25 bp, Homo sapiens
gggtcaggaaattactgccccactt

SEQ ID NO: 15359 - DNA, 25 bp, Homo sapiens
tactgccccacttgtcaagttcagc

SEQ ID NO: 15360 - DNA, 25 bp, Homo sapiens
ttcagcccaccatctgtttgaacat

SEQ ID NO: 15361 - DNA, 25 bp, Homo sapiens
cgcaggactccctcacaggagtagg

SEQ ID NO: 15362 - DNA, 25 bp, Homo sapiens
ggaatgacttgctagtggctgcaga

SEQ ID NO: 15363 - DNA, 25 bp, Homo sapiens
gtggctgcagattccatcactaaca

SEQ ID NO: 15364 - DNA, 25 bp, Homo sapiens
cactaacactatgtcctctcttgtg

SEQ ID NO: 15365 - DNA, 25 bp, Homo sapiens
tggattctgaatttgcacggactca

SEQ ID NO: 15366 - DNA, 25 bp, Homo sapiens
ttgaggatcttgttccctcaccaac

SEQ ID NO: 15367 - DNA, 25 bp, Homo sapiens
gcttttctagcgcaaatccatgccc

SEQ ID NO: 15368 - DNA, 25 bp, Homo sapiens
atccatgcccgaaaacctgggtaca

SEQ ID NO: 15369 - DNA, 25 bp, Homo sapiens
atgcgtggcgacatggttacggagg

SEQ ID NO: 15370 - DNA, 25 bp, Homo sapiens
agatccctatgtgcagcctgaagat

SEQ ID NO: 15371 - DNA, 25 bp, Homo sapiens
tgaaaatgactctgtccggcagctg

SEQ ID NO: 15372 - DNA, 25 bp, Homo sapiens
attcagccatgtccctttataatag

SEQ ID NO: 15373 - DNA, 25 bp, Homo sapiens
attcagcagaagacccggcttgctc

SEQ ID NO: 15374 - DNA, 25 bp, Homo sapiens
gctccagtgtagctttctacatccc

SEQ ID NO: 15375 - DNA, 25 bp, Homo sapiens
atcgggtggccatccttgtggatga

SEQ ID NO: 15376 - DNA, 25 bp, Homo sapiens
catggctgacacttgtggcacaatc

SEQ ID NO: 15377 - DNA, 25 bp, Homo sapiens
ggcacaatctgccatgcagctgaca

SEQ ID NO: 15378 - DNA, 25 bp, Homo sapiens
ggcgccaccagagtttatgccatct

SEQ ID NO: 15379 - DNA, 25 bp, Homo sapiens
gcatcaacaacgcatgctttgaggc

SEQ ID NO: 15380 - DNA, 25 bp, Homo sapiens
tgaggcagtagtagtcaccaatacc

SEQ ID NO: 15381 - DNA, 25 bp, Homo sapiens
gtgattgacatctctatgatccttg

SEQ ID NO: 15382 - DNA, 25 bp, Homo sapiens
agaatccgtttcttacctattcagc

SEQ ID NO: 15383 - DNA, 25 bp, Homo sapiens
ccaccttgtgttctgctgaagtctg

SEQ ID NO: 15384 - DNA, 25 bp, Homo sapiens
gctgaagtctgccagtgtgctgagg

SEQ ID NO: 15385 - DNA, 25 bp, Homo sapiens
aggatgaagtttgcctgctactacc

SEQ ID NO: 15386 - DNA, 25 bp, Homo sapiens
tactacccccgtgtggagtacggct

SEQ ID NO: 15387 - DNA, 25 bp, Homo sapiens
gcttccaggttaaggttctccgaga

SEQ ID NO: 15388 - DNA, 25 bp, Homo sapiens
aagacagcagagctgctttccgcct

SEQ ID NO: 15389 - DNA, 25 bp, Homo sapiens
tgagaccaagatcacccaagtcctg

SEQ ID NO: 15390 - DNA, 25 bp, Homo sapiens
caagtcctgcacttcaccaaggatg

SEQ ID NO: 15391 - DNA, 25 bp, Homo sapiens
caccaaggatgtcaaggccgctgct

SEQ ID NO: 15392 - DNA, 25 bp, Homo sapiens
ggccgctgctaatcagatgcgcaac

SEQ ID NO: 15393 - DNA, 25 bp, Homo sapiens
atcgaggagatgccctctgaacgcc

SEQ ID NO: 15394 - DNA, 25 bp, Homo sapiens
gggctgcgtccaaagaggactctgc

SEQ ID NO: 15395 - DNA, 25 bp, Homo sapiens
ggagttggtgccttccagtattatc

SEQ ID NO: 15396 - DNA, 25 bp, Homo sapiens
gatggagtctgacgcaggaaccttc

SEQ ID NO: 15397 - DNA, 25 bp, Homo sapiens
actgggctgcaattcactggcagtg

SEQ ID NO: 15398 - DNA, 25 bp, Homo sapiens
ggaggaggttatgagcctgctgcag

SEQ ID NO: 15399 - DNA, 25 bp, Homo sapiens
gcctggagccagtctacttgatgac

SEQ ID NO: 15400 - DNA, 25 bp, Homo sapiens
atcactcccacggagacaccatgac

SEQ ID NO: 15401 - DNA, 25 bp, Homo sapiens
gtttgggctgttgtttcttatgttg

SEQ ID NO: 15402 - DNA, 25 bp, Homo sapiens
ggaagaaatgctgcctaggtcctag

SEQ ID NO: 15403 - DNA, 25 bp, Homo sapiens
ggcggtggagcctttatatcatggg

SEQ ID NO: 15404 - DNA, 25 bp, Homo sapiens
atcatgggaagcactctcacttatt

SEQ ID NO: 15405 - DNA, 25 bp, Homo sapiens
gatccaaccattgaagattcttaca

SEQ ID NO: 15406 - DNA, 25 bp, Homo sapiens
gacagagcagcccggctagatattt

SEQ ID NO: 15407 - DNA, 25 bp, Homo sapiens
tgaggactggcgaaggcttcctgtt

SEQ ID NO: 15408 - DNA, 25 bp, Homo sapiens
ttcctgttggtcttttcagtcacag

SEQ ID NO: 15409 - DNA, 25 bp, Homo sapiens
ggatcgtgatgagttcccaatgatt

SEQ ID NO: 15410 - DNA, 25 bp, Homo sapiens
gaaggacaacagttagcacggcagc

SEQ ID NO: 15411 - DNA, 25 bp, Homo sapiens
gcacggcagcttaaggtaacataca

SEQ ID NO: 15412 - DNA, 25 bp, Homo sapiens
tgtagatcaagctttccatgaactt

SEQ ID NO: 15413 - DNA, 25 bp, Homo sapiens
ccatgaacttgtccgggttatcagg

SEQ ID NO: 15414 - DNA, 25 bp, Homo sapiens
tccttcaccagaaccaacacggaaa

SEQ ID NO: 15415 - DNA, 25 bp, Homo sapiens
gacaagaaaggctgccattgtgtca

SEQ ID NO: 15416 - DNA, 25 bp, Homo sapiens
ggatggctcaggaacgcttggatct

SEQ ID NO: 15417 - DNA, 25 bp, Homo sapiens
ggatctggcagttcaggcctacagt

SEQ ID NO: 15418 - DNA, 25 bp, Homo sapiens
agtccacccgttttatgtgtgcagc

SEQ ID NO: 15419 - DNA, 25 bp, Homo sapiens
agacttccttgtcctcataagatag

SEQ ID NO: 15420 - DNA, 25 bp, Homo sapiens
aagaccatcttccttctgataatgt

SEQ ID NO: 15421 - DNA, 25 bp, Homo sapiens
tatggtgttacaggcctttgcctct

SEQ ID NO: 15422 - DNA, 25 bp, Homo sapiens
tttgcctcttgcttaacatttggga

SEQ ID NO: 15423 - DNA, 25 bp, Homo sapiens
tttgggaccattcgagactcactaa

SEQ ID NO: 15424 - DNA, 25 bp, Homo sapiens
gaacttgaggatccgggtgcttata

SEQ ID NO: 15425 - DNA, 25 bp, Homo sapiens
agtacaccgaactgtccaatgctaa

SEQ ID NO: 15426 - DNA, 25 bp, Homo sapiens
gcagccatgaggagaacctcccagc

SEQ ID NO: 15427 - DNA, 25 bp, Homo sapiens
ggagagctattccgtgtacgtgtac

SEQ ID NO: 15428 - DNA, 25 bp, Homo sapiens
catctcatccaaggccatgggcatc

SEQ ID NO: 15429 - DNA, 25 bp, Homo sapiens
atcatgaactccttcgtcaacgata

SEQ ID NO: 15430 - DNA, 25 bp, Homo sapiens
cgatatcttcgagcgcatcgctggc

SEQ ID NO: 15431 - DNA, 25 bp, Homo sapiens
cccgcctggcgcattacaacaagcg

SEQ ID NO: 15432 - DNA, 25 bp, Homo sapiens
caccatcacctccagggagatccag

SEQ ID NO: 15433 - DNA, 25 bp, Homo sapiens
tccgctcctgctccaaaaaagggct

SEQ ID NO: 15434 - DNA, 25 bp, Homo sapiens
ctggctaagcacgccgtgtcagagg

SEQ ID NO: 15435 - DNA, 25 bp, Homo sapiens
tgtcagagggcaccaaggccgtcac

SEQ ID NO: 15436 - DNA, 25 bp, Homo sapiens
tcaccaagtacaccagctctaagta

SEQ ID NO: 15437 - DNA, 25 bp, Homo sapiens
ggtaagaagcgcaagcgtagccgca

SEQ ID NO: 15438 - DNA, 25 bp, Homo sapiens
tctccattattgctgcccggaagca

SEQ ID NO: 15439 - DNA, 25 bp, Homo sapiens
gaaattgtccgagatcactgggcca

SEQ ID NO: 15440 - DNA, 25 bp, Homo sapiens
ccgccactactattgcaggtttgac

SEQ ID NO: 15441 - DNA, 25 bp, Homo sapiens
gaggggttggatcccaagacgacat

SEQ ID NO: 15442 - DNA, 25 bp, Homo sapiens
gccctggtcacagacaaatccttca

SEQ ID NO: 15443 - DNA, 25 bp, Homo sapiens
aatccttcattggccagcagtttgc

SEQ ID NO: 15444 - DNA, 25 bp, Homo sapiens
gtttgctgtggggagccatgtctac

SEQ ID NO: 15445 - DNA, 25 bp, Homo sapiens
agttttgaatacgtggaccctgtgg

SEQ ID NO: 15446 - DNA, 25 bp, Homo sapiens
aggacgttgcaatctgtgtggggaa

SEQ ID NO: 15447 - DNA, 25 bp, Homo sapiens
agagagctttggcactggctctgac

SEQ ID NO: 15448 - DNA, 25 bp, Homo sapiens
gaccacctccgagagaaggatggcc

SEQ ID NO: 15449 - DNA, 25 bp, Homo sapiens
acctcgcggcggaacccgaggagag

SEQ ID NO: 15450 - DNA, 25 bp, Homo sapiens
gccaaactgcaggcacaagtgcgca

SEQ ID NO: 15451 - DNA, 25 bp, Homo sapiens
acagtgatccactttaacaacccta

SEQ ID NO: 15452 - DNA, 25 bp, Homo sapiens
ttcaggcatctctggcagcgaacac

SEQ ID NO: 15453 - DNA, 25 bp, Homo sapiens
gcgaacactttcaccattacaggcc

SEQ ID NO: 15454 - DNA, 25 bp, Homo sapiens
gctacccagcatcttaaaccagctt

SEQ ID NO: 15455 - DNA, 25 bp, Homo sapiens
agcttggtgcggatagtctgactag

SEQ ID NO: 15456 - DNA, 25 bp, Homo sapiens
ttaaggagactggccgaagctctgc

SEQ ID NO: 15457 - DNA, 25 bp, Homo sapiens
gaagctctgcccaaacaatctgtgg

SEQ ID NO: 15458 - DNA, 25 bp, Homo sapiens
agcaccacttgctactggagaggat

SEQ ID NO: 15459 - DNA, 25 bp, Homo sapiens
tgactctcgggggcgaggtcgagcc

SEQ ID NO: 15460 - DNA, 25 bp, Homo sapiens
ggagagctattccgtgtacgtgtac

SEQ ID NO: 15461 - DNA, 25 bp, Homo sapiens
caaggtgctgaagcaggtccacccc

SEQ ID NO: 15462 - DNA, 25 bp, Homo sapiens
gcctgaaccagctaagtcagctccc

SEQ ID NO: 15463 - DNA, 25 bp, Homo sapiens
catctcgtccaaggctatggggatt

SEQ ID NO: 15464 - DNA, 25 bp, Homo sapiens
gattatgaactccttcgtcaacgac

SEQ ID NO: 15465 - DNA, 25 bp, Homo sapiens
ttttcgagcgcattgcaggcgaggc

SEQ ID NO: 15466 - DNA, 25 bp, Homo sapiens
tcccgcctggcgcattataacaagc

SEQ ID NO: 15467 - DNA, 25 bp, Homo sapiens
ttataacaagcgctcgaccatcact

SEQ ID NO: 15468 - DNA, 25 bp, Homo sapiens
ccagggagatccaaacggctgtgcg

SEQ ID NO: 15469 - DNA, 25 bp, Homo sapiens
aaacacgcggtgtcggagggcacca

SEQ ID NO: 15470 - DNA, 25 bp, Homo sapiens
gaagggctccaagaaggcggtgacc

SEQ ID NO: 15471 - DNA, 25 bp, Homo sapiens
aagcgcagccgcaaggagagctact

SEQ ID NO: 15472 - DNA, 25 bp, Homo sapiens
gagagctactccgtatacgtgtaca

SEQ ID NO: 15473 - DNA, 25 bp, Homo sapiens
atgcctgagccagcgaaatccgctc

SEQ ID NO: 15474 - DNA, 25 bp, Homo sapiens
gcatctcctctaaagccatggggat

SEQ ID NO: 15475 - DNA, 25 bp, Homo sapiens
tgtcaacgacatcttcgagcgcatc

SEQ ID NO: 15476 - DNA, 25 bp, Homo sapiens
gcattacaacaagcgctcgaccatc

SEQ ID NO: 15477 - DNA, 25 bp, Homo sapiens
tcgaccatcacctccagggagatcc

SEQ ID NO: 15478 - DNA, 25 bp, Homo sapiens
ggccaagcacgctgtgtcagagggc

SEQ ID NO: 15479 - DNA, 25 bp, Homo sapiens
gtcagagggcaccaaggccgttacc

SEQ ID NO: 15480 - DNA, 25 bp, Homo sapiens
ttaccaagtacaccagctccaagta

SEQ ID NO: 15481 - DNA, 25 bp, Homo sapiens
gaagggctccaagaaggccgtgacc

SEQ ID NO: 15482 - DNA, 25 bp, Homo sapiens
ggagacaggacaagcaggctcaccg

SEQ ID NO: 15483 - DNA, 25 bp, Homo sapiens
ggagcagaggttcctgggctgctag

SEQ ID NO: 15484 - DNA, 25 bp, Homo sapiens
gggctgctagggccagaggggcctc

SEQ ID NO: 15485 - DNA, 25 bp, Homo sapiens
gctccaaggtgttcctggaccaaag

SEQ ID NO: 15486 - DNA, 25 bp, Homo sapiens
ctacccggagcttcaggtttggacg

SEQ ID NO: 15487 - DNA, 25 bp, Homo sapiens
ggaccaattggagttccaggcccag

SEQ ID NO: 15488 - DNA, 25 bp, Homo sapiens
ctgggcttcctggtttacatggacc

SEQ ID NO: 15489 - DNA, 25 bp, Homo sapiens
tacatggaccacccggggacaaggg

SEQ ID NO: 15490 - DNA, 25 bp, Homo sapiens
aaggagcgcctggattagatgcccc

SEQ ID NO: 15491 - DNA, 25 bp, Homo sapiens
gcccattgggccaagatggctaccc

SEQ ID NO: 15492 - DNA, 25 bp, Homo sapiens
ctacccagtccaaggctgctggaac

SEQ ID NO: 15493 - DNA, 25 bp, Homo sapiens
aacgcagccgcaaggagagctactc

SEQ ID NO: 15494 - DNA, 25 bp, Homo sapiens
gagagctactccgtatacgtttaca

SEQ ID NO: 15495 - DNA, 25 bp, Homo sapiens
caaggtgctgaagcaagtccacccc

SEQ ID NO: 15496 - DNA, 25 bp, Homo sapiens
catctcctccaaagccatggggatc

SEQ ID NO: 15497 - DNA, 25 bp, Homo sapiens
ggatcatgaattcctttgtcaacga

SEQ ID NO: 15498 - DNA, 25 bp, Homo sapiens
caacgatatcttcgagcgcatcgcc

SEQ ID NO: 15499 - DNA, 25 bp, Homo sapiens
gcctggctcattacaacaagcgttc

SEQ ID NO: 15500 - DNA, 25 bp, Homo sapiens
acaacaagcgttcgaccattacctc

SEQ ID NO: 15501 - DNA, 25 bp, Homo sapiens
cctccagggagatccagacagccgt

SEQ ID NO: 15502 - DNA, 25 bp, Homo sapiens
tgtccgagggcactaaggccgtcac

SEQ ID NO: 15503 - DNA, 25 bp, Homo sapiens
gaagggctccaagaaggcggtgacc

SEQ ID NO: 15504 - DNA, 25 bp, Homo sapiens
aagcgcagccgcaaggagagctact

SEQ ID NO: 15505 - DNA, 25 bp, Homo sapiens
gagagctactccgtatacgtgtaca

SEQ ID NO: 15506 - DNA, 25 bp, Homo sapiens
caaggtgctgaagcaggtccacccc

SEQ ID NO: 15507 - DNA, 25 bp, Homo sapiens
gcatctcctctaaggccatgggaat

SEQ ID NO: 15508 - DNA, 25 bp, Homo sapiens
tgggaatcatgaactccttcgtcaa

SEQ ID NO: 15509 - DNA, 25 bp, Homo sapiens
tcgtcaacgacatcttcgaacgcat

SEQ ID NO: 15510 - DNA, 25 bp, Homo sapiens
tcgaacgcatcgcaggtgaggcttc

SEQ ID NO: 15511 - DNA, 25 bp, Homo sapiens
gcattacaacaagcgctcgaccatc

SEQ ID NO: 15512 - DNA, 25 bp, Homo sapiens
tcgaccatcacctccagggagatcc

SEQ ID NO: 15513 - DNA, 25 bp, Homo sapiens
tcaccaagtacaccagcgctaagta

SEQ ID NO: 15514 - DNA, 25 bp, Homo sapiens
gaaggacggcaggaagcgcaagcgc

SEQ ID NO: 15515 - DNA, 25 bp, Homo sapiens
cttgctcgccgcggcggcgtgaagc

SEQ ID NO: 15516 - DNA, 25 bp, Homo sapiens
atgtctggccgcggcaaaggcggga

SEQ ID NO: 15517 - DNA, 25 bp, Homo sapiens
atctccggcctcatctacgaggaga

SEQ ID NO: 15518 - DNA, 25 bp, Homo sapiens
gactcgcggggtgctgaaggtgttc

SEQ ID NO: 15519 - DNA, 25 bp, Homo sapiens
gttcctggagaacgtgatccgggac

SEQ ID NO: 15520 - DNA, 25 bp, Homo sapiens
gacctatacagagcacgccaagcgc

SEQ ID NO: 15521 - DNA, 25 bp, Homo sapiens
gcaagacggtcaccgccatggatgt

SEQ ID NO: 15522 - DNA, 25 bp, Homo sapiens
cgccatggatgtggtctacgcgctc

SEQ ID NO: 15523 - DNA, 25 bp, Homo sapiens
aaaggcggcgctaagcgccaccgta

SEQ ID NO: 15524 - DNA, 25 bp, Homo sapiens
cgccaccgtaaagtactgcgcgaca

SEQ ID NO: 15525 - DNA, 25 bp, Homo sapiens
gcgacaatatccagggcatcaccaa

SEQ ID NO: 15526 - DNA, 25 bp, Homo sapiens
tcgcctgctccgcaaaggcaactat

SEQ ID NO: 15527 - DNA, 25 bp, Homo sapiens
gcaactatgcggagcgggtcggtgc

SEQ ID NO: 15528 - DNA, 25 bp, Homo sapiens
cggcggtgctggagtacctgaccgc

SEQ ID NO: 15529 - DNA, 25 bp, Homo sapiens
caacgcggcccgcgacaacaagaag

SEQ ID NO: 15530 - DNA, 25 bp, Homo sapiens
caacaagaagactcgcatcatcccg

SEQ ID NO: 15531 - DNA, 25 bp, Homo sapiens
gctggccatccgcaacgatgaggag

SEQ ID NO: 15532 - DNA, 25 bp, Homo sapiens
aagcagggaggcaaagctcgcgcca

SEQ ID NO: 15533 - DNA, 25 bp, Homo sapiens
agcttctgggcaaagtcaccatcgc

SEQ ID NO: 15534 - DNA, 25 bp, Homo sapiens
agtcaccatcgcacagggtggcgtc

SEQ ID NO: 15535 - DNA, 25 bp, Homo sapiens
caggccgtgctgctgccaaagaaaa

SEQ ID NO: 15536 - DNA, 25 bp, Homo sapiens
gaaaactgagagccaccacaagact

SEQ ID NO: 15537 - DNA, 25 bp, Homo sapiens
aaaatgatcgcctcttggtatgcca

SEQ ID NO: 15538 - DNA, 25 bp, Homo sapiens
ggtatgccaggtgtgcatcaaactg

SEQ ID NO: 15539 - DNA, 25 bp, Homo sapiens
agaagcaaatcttggtctgcccatc

SEQ ID NO: 15540 - DNA, 25 bp, Homo sapiens
tctgcccatcagtccattcatggat

SEQ ID NO: 15541 - DNA, 25 bp, Homo sapiens
tccattcatggatcgttcttctcct

SEQ ID NO: 15542 - DNA, 25 bp, Homo sapiens
tcttctcctcaactagcaaaactcc

SEQ ID NO: 15543 - DNA, 25 bp, Homo sapiens
tccaagaatcttttatcacccacat

SEQ ID NO: 15544 - DNA, 25 bp, Homo sapiens
acatagtgggtcccctgtgtaactc

SEQ ID NO: 15545 - DNA, 25 bp, Homo sapiens
gtgtaactcctatgatgctgctggt

SEQ ID NO: 15546 - DNA, 25 bp, Homo sapiens
gctgctggtttgctaccaggtcagt

SEQ ID NO: 15547 - DNA, 25 bp, Homo sapiens
ttcctccttacctcaagcagatgag

SEQ ID NO: 15548 - DNA, 25 bp, Homo sapiens
gaatgacaggagccatccgcaagca

SEQ ID NO: 15549 - DNA, 25 bp, Homo sapiens
gcagttggcggctttcttagaaggc

SEQ ID NO: 15550 - DNA, 25 bp, Homo sapiens
tatatcaggactgcccaccattgac

SEQ ID NO: 15551 - DNA, 25 bp, Homo sapiens
accagtccaactctattcagatcca

SEQ ID NO: 15552 - DNA, 25 bp, Homo sapiens
gagcattgcgttctttcgatcaagc

SEQ ID NO: 15553 - DNA, 25 bp, Homo sapiens
cgatcaagctgaccgtgccaagttc

SEQ ID NO: 15554 - DNA, 25 bp, Homo sapiens
cagtttgtcacgggtacttccaagg

SEQ ID NO: 15555 - DNA, 25 bp, Homo sapiens
gctttgctgccctcgaaggcatgaa

SEQ ID NO: 15556 - DNA, 25 bp, Homo sapiens
tttaatcagctggatctgcctgcct

SEQ ID NO: 15557 - DNA, 25 bp, Homo sapiens
ctccgccacatgctactgttggcta

SEQ ID NO: 15558 - DNA, 25 bp, Homo sapiens
gttggctatccaggagtgctctgaa

SEQ ID NO: 15559 - DNA, 25 bp, Homo sapiens
gacaagtctggcaggctgaaccatc

SEQ ID NO: 15560 - DNA, 25 bp, Homo sapiens
cctgggctatgacctgcccatggtg

SEQ ID NO: 15561 - DNA, 25 bp, Homo sapiens
gaacctgaccctgagttcgaggcaa

SEQ ID NO: 15562 - DNA, 25 bp, Homo sapiens
ggcaatcctggacacggtggatccg

SEQ ID NO: 15563 - DNA, 25 bp, Homo sapiens
tggccatgtctccttgcaagaatac

SEQ ID NO: 15564 - DNA, 25 bp, Homo sapiens
ggctttcatgatcagccgcgaaact

SEQ ID NO: 15565 - DNA, 25 bp, Homo sapiens
cgaggagattgagagcgccttccgg

SEQ ID NO: 15566 - DNA, 25 bp, Homo sapiens
cgggaacaagccgactactgcgtct

SEQ ID NO: 15567 - DNA, 25 bp, Homo sapiens
tctcccacatgaagccctacgtgga

SEQ ID NO: 15568 - DNA, 25 bp, Homo sapiens
cccgctcgcttttcgtgaactgagc

SEQ ID NO: 15569 - DNA, 25 bp, Homo sapiens
ccactgtaaccttaagcctgcttag

SEQ ID NO: 15570 - DNA, 25 bp, Homo sapiens
catggctcctggtaactacctgatc

SEQ ID NO: 15571 - DNA, 25 bp, Homo sapiens
caaatacggtgggcccaaccacatc

SEQ ID NO: 15572 - DNA, 25 bp, Homo sapiens
gccagcgtctagttagccctggctc

SEQ ID NO: 15573 - DNA, 25 bp, Homo sapiens
ggtggagtcagtgaccaggtcgtct

SEQ ID NO: 15574 - DNA, 25 bp, Homo sapiens
tgctatagcgccattcccaaggcat

SEQ ID NO: 15575 - DNA, 25 bp, Homo sapiens
tgacctctaagggggcagggctctc

SEQ ID NO: 15576 - DNA, 25 bp, Homo sapiens
gggctctcaaaggcctttgtgggcc

SEQ ID NO: 15577 - DNA, 25 bp, Homo sapiens
gtgggccagaagagttccttcctgg

SEQ ID NO: 15578 - DNA, 25 bp, Homo sapiens
gcagcaaagctggctccaacatgct

SEQ ID NO: 15579 - DNA, 25 bp, Homo sapiens
tccaacatgctgctgatcggggtcc

SEQ ID NO: 15580 - DNA, 25 bp, Homo sapiens
gagaggggcgattatgtgctggctg

SEQ ID NO: 15581 - DNA, 25 bp, Homo sapiens
tggatgcatctactcaaaccaccca

SEQ ID NO: 15582 - DNA, 25 bp, Homo sapiens
gcgccaaggcgccaacattaatgag

SEQ ID NO: 15583 - DNA, 25 bp, Homo sapiens
taatgagatccgccagatgtccggg

SEQ ID NO: 15584 - DNA, 25 bp, Homo sapiens
ccagtggaaggctcctctggtaggc

SEQ ID NO: 15585 - DNA, 25 bp, Homo sapiens
aggcaggttactatcactggctctg

SEQ ID NO: 15586 - DNA, 25 bp, Homo sapiens
ggctctgctgccagtattagtctgg

SEQ ID NO: 15587 - DNA, 25 bp, Homo sapiens
gttctcccatgatccaactgttaat

SEQ ID NO: 15588 - DNA, 25 bp, Homo sapiens
cctctagatgcctactcgattcaag

SEQ ID NO: 15589 - DNA, 25 bp, Homo sapiens
gctcgatctggccaagctgaaccag

SEQ ID NO: 15590 - DNA, 25 bp, Homo sapiens
agacaacagtctcactttgccatga

SEQ ID NO: 15591 - DNA, 25 bp, Homo sapiens
catgatgcacggcgggaccggattc

SEQ ID NO: 15592 - DNA, 25 bp, Homo sapiens
taaagactatcggcctccgggaagt

SEQ ID NO: 15593 - DNA, 25 bp, Homo sapiens
aaaggatttcctacctggctgaagc

SEQ ID NO: 15594 - DNA, 25 bp, Homo sapiens
ggaaggagaatcccctccagttcaa

SEQ ID NO: 15595 - DNA, 25 bp, Homo sapiens
cagttcaagttccgggccaagttct

SEQ ID NO: 15596 - DNA, 25 bp, Homo sapiens
tcatccaggacatcacccagaaact

SEQ ID NO: 15597 - DNA, 25 bp, Homo sapiens
gaaacttttcttcctccaagtgaag

SEQ ID NO: 15598 - DNA, 25 bp, Homo sapiens
ccttagcgatgagatctactgcccc

SEQ ID NO: 15599 - DNA, 25 bp, Homo sapiens
gaagtgcacaagtctgggtacctca

SEQ ID NO: 15600 - DNA, 25 bp, Homo sapiens
gtacctcagctctgagcggctgatc

SEQ ID NO: 15601 - DNA, 25 bp, Homo sapiens
ggaccagcacaaacttaccagggac

SEQ ID NO: 15602 - DNA, 25 bp, Homo sapiens
gcatgcggaacaccgtgggatgctc

SEQ ID NO: 15603 - DNA, 25 bp, Homo sapiens
agaggacccacaatgacatcatcca

SEQ ID NO: 15604 - DNA, 25 bp, Homo sapiens
tacaagacgctgcggcagatccggc

SEQ ID NO: 15605 - DNA, 25 bp, Homo sapiens
agcagcgcatcgacgagttcgaggc

SEQ ID NO: 15606 - DNA, 25 bp, Homo sapiens
gttcgaggccctgtaacagccaggc

SEQ ID NO: 15607 - DNA, 25 bp, Homo sapiens
aagggcagaggggtgctcatagcgg

SEQ ID NO: 15608 - DNA, 25 bp, Homo sapiens
caagtctaggaactccctcagatcc

SEQ ID NO: 15609 - DNA, 25 bp, Homo sapiens
gttttccccagttgtaatagtgcca

SEQ ID NO: 15610 - DNA, 25 bp, Homo sapiens
tagtgccaagcaggcctgattctcg

SEQ ID NO: 15611 - DNA, 25 bp, Homo sapiens
tcgcgattattctcgaatcacctcc

SEQ ID NO: 15612 - DNA, 25 bp, Homo sapiens
atcacctcctgtgttgtgctgggag

SEQ ID NO: 15613 - DNA, 25 bp, Homo sapiens
gtaagaaacttcatgctggcctgtg

SEQ ID NO: 15614 - DNA, 25 bp, Homo sapiens
taaccccaggaagtaccttcgcagt

SEQ ID NO: 15615 - DNA, 25 bp, Homo sapiens
gcggaggcagcaaatgttacaggtc

SEQ ID NO: 15616 - DNA, 25 bp, Homo sapiens
ggtggtgttccagttcaaggcagta

SEQ ID NO: 15617 - DNA, 25 bp, Homo sapiens
gcagaccgtaaccattatagacgct

SEQ ID NO: 15618 - DNA, 25 bp, Homo sapiens
gacgctatccacgtcgtaggggtcc

SEQ ID NO: 15619 - DNA, 25 bp, Homo sapiens
gagggatcggagagtgctcccgaag

SEQ ID NO: 15620 - DNA, 25 bp, Homo sapiens
gttcccaccttactacatgcggaga

SEQ ID NO: 15621 - DNA, 25 bp, Homo sapiens
ctatgggcgtcgaccacagtattcc

SEQ ID NO: 15622 - DNA, 25 bp, Homo sapiens
ttccaaccctcctgtgcagggagaa

SEQ ID NO: 15623 - DNA, 25 bp, Homo sapiens
gggtgctgacaaccagggtgcagga

SEQ ID NO: 15624 - DNA, 25 bp, Homo sapiens
gggatatagaccacgattccgcagg

SEQ ID NO: 15625 - DNA, 25 bp, Homo sapiens
gaaaaccctaaaccacaagatggca

SEQ ID NO: 15626 - DNA, 25 bp, Homo sapiens
agagacaaaagcagccgatccacca

SEQ ID NO: 15627 - DNA, 25 bp, Homo sapiens
atccaccagctgagaattcgtccgc

SEQ ID NO: 15628 - DNA, 25 bp, Homo sapiens
tgagtaaatgccggcttaccatctc

SEQ ID NO: 15629 - DNA, 25 bp, Homo sapiens
atctctaccatcatccggtttagtc

SEQ ID NO: 15630 - DNA, 25 bp, Homo sapiens
tcatccggtttagtcatccaacaag

SEQ ID NO: 15631 - DNA, 25 bp, Homo sapiens
gattggagctgaagacctaaagtgc

SEQ ID NO: 15632 - DNA, 25 bp, Homo sapiens
cctaaagtgcttgctttttgcccgt

SEQ ID NO: 15633 - DNA, 25 bp, Homo sapiens
ctttttgcccgttgaccagataaat

SEQ ID NO: 15634 - DNA, 25 bp, Homo sapiens
gcattatctatgcagcatggggttt

SEQ ID NO: 15635 - DNA, 25 bp, Homo sapiens
aacttcaattaccgacgcagacgcc

SEQ ID NO: 15636 - DNA, 25 bp, Homo sapiens
ccgtccttatctcatcaaagccagg

SEQ ID NO: 15637 - DNA, 25 bp, Homo sapiens
gccaggctgctttattgcaggtgct

SEQ ID NO: 15638 - DNA, 25 bp, Homo sapiens
gatatcaacatgttagccgcttgca

SEQ ID NO: 15639 - DNA, 25 bp, Homo sapiens
gccgcttgcaagacccttcaagaag

SEQ ID NO: 15640 - DNA, 25 bp, Homo sapiens
aaagcctattgtggctgccatcaat

SEQ ID NO: 15641 - DNA, 25 bp, Homo sapiens
tgccatcaatggatcctgcctggga

SEQ ID NO: 15642 - DNA, 25 bp, Homo sapiens
gcaggaggcacacaaaggctgccca

SEQ ID NO: 15643 - DNA, 25 bp, Homo sapiens
gcccaaaatggtgggtgtgcctgct

SEQ ID NO: 15644 - DNA, 25 bp, Homo sapiens
gggaccaggactaaaacctccagag

SEQ ID NO: 15645 - DNA, 25 bp, Homo sapiens
gacagcgtatgccatgactattcca

SEQ ID NO: 15646 - DNA, 25 bp, Homo sapiens
gccatgactattccatttgtcaggc

SEQ ID NO: 15647 - DNA, 25 bp, Homo sapiens
aacccagaatggcacacactgctct

SEQ ID NO: 15648 - DNA, 25 bp, Homo sapiens
tgtagcatcatgtcagggcttcctg

SEQ ID NO: 15649 - DNA, 25 bp, Homo sapiens
agtacacctctcagtttgtctttta

SEQ ID NO: 15650 - DNA, 25 bp, Homo sapiens
aacagctgaatctttactacctatt

SEQ ID NO: 15651 - DNA, 25 bp, Homo sapiens
aatggagtaggctgtccttggcact

SEQ ID NO: 15652 - DNA, 25 bp, Homo sapiens
tgcctcttcttgagcatggcttgag

SEQ ID NO: 15653 - DNA, 25 bp, Homo sapiens
aaagctgtaactcacgaagccctga

SEQ ID NO: 15654 - DNA, 25 bp, Homo sapiens
gatcgagcttgttttcagtgactgg

SEQ ID NO: 15655 - DNA, 25 bp, Homo sapiens
tgaagcggtagcattgccaccatct

SEQ ID NO: 15656 - DNA, 25 bp, Homo sapiens
atctccctctcatctagagcagttt

SEQ ID NO: 15657 - DNA, 25 bp, Homo sapiens
gagcagttttcttatgccttggttt

SEQ ID NO: 15658 - DNA, 25 bp, Homo sapiens
tccagctccagtgctagtcagagta

SEQ ID NO: 15659 - DNA, 25 bp, Homo sapiens
gagtaaccacagctgtacatccatg

SEQ ID NO: 15660 - DNA, 25 bp, Homo sapiens
ttcattctagtcggacatcccttgc

SEQ ID NO: 15661 - DNA, 25 bp, Homo sapiens
gaccctaaaaagtctgccagtcgcc

SEQ ID NO: 15662 - DNA, 25 bp, Homo sapiens
tgggagtcgggctgggagtcgagcc

SEQ ID NO: 15663 - DNA, 25 bp, Homo sapiens
gcagccggcgaggaagtgacgcttc

SEQ ID NO: 15664 - DNA, 25 bp, Homo sapiens
gcttctgactttgacctcttagaga

SEQ ID NO: 15665 - DNA, 25 bp, Homo sapiens
agagacgcagtctgcttgttccgac

SEQ ID NO: 15666 - DNA, 25 bp, Homo sapiens
agaaagcagcgctgcagggggccaa

SEQ ID NO: 15667 - DNA, 25 bp, Homo sapiens
tgtctaagaagaccaccactgcctc

SEQ ID NO: 15668 - DNA, 25 bp, Homo sapiens
aggtcccaagcgataacactgtcta

SEQ ID NO: 15669 - DNA, 25 bp, Homo sapiens
aactatttgcaccgaaatgtcttgt

SEQ ID NO: 15670 - DNA, 25 bp, Homo sapiens
gtcttgttttgttgcgacataggaa

SEQ ID NO: 15671 - DNA, 25 bp, Homo sapiens
caagcacaaagttatattccatcct

SEQ ID NO: 15672 - DNA, 25 bp, Homo sapiens
atattccatcctttttactgatttt

SEQ ID NO: 15673 - DNA, 25 bp, Homo sapiens
caatctcatgtccattttggtgtgg

SEQ ID NO: 15674 - DNA, 25 bp, Homo sapiens
cattttggtgtgggagtcggggtag

SEQ ID NO: 15675 - DNA, 25 bp, Homo sapiens
atgtgtgtttgctagctcacttgtc

SEQ ID NO: 15676 - DNA, 25 bp, Homo sapiens
tctcatttttaaatcccctcagagg

SEQ ID NO: 15677 - DNA, 25 bp, Homo sapiens
aaatcccctcagaggtgtgactagt

SEQ ID NO: 15678 - DNA, 25 bp, Homo sapiens
gactagtctctttatcagcacacac

SEQ ID NO: 15679 - DNA, 25 bp, Homo sapiens
ggacaactttgatattgcttggcac

SEQ ID NO: 15680 - DNA, 25 bp, Homo sapiens
ggtcccgaggagttcaaagcctgcc

SEQ ID NO: 15681 - DNA, 25 bp, Homo sapiens
gcagaatttgcccgcatcatgagca

SEQ ID NO: 15682 - DNA, 25 bp, Homo sapiens
tcatgagcattgtggaccccaaccg

SEQ ID NO: 15683 - DNA, 25 bp, Homo sapiens
tgggggtagtgacattccaggcctt

SEQ ID NO: 15684 - DNA, 25 bp, Homo sapiens
agcagaccaagtcatggcttccttc

SEQ ID NO: 15685 - DNA, 25 bp, Homo sapiens
cttccttcaagatcctggctgggga

SEQ ID NO: 15686 - DNA, 25 bp, Homo sapiens
tacattaccatggacgagctgcgcc

SEQ ID NO: 15687 - DNA, 25 bp, Homo sapiens
ccgaccaggctgagtactgcatcgc

SEQ ID NO: 15688 - DNA, 25 bp, Homo sapiens
aggtgctctggactacatgtccttc

SEQ ID NO: 15689 - DNA, 25 bp, Homo sapiens
ggcgctgtacggcgagagtgacctc

SEQ ID NO: 15690 - DNA, 25 bp, Homo sapiens
ccctgcccgcgaagtgacagtttac

SEQ ID NO: 15691 - DNA, 25 bp, Homo sapiens
accagctcataaatcacatcgaaca

SEQ ID NO: 15692 - DNA, 25 bp, Homo sapiens
agagcatagactgcatccgagcctt

SEQ ID NO: 15693 - DNA, 25 bp, Homo sapiens
gagcagcgctttaacaacttcctga

SEQ ID NO: 15694 - DNA, 25 bp, Homo sapiens
acttcctgaaagcccttcaagagaa

SEQ ID NO: 15695 - DNA, 25 bp, Homo sapiens
cctctggaagttctgtcacagctga

SEQ ID NO: 15696 - DNA, 25 bp, Homo sapiens
ttctggcccccaaagacaaaccaag

SEQ ID NO: 15697 - DNA, 25 bp, Homo sapiens
ctaagagagctgccatcgctgtgat

SEQ ID NO: 15698 - DNA, 25 bp, Homo sapiens
tcgctgtgatgctgggagttctaac

SEQ ID NO: 15699 - DNA, 25 bp, Homo sapiens
ggatgcggccattcaaggggagcca

SEQ ID NO: 15700 - DNA, 25 bp, Homo sapiens
gaaattcccagcaggttacctggag

SEQ ID NO: 15701 - DNA, 25 bp, Homo sapiens
aggcggatcatctaattctctgtgg

SEQ ID NO: 15702 - DNA, 25 bp, Homo sapiens
tggccatccgtgaatccatcgagag

SEQ ID NO: 15703 - DNA, 25 bp, Homo sapiens
gagagaggcagacaaacccatcagc

SEQ ID NO: 15704 - DNA, 25 bp, Homo sapiens
gacaaacccatcagccatggaggta

SEQ ID NO: 15705 - DNA, 25 bp, Homo sapiens
atgatccagtgcctgagatccgtcg

SEQ ID NO: 15706 - DNA, 25 bp, Homo sapiens
gagatccgtcgagatcactttgaag

SEQ ID NO: 15707 - DNA, 25 bp, Homo sapiens
cgcgccgttctgtcagtgacaatga

SEQ ID NO: 15708 - DNA, 25 bp, Homo sapiens
gattcccttcagggaaccagggtgg

SEQ ID NO: 15709 - DNA, 25 bp, Homo sapiens
gatgatgacctgtatggctaagtgg

SEQ ID NO: 15710 - DNA, 25 bp, Homo sapiens
ctccattctccagtctgaacagttc

SEQ ID NO: 15711 - DNA, 25 bp, Homo sapiens
gaacagttcagctacagtctgactc

SEQ ID NO: 15712 - DNA, 25 bp, Homo sapiens
tacagtctgactctggacagggggt

SEQ ID NO: 15713 - DNA, 25 bp, Homo sapiens
aatctactaattccacaccttttat

SEQ ID NO: 15714 - DNA, 25 bp, Homo sapiens
tactaattccacaccttttattgac

SEQ ID NO: 15715 - DNA, 25 bp, Homo sapiens
gaaaatgttgagaatcccaaatttg

SEQ ID NO: 15716 - DNA, 25 bp, Homo sapiens
gaagaacatgtgagaggtttgacta

SEQ ID NO: 15717 - DNA, 25 bp, Homo sapiens
gagaggtttgactagatgatggatg

SEQ ID NO: 15718 - DNA, 25 bp, Homo sapiens
ggatgccaatattaaatctgctgga

SEQ ID NO: 15719 - DNA, 25 bp, Homo sapiens
aatctgctggagtttcatgtacaag

SEQ ID NO: 15720 - DNA, 25 bp, Homo sapiens
aaggagaggcaacatccaaaatagt

SEQ ID NO: 15721 - DNA, 25 bp, Homo sapiens
agacatgatttccttgaatgtggct

SEQ ID NO: 15722 - DNA, 25 bp, Homo sapiens
tggcttgagaaatatggacacttaa

SEQ ID NO: 15723 - DNA, 25 bp, Homo sapiens
ggacacttaatactaccttgaaaat

SEQ ID NO: 15724 - DNA, 25 bp, Homo sapiens
ctgggattacaggcttgagcccccg

SEQ ID NO: 15725 - DNA, 25 bp, Homo sapiens
gcgcccagccatcaaaatgcttttt

SEQ ID NO: 15726 - DNA, 25 bp, Homo sapiens
gctttttatttctgcatatgtttga

SEQ ID NO: 15727 - DNA, 25 bp, Homo sapiens
tcacaaacttttatactctttctgt

SEQ ID NO: 15728 - DNA, 25 bp, Homo sapiens
tctgtatatacattttttttcttta

SEQ ID NO: 15729 - DNA, 25 bp, Homo sapiens
aatagccacatttagaacacttttt

SEQ ID NO: 15730 - DNA, 25 bp, Homo sapiens
aacactttttgttatcagtcaatat

SEQ ID NO: 15731 - DNA, 25 bp, Homo sapiens
gatagttagaacctggtcctaagcc

SEQ ID NO: 15732 - DNA, 25 bp, Homo sapiens
gaacctggtcctaagcctaaaagtg

SEQ ID NO: 15733 - DNA, 25 bp, Homo sapiens
aagtgggcttgattctgcagtaaat

SEQ ID NO: 15734 - DNA, 25 bp, Homo sapiens
taaatcttttacaactgcctcgaca

SEQ ID NO: 15735 - DNA, 25 bp, Homo sapiens
ttgtcctggtcttgggtgtgcaggc

SEQ ID NO: 15736 - DNA, 25 bp, Homo sapiens
gaaattaccacactctgtaaacaga

SEQ ID NO: 15737 - DNA, 25 bp, Homo sapiens
gtaaacagacccattgaattaataa

SEQ ID NO: 15738 - DNA, 25 bp, Homo sapiens
aattaataaggactggtgattcatt

SEQ ID NO: 15739 - DNA, 25 bp, Homo sapiens
ggtgattcatttgtgtaactcactg

SEQ ID NO: 15740 - DNA, 25 bp, Homo sapiens
tgtgtaactcactgaagccaaaata

SEQ ID NO: 15741 - DNA, 25 bp, Homo sapiens
ctatcttttaagatgtcccacatgg

SEQ ID NO: 15742 - DNA, 25 bp, Homo sapiens
gatgtcccacatggaagacgctatt

SEQ ID NO: 15743 - DNA, 25 bp, Homo sapiens
ggaagacgctattccaggatcttta

SEQ ID NO: 15744 - DNA, 25 bp, Homo sapiens
ggatctttaaatttccatggatgca

SEQ ID NO: 15745 - DNA, 25 bp, Homo sapiens
ggatgcatataggatgtttgggagc

SEQ ID NO: 15746 - DNA, 25 bp, Homo sapiens
atttccaccagactgtcttgagtag

SEQ ID NO: 15747 - DNA, 25 bp, Homo sapiens
gtcttgagtagtgacttctttggtg

SEQ ID NO: 15748 - DNA, 25 bp, Homo sapiens
gaccaatgtaatttcacaacaccta

SEQ ID NO: 15749 - DNA, 25 bp, Homo sapiens
tgtagatttttactgattgtcctgg

SEQ ID NO: 15750 - DNA, 25 bp, Homo sapiens
ttccttcttggtttcccatagtata

SEQ ID NO: 15751 - DNA, 25 bp, Homo sapiens
agcatgcatactttaacttctatag

SEQ ID NO: 15752 - DNA, 25 bp, Homo sapiens
acttctatagttttctcctttagag

SEQ ID NO: 15753 - DNA, 25 bp, Homo sapiens
ccttgcctttgactcattggactag

SEQ ID NO: 15754 - DNA, 25 bp, Homo sapiens
attggactagtgcagaggctttaag

SEQ ID NO: 15755 - DNA, 25 bp, Homo sapiens
ttttgcttttctaggtcattaacgt

SEQ ID NO: 15756 - DNA, 25 bp, Homo sapiens
ggctgagtttcgcacttgattttca

SEQ ID NO: 15757 - DNA, 25 bp, Homo sapiens
gctctttgctttttcgttgtctgag

SEQ ID NO: 15758 - DNA, 25 bp, Homo sapiens
gttgtctgagaaattgttggcgtag

SEQ ID NO: 15759 - DNA, 25 bp, Homo sapiens
gttggcgtagatttggcttctggta

SEQ ID NO: 15760 - DNA, 25 bp, Homo sapiens
ggtatgtgtttctgattgcttcctg

SEQ ID NO: 15761 - DNA, 25 bp, Homo sapiens
tctgattgcttcctgttgagcacaa

SEQ ID NO: 15762 - DNA, 25 bp, Homo sapiens
agtgagagctgccactgagcagccc

SEQ ID NO: 15763 - DNA, 25 bp, Homo sapiens
ccctgccaggggtgctgtttcaggc

SEQ ID NO: 15764 - DNA, 25 bp, Homo sapiens
cctgcaaaccaagggctgggggcaa

SEQ ID NO: 15765 - DNA, 25 bp, Homo sapiens
ggcaaaggggcatgatccagggtcc

SEQ ID NO: 15766 - DNA, 25 bp, Homo sapiens
ctggacccagaggcagatactgcgg

SEQ ID NO: 15767 - DNA, 25 bp, Homo sapiens
aaggtagagtaggctgtggcaatgg

SEQ ID NO: 15768 - DNA, 25 bp, Homo sapiens
ggttctcggctcagtgaactttcta

SEQ ID NO: 15769 - DNA, 25 bp, Homo sapiens
taacacggttcatcccgagttactc

SEQ ID NO: 15770 - DNA, 25 bp, Homo sapiens
ccgagttactccctgagtcttcagg

SEQ ID NO: 15771 - DNA, 25 bp, Homo sapiens
tggccaagggcttgtgacttctgca

SEQ ID NO: 15772 - DNA, 25 bp, Homo sapiens
gacttctgcaagcgacgtgactgga

SEQ ID NO: 15773 - DNA, 25 bp, Homo sapiens
gcagcacttcacagggatcctagtg

SEQ ID NO: 15774 - DNA, 25 bp, Homo sapiens
tgaagccactcagctgacagggcca

SEQ ID NO: 15775 - DNA, 25 bp, Homo sapiens
ggcagctctgtcagaacgaagccct

SEQ ID NO: 15776 - DNA, 25 bp, Homo sapiens
gaacgaagccctgtggctgatcgga

SEQ ID NO: 15777 - DNA, 25 bp, Homo sapiens
gcgttcaagccagtctccaaaaaag

SEQ ID NO: 15778 - DNA, 25 bp, Homo sapiens
ggtattcccatgttacaacagcact

SEQ ID NO: 15779 - DNA, 25 bp, Homo sapiens
tccctcccctccaatgataaagaaa

SEQ ID NO: 15780 - DNA, 25 bp, Homo sapiens
tctgttgtgcattcaattcttattt

SEQ ID NO: 15781 - DNA, 25 bp, Homo sapiens
gtataggcattgtacctgacattgc

SEQ ID NO: 15782 - DNA, 25 bp, Homo sapiens
tacctgacattgctacgtttctacc

SEQ ID NO: 15783 - DNA, 25 bp, Homo sapiens
gctacgtttctaccagtgtttcaat

SEQ ID NO: 15784 - DNA, 25 bp, Homo sapiens
ggataaggccttctgtactttgctt

SEQ ID NO: 15785 - DNA, 25 bp, Homo sapiens
tcaggttctaaccctttgctgtaca

SEQ ID NO: 15786 - DNA, 25 bp, Homo sapiens
aacactcaccatataaacttgcatt

SEQ ID NO: 15787 - DNA, 25 bp, Homo sapiens
tgtgtagagttctcctttctcgaaa

SEQ ID NO: 15788 - DNA, 25 bp, Homo sapiens
cctttctcgaaattgccagtgtgta

SEQ ID NO: 15789 - DNA, 25 bp, Homo sapiens
ccagtgtgtacttggcttaactcaa

SEQ ID NO: 15790 - DNA, 25 bp, Homo sapiens
aatgtatccaactaggacacatatc

SEQ ID NO: 15791 - DNA, 25 bp, Homo sapiens
gacacatatcttttgagttatttgg

SEQ ID NO: 15792 - DNA, 25 bp, Homo sapiens
gtgatctagtcaagccacagttatc

SEQ ID NO: 15793 - DNA, 25 bp, Homo sapiens
gtatcacgtgtgctttgtatcttaa

SEQ ID NO: 15794 - DNA, 25 bp, Homo sapiens
gatgtgtttccaagagcatctgaaa

SEQ ID NO: 15795 - DNA, 25 bp, Homo sapiens
gagcatctgaaattttgtttgtaca

SEQ ID NO: 15796 - DNA, 25 bp, Homo sapiens
ataaagccactgtgatctataaatc

SEQ ID NO: 15797 - DNA, 25 bp, Homo sapiens
gaaatcaattatcaagaacgtccta

SEQ ID NO: 15798 - DNA, 25 bp, Homo sapiens
gaacgtcctaaaacacctatggctt

SEQ ID NO: 15799 - DNA, 25 bp, Homo sapiens
aaaacacctatggctttgactttgt

SEQ ID NO: 15800 - DNA, 25 bp, Homo sapiens
aactgccaatacaaaagcccactga

SEQ ID NO: 15801 - DNA, 25 bp, Homo sapiens
gggcgcagacttcgagagcgaggac

SEQ ID NO: 15802 - DNA, 25 bp, Homo sapiens
ggacgagggcgaggaatttgatgac

SEQ ID NO: 15803 - DNA, 25 bp, Homo sapiens
gatgactgggaggacgactacgact

SEQ ID NO: 15804 - DNA, 25 bp, Homo sapiens
acgactacgactatcccgaagagga

SEQ ID NO: 15805 - DNA, 25 bp, Homo sapiens
tcagtggtgccggctacagagtatc

SEQ ID NO: 15806 - DNA, 25 bp, Homo sapiens
tcagccgctcttgaagaagccgaca

SEQ ID NO: 15807 - DNA, 25 bp, Homo sapiens
agaaccagccctggatggcgggttt

SEQ ID NO: 15808 - DNA, 25 bp, Homo sapiens
gatggttgtcaatcgtctgaccgaa

SEQ ID NO: 15809 - DNA, 25 bp, Homo sapiens
gtctgaccgaagaactcggctgtga

SEQ ID NO: 15810 - DNA, 25 bp, Homo sapiens
tttccgctatcttttgggttcattc

SEQ ID NO: 15811 - DNA, 25 bp, Homo sapiens
ccagccaatggcggcgccagagggg

SEQ ID NO: 15812 - DNA, 25 bp, Homo sapiens
catcgtgatccagcagctctcaaat

SEQ ID NO: 15813 - DNA, 25 bp, Homo sapiens
ctcaaatggcaaatgggtccccttt

SEQ ID NO: 15814 - DNA, 25 bp, Homo sapiens
ggtcccctttgatggcgatgacatt

SEQ ID NO: 15815 - DNA, 25 bp, Homo sapiens
ggagtttgtccgcattgatcctttt

SEQ ID NO: 15816 - DNA, 25 bp, Homo sapiens
gatccttttgtgaggaccttcctga

SEQ ID NO: 15817 - DNA, 25 bp, Homo sapiens
acagtgttcagttcaagttgcccga

SEQ ID NO: 15818 - DNA, 25 bp, Homo sapiens
gttgcccgacgtgtatggtgtattc

SEQ ID NO: 15819 - DNA, 25 bp, Homo sapiens
gattacaaccggctaggctacacac

SEQ ID NO: 15820 - DNA, 25 bp, Homo sapiens
cctgtactcttccactcaggtatcc

SEQ ID NO: 15821 - DNA, 25 bp, Homo sapiens
cacacgcagtatgagcgcttcatcc

SEQ ID NO: 15822 - DNA, 25 bp, Homo sapiens
atggcacaactttacctctgtggga

SEQ ID NO: 15823 - DNA, 25 bp, Homo sapiens
gatgggtgtggtggagtgcgccaaa

SEQ ID NO: 15824 - DNA, 25 bp, Homo sapiens
tggagtgcgccaaacatgaactgct

SEQ ID NO: 15825 - DNA, 25 bp, Homo sapiens
catgaactgctgcaaccatttaatg

SEQ ID NO: 15826 - DNA, 25 bp, Homo sapiens
cccatgcggataaccagtggtccct

SEQ ID NO: 15827 - DNA, 25 bp, Homo sapiens
gaagctggggactgaggtgggtccc

SEQ ID NO: 15828 - DNA, 25 bp, Homo sapiens
ggggactgaggtgggtcccatctcc

SEQ ID NO: 15829 - DNA, 25 bp, Homo sapiens
ccccagactctgtgaagtgcagttc

SEQ ID NO: 15830 - DNA, 25 bp, Homo sapiens
ctgtgaagtgcagttcttctccacc

SEQ ID NO: 15831 - DNA, 25 bp, Homo sapiens
cacctaggaccgccagcagagcggg

SEQ ID NO: 15832 - DNA, 25 bp, Homo sapiens
aggaccgccagcagagcggggggat

SEQ ID NO: 15833 - DNA, 25 bp, Homo sapiens
ttgggaggtgaggcttcccaaccac

SEQ ID NO: 15834 - DNA, 25 bp, Homo sapiens
gtctctttgctatatgaccttgaaa

SEQ ID NO: 15835 - DNA, 25 bp, Homo sapiens
gaccttgaaaatcttccggcatcca

SEQ ID NO: 15836 - DNA, 25 bp, Homo sapiens
atcttccggcatccaaggattccat

SEQ ID NO: 15837 - DNA, 25 bp, Homo sapiens
ggattccattgtgcatcaagctggc

SEQ ID NO: 15838 - DNA, 25 bp, Homo sapiens
gaagcgaaattgttttgcctctgtc

SEQ ID NO: 15839 - DNA, 25 bp, Homo sapiens
gagtcacagtagtcttcagcacagt

SEQ ID NO: 15840 - DNA, 25 bp, Homo sapiens
aaagaaggacgcagagccagccaca

SEQ ID NO: 15841 - DNA, 25 bp, Homo sapiens
tcctctttagccacagggaacctcc

SEQ ID NO: 15842 - DNA, 25 bp, Homo sapiens
gagctgaaagacacagacgccgctg

SEQ ID NO: 15843 - DNA, 25 bp, Homo sapiens
gtgacaacattggctacattacctt

SEQ ID NO: 15844 - DNA, 25 bp, Homo sapiens
taaggcctatattcacacacgtatg

SEQ ID NO: 15845 - DNA, 25 bp, Homo sapiens
ttctcacttctgtcatctagcatgg

SEQ ID NO: 15846 - DNA, 25 bp, Homo sapiens
gggacccatgaacattcctttggta

SEQ ID NO: 15847 - DNA, 25 bp, Homo sapiens
tttggtatcagacccgaagcgcacc

SEQ ID NO: 15848 - DNA, 25 bp, Homo sapiens
gaagcgcaccattgctcaggattat

SEQ ID NO: 15849 - DNA, 25 bp, Homo sapiens
gaaggcatctcgttcaggggccttt

SEQ ID NO: 15850 - DNA, 25 bp, Homo sapiens
aagggtattcttcggcagatcactg

SEQ ID NO: 15851 - DNA, 25 bp, Homo sapiens
gttgccgctctgtggatgagacttt

SEQ ID NO: 15852 - DNA, 25 bp, Homo sapiens
ctttgagactagttcaggccttcca

SEQ ID NO: 15853 - DNA, 25 bp, Homo sapiens
aggccttccagttcactgacaaaca

SEQ ID NO: 15854 - DNA, 25 bp, Homo sapiens
gtgagcgctgggctgttttagtgcc

SEQ ID NO: 15855 - DNA, 25 bp, Homo sapiens
tttagtgccaggctgcggtgggcag

SEQ ID NO: 15856 - DNA, 25 bp, Homo sapiens
gtacctggactatgccagagtcccc

SEQ ID NO: 15857 - DNA, 25 bp, Homo sapiens
atgccagagtccccaatagcaatcc

SEQ ID NO: 15858 - DNA, 25 bp, Homo sapiens
gcctgcgctcttactatgagaccag

SEQ ID NO: 15859 - DNA, 25 bp, Homo sapiens
ggcagctcagtaccgagaggcgatg

SEQ ID NO: 15860 - DNA, 25 bp, Homo sapiens
ggctgcagctgaagccaaggctagg

SEQ ID NO: 15861 - DNA, 25 bp, Homo sapiens
agctcgaatgggcattgggctcggc

SEQ ID NO: 15862 - DNA, 25 bp, Homo sapiens
ctgatatcggaccctgggccaaagc

SEQ ID NO: 15863 - DNA, 25 bp, Homo sapiens
ccaaagcccggatccaggcgggagc

SEQ ID NO: 15864 - DNA, 25 bp, Homo sapiens
gtaccaataacagtgccagtgccag

SEQ ID NO: 15865 - DNA, 25 bp, Homo sapiens
agtgccagcaccagtggtggcttca

SEQ ID NO: 15866 - DNA, 25 bp, Homo sapiens
caccagtggcagctctggtgcctgt

SEQ ID NO: 15867 - DNA, 25 bp, Homo sapiens
ggtttaaggatcagtcctctgcagt

SEQ ID NO: 15868 - DNA, 25 bp, Homo sapiens
ccccctttgtgtgcatgggtcagtc

SEQ ID NO: 15869 - DNA, 25 bp, Homo sapiens
atgggtcagtcaccatatgttcccc

SEQ ID NO: 15870 - DNA, 25 bp, Homo sapiens
gttccccccagagaatgtgtctata

SEQ ID NO: 15871 - DNA, 25 bp, Homo sapiens
tgcagctactcttcagatctggctc

SEQ ID NO: 15872 - DNA, 25 bp, Homo sapiens
atctttttctcttctatggaaaatc

SEQ ID NO: 15873 - DNA, 25 bp, Homo sapiens
tgaggtcttctcaacttgactacag

SEQ ID NO: 15874 - DNA, 25 bp, Homo sapiens
acttgactacagttgtgctcataat

SEQ ID NO: 15875 - DNA, 25 bp, Homo sapiens
gttgtgctcataattgtccttgcct

SEQ ID NO: 15876 - DNA, 25 bp, Homo sapiens
tccttgcctttccagcttaattatt

SEQ ID NO: 15877 - DNA, 25 bp, Homo sapiens
ggttgcattcaactgagatcatacc

SEQ ID NO: 15878 - DNA, 25 bp, Homo sapiens
agtcacttttgacattgatgccaat

SEQ ID NO: 15879 - DNA, 25 bp, Homo sapiens
caatggtatactcaatgtctctgct

SEQ ID NO: 15880 - DNA, 25 bp, Homo sapiens
gacaagggccgtttgagcaaggaag

SEQ ID NO: 15881 - DNA, 25 bp, Homo sapiens
gaattcacttgagtcctatgccttc

SEQ ID NO: 15882 - DNA, 25 bp, Homo sapiens
gagtcctatgccttcaacatgaaag

SEQ ID NO: 15883 - DNA, 25 bp, Homo sapiens
gctggagaaagtttgcaaccccatc

SEQ ID NO: 15884 - DNA, 25 bp, Homo sapiens
catcatcaccaagctgtaccagagt

SEQ ID NO: 15885 - DNA, 25 bp, Homo sapiens
accagagtgcaggaggcatgccagg

SEQ ID NO: 15886 - DNA, 25 bp, Homo sapiens
aatgcctgggggatttcctggtggt

SEQ ID NO: 15887 - DNA, 25 bp, Homo sapiens
tcctcagggcccaccattgaagagg

SEQ ID NO: 15888 - DNA, 25 bp, Homo sapiens
gatgtagcattgttccacacattta

SEQ ID NO: 15889 - DNA, 25 bp, Homo sapiens
cttccttcggcctgggtaggatcat

SEQ ID NO: 15890 - DNA, 25 bp, Homo sapiens
gttgctccattcaaatgttccgtcc

SEQ ID NO: 15891 - DNA, 25 bp, Homo sapiens
aaaccaggagttcatgccatttgtc

SEQ ID NO: 15892 - DNA, 25 bp, Homo sapiens
atcggaagccctgaccaggcatgga

SEQ ID NO: 15893 - DNA, 25 bp, Homo sapiens
agtagacgattcctctgggtcaatc

SEQ ID NO: 15894 - DNA, 25 bp, Homo sapiens
gggtcaatcggaaggcgctatgcca

SEQ ID NO: 15895 - DNA, 25 bp, Homo sapiens
ccccacactgcaactctgagggacc

SEQ ID NO: 15896 - DNA, 25 bp, Homo sapiens
gggaccgtgactcaatgcggcagat

SEQ ID NO: 15897 - DNA, 25 bp, Homo sapiens
gatctctgagctgcccagcatagtc

SEQ ID NO: 15898 - DNA, 25 bp, Homo sapiens
agtccaagacctagccaatggcaac

SEQ ID NO: 15899 - DNA, 25 bp, Homo sapiens
aggccaggtatcctctgtttgaagg

SEQ ID NO: 15900 - DNA, 25 bp, Homo sapiens
gattcaagggaaccttccctgatgc

SEQ ID NO: 15901 - DNA, 25 bp, Homo sapiens
gagagcaggagattcggatgggtca

SEQ ID NO: 15902 - DNA, 25 bp, Homo sapiens
ggatgggtcagatggctatgggagg

SEQ ID NO: 15903 - DNA, 25 bp, Homo sapiens
acctgccactatgatgccggatgga

SEQ ID NO: 15904 - DNA, 25 bp, Homo sapiens
tggaactttgggattgaccccacca

SEQ ID NO: 15905 - DNA, 25 bp, Homo sapiens
ccccaccaacaactgaacgctttgg

SEQ ID NO: 15906 - DNA, 25 bp, Homo sapiens
ctgaacgctttggtcaggctgctac

SEQ ID NO: 15907 - DNA, 25 bp, Homo sapiens
gtcaggctgctacaatggaaggaat

SEQ ID NO: 15908 - DNA, 25 bp, Homo sapiens
ttggggcaattggtggaactcctcc

SEQ ID NO: 15909 - DNA, 25 bp, Homo sapiens
aacgtcgccgatactaataagttgc

SEQ ID NO: 15910 - DNA, 25 bp, Homo sapiens
ataagttgcagtgtctagtttctca

SEQ ID NO: 15911 - DNA, 25 bp, Homo sapiens
cactggccaagctgggccatgccag

SEQ ID NO: 15912 - DNA, 25 bp, Homo sapiens
aaaattccaccttctcggagatctt

SEQ ID NO: 15913 - DNA, 25 bp, Homo sapiens
tcaaaaaggagcacccggaccgctt

SEQ ID NO: 15914 - DNA, 25 bp, Homo sapiens
gggcctttgaccagattcgcatggc

SEQ ID NO: 15915 - DNA, 25 bp, Homo sapiens
ccgagagcaacatcaacctctgcgg

SEQ ID NO: 15916 - DNA, 25 bp, Homo sapiens
gcggcgtttccatcggggaagacgg

SEQ ID NO: 15917 - DNA, 25 bp, Homo sapiens
gatctggctatgtttcggtcagtcc

SEQ ID NO: 15918 - DNA, 25 bp, Homo sapiens
ccacatcaactgtcttttacccaag

SEQ ID NO: 15919 - DNA, 25 bp, Homo sapiens
gaaggcagtggaactagccgccaat

SEQ ID NO: 15920 - DNA, 25 bp, Homo sapiens
ggacttccaggtcggacaagccaag

SEQ ID NO: 15921 - DNA, 25 bp, Homo sapiens
gaccaggtgaccgttatcggggctg

SEQ ID NO: 15922 - DNA, 25 bp, Homo sapiens
gacttccaggtcggacaagccaagg

SEQ ID NO: 15923 - DNA, 25 bp, Homo sapiens
gacaagccaaggtggtcctgaagag

SEQ ID NO: 15924 - DNA, 25 bp, Homo sapiens
ggatgaccaggtgaccgttatcggg

SEQ ID NO: 15925 - DNA, 25 bp, Homo sapiens
tgaccgttatcggggctggggtgac

SEQ ID NO: 15926 - DNA, 25 bp, Homo sapiens
aaagatcaacatccgcgtgctggac

SEQ ID NO: 15927 - DNA, 25 bp, Homo sapiens
agaaaactcattctcgacagcgctc

SEQ ID NO: 15928 - DNA, 25 bp, Homo sapiens
gaggaccattattatgaaggtggca

SEQ ID NO: 15929 - DNA, 25 bp, Homo sapiens
tggtgaggctgtgtccagtgcagta

SEQ ID NO: 15930 - DNA, 25 bp, Homo sapiens
cagtgcagtagtgggcgagcctggc

SEQ ID NO: 15931 - DNA, 25 bp, Homo sapiens
gctgctgaagatgtttggtatcgac

SEQ ID NO: 15932 - DNA, 25 bp, Homo sapiens
attgcacaagctgtgaggggcctca

SEQ ID NO: 15933 - DNA, 25 bp, Homo sapiens
gtagcagtgctctcattggcctgct

SEQ ID NO: 15934 - DNA, 25 bp, Homo sapiens
atcgcagtggccattgccacggtca

SEQ ID NO: 15935 - DNA, 25 bp, Homo sapiens
gaggcagtatggcaccatcagccac

SEQ ID NO: 15936 - DNA, 25 bp, Homo sapiens
tggaggttgatccaatgctcacccc

SEQ ID NO: 15937 - DNA, 25 bp, Homo sapiens
gaaccatggctatgagaaccccacc

SEQ ID NO: 15938 - DNA, 25 bp, Homo sapiens
accccacctacaaatacctggagca

SEQ ID NO: 15939 - DNA, 25 bp, Homo sapiens
ttaggtggcagggagcgcggcagcc

SEQ ID NO: 15940 - DNA, 25 bp, Homo sapiens
tccgatcgactgccaagcagcagcc

SEQ ID NO: 15941 - DNA, 25 bp, Homo sapiens
atcctgacctcctggactgtaggac

SEQ ID NO: 15942 - DNA, 25 bp, Homo sapiens
attaatcagaaaccccacttccatt

SEQ ID NO: 15943 - DNA, 25 bp, Homo sapiens
gtattgtctgacacatgctctcaat

SEQ ID NO: 15944 - DNA, 25 bp, Homo sapiens
agaagaggtcatcatcagctggtcg

SEQ ID NO: 15945 - DNA, 25 bp, Homo sapiens
tcagctggtcggaaaaggcctctaa

SEQ ID NO: 15946 - DNA, 25 bp, Homo sapiens
atatgtctccaaagaacttgccaaa

SEQ ID NO: 15947 - DNA, 25 bp, Homo sapiens
gaggtggtgtattcgaaggctgcca

SEQ ID NO: 15948 - DNA, 25 bp, Homo sapiens
aaggctgccagtgtaccgaaagttg

SEQ ID NO: 15949 - DNA, 25 bp, Homo sapiens
gggatggatgcaacctagcttaaca

SEQ ID NO: 15950 - DNA, 25 bp, Homo sapiens
ataatgctgcaaattttcctccata

SEQ ID NO: 15951 - DNA, 25 bp, Homo sapiens
aaattttcctccataatcagccaga

SEQ ID NO: 15952 - DNA, 25 bp, Homo sapiens
aacatcatgctacactttacactaa

SEQ ID NO: 15953 - DNA, 25 bp, Homo sapiens
gagtggtctgttattaagcccaatg

SEQ ID NO: 15954 - DNA, 25 bp, Homo sapiens
tagggagtccatacacatcagtgag

SEQ ID NO: 15955 - DNA, 25 bp, Homo sapiens
ccgagacttagtctcgggccgccat

SEQ ID NO: 15956 - DNA, 25 bp, Homo sapiens
tccacgagagcctctacttcaatcc

SEQ ID NO: 15957 - DNA, 25 bp, Homo sapiens
cctctacttcaatcccatgatgacc

SEQ ID NO: 15958 - DNA, 25 bp, Homo sapiens
gatgaccaatggggttgtgcacgcc

SEQ ID NO: 15959 - DNA, 25 bp, Homo sapiens
tgtgcacgccaatgtgttcggcatc

SEQ ID NO: 15960 - DNA, 25 bp, Homo sapiens
acgccaatgtgttcggcatcaagga

SEQ ID NO: 15961 - DNA, 25 bp, Homo sapiens
atcaaggactgggtgacgccgtaca

SEQ ID NO: 15962 - DNA, 25 bp, Homo sapiens
gacgccgtacaagatcgcggtgctg

SEQ ID NO: 15963 - DNA, 25 bp, Homo sapiens
gctgaacgagatgagccgcacaggc

SEQ ID NO: 15964 - DNA, 25 bp, Homo sapiens
cgccgtcagcctcatggagcggcgg

SEQ ID NO: 15965 - DNA, 25 bp, Homo sapiens
catggagcggcggaggctcaaccag

SEQ ID NO: 15966 - DNA, 25 bp, Homo sapiens
cctctccaaggagtaccggttacag

SEQ ID NO: 15967 - DNA, 25 bp, Homo sapiens
tctccaaggagtaccggttacagta

SEQ ID NO: 15968 - DNA, 25 bp, Homo sapiens
gtaccggttacagtacttggcctct

SEQ ID NO: 15969 - DNA, 25 bp, Homo sapiens
ccggttacagtacttggcctctgaa

SEQ ID NO: 15970 - DNA, 25 bp, Homo sapiens
ggttacagtacttggcctctgaaac

SEQ ID NO: 15971 - DNA, 25 bp, Homo sapiens
cttttgcgcagctcattcttggaat

SEQ ID NO: 15972 - DNA, 25 bp, Homo sapiens
ttttgcgcagctcattcttggaatc

SEQ ID NO: 15973 - DNA, 25 bp, Homo sapiens
gcagctcattcttggaatcccagaa

SEQ ID NO: 15974 - DNA, 25 bp, Homo sapiens
gctcattcttggaatcccagaacag

SEQ ID NO: 15975 - DNA, 25 bp, Homo sapiens
tcattcttggaatcccagaacaggc

SEQ ID NO: 15976 - DNA, 25 bp, Homo sapiens
cagaacaggccttaagtcttctcca

SEQ ID NO: 15977 - DNA, 25 bp, Homo sapiens
cacatgccgatcaccggacacaatc

SEQ ID NO: 15978 - DNA, 25 bp, Homo sapiens
tcctgcagaaggacacacgactcta

SEQ ID NO: 15979 - DNA, 25 bp, Homo sapiens
acgactctatttcctacagtgcgaa

SEQ ID NO: 15980 - DNA, 25 bp, Homo sapiens
ccagtatcaaaaccggcttccaggc

SEQ ID NO: 15981 - DNA, 25 bp, Homo sapiens
ctgtcacgggcaagcgagcacagct

SEQ ID NO: 15982 - DNA, 25 bp, Homo sapiens
cacagctccgtgccaaagctaacta

SEQ ID NO: 15983 - DNA, 25 bp, Homo sapiens
ggctggacaggtttgccatcagagt

SEQ ID NO: 15984 - DNA, 25 bp, Homo sapiens
ggagctgctgaatcgagtgttcaac

SEQ ID NO: 15985 - DNA, 25 bp, Homo sapiens
acctccacaagtcgtccgagtagga

SEQ ID NO: 15986 - DNA, 25 bp, Homo sapiens
aaactattacatcgtcagcccaaac

SEQ ID NO: 15987 - DNA, 25 bp, Homo sapiens
aacatctccttgcatttttgttggc

SEQ ID NO: 15988 - DNA, 25 bp, Homo sapiens
tttcagccagtgcatgaccttacta

SEQ ID NO: 15989 - DNA, 25 bp, Homo sapiens
ggcagggcaagaatcctttcgttcc

SEQ ID NO: 15990 - DNA, 25 bp, Homo sapiens
ctttcgttccatcacaaggtcgtat

SEQ ID NO: 15991 - DNA, 25 bp, Homo sapiens
gcagcaggagctttactagtttacg

SEQ ID NO: 15992 - DNA, 25 bp, Homo sapiens
gatacattcaaccacttgacaacct

SEQ ID NO: 15993 - DNA, 25 bp, Homo sapiens
acaacctggttagaagatgcccgcc

SEQ ID NO: 15994 - DNA, 25 bp, Homo sapiens
gccagcattccaattccaacatggt

SEQ ID NO: 15995 - DNA, 25 bp, Homo sapiens
gaagcttttgcacgagaacatggac

SEQ ID NO: 15996 - DNA, 25 bp, Homo sapiens
gtctgctaagactgcttccaatgta

SEQ ID NO: 15997 - DNA, 25 bp, Homo sapiens
ttaaaattggccctcagcatgctgc

SEQ ID NO: 15998 - DNA, 25 bp, Homo sapiens
atgctgctaccaatgcaacacatgc

SEQ ID NO: 15999 - DNA, 25 bp, Homo sapiens
tgaacagtaccgcctgcagagggag

SEQ ID NO: 16000 - DNA, 25 bp, Homo sapiens
aggaagctgcggcattgggatcccg

SEQ ID NO: 16001 - DNA, 25 bp, Homo sapiens
atcccgtggcagttgcagcactgaa

SEQ ID NO: 16002 - DNA, 25 bp, Homo sapiens
tcctctagacatacttccggcagaa

SEQ ID NO: 16003 - DNA, 25 bp, Homo sapiens
acaacctcttggcttttgtctgtga

SEQ ID NO: 16004 - DNA, 25 bp, Homo sapiens
gtgacattcggccagaaatccatga

SEQ ID NO: 16005 - DNA, 25 bp, Homo sapiens
ggagtggcattttagatgccctcac

SEQ ID NO: 16006 - DNA, 25 bp, Homo sapiens
gatgccctcacgaatatgaagctta

SEQ ID NO: 16007 - DNA, 25 bp, Homo sapiens
agcacagctctagttacattcttat

SEQ ID NO: 16008 - DNA, 25 bp, Homo sapiens
ataggtccttccactttttggagag

SEQ ID NO: 16009 - DNA, 25 bp, Homo sapiens
gactttttctttcttagatctagtt

SEQ ID NO: 16010 - DNA, 25 bp, Homo sapiens
accaccgaatggacgagttctcccg

SEQ ID NO: 16011 - DNA, 25 bp, Homo sapiens
tcccggggaaatgtaccgtccagcg

SEQ ID NO: 16012 - DNA, 25 bp, Homo sapiens
accgtccagcgagttgcagatctac

SEQ ID NO: 16013 - DNA, 25 bp, Homo sapiens
gcagatctacacttggatggatgca

SEQ ID NO: 16014 - DNA, 25 bp, Homo sapiens
gggcactcacttcaattttgcaatc

SEQ ID NO: 16015 - DNA, 25 bp, Homo sapiens
aggagattggcagcaccatgtctgg

SEQ ID NO: 16016 - DNA, 25 bp, Homo sapiens
gggactgatgattccatgaccctgc

SEQ ID NO: 16017 - DNA, 25 bp, Homo sapiens
aagatggcggtggagtcgcgcgtta

SEQ ID NO: 16018 - DNA, 25 bp, Homo sapiens
tggacatagcaattacccctccaaa

SEQ ID NO: 16019 - DNA, 25 bp, Homo sapiens
tcgcgcgttacccaggaggaaatta

SEQ ID NO: 16020 - DNA, 25 bp, Homo sapiens
cagagaaaccgatcgaccgcgagaa

SEQ ID NO: 16021 - DNA, 25 bp, Homo sapiens
tgcagaggcctatgttttcactcct

SEQ ID NO: 16022 - DNA, 25 bp, Homo sapiens
gcctttgctgtacaggatcccaatg

SEQ ID NO: 16023 - DNA, 25 bp, Homo sapiens
agaccaaattctacgcagctggcct

SEQ ID NO: 16024 - DNA, 25 bp, Homo sapiens
tgtgggacctatgggctctacacac

SEQ ID NO: 16025 - DNA, 25 bp, Homo sapiens
tatgcaggaaaatagcaccccccgt

SEQ ID NO: 16026 - DNA, 25 bp, Homo sapiens
gggtggtgaccaatgcattaccttc

SEQ ID NO: 16027 - DNA, 25 bp, Homo sapiens
gcattaccttctgttccttatgata

SEQ ID NO: 16028 - DNA, 25 bp, Homo sapiens
ttgattgttgagacgccttgctaga

SEQ ID NO: 16029 - DNA, 25 bp, Homo sapiens
acatttgtggtctgactccttgggg

SEQ ID NO: 16030 - DNA, 25 bp, Homo sapiens
tttccccggagtacctattgtagat

SEQ ID NO: 16031 - DNA, 25 bp, Homo sapiens
aacactatgggtggggcactccttt

SEQ ID NO: 16032 - DNA, 25 bp, Homo sapiens
aggctgctcagctggacatgctgct

SEQ ID NO: 16033 - DNA, 25 bp, Homo sapiens
aggagatcagtggtcccttgacttc

SEQ ID NO: 16034 - DNA, 25 bp, Homo sapiens
tggtgtccagcggcagtgggaccat

SEQ ID NO: 16035 - DNA, 25 bp, Homo sapiens
aagtactggacattctaactcgcct

SEQ ID NO: 16036 - DNA, 25 bp, Homo sapiens
gagcatctcccaggtgaatcacaag

SEQ ID NO: 16037 - DNA, 25 bp, Homo sapiens
aagcctttgagaacagcctgagcct

SEQ ID NO: 16038 - DNA, 25 bp, Homo sapiens
acagatgcccagcctcatagctgaa

SEQ ID NO: 16039 - DNA, 25 bp, Homo sapiens
ttgcctgaatgatcctcctgttgca

SEQ ID NO: 16040 - DNA, 25 bp, Homo sapiens
ctcatctctccttgccaaatagttt

SEQ ID NO: 16041 - DNA, 25 bp, Homo sapiens
gccaacctcacactgctatgattgc

SEQ ID NO: 16042 - DNA, 25 bp, Homo sapiens
gtcccatgtcagccttctgatgatc

SEQ ID NO: 16043 - DNA, 25 bp, Homo sapiens
acacacaaggcctgatcttcgtggt

SEQ ID NO: 16044 - DNA, 25 bp, Homo sapiens
agagagcgtgtgaacgaggcccgtg

SEQ ID NO: 16045 - DNA, 25 bp, Homo sapiens
gaggcccgtgaggagctcatgagga

SEQ ID NO: 16046 - DNA, 25 bp, Homo sapiens
tcatgaggatgctggccgaggacga

SEQ ID NO: 16047 - DNA, 25 bp, Homo sapiens
cccaacgccatgaatgcggccgaga

SEQ ID NO: 16048 - DNA, 25 bp, Homo sapiens
cctctgctttactctcatgtggcaa

SEQ ID NO: 16049 - DNA, 25 bp, Homo sapiens
tcatgtggcaaacgtgcggctcgtg

SEQ ID NO: 16050 - DNA, 25 bp, Homo sapiens
gtgtgcatcgcaccgtgctgtaaat

SEQ ID NO: 16051 - DNA, 25 bp, Homo sapiens
taaatgtggcagacgcagcctgcgg

SEQ ID NO: 16052 - DNA, 25 bp, Homo sapiens
ctgcggccaggctttttatttaatg

SEQ ID NO: 16053 - DNA, 25 bp, Homo sapiens
caatgaggcagtttctggtactcct

SEQ ID NO: 16054 - DNA, 25 bp, Homo sapiens
tccatttatttaagcccccataggt

SEQ ID NO: 16055 - DNA, 25 bp, Homo sapiens
catttatttaagcccccataggtgc

SEQ ID NO: 16056 - DNA, 25 bp, Homo sapiens
acccccaaaaccagctgtacagaat

SEQ ID NO: 16057 - DNA, 25 bp, Homo sapiens
aaaccagctgtacagaatctttgat

SEQ ID NO: 16058 - DNA, 25 bp, Homo sapiens
gtacagaatctttgatacagaccta

SEQ ID NO: 16059 - DNA, 25 bp, Homo sapiens
gaatctttgatacagacctatttgc

SEQ ID NO: 16060 - DNA, 25 bp, Homo sapiens
tctttgatacagacctatttgctag

SEQ ID NO: 16061 - DNA, 25 bp, Homo sapiens
agacctatttgctaggggtgctgcc

SEQ ID NO: 16062 - DNA, 25 bp, Homo sapiens
acctatttgctaggggtgctgccgg

SEQ ID NO: 16063 - DNA, 25 bp, Homo sapiens
gaccagctgagtcatgaggccggtt

SEQ ID NO: 16064 - DNA, 25 bp, Homo sapiens
agctgagtcatgaggccggtttctc

SEQ ID NO: 16065 - DNA, 25 bp, Homo sapiens
cccccaactatgaccatgtggtcct

SEQ ID NO: 16066 - DNA, 25 bp, Homo sapiens
ggtcctgggcggtggtcaggaagcc

SEQ ID NO: 16067 - DNA, 25 bp, Homo sapiens
catggatgtaaccacaacctccacc

SEQ ID NO: 16068 - DNA, 25 bp, Homo sapiens
tttgaggccaggttcttccatttgg

SEQ ID NO: 16069 - DNA, 25 bp, Homo sapiens
ggaagagtcaagggtcactttggac

SEQ ID NO: 16070 - DNA, 25 bp, Homo sapiens
gggtcactttggacctatcaacagt

SEQ ID NO: 16071 - DNA, 25 bp, Homo sapiens
ctatcaacagtgttgccttccatcc

SEQ ID NO: 16072 - DNA, 25 bp, Homo sapiens
gccttccatcctgatggcaagagct

SEQ ID NO: 16073 - DNA, 25 bp, Homo sapiens
ttacgtccgtatccattacttcgac

SEQ ID NO: 16074 - DNA, 25 bp, Homo sapiens
attacttcgacccacagtacttcga

SEQ ID NO: 16075 - DNA, 25 bp, Homo sapiens
tcgacccacagtacttcgaatttga

SEQ ID NO: 16076 - DNA, 25 bp, Homo sapiens
gactccagccgctgttggctgggaa

SEQ ID NO: 16077 - DNA, 25 bp, Homo sapiens
ctcggtctgacgtctgatgtttgtg

SEQ ID NO: 16078 - DNA, 25 bp, Homo sapiens
ggtttgaatatttgtagcccgctcc

SEQ ID NO: 16079 - DNA, 25 bp, Homo sapiens
aagtaacggatgtttctcgccaatc

SEQ ID NO: 16080 - DNA, 25 bp, Homo sapiens
tctcgccaatcgtagtgacttcagc

SEQ ID NO: 16081 - DNA, 25 bp, Homo sapiens
ttcttttgtagtaccacggtcctcg

SEQ ID NO: 16082 - DNA, 25 bp, Homo sapiens
ggtcctcggcctaacgaaggacgtg

SEQ ID NO: 16083 - DNA, 25 bp, Homo sapiens
agaggagagctctgaaacgcggtca

SEQ ID NO: 16084 - DNA, 25 bp, Homo sapiens
ctgaaacgcggtcacctttgtttag

SEQ ID NO: 16085 - DNA, 25 bp, Homo sapiens
ttcccggcatgaggtgcctcggaat

SEQ ID NO: 16086 - DNA, 25 bp, Homo sapiens
ggcaatggattaaccactgtatcta

SEQ ID NO: 16087 - DNA, 25 bp, Homo sapiens
gggcctaaccagccttgggagtatt

SEQ ID NO: 16088 - DNA, 25 bp, Homo sapiens
gggagtattgactggtcccttacct

SEQ ID NO: 16089 - DNA, 25 bp, Homo sapiens
gtcccttacctcttatggctaagtc

SEQ ID NO: 16090 - DNA, 25 bp, Homo sapiens
gtgttcatttaccaagttgacccag

SEQ ID NO: 16091 - DNA, 25 bp, Homo sapiens
tctgaatgcggccacggatgccttg

SEQ ID NO: 16092 - DNA, 25 bp, Homo sapiens
ccccagctgtccactgaaacgtgaa

SEQ ID NO: 16093 - DNA, 25 bp, Homo sapiens
gtcctgttttgaatgccaaacccac

SEQ ID NO: 16094 - DNA, 25 bp, Homo sapiens
aacccaccattcactggtgctgact

SEQ ID NO: 16095 - DNA, 25 bp, Homo sapiens
ggtgtgcccagaaagcttgtctgta

SEQ ID NO: 16096 - DNA, 25 bp, Homo sapiens
tgaacactttccactttttgacacc

SEQ ID NO: 16097 - DNA, 25 bp, Homo sapiens
gacaccttatcctgatgtatggttc

SEQ ID NO: 16098 - DNA, 25 bp, Homo sapiens
tctgcagtggtgctgaaacgaccgg

SEQ ID NO: 16099 - DNA, 25 bp, Homo sapiens
gtggtgctgaaacgaccggagatac

SEQ ID NO: 16100 - DNA, 25 bp, Homo sapiens
aacgaccggagatactgacagatga

SEQ ID NO: 16101 - DNA, 25 bp, Homo sapiens
tgacagatgagagcctcagcagctt

SEQ ID NO: 16102 - DNA, 25 bp, Homo sapiens
tccaaaccagcgccatttcaaggga

SEQ ID NO: 16103 - DNA, 25 bp, Homo sapiens
tcaagggacatcgacacagcagcca

SEQ ID NO: 16104 - DNA, 25 bp, Homo sapiens
caagttcattggagctggggctgcc

SEQ ID NO: 16105 - DNA, 25 bp, Homo sapiens
ctcttttgtctgatggtagcctttc

SEQ ID NO: 16106 - DNA, 25 bp, Homo sapiens
ctggggaacgtggttggctcagggt

SEQ ID NO: 16107 - DNA, 25 bp, Homo sapiens
gaacgtggttggctcagggtttgac

SEQ ID NO: 16108 - DNA, 25 bp, Homo sapiens
cgtggttggctcagggtttgacaga

SEQ ID NO: 16109 - DNA, 25 bp, Homo sapiens
gtagaattcttcctgtacgattggg

SEQ ID NO: 16110 - DNA, 25 bp, Homo sapiens
ttcactaaccttccctaggcattga

SEQ ID NO: 16111 - DNA, 25 bp, Homo sapiens
aacttcccccaaatctgatggacct

SEQ ID NO: 16112 - DNA, 25 bp, Homo sapiens
ggacctagaagtctgcttttgtacc

SEQ ID NO: 16113 - DNA, 25 bp, Homo sapiens
tctgttccctctcttttgaaaatgt

SEQ ID NO: 16114 - DNA, 25 bp, Homo sapiens
gggttacttgattagctgtgtttgg

SEQ ID NO: 16115 - DNA, 25 bp, Homo sapiens
tggaactgctaccgatacatcaatg

SEQ ID NO: 16116 - DNA, 25 bp, Homo sapiens
actcctctgatgtcctggtttatgt

SEQ ID NO: 16117 - DNA, 25 bp, Homo sapiens
gcaatgacactacggtgctgctacc

SEQ ID NO: 16118 - DNA, 25 bp, Homo sapiens
tgccactgtgaatggtgctgccaag

SEQ ID NO: 16119 - DNA, 25 bp, Homo sapiens
gtctgcctaagccttcaagtgggcg

SEQ ID NO: 16120 - DNA, 25 bp, Homo sapiens
tttcccctctagttttgggtgtgca

SEQ ID NO: 16121 - DNA, 25 bp, Homo sapiens
gggtgtgcatgtttggagtttgtag

SEQ ID NO: 16122 - DNA, 25 bp, Homo sapiens
cattctgccttgctatgggttgttc

SEQ ID NO: 16123 - DNA, 25 bp, Homo sapiens
gtcctggggctgttgagcagcataa

SEQ ID NO: 16124 - DNA, 25 bp, Homo sapiens
tgagcagcataataatcccgggaga

SEQ ID NO: 16125 - DNA, 25 bp, Homo sapiens
atcccgggagaatgattcccctcat

SEQ ID NO: 16126 - DNA, 25 bp, Homo sapiens
catccatcccctcatagttaagtag

SEQ ID NO: 16127 - DNA, 25 bp, Homo sapiens
taagtagccactggtgtcctgggaa

SEQ ID NO: 16128 - DNA, 25 bp, Homo sapiens
gggtgagagtaacaggccatttggc

SEQ ID NO: 16129 - DNA, 25 bp, Homo sapiens
gtctcaggaataagctggatctcca

SEQ ID NO: 16130 - DNA, 25 bp, Homo sapiens
gctggatctccaatgttttggggat

SEQ ID NO: 16131 - DNA, 25 bp, Homo sapiens
tgtagaagcagccctttccatatac

SEQ ID NO: 16132 - DNA, 25 bp, Homo sapiens
tgcaaccagcatggggtctcgggaa

SEQ ID NO: 16133 - DNA, 25 bp, Homo sapiens
ggtctcgggaacagcttgcgattgc

SEQ ID NO: 16134 - DNA, 25 bp, Homo sapiens
aagatcacttcttgttattcccaat

SEQ ID NO: 16135 - DNA, 25 bp, Homo sapiens
gttattcccaatacactagcagtta

SEQ ID NO: 16136 - DNA, 25 bp, Homo sapiens
gcagttaatgctgcccaggactcca

SEQ ID NO: 16137 - DNA, 25 bp, Homo sapiens
caggactccacagatctggttgcaa

SEQ ID NO: 16138 - DNA, 25 bp, Homo sapiens
ataatgaggcccaggttaacccaga

SEQ ID NO: 16139 - DNA, 25 bp, Homo sapiens
gagcaatggtaaacctcgagacaac

SEQ ID NO: 16140 - DNA, 25 bp, Homo sapiens
gcaggggtgtttgaaccaaccatag

SEQ ID NO: 16141 - DNA, 25 bp, Homo sapiens
gctgcaatcaccattcttcgaattg

SEQ ID NO: 16142 - DNA, 25 bp, Homo sapiens
gagagagcaaggtcgtagttccccc

SEQ ID NO: 16143 - DNA, 25 bp, Homo sapiens
cctgggaaagcgtttttgcgtcact

SEQ ID NO: 16144 - DNA, 25 bp, Homo sapiens
ttgcgtcacttcccttttagaggag

SEQ ID NO: 16145 - DNA, 25 bp, Homo sapiens
taaacaaggtcgctggtcatcctct

SEQ ID NO: 16146 - DNA, 25 bp, Homo sapiens
ggtcatcctctggcacagaacgaac

SEQ ID NO: 16147 - DNA, 25 bp, Homo sapiens
gaacgaacgttgtcttcacatgttt

SEQ ID NO: 16148 - DNA, 25 bp, Homo sapiens
catgccttcagtatactaacactcc

SEQ ID NO: 16149 - DNA, 25 bp, Homo sapiens
ctaacactccatatgctcagttttg

SEQ ID NO: 16150 - DNA, 25 bp, Homo sapiens
cctcattccagcctttctatataaa

SEQ ID NO: 16151 - DNA, 25 bp, Homo sapiens
ataaatagctccttcctgctgtttt

SEQ ID NO: 16152 - DNA, 25 bp, Homo sapiens
tgggtgcacactatagcctcacaac

SEQ ID NO: 16153 - DNA, 25 bp, Homo sapiens
gtttagttgcacaaattgggccaaa

SEQ ID NO: 16154 - DNA, 25 bp, Homo sapiens
gggccaaagaaacattgccttgagg

SEQ ID NO: 16155 - DNA, 25 bp, Homo sapiens
aatactgttttactgtccaaagaca

SEQ ID NO: 16156 - DNA, 25 bp, Homo sapiens
aagacatgtttatagtgctctgtaa

SEQ ID NO: 16157 - DNA, 25 bp, Homo sapiens
cctttcctttgtagtctctggcaag

SEQ ID NO: 16158 - DNA, 25 bp, Homo sapiens
gtagtctctggcaagatgctttagg

SEQ ID NO: 16159 - DNA, 25 bp, Homo sapiens
agtttatacccgtttcacatgcttt

SEQ ID NO: 16160 - DNA, 25 bp, Homo sapiens
cacatgcttttcaagaatgtcgcaa

SEQ ID NO: 16161 - DNA, 25 bp, Homo sapiens
gaatgtcgcaattactaagaagcag

SEQ ID NO: 16162 - DNA, 25 bp, Homo sapiens
gcagtttctgcttcacatttgattt

SEQ ID NO: 16163 - DNA, 25 bp, Homo sapiens
gagaccagttttctctggaagtttg

SEQ ID NO: 16164 - DNA, 25 bp, Homo sapiens
tctgccttccggcttaaagctgtgg

SEQ ID NO: 16165 - DNA, 25 bp, Homo sapiens
tggatgatccacgtttttgtttttt

SEQ ID NO: 16166 - DNA, 25 bp, Homo sapiens
gttatcactcttaggtcagacagcc

SEQ ID NO: 16167 - DNA, 25 bp, Homo sapiens
ttctcccacaccaagtgcatgtcag

SEQ ID NO: 16168 - DNA, 25 bp, Homo sapiens
agccgtacgctctttacagatacta

SEQ ID NO: 16169 - DNA, 25 bp, Homo sapiens
tgtcaagagttaaacctcctcaggt

SEQ ID NO: 16170 - DNA, 25 bp, Homo sapiens
aaagactagtgcttcccagtacttg

SEQ ID NO: 16171 - DNA, 25 bp, Homo sapiens
gtacttgcatggggttcactattta

SEQ ID NO: 16172 - DNA, 25 bp, Homo sapiens
caccactttagaccctatgtgtagc

SEQ ID NO: 16173 - DNA, 25 bp, Homo sapiens
gtgtagcaggtcacaacttaccctt

SEQ ID NO: 16174 - DNA, 25 bp, Homo sapiens
acttacccttgtgtgtttagatgtg

SEQ ID NO: 16175 - DNA, 25 bp, Homo sapiens
aaaaatctaccattccctacatatt

SEQ ID NO: 16176 - DNA, 25 bp, Homo sapiens
tgatgaaaacgtgtgtcagcccggt

SEQ ID NO: 16177 - DNA, 25 bp, Homo sapiens
atttgcctaacatctttggacgtgg

SEQ ID NO: 16178 - DNA, 25 bp, Homo sapiens
ggacgtggcagaaccttacatattc

SEQ ID NO: 16179 - DNA, 25 bp, Homo sapiens
tattctgtgagcttcgatgagccag

SEQ ID NO: 16180 - DNA, 25 bp, Homo sapiens
gaaatcatactctcctttcttagtc

SEQ ID NO: 16181 - DNA, 25 bp, Homo sapiens
aaatcacacatgtcatctttgtcaa

SEQ ID NO: 16182 - DNA, 25 bp, Homo sapiens
aatatatcattcatacccccattaa

SEQ ID NO: 16183 - DNA, 25 bp, Homo sapiens
gtggactcgattcttttttactaca

SEQ ID NO: 16184 - DNA, 25 bp, Homo sapiens
tactacatatttcccaagttatctt

SEQ ID NO: 16185 - DNA, 25 bp, Homo sapiens
gtaaatggctctgtacctggacata

SEQ ID NO: 16186 - DNA, 25 bp, Homo sapiens
agatgtgtttagaacctcttgttta

SEQ ID NO: 16187 - DNA, 25 bp, Homo sapiens
tatcataaaatcacatctcacacat

SEQ ID NO: 16188 - DNA, 25 bp, Homo sapiens
aatttagcctctgaataccttctcc

SEQ ID NO: 16189 - DNA, 25 bp, Homo sapiens
ttcttggaaccactcatgacatatc

SEQ ID NO: 16190 - DNA, 25 bp, Homo sapiens
gcacattcgtactatagggagccta

SEQ ID NO: 16191 - DNA, 25 bp, Homo sapiens
gggagcctattggttctctattagt

SEQ ID NO: 16192 - DNA, 25 bp, Homo sapiens
ctctattagtcttgtgggttttctg

SEQ ID NO: 16193 - DNA, 25 bp, Homo sapiens
ggagtcatggcatctgtttacattt

SEQ ID NO: 16194 - DNA, 25 bp, Homo sapiens
gtatgtcttcattgctaggtactaa

SEQ ID NO: 16195 - DNA, 25 bp, Homo sapiens
ggtactaatttgcagatgtctttac

SEQ ID NO: 16196 - DNA, 25 bp, Homo sapiens
agctcacctggatatacctacattg

SEQ ID NO: 16197 - DNA, 25 bp, Homo sapiens
gaagggagtgttgctcccagtccag

SEQ ID NO: 16198 - DNA, 25 bp, Homo sapiens
cccagtccagaggcctgattctgtt

SEQ ID NO: 16199 - DNA, 25 bp, Homo sapiens
tgattctgttcggactgggttctca

SEQ ID NO: 16200 - DNA, 25 bp, Homo sapiens
gttctcaagacacgaccaggttctc

SEQ ID NO: 16201 - DNA, 25 bp, Homo sapiens
ccaggttctcaagacacgagtcccc

SEQ ID NO: 16202 - DNA, 25 bp, Homo sapiens
ctctgccctgctttttagaactgca

SEQ ID NO: 16203 - DNA, 25 bp, Homo sapiens
tggggacacaaaccttttatacaat

SEQ ID NO: 16204 - DNA, 25 bp, Homo sapiens
gaagacccctctgccgagggaggtt

SEQ ID NO: 16205 - DNA, 25 bp, Homo sapiens
gacaaggtcccttggtgctgatggc

SEQ ID NO: 16206 - DNA, 25 bp, Homo sapiens
ggcagatgcagttttctgtgggctt

SEQ ID NO: 16207 - DNA, 25 bp, Homo sapiens
gcagcccgaccaataaacctgcttt

SEQ ID NO: 16208 - DNA, 25 bp, Homo sapiens
ccccgcttggacacagtccgagtgg

SEQ ID NO: 16209 - DNA, 25 bp, Homo sapiens
gtcctggttgtccaagtcgggatct

SEQ ID NO: 16210 - DNA, 25 bp, Homo sapiens
ttgcagtgattccacggttaggccc

SEQ ID NO: 16211 - DNA, 25 bp, Homo sapiens
ggactcaaagccaaaactgcccaaa

SEQ ID NO: 16212 - DNA, 25 bp, Homo sapiens
tgaatcctaaaggggatccttgccc

SEQ ID NO: 16213 - DNA, 25 bp, Homo sapiens
gcacaggctgtatctgcagagggtc

SEQ ID NO: 16214 - DNA, 25 bp, Homo sapiens
gggtcccagaggaacgctggagcca

SEQ ID NO: 16215 - DNA, 25 bp, Homo sapiens
gagccaagagaagccctgggaagga

SEQ ID NO: 16216 - DNA, 25 bp, Homo sapiens
cacactgatgtgtttatgcacctgt

SEQ ID NO: 16217 - DNA, 25 bp, Homo sapiens
cctgtacacaggagcgcatggccat

SEQ ID NO: 16218 - DNA, 25 bp, Homo sapiens
gagcgcatggccatggctttggaaa

SEQ ID NO: 16219 - DNA, 25 bp, Homo sapiens
ggctgcctgcggatgaaggaccagt

SEQ ID NO: 16220 - DNA, 25 bp, Homo sapiens
cagtgtgacaagtgccgggagatct

SEQ ID NO: 16221 - DNA, 25 bp, Homo sapiens
tgccgggagatcttgtctgtggact

SEQ ID NO: 16222 - DNA, 25 bp, Homo sapiens
ttgtctgtggactgttccaccaaca

SEQ ID NO: 16223 - DNA, 25 bp, Homo sapiens
ctcccaggctaagctgcggcgggag

SEQ ID NO: 16224 - DNA, 25 bp, Homo sapiens
ctccaggtcgctgagaggttgacca

SEQ ID NO: 16225 - DNA, 25 bp, Homo sapiens
acgagctgctaaagtcctaccagtg

SEQ ID NO: 16226 - DNA, 25 bp, Homo sapiens
gaccagtactatctgcgggtcacca

SEQ ID NO: 16227 - DNA, 25 bp, Homo sapiens
actgaggtggtcgtgaagctctttg

SEQ ID NO: 16228 - DNA, 25 bp, Homo sapiens
catcactgtgacggtccctgtagaa

SEQ ID NO: 16229 - DNA, 25 bp, Homo sapiens
gtagaagtctccaggaagaacccta

SEQ ID NO: 16230 - DNA, 25 bp, Homo sapiens
agcagctgaacgagcagtttaactg

SEQ ID NO: 16231 - DNA, 25 bp, Homo sapiens
gagcagtttaactgggtgtcccggc

SEQ ID NO: 16232 - DNA, 25 bp, Homo sapiens
agcagtttaactgggtgtcccggct

SEQ ID NO: 16233 - DNA, 25 bp, Homo sapiens
cagtttaactgggtgtcccggctgg

SEQ ID NO: 16234 - DNA, 25 bp, Homo sapiens
tggcaaacctcacgcaaggcgaaga

SEQ ID NO: 16235 - DNA, 25 bp, Homo sapiens
gaaccctaaatttatggagaccgtg

SEQ ID NO: 16236 - DNA, 25 bp, Homo sapiens
aaatttatggagaccgtggcggaga

SEQ ID NO: 16237 - DNA, 25 bp, Homo sapiens
atggagaccgtggcggagaaagcgc

SEQ ID NO: 16238 - DNA, 25 bp, Homo sapiens
gcaggaataccgcaaaaagcaccgg

SEQ ID NO: 16239 - DNA, 25 bp, Homo sapiens
aaagcaccgggaggagtgagatgtg

SEQ ID NO: 16240 - DNA, 25 bp, Homo sapiens
gggaggagtgagatgtggatgttgc

SEQ ID NO: 16241 - DNA, 25 bp, Homo sapiens
cacttcgaaaacttgctttcccaca

SEQ ID NO: 16242 - DNA, 25 bp, Homo sapiens
gctttcccacactaaggtaagttca

SEQ ID NO: 16243 - DNA, 25 bp, Homo sapiens
cagactagattgaacactccagaat

SEQ ID NO: 16244 - DNA, 25 bp, Homo sapiens
tgcccttactgtgccaaaacaaaaa

SEQ ID NO: 16245 - DNA, 25 bp, Homo sapiens
gcaagtagacaccttcataactatg

SEQ ID NO: 16246 - DNA, 25 bp, Homo sapiens
tgaagtagtgtttaggatcctccat

SEQ ID NO: 16247 - DNA, 25 bp, Homo sapiens
ggatcctccatggcagttagtgaat

SEQ ID NO: 16248 - DNA, 25 bp, Homo sapiens
agttactcagtgcaatgtatagcct

SEQ ID NO: 16249 - DNA, 25 bp, Homo sapiens
atagcctgagtctatccatgatggc

SEQ ID NO: 16250 - DNA, 25 bp, Homo sapiens
ggctatatccaatttgacatcacgt

SEQ ID NO: 16251 - DNA, 25 bp, Homo sapiens
gtaaactaaccaactaccattatgt

SEQ ID NO: 16252 - DNA, 25 bp, Homo sapiens
ctggcctctactacgtggacagtga

SEQ ID NO: 16253 - DNA, 25 bp, Homo sapiens
taggttctggctctgtgtatgcata

SEQ ID NO: 16254 - DNA, 25 bp, Homo sapiens
tggatcggggctattcctatgacct

SEQ ID NO: 16255 - DNA, 25 bp, Homo sapiens
ggagcaggcctatgatctggcccgt

SEQ ID NO: 16256 - DNA, 25 bp, Homo sapiens
aggaggtgcagtcaacctctaccac

SEQ ID NO: 16257 - DNA, 25 bp, Homo sapiens
ggaggatggctggatccgagtctcc

SEQ ID NO: 16258 - DNA, 25 bp, Homo sapiens
tgagaagtatagtggctctaccccc

SEQ ID NO: 16259 - DNA, 25 bp, Homo sapiens
gtgtttcttggggtgactgtcattg

SEQ ID NO: 16260 - DNA, 25 bp, Homo sapiens
taatacggacacagtgacccatcct

SEQ ID NO: 16261 - DNA, 25 bp, Homo sapiens
gaagggccttcaattgtatcagtac

SEQ ID NO: 16262 - DNA, 25 bp, Homo sapiens
taagctctggcacattgacctctat

SEQ ID NO: 16263 - DNA, 25 bp, Homo sapiens
tcttcctcaaagtctgcctagtgag

SEQ ID NO: 16264 - DNA, 25 bp, Homo sapiens
gagatatggcctactggttgcctca

SEQ ID NO: 16265 - DNA, 25 bp, Homo sapiens
ggttgcctcatagctttgtacagat

SEQ ID NO: 16266 - DNA, 25 bp, Homo sapiens
gggcatttacccatcttggtatctg

SEQ ID NO: 16267 - DNA, 25 bp, Homo sapiens
ttggtatctgttgtatcctttatct

SEQ ID NO: 16268 - DNA, 25 bp, Homo sapiens
ttttcagtttcacataccttatcta

SEQ ID NO: 16269 - DNA, 25 bp, Homo sapiens
aactacttctatgatttcagctgga

SEQ ID NO: 16270 - DNA, 25 bp, Homo sapiens
tacttgtttctgttcaagtcccact

SEQ ID NO: 16271 - DNA, 25 bp, Homo sapiens
caagtcccactttaaattatgtctt

SEQ ID NO: 16272 - DNA, 25 bp, Homo sapiens
aatcttctgagcattcctaaatatc

SEQ ID NO: 16273 - DNA, 25 bp, Homo sapiens
gagggaccttcttaatacactgatg

SEQ ID NO: 16274 - DNA, 25 bp, Homo sapiens
ggtcacatgggtttggactgtctca

SEQ ID NO: 16275 - DNA, 25 bp, Homo sapiens
gtatctgagttgcataccaggcagt

SEQ ID NO: 16276 - DNA, 25 bp, Homo sapiens
ctaacaggtctgtttggcccattga

SEQ ID NO: 16277 - DNA, 25 bp, Homo sapiens
ctgtttggcccattgatagatactc

SEQ ID NO: 16278 - DNA, 25 bp, Homo sapiens
tggtgtctccttctggttatggatt

SEQ ID NO: 16279 - DNA, 25 bp, Homo sapiens
attttgaccattgattacctttctc

SEQ ID NO: 16280 - DNA, 25 bp, Homo sapiens
gtctttccttgcttacaaactactt

SEQ ID NO: 16281 - DNA, 25 bp, Homo sapiens
aactactttcacattgaacagctgt

SEQ ID NO: 16282 - DNA, 25 bp, Homo sapiens
gtattcattttatgctgcccaagat

SEQ ID NO: 16283 - DNA, 25 bp, Homo sapiens
gtgattatattactctgtccttgtt

SEQ ID NO: 16284 - DNA, 25 bp, Homo sapiens
taaagtgctgctgtgtttgactctg

SEQ ID NO: 16285 - DNA, 25 bp, Homo sapiens
ggacccattttcatttgacttcttt

SEQ ID NO: 16286 - DNA, 25 bp, Homo sapiens
gaggacttctttgggaatcgaaggg

SEQ ID NO: 16287 - DNA, 25 bp, Homo sapiens
atcgaaggggtccccgaggaagcag

SEQ ID NO: 16288 - DNA, 25 bp, Homo sapiens
gtccccgaggaagcagaagccgagg

SEQ ID NO: 16289 - DNA, 25 bp, Homo sapiens
gcagaagccgagggacggggtcgtt

SEQ ID NO: 16290 - DNA, 25 bp, Homo sapiens
tcgtttttctctgcgttcagtggat

SEQ ID NO: 16291 - DNA, 25 bp, Homo sapiens
gttcagtggatttccgtcttttgga

SEQ ID NO: 16292 - DNA, 25 bp, Homo sapiens
cattctcttccacgtcatttggtgg

SEQ ID NO: 16293 - DNA, 25 bp, Homo sapiens
cacgtcatttggtggtagtggcatg

SEQ ID NO: 16294 - DNA, 25 bp, Homo sapiens
ggtggtagtggcatgggcaacttca

SEQ ID NO: 16295 - DNA, 25 bp, Homo sapiens
gagaattgtcgagaacggtcaagaa

SEQ ID NO: 16296 - DNA, 25 bp, Homo sapiens
atggctgaccggattctgaccatga

SEQ ID NO: 16297 - DNA, 25 bp, Homo sapiens
ggcacgactagaagccctcaaaacc

SEQ ID NO: 16298 - DNA, 25 bp, Homo sapiens
aaattggcatgttcagcttcactgg

SEQ ID NO: 16299 - DNA, 25 bp, Homo sapiens
gctgccaagtggtcgaatcaacgtg

SEQ ID NO: 16300 - DNA, 25 bp, Homo sapiens
ctccatccatgaagcagtcaccaaa

SEQ ID NO: 16301 - DNA, 25 bp, Homo sapiens
tccagtgaagaaacaccacccgtcc

SEQ ID NO: 16302 - DNA, 25 bp, Homo sapiens
gtccagtaccaccaaagtagttctc

SEQ ID NO: 16303 - DNA, 25 bp, Homo sapiens
ctgcctgcacaaacctacatgtaca

SEQ ID NO: 16304 - DNA, 25 bp, Homo sapiens
gactgaaaggctgctctggtgaggc

SEQ ID NO: 16305 - DNA, 25 bp, Homo sapiens
taaaccggccccacatgaagagaac

SEQ ID NO: 16306 - DNA, 25 bp, Homo sapiens
gagaacatcccttgagacgaatttg

SEQ ID NO: 16307 - DNA, 25 bp, Homo sapiens
gaagaccagccaaagcaagtttatg

SEQ ID NO: 16308 - DNA, 25 bp, Homo sapiens
tgatcatttggatgctgctgacatg

SEQ ID NO: 16309 - DNA, 25 bp, Homo sapiens
agcagagtttgaccatggatccagt

SEQ ID NO: 16310 - DNA, 25 bp, Homo sapiens
accatggatccagttgtcaagtcaa

SEQ ID NO: 16311 - DNA, 25 bp, Homo sapiens
ggagctgacaagtacttgtagccct

SEQ ID NO: 16312 - DNA, 25 bp, Homo sapiens
gtagccctataatttcaaagcccaa

SEQ ID NO: 16313 - DNA, 25 bp, Homo sapiens
atgcagagcagaatggaccagtgga

SEQ ID NO: 16314 - DNA, 25 bp, Homo sapiens
atggacaaggagacaacccaggccc

SEQ ID NO: 16315 - DNA, 25 bp, Homo sapiens
cccccaggctgctgagcagggtaca

SEQ ID NO: 16316 - DNA, 25 bp, Homo sapiens
agggtacagacacagctgtgccttc

SEQ ID NO: 16317 - DNA, 25 bp, Homo sapiens
gctgtgccttcggattcagacaaga

SEQ ID NO: 16318 - DNA, 25 bp, Homo sapiens
cggatggtggatttcgctggcatga

SEQ ID NO: 16319 - DNA, 25 bp, Homo sapiens
ggatttcgctggcatgaaggacaag

SEQ ID NO: 16320 - DNA, 25 bp, Homo sapiens
gaaggacaaggtcacccttgtggtt

SEQ ID NO: 16321 - DNA, 25 bp, Homo sapiens
aaggtcacccttgtggttggagcgt

SEQ ID NO: 16322 - DNA, 25 bp, Homo sapiens
tggttggagcgtcccaggacatcat

SEQ ID NO: 16323 - DNA, 25 bp, Homo sapiens
atcatcccccagctgaagaagaagt

SEQ ID NO: 16324 - DNA, 25 bp, Homo sapiens
tggtcttcctcgaccactggaagga

SEQ ID NO: 16325 - DNA, 25 bp, Homo sapiens
tcgaccactggaaggaccggtacct

SEQ ID NO: 16326 - DNA, 25 bp, Homo sapiens
cactggaaggaccggtacctgccgg

SEQ ID NO: 16327 - DNA, 25 bp, Homo sapiens
gtggtggacggcctggagaaggcca

SEQ ID NO: 16328 - DNA, 25 bp, Homo sapiens
gaaggccatctacaagggcccaggc

SEQ ID NO: 16329 - DNA, 25 bp, Homo sapiens
ctctcacccagcctggtactgaagg

SEQ ID NO: 16330 - DNA, 25 bp, Homo sapiens
tactgaaggtgccagacgtgctcct

SEQ ID NO: 16331 - DNA, 25 bp, Homo sapiens
tgtcctaaatgcaaagcacacctcg

SEQ ID NO: 16332 - DNA, 25 bp, Homo sapiens
taacctctctgaactgcaacactgg

SEQ ID NO: 16333 - DNA, 25 bp, Homo sapiens
gcaacactggattgttcttttttaa

SEQ ID NO: 16334 - DNA, 25 bp, Homo sapiens
ggcctgctgcggaaggggacagtgc

SEQ ID NO: 16335 - DNA, 25 bp, Homo sapiens
gaaggggacagtgctactggctgac

SEQ ID NO: 16336 - DNA, 25 bp, Homo sapiens
actggctgacaacgtgatctgccca

SEQ ID NO: 16337 - DNA, 25 bp, Homo sapiens
ttcctagcacacgtgcgcgggagca

SEQ ID NO: 16338 - DNA, 25 bp, Homo sapiens
agctgctttgagtgcacacactacc

SEQ ID NO: 16339 - DNA, 25 bp, Homo sapiens
tgagtgcacacactaccaatcgttc

SEQ ID NO: 16340 - DNA, 25 bp, Homo sapiens
ttcccgtaaggctgttacgataggt

SEQ ID NO: 16341 - DNA, 25 bp, Homo sapiens
gttacgataggtccttttatctcct

SEQ ID NO: 16342 - DNA, 25 bp, Homo sapiens
gacccttggccacagagtatggaag

SEQ ID NO: 16343 - DNA, 25 bp, Homo sapiens
gtatggaagtagctccgcagaggcg

SEQ ID NO: 16344 - DNA, 25 bp, Homo sapiens
tggaagtagctccgcagaggcgtgg

SEQ ID NO: 16345 - DNA, 25 bp, Homo sapiens
ccacgttaccacagacctgtttgtt

SEQ ID NO: 16346 - DNA, 25 bp, Homo sapiens
tgttgttcgtggagtctcatgggat

SEQ ID NO: 16347 - DNA, 25 bp, Homo sapiens
cgtggagtctcatgggattgtctgg

SEQ ID NO: 16348 - DNA, 25 bp, Homo sapiens
gagtctcatgggattgtctggtttc

SEQ ID NO: 16349 - DNA, 25 bp, Homo sapiens
catgggattgtctggtttccttaca

SEQ ID NO: 16350 - DNA, 25 bp, Homo sapiens
ggattgtctggtttccttacagggc

SEQ ID NO: 16351 - DNA, 25 bp, Homo sapiens
cgcaccccgacttgatagcgacggg

SEQ ID NO: 16352 - DNA, 25 bp, Homo sapiens
ctcctcaccaagctgttgcagtttg

SEQ ID NO: 16353 - DNA, 25 bp, Homo sapiens
atcggatctccgcagaggatgccat

SEQ ID NO: 16354 - DNA, 25 bp, Homo sapiens
gccatgaaacatccattcttcctca

SEQ ID NO: 16355 - DNA, 25 bp, Homo sapiens
ttcttcctcagtctgggggagcgga

SEQ ID NO: 16356 - DNA, 25 bp, Homo sapiens
tcctgacactacttccatatttgca

SEQ ID NO: 16357 - DNA, 25 bp, Homo sapiens
caaaaggaggccagccttcggtctt

SEQ ID NO: 16358 - DNA, 25 bp, Homo sapiens
tggacaccgagttctaagccacaga

SEQ ID NO: 16359 - DNA, 25 bp, Homo sapiens
gccccagcaggcagcggctggaggg

SEQ ID NO: 16360 - DNA, 25 bp, Homo sapiens
cacccattggcctgtctgctgggtg

SEQ ID NO: 16361 - DNA, 25 bp, Homo sapiens
gggtgctaacaaagctctcatcact

SEQ ID NO: 16362 - DNA, 25 bp, Homo sapiens
ttttgaggatgaccggtgccttgct

SEQ ID NO: 16363 - DNA, 25 bp, Homo sapiens
cctcaagcaccaacacattttctgg

SEQ ID NO: 16364 - DNA, 25 bp, Homo sapiens
agaaatgtgctgctgatctgggcct

SEQ ID NO: 16365 - DNA, 25 bp, Homo sapiens
cccgcgcgggagagaggccgagatg

SEQ ID NO: 16366 - DNA, 25 bp, Homo sapiens
tggacagtctgtctatcacgttcat

SEQ ID NO: 16367 - DNA, 25 bp, Homo sapiens
tcacgttcatctccatgttcttgga

SEQ ID NO: 16368 - DNA, 25 bp, Homo sapiens
caaatgcattggcctcctggttaag

SEQ ID NO: 16369 - DNA, 25 bp, Homo sapiens
gggataattttctcttctttaggca

SEQ ID NO: 16370 - DNA, 25 bp, Homo sapiens
aagtaacacacttatttttgcctgt

SEQ ID NO: 16371 - DNA, 25 bp, Homo sapiens
gagattgccaaggctcaggtcgctc

SEQ ID NO: 16372 - DNA, 25 bp, Homo sapiens
ctggtggcgacacgatctttgggaa

SEQ ID NO: 16373 - DNA, 25 bp, Homo sapiens
tctcacttctgtcagtctgtaagct

SEQ ID NO: 16374 - DNA, 25 bp, Homo sapiens
gctttgataacctgcttaatactcc

SEQ ID NO: 16375 - DNA, 25 bp, Homo sapiens
atactccaaagtgtgagttcctctg

SEQ ID NO: 16376 - DNA, 25 bp, Homo sapiens
tcctctgatctcttgattccttagt

SEQ ID NO: 16377 - DNA, 25 bp, Homo sapiens
gatctcttgattccttagttctaat

SEQ ID NO: 16378 - DNA, 25 bp, Homo sapiens
tagttctaatctcacgttttgtttt

SEQ ID NO: 16379 - DNA, 25 bp, Homo sapiens
gctcattgcatccttgaaatcctgg

SEQ ID NO: 16380 - DNA, 25 bp, Homo sapiens
ctggctaattttgtctcatgtcttc

SEQ ID NO: 16381 - DNA, 25 bp, Homo sapiens
taaaatatctctgttggcctttctt

SEQ ID NO: 16382 - DNA, 25 bp, Homo sapiens
ctccaagcgctttttgtttctaagt

SEQ ID NO: 16383 - DNA, 25 bp, Homo sapiens
gttgagtgcttggggtttgacaggt

SEQ ID NO: 16384 - DNA, 25 bp, Homo sapiens
aggccagggattagccactgtggga

SEQ ID NO: 16385 - DNA, 25 bp, Homo sapiens
aatggttcagtggcctggctgttgg

SEQ ID NO: 16386 - DNA, 25 bp, Homo sapiens
tggcaggaactccaagtgcccaggc

SEQ ID NO: 16387 - DNA, 25 bp, Homo sapiens
gcctctgtttcatgatgcatgggtc

SEQ ID NO: 16388 - DNA, 25 bp, Homo sapiens
gcatgggtcatttgtcttgggtgtc

SEQ ID NO: 16389 - DNA, 25 bp, Homo sapiens
gggtgtcctatcccatatggagaag

SEQ ID NO: 16390 - DNA, 25 bp, Homo sapiens
ggtgactttgcagatctgctcaccc

SEQ ID NO: 16391 - DNA, 25 bp, Homo sapiens
tgctgggctgggtcgcgtagcccag

SEQ ID NO: 16392 - DNA, 25 bp, Homo sapiens
tcatgcccatgcttgattcttgcac

SEQ ID NO: 16393 - DNA, 25 bp, Homo sapiens
gaaggcatccgactgcattaagtgt

SEQ ID NO: 16394 - DNA, 25 bp, Homo sapiens
aaagacatttacaactaggccaggg

SEQ ID NO: 16395 - DNA, 25 bp, Homo sapiens
gaactcattaacattgacatctgca

SEQ ID NO: 16396 - DNA, 25 bp, Homo sapiens
gacatctgcaacaggaggcaacagg

SEQ ID NO: 16397 - DNA, 25 bp, Homo sapiens
gatgagggcattttatctgcttgct

SEQ ID NO: 16398 - DNA, 25 bp, Homo sapiens
ttatctgcttgctgtgaccagcgtg

SEQ ID NO: 16399 - DNA, 25 bp, Homo sapiens
gcgtgtgtacacataaaccttaaca

SEQ ID NO: 16400 - DNA, 25 bp, Homo sapiens
tagaccagatttagtagctccatat

SEQ ID NO: 16401 - DNA, 25 bp, Homo sapiens
agtacagggatggctggctgctcaa

SEQ ID NO: 16402 - DNA, 25 bp, Homo sapiens
tcctttctttaagctgtgtacagtg

SEQ ID NO: 16403 - DNA, 25 bp, Homo sapiens
gcatgatggtgccttctattaatac

SEQ ID NO: 16404 - DNA, 25 bp, Homo sapiens
ttaatacatcattccagtcttgctg

SEQ ID NO: 16405 - DNA, 25 bp, Homo sapiens
atagtgtatgaattgctgtgctgca

SEQ ID NO: 16406 - DNA, 25 bp, Homo sapiens
cgagaagcctgtttctgcggctgtg

SEQ ID NO: 16407 - DNA, 25 bp, Homo sapiens
gcggctgtggatgccaatgcttctg

SEQ ID NO: 16408 - DNA, 25 bp, Homo sapiens
aatgcttctgagtcaccttaacttt

SEQ ID NO: 16409 - DNA, 25 bp, Homo sapiens
gtttgtaccgtatctgtaggcatcc

SEQ ID NO: 16410 - DNA, 25 bp, Homo sapiens
cgaggacgtgggttgtatcctgcca

SEQ ID NO: 16411 - DNA, 25 bp, Homo sapiens
atcctgccaggttgagtggggctca

SEQ ID NO: 16412 - DNA, 25 bp, Homo sapiens
gtggggctcacacgctagggtgaga

SEQ ID NO: 16413 - DNA, 25 bp, Homo sapiens
tgtaagggtggcttgctgccaggct

SEQ ID NO: 16414 - DNA, 25 bp, Homo sapiens
ctgctgctccttccgtaagaaaatg

SEQ ID NO: 16415 - DNA, 25 bp, Homo sapiens
tattctatgcctaatactcacacgc

SEQ ID NO: 16416 - DNA, 25 bp, Homo sapiens
actcacacgcaacatttcttgtact

SEQ ID NO: 16417 - DNA, 25 bp, Homo sapiens
gtgttacatctaaattacaaccctt

SEQ ID NO: 16418 - DNA, 25 bp, Homo sapiens
taaattacaacccttaattgccacg

SEQ ID NO: 16419 - DNA, 25 bp, Homo sapiens
aattgccacgtgtgcacttactact

SEQ ID NO: 16420 - DNA, 25 bp, Homo sapiens
tctccagtatgtcttattactctcc

SEQ ID NO: 16421 - DNA, 25 bp, Homo sapiens
ccagtatgtcttattactctccagt

SEQ ID NO: 16422 - DNA, 25 bp, Homo sapiens
attactctccagtatgtcacgcatc

SEQ ID NO: 16423 - DNA, 25 bp, Homo sapiens
tctccagtatgtcacgcatctttaa

SEQ ID NO: 16424 - DNA, 25 bp, Homo sapiens
gtatgtcacgcatctttaacttttc

SEQ ID NO: 16425 - DNA, 25 bp, Homo sapiens
tctttaacttttcacgtcctatgtt

SEQ ID NO: 16426 - DNA, 25 bp, Homo sapiens
aacttttcacgtcctatgtttgctt

SEQ ID NO: 16427 - DNA, 25 bp, Homo sapiens
gttaactggaattgatttactgaat

SEQ ID NO: 16428 - DNA, 25 bp, Homo sapiens
gttggttgtgactgtactattctag

SEQ ID NO: 16429 - DNA, 25 bp, Homo sapiens
ttctcagcacctacttttgtcaaat

SEQ ID NO: 16430 - DNA, 25 bp, Homo sapiens
tttgccacttcgagatcacattgcc

SEQ ID NO: 16431 - DNA, 25 bp, Homo sapiens
atcattcctgtgttgttgtactttc

SEQ ID NO: 16432 - DNA, 25 bp, Homo sapiens
gtataacctaaaccatctactcttt

SEQ ID NO: 16433 - DNA, 25 bp, Homo sapiens
acttgctcattctacagcttttttc

SEQ ID NO: 16434 - DNA, 25 bp, Homo sapiens
agctctcgttcattaattttagtcc

SEQ ID NO: 16435 - DNA, 25 bp, Homo sapiens
aatttatctgttctccagtccagtt

SEQ ID NO: 16436 - DNA, 25 bp, Homo sapiens
gcatgaagttgttgccagtttctgt

SEQ ID NO: 16437 - DNA, 25 bp, Homo sapiens
acattcttctgcattgggctactcg

SEQ ID NO: 16438 - DNA, 25 bp, Homo sapiens
gctactcgcgtgttacctaagacgt

SEQ ID NO: 16439 - DNA, 25 bp, Homo sapiens
gcaggtggcttgttaaggaacgcta

SEQ ID NO: 16440 - DNA, 25 bp, Homo sapiens
catggcacgtgagctccggaataga

SEQ ID NO: 16441 - DNA, 25 bp, Homo sapiens
ggaatagatgtcttcatcacttctt

SEQ ID NO: 16442 - DNA, 25 bp, Homo sapiens
gtgtgttgacactgttttccttacc

SEQ ID NO: 16443 - DNA, 25 bp, Homo sapiens
tcacagtgcagcttgcagtccgttg

SEQ ID NO: 16444 - DNA, 25 bp, Homo sapiens
gcttgcagtccgttgctgaaaatga

SEQ ID NO: 16445 - DNA, 25 bp, Homo sapiens
attacgtgtatgtttcttctttctt

SEQ ID NO: 16446 - DNA, 25 bp, Homo sapiens
ttttaagcagacccatacctttcca

SEQ ID NO: 16447 - DNA, 25 bp, Homo sapiens
atacctttccagggtcaaagtacag

SEQ ID NO: 16448 - DNA, 25 bp, Homo sapiens
gaagtctaattcacaggcaaaccaa

SEQ ID NO: 16449 - DNA, 25 bp, Homo sapiens
taagccttcatttgcaattcatgta

SEQ ID NO: 16450 - DNA, 25 bp, Homo sapiens
aagaaaactgatgcacctcaaccgg

SEQ ID NO: 16451 - DNA, 25 bp, Homo sapiens
gatgcacctcaaccggatgtgaagg

SEQ ID NO: 16452 - DNA, 25 bp, Homo sapiens
gaagatggtggcactgtcagtcaag

SEQ ID NO: 16453 - DNA, 25 bp, Homo sapiens
gatcaccaagaaacagaaagccacg

SEQ ID NO: 16454 - DNA, 25 bp, Homo sapiens
aacaatcttaagagcttgatctgtg

SEQ ID NO: 16455 - DNA, 25 bp, Homo sapiens
ctcccctgcaagagtggtcctagga

SEQ ID NO: 16456 - DNA, 25 bp, Homo sapiens
ggacctggcacaccttaggttgaca

SEQ ID NO: 16457 - DNA, 25 bp, Homo sapiens
aacttcaagacatcaccatcagcag

SEQ ID NO: 16458 - DNA, 25 bp, Homo sapiens
catcagcaggctccagttgaacact

SEQ ID NO: 16459 - DNA, 25 bp, Homo sapiens
gttgaacactagtctgtgtaacttt

SEQ ID NO: 16460 - DNA, 25 bp, Homo sapiens
gatataaaggaccctgtttctgtag

SEQ ID NO: 16461 - DNA, 25 bp, Homo sapiens
gcagccccagctaaggttgaagcca

SEQ ID NO: 16462 - DNA, 25 bp, Homo sapiens
aatctccaggggcaccattgaaatc

SEQ ID NO: 16463 - DNA, 25 bp, Homo sapiens
acgctgctgaacatgctcaacatct

SEQ ID NO: 16464 - DNA, 25 bp, Homo sapiens
ctggtcatccagcaggtgttcgaca

SEQ ID NO: 16465 - DNA, 25 bp, Homo sapiens
ggcagcatctacaaccctgaagtgc

SEQ ID NO: 16466 - DNA, 25 bp, Homo sapiens
cttcctggagggtgtccgcaatgtt

SEQ ID NO: 16467 - DNA, 25 bp, Homo sapiens
atgttgccagtgtctgtctgcagat

SEQ ID NO: 16468 - DNA, 25 bp, Homo sapiens
gattggctacccaactgttgcatca

SEQ ID NO: 16469 - DNA, 25 bp, Homo sapiens
agtaccccattctatcatcaacggg

SEQ ID NO: 16470 - DNA, 25 bp, Homo sapiens
tgtggagacggattacaccttccca

SEQ ID NO: 16471 - DNA, 25 bp, Homo sapiens
aaggtcaaggccttcttggctgatc

SEQ ID NO: 16472 - DNA, 25 bp, Homo sapiens
gtgggccttgcaaaatgatcaagcc

SEQ ID NO: 16473 - DNA, 25 bp, Homo sapiens
gatgttgcttcagagtgtgaagtca

SEQ ID NO: 16474 - DNA, 25 bp, Homo sapiens
gaagtcaaatgcatgccaacattcc

SEQ ID NO: 16475 - DNA, 25 bp, Homo sapiens
tgcatgccaacattccagtttttta

SEQ ID NO: 16476 - DNA, 25 bp, Homo sapiens
caaaaggtgggtgaattttctggag

SEQ ID NO: 16477 - DNA, 25 bp, Homo sapiens
aaagcttgaagccaccattaatgaa

SEQ ID NO: 16478 - DNA, 25 bp, Homo sapiens
cagatcgagagcaagactgcttttc

SEQ ID NO: 16479 - DNA, 25 bp, Homo sapiens
gactgcttttcaggaagccttggac

SEQ ID NO: 16480 - DNA, 25 bp, Homo sapiens
ttttcaggaagccttggacgctgca

SEQ ID NO: 16481 - DNA, 25 bp, Homo sapiens
ggacgctgcaggtgataaacttgta

SEQ ID NO: 16482 - DNA, 25 bp, Homo sapiens
tgtagtagttgacttctcagccacg

SEQ ID NO: 16483 - DNA, 25 bp, Homo sapiens
atggtattcctttgcaagtcaattt

SEQ ID NO: 16484 - DNA, 25 bp, Homo sapiens
gcaagtcaatttaggtttcgtgtta

SEQ ID NO: 16485 - DNA, 25 bp, Homo sapiens
acaatatctagtactgcaactgcca

SEQ ID NO: 16486 - DNA, 25 bp, Homo sapiens
gcaactgccagaacttggtattgta

SEQ ID NO: 16487 - DNA, 25 bp, Homo sapiens
gcccgctgactagcagctggactga

SEQ ID NO: 16488 - DNA, 25 bp, Homo sapiens
tataagcagttgactttcacccttg

SEQ ID NO: 16489 - DNA, 25 bp, Homo sapiens
tttcacccttggagagcatcacact

SEQ ID NO: 16490 - DNA, 25 bp, Homo sapiens
aggttcagtgattgttgaccctccc

SEQ ID NO: 16491 - DNA, 25 bp, Homo sapiens
ccctcctgcttctttaagttatctg

SEQ ID NO: 16492 - DNA, 25 bp, Homo sapiens
taagttatctgtgtgcgtgcgcttc

SEQ ID NO: 16493 - DNA, 25 bp, Homo sapiens
ctggaaatgctgccgggagcctatt

SEQ ID NO: 16494 - DNA, 25 bp, Homo sapiens
gtagtggaccatacctggggaccaa

SEQ ID NO: 16495 - DNA, 25 bp, Homo sapiens
gtggaccatacctggggaccaaaag

SEQ ID NO: 16496 - DNA, 25 bp, Homo sapiens
caccccaggggtggcagtagacaac

SEQ ID NO: 16497 - DNA, 25 bp, Homo sapiens
cccaggggtggcagtagacaacaac

SEQ ID NO: 16498 - DNA, 25 bp, Homo sapiens
ggtggcagtagacaacaacccagaa

SEQ ID NO: 16499 - DNA, 25 bp, Homo sapiens
ggggttaggcatgaaggtggttgtg

SEQ ID NO: 16500 - DNA, 25 bp, Homo sapiens
ggtggttgtgattaagaagatggtt

SEQ ID NO: 16501 - DNA, 25 bp, Homo sapiens
acatctagaaacattacaccacaca

SEQ ID NO: 16502 - DNA, 25 bp, Homo sapiens
tctagaaacattacaccacacacac

SEQ ID NO: 16503 - DNA, 25 bp, Homo sapiens
gtattcctggggtttaattgttgtg

SEQ ID NO: 16504 - DNA, 25 bp, Homo sapiens
attcctggggtttaattgttgtgca

SEQ ID NO: 16505 - DNA, 25 bp, Homo sapiens
tactgctgcctttgtccgaagaaac

SEQ ID NO: 16506 - DNA, 25 bp, Homo sapiens
gaaaccgttcctccattatttgaat

SEQ ID NO: 16507 - DNA, 25 bp, Homo sapiens
ccccccacttttggagatgcgtcag

SEQ ID NO: 16508 - DNA, 25 bp, Homo sapiens
gtcagtcattgcccttgaattacta

SEQ ID NO: 16509 - DNA, 25 bp, Homo sapiens
aattcaggtctgtcatctcctataa

SEQ ID NO: 16510 - DNA, 25 bp, Homo sapiens
tcttttcccttaataccgttgcaag

SEQ ID NO: 16511 - DNA, 25 bp, Homo sapiens
acaatctggccaacatcatctacta

SEQ ID NO: 16512 - DNA, 25 bp, Homo sapiens
gaaggagtccaccactagtgagcag

SEQ ID NO: 16513 - DNA, 25 bp, Homo sapiens
gcagagtgccaggatgacagccatg

SEQ ID NO: 16514 - DNA, 25 bp, Homo sapiens
aaattatctctggtgctgcagctct

SEQ ID NO: 16515 - DNA, 25 bp, Homo sapiens
aatcaagttccatcctcagacaaga

SEQ ID NO: 16516 - DNA, 25 bp, Homo sapiens
tcgccgccaccatgaacaagaagaa

SEQ ID NO: 16517 - DNA, 25 bp, Homo sapiens
ttcaccacgcggtcagacattgggc

SEQ ID NO: 16518 - DNA, 25 bp, Homo sapiens
cccgtgatgcaaatgaccctgtgga

SEQ ID NO: 16519 - DNA, 25 bp, Homo sapiens
tgaccctgtggatgatcgccatgca

SEQ ID NO: 16520 - DNA, 25 bp, Homo sapiens
cacccccaggcaagagaaccgttgg

SEQ ID NO: 16521 - DNA, 25 bp, Homo sapiens
atcaggctgctgacgatgacgacga

SEQ ID NO: 16522 - DNA, 25 bp, Homo sapiens
aatggctatgctgggagcctcttct

SEQ ID NO: 16523 - DNA, 25 bp, Homo sapiens
cagatgctatctatgcagccctgga

SEQ ID NO: 16524 - DNA, 25 bp, Homo sapiens
ggcgacactttgctacggagtgcat

SEQ ID NO: 16525 - DNA, 25 bp, Homo sapiens
agtgcatcggacgtcgaagcctaga

SEQ ID NO: 16526 - DNA, 25 bp, Homo sapiens
gaagcctagagtctctgcgtctttc

SEQ ID NO: 16527 - DNA, 25 bp, Homo sapiens
gatacttacagtcagccactgcttt

SEQ ID NO: 16528 - DNA, 25 bp, Homo sapiens
gagtcccactcggtaagagttgctt

SEQ ID NO: 16529 - DNA, 25 bp, Homo sapiens
gacactgttgacatttgggctggat

SEQ ID NO: 16530 - DNA, 25 bp, Homo sapiens
aaacccctgtggtggggtctgtgct

SEQ ID NO: 16531 - DNA, 25 bp, Homo sapiens
ggtctgtgctgtgcattgcaggatg

SEQ ID NO: 16532 - DNA, 25 bp, Homo sapiens
ttgcaggatggtgagcagcgtccct

SEQ ID NO: 16533 - DNA, 25 bp, Homo sapiens
tgacacccacagttatgccggatgt

SEQ ID NO: 16534 - DNA, 25 bp, Homo sapiens
ttatgccggatgttgccagatgccc

SEQ ID NO: 16535 - DNA, 25 bp, Homo sapiens
tgcccctaggggacagagtcaaccc

SEQ ID NO: 16536 - DNA, 25 bp, Homo sapiens
ggaccactgtcctacagagtcagga

SEQ ID NO: 16537 - DNA, 25 bp, Homo sapiens
gaaacctcaagacagatttattatt

SEQ ID NO: 16538 - DNA, 25 bp, Homo sapiens
cgatcaccaatgtacctccagaggt

SEQ ID NO: 16539 - DNA, 25 bp, Homo sapiens
gatcaccaatgtacctccagaggta

SEQ ID NO: 16540 - DNA, 25 bp, Homo sapiens
cctccagaggtaactgtgctcacga

SEQ ID NO: 16541 - DNA, 25 bp, Homo sapiens
tccagaggtaactgtgctcacgaac

SEQ ID NO: 16542 - DNA, 25 bp, Homo sapiens
aggtaactgtgctcacgaacagccc

SEQ ID NO: 16543 - DNA, 25 bp, Homo sapiens
tgctcacgaacagccctgtggaact

SEQ ID NO: 16544 - DNA, 25 bp, Homo sapiens
tggaactgagagagcccaacgtcct

SEQ ID NO: 16545 - DNA, 25 bp, Homo sapiens
caacgtcctcatctgtttcatagac

SEQ ID NO: 16546 - DNA, 25 bp, Homo sapiens
acgtcctcatctgtttcatagacaa

SEQ ID NO: 16547 - DNA, 25 bp, Homo sapiens
gtcctcatctgtttcatagacaagt

SEQ ID NO: 16548 - DNA, 25 bp, Homo sapiens
ctgtttcatagacaagttcacccca

SEQ ID NO: 16549 - DNA, 25 bp, Homo sapiens
ggtgacttcagcactacagttatcc

SEQ ID NO: 16550 - DNA, 25 bp, Homo sapiens
gtagcaggtgttactttgccagtat

SEQ ID NO: 16551 - DNA, 25 bp, Homo sapiens
tactggtggaactagcttctctgca

SEQ ID NO: 16552 - DNA, 25 bp, Homo sapiens
cttctctgcagacttcttttgttac

SEQ ID NO: 16553 - DNA, 25 bp, Homo sapiens
cattgaacatgtcatcattccccgg

SEQ ID NO: 16554 - DNA, 25 bp, Homo sapiens
tcattccccggattgaacgtactct

SEQ ID NO: 16555 - DNA, 25 bp, Homo sapiens
aacgtactcttgcttatatcatcac

SEQ ID NO: 16556 - DNA, 25 bp, Homo sapiens
agctggaaggtgttggagcctgcta

SEQ ID NO: 16557 - DNA, 25 bp, Homo sapiens
ggagcctgctaatcttcttggctga

SEQ ID NO: 16558 - DNA, 25 bp, Homo sapiens
taatctttcctgttctggttctttg

SEQ ID NO: 16559 - DNA, 25 bp, Homo sapiens
tgagaaaccctaacactggcttcat

SEQ ID NO: 16560 - DNA, 25 bp, Homo sapiens
ggtgcgcgtggaattcatggacgac

SEQ ID NO: 16561 - DNA, 25 bp, Homo sapiens
attcatggacgacacgagccgatcc

SEQ ID NO: 16562 - DNA, 25 bp, Homo sapiens
ccgatccatcatccgcaatgtaaaa

SEQ ID NO: 16563 - DNA, 25 bp, Homo sapiens
tcacccttttggagtcagagcgaga

SEQ ID NO: 16564 - DNA, 25 bp, Homo sapiens
gtcagagcgagaagcccggaggttg

SEQ ID NO: 16565 - DNA, 25 bp, Homo sapiens
ctgggtcttggatgtcgggttcgac

SEQ ID NO: 16566 - DNA, 25 bp, Homo sapiens
ttggatgtcgggttcgaccacttgg

SEQ ID NO: 16567 - DNA, 25 bp, Homo sapiens
ttcgaccacttggccgatgggaatg

SEQ ID NO: 16568 - DNA, 25 bp, Homo sapiens
tggccgatgggaatggtctgtcaca

SEQ ID NO: 16569 - DNA, 25 bp, Homo sapiens
tccgccacacgtaactgagatgctc

SEQ ID NO: 16570 - DNA, 25 bp, Homo sapiens
acacgtaactgagatgctcctttaa

SEQ ID NO: 16571 - DNA, 25 bp, Homo sapiens
agatctataaggtcacatgctttta

SEQ ID NO: 16572 - DNA, 25 bp, Homo sapiens
gttaaacttcactcttgaattcttt

SEQ ID NO: 16573 - DNA, 25 bp, Homo sapiens
taggattgtctttaaacagccattc

SEQ ID NO: 16574 - DNA, 25 bp, Homo sapiens
gggaatggtgcttttgccaacttaa

SEQ ID NO: 16575 - DNA, 25 bp, Homo sapiens
ctggggaaattgcttcactgtctta

SEQ ID NO: 16576 - DNA, 25 bp, Homo sapiens
attgcttcactgtcttagaaccaag

SEQ ID NO: 16577 - DNA, 25 bp, Homo sapiens
accaagcaagattcacctgtgtttt

SEQ ID NO: 16578 - DNA, 25 bp, Homo sapiens
ttttgtgttcatgttcatttgcctc

SEQ ID NO: 16579 - DNA, 25 bp, Homo sapiens
agcaatgtctatagttttggcctta

SEQ ID NO: 16580 - DNA, 25 bp, Homo sapiens
aagattattcaacacctctcacatc

SEQ ID NO: 16581 - DNA, 25 bp, Homo sapiens
acacctctcacatcttacagatcta

SEQ ID NO: 16582 - DNA, 25 bp, Homo sapiens
gagaggcaaacccctgtttgtgcgt

SEQ ID NO: 16583 - DNA, 25 bp, Homo sapiens
ctgtttgtgcgtcatagaacccaga

SEQ ID NO: 16584 - DNA, 25 bp, Homo sapiens
ggacccacagcatgatctagatcga

SEQ ID NO: 16585 - DNA, 25 bp, Homo sapiens
gataggtgtttgcactcatcttggc

SEQ ID NO: 16586 - DNA, 25 bp, Homo sapiens
tcatcttggctgtgtacccattgca

SEQ ID NO: 16587 - DNA, 25 bp, Homo sapiens
ttttggtggttattactgcccttgc

SEQ ID NO: 16588 - DNA, 25 bp, Homo sapiens
gggtcacactatgatgcatctggca

SEQ ID NO: 16589 - DNA, 25 bp, Homo sapiens
caggatcagattgggtcctgctcct

SEQ ID NO: 16590 - DNA, 25 bp, Homo sapiens
tgaagtccccacgtatgagttcacc

SEQ ID NO: 16591 - DNA, 25 bp, Homo sapiens
ggactcaagtcataggcttctttca

SEQ ID NO: 16592 - DNA, 25 bp, Homo sapiens
ggcttctttcagtctttatgtcacc

SEQ ID NO: 16593 - DNA, 25 bp, Homo sapiens
tgacatcaactcccaatttcgtggt

SEQ ID NO: 16594 - DNA, 25 bp, Homo sapiens
atcaactcccaatttcgtggttgaa

SEQ ID NO: 16595 - DNA, 25 bp, Homo sapiens
ctcccaatttcgtggttgaagttat

SEQ ID NO: 16596 - DNA, 25 bp, Homo sapiens
gatgatggcaagaaggcccttgtgt

SEQ ID NO: 16597 - DNA, 25 bp, Homo sapiens
aagaaggcccttgtgttggactgtc

SEQ ID NO: 16598 - DNA, 25 bp, Homo sapiens
gcccttgtgttggactgtcattatc

SEQ ID NO: 16599 - DNA, 25 bp, Homo sapiens
gtgttggactgtcattatccagagg

SEQ ID NO: 16600 - DNA, 25 bp, Homo sapiens
ggactgtcattatccagaggatgag

SEQ ID NO: 16601 - DNA, 25 bp, Homo sapiens
ttatccagaggatgaggttggacaa

SEQ ID NO: 16602 - DNA, 25 bp, Homo sapiens
actgggccttatatgaccacctaat

SEQ ID NO: 16603 - DNA, 25 bp, Homo sapiens
ctggagcaccaggagtacattactt

SEQ ID NO: 16604 - DNA, 25 bp, Homo sapiens
tccccaaggaagtgccaccaggtac

SEQ ID NO: 16605 - DNA, 25 bp, Homo sapiens
cttccccatcttcacagaatacacc

SEQ ID NO: 16606 - DNA, 25 bp, Homo sapiens
ttggagtctgttaagcccagcagcc

SEQ ID NO: 16607 - DNA, 25 bp, Homo sapiens
ccgcctctcattgtgtatgaccgga

SEQ ID NO: 16608 - DNA, 25 bp, Homo sapiens
tggattcagaattctgctccacttc

SEQ ID NO: 16609 - DNA, 25 bp, Homo sapiens
tacaggtgctgctcttgaccatgat

SEQ ID NO: 16610 - DNA, 25 bp, Homo sapiens
tgcattcagtcctttgatgcctcca

SEQ ID NO: 16611 - DNA, 25 bp, Homo sapiens
gtgatatctcagatgctgctgcttg

SEQ ID NO: 16612 - DNA, 25 bp, Homo sapiens
ctgctgcttgacaatccacacaaag

SEQ ID NO: 16613 - DNA, 25 bp, Homo sapiens
gaacctatccgcttacggtacaagc

SEQ ID NO: 16614 - DNA, 25 bp, Homo sapiens
aggtggacagcctttcagcgaagta

SEQ ID NO: 16615 - DNA, 25 bp, Homo sapiens
tcctcctacctgtccaatgtggatg

SEQ ID NO: 16616 - DNA, 25 bp, Homo sapiens
gtggatgtctacctggacggacacc

SEQ ID NO: 16617 - DNA, 25 bp, Homo sapiens
ctcatcaccacggtgcagggcgacg

SEQ ID NO: 16618 - DNA, 25 bp, Homo sapiens
gaaagtgctagaagaccctgccatc

SEQ ID NO: 16619 - DNA, 25 bp, Homo sapiens
tcctgaccccattcagctttgagaa

SEQ ID NO: 16620 - DNA, 25 bp, Homo sapiens
gaggggaacgcagctgttgttctcc

SEQ ID NO: 16621 - DNA, 25 bp, Homo sapiens
tgttctccggagtcggctgaaggtc

SEQ ID NO: 16622 - DNA, 25 bp, Homo sapiens
gaagacggccgtgcacaatgggctg

SEQ ID NO: 16623 - DNA, 25 bp, Homo sapiens
ggctgcaggcctggacatggatgtc

SEQ ID NO: 16624 - DNA, 25 bp, Homo sapiens
caggccatgcagtaccaggtcctga

SEQ ID NO: 16625 - DNA, 25 bp, Homo sapiens
aggtggtgattgacagaggcccctc

SEQ ID NO: 16626 - DNA, 25 bp, Homo sapiens
gaaatgggctgggagtgcttctgtc

SEQ ID NO: 16627 - DNA, 25 bp, Homo sapiens
aaatgggctgggagtgcttctgtcc

SEQ ID NO: 16628 - DNA, 25 bp, Homo sapiens
tccatgccaggatatttttccgcaa

SEQ ID NO: 16629 - DNA, 25 bp, Homo sapiens
atgccaggatatttttccgcaaatc

SEQ ID NO: 16630 - DNA, 25 bp, Homo sapiens
ggatatttttccgcaaatcagtcgg

SEQ ID NO: 16631 - DNA, 25 bp, Homo sapiens
atttttccgcaaatcagtcggttga

SEQ ID NO: 16632 - DNA, 25 bp, Homo sapiens
tccgcaaatcagtcggttgaaattc

SEQ ID NO: 16633 - DNA, 25 bp, Homo sapiens
gtcggttgaaattcagaggagtcag

SEQ ID NO: 16634 - DNA, 25 bp, Homo sapiens
agtcagaatgactcgacctgtcctt

SEQ ID NO: 16635 - DNA, 25 bp, Homo sapiens
tcgacctgtccttcaatgttgataa

SEQ ID NO: 16636 - DNA, 25 bp, Homo sapiens
gacctgtccttcaatgttgataata

SEQ ID NO: 16637 - DNA, 25 bp, Homo sapiens
gcactccgtaactcaacatggcatg

SEQ ID NO: 16638 - DNA, 25 bp, Homo sapiens
gcctttctctccgtaaactatttag

SEQ ID NO: 16639 - DNA, 25 bp, Homo sapiens
ttttcagtatctctgtacctgttaa

SEQ ID NO: 16640 - DNA, 25 bp, Homo sapiens
gagaatattggctgctgattgttgc

SEQ ID NO: 16641 - DNA, 25 bp, Homo sapiens
ttgttgccatcacgttcctacaaaa

SEQ ID NO: 16642 - DNA, 25 bp, Homo sapiens
tgggatgttctggcagctgtgtcat

SEQ ID NO: 16643 - DNA, 25 bp, Homo sapiens
atgctgctgggttcattcattcatt

SEQ ID NO: 16644 - DNA, 25 bp, Homo sapiens
gtttagggatctttctgatggtctt

SEQ ID NO: 16645 - DNA, 25 bp, Homo sapiens
cttagttctaagtcattgttcccat

SEQ ID NO: 16646 - DNA, 25 bp, Homo sapiens
aatagtgaacttgattcccctgctt

SEQ ID NO: 16647 - DNA, 25 bp, Homo sapiens
ctgcttccactaaatccagttgtga

SEQ ID NO: 16648 - DNA, 25 bp, Homo sapiens
cccagcacatccagagttccgagtg

SEQ ID NO: 16649 - DNA, 25 bp, Homo sapiens
accctgcgatggagcttcagcaatg

SEQ ID NO: 16650 - DNA, 25 bp, Homo sapiens
cagcaatggtacctcatggcggaaa

SEQ ID NO: 16651 - DNA, 25 bp, Homo sapiens
ccagctctacgtcctgtatgagaaa

SEQ ID NO: 16652 - DNA, 25 bp, Homo sapiens
gaaccactacacagagagcatctcc

SEQ ID NO: 16653 - DNA, 25 bp, Homo sapiens
agcatctccgtggccaaaatcagtg

SEQ ID NO: 16654 - DNA, 25 bp, Homo sapiens
tatgggacactctgagctgtgccac

SEQ ID NO: 16655 - DNA, 25 bp, Homo sapiens
cacaggggtattctgccttcaggac

SEQ ID NO: 16656 - DNA, 25 bp, Homo sapiens
ggactgaaagctaggcgtcctctcc

SEQ ID NO: 16657 - DNA, 25 bp, Homo sapiens
gaatactgtctttccatatggctaa

SEQ ID NO: 16658 - DNA, 25 bp, Homo sapiens
cccgggacattgattggtcctgtct

SEQ ID NO: 16659 - DNA, 25 bp, Homo sapiens
gcaagaccgagagcacctgtggaag

SEQ ID NO: 16660 - DNA, 25 bp, Homo sapiens
gaagttgatcgaaggcggtgcccac

SEQ ID NO: 16661 - DNA, 25 bp, Homo sapiens
tctacgtctgtggggatgcacggaa

SEQ ID NO: 16662 - DNA, 25 bp, Homo sapiens
gatgcacggaacatggccagggatg

SEQ ID NO: 16663 - DNA, 25 bp, Homo sapiens
gatgtgcagaacaccttctacgaca

SEQ ID NO: 16664 - DNA, 25 bp, Homo sapiens
tctacgacatcgtggctgagctcgg

SEQ ID NO: 16665 - DNA, 25 bp, Homo sapiens
aaactgatgaccaagggccgctact

SEQ ID NO: 16666 - DNA, 25 bp, Homo sapiens
gctactccctggacgtgtggagcta

SEQ ID NO: 16667 - DNA, 25 bp, Homo sapiens
cttggccttggcatgggcgcaggcc

SEQ ID NO: 16668 - DNA, 25 bp, Homo sapiens
tgggcgcaggcccagtgacaaagac

SEQ ID NO: 16669 - DNA, 25 bp, Homo sapiens
cctcggtggctgcacagaagggctc

SEQ ID NO: 16670 - DNA, 25 bp, Homo sapiens
ggttcggtaccacacgaaggtgcgc

SEQ ID NO: 16671 - DNA, 25 bp, Homo sapiens
tcagggtggccggcattcacaagaa

SEQ ID NO: 16672 - DNA, 25 bp, Homo sapiens
tcacaagaaggtggcccggaccatc

SEQ ID NO: 16673 - DNA, 25 bp, Homo sapiens
gaccatcggcatttctgtggatccg

SEQ ID NO: 16674 - DNA, 25 bp, Homo sapiens
ggaggcggaacaagtccacggagtc

SEQ ID NO: 16675 - DNA, 25 bp, Homo sapiens
gctgaagaactgaaactggccaccc

SEQ ID NO: 16676 - DNA, 25 bp, Homo sapiens
agctgaccggaccggtcatgcccgt

SEQ ID NO: 16677 - DNA, 25 bp, Homo sapiens
tgcccgtccggaacgtctataagaa

SEQ ID NO: 16678 - DNA, 25 bp, Homo sapiens
aatttcaaagccttcgctagtctcc

SEQ ID NO: 16679 - DNA, 25 bp, Homo sapiens
ggctcttcggcatacgggcaaaaag

SEQ ID NO: 16680 - DNA, 25 bp, Homo sapiens
taaagccctcctggggacttggaat

SEQ ID NO: 16681 - DNA, 25 bp, Homo sapiens
cacggccaacagaccgatgggtgct

SEQ ID NO: 16682 - DNA, 25 bp, Homo sapiens
ccctgcggagagtgctggagtgcct

SEQ ID NO: 16683 - DNA, 25 bp, Homo sapiens
ctggcgtcgggcatcgtgatgccag

SEQ ID NO: 16684 - DNA, 25 bp, Homo sapiens
ggttctggcatttatgacccttgtg

SEQ ID NO: 16685 - DNA, 25 bp, Homo sapiens
aagaagccactgatgctattgggca

SEQ ID NO: 16686 - DNA, 25 bp, Homo sapiens
gaagatatcacacagagtgcgcagc

SEQ ID NO: 16687 - DNA, 25 bp, Homo sapiens
gtggactacaccgttcagatcccac

SEQ ID NO: 16688 - DNA, 25 bp, Homo sapiens
ttacgcccatgaaacgcccaatgga

SEQ ID NO: 16689 - DNA, 25 bp, Homo sapiens
tccaggccagagccaacgggctgaa

SEQ ID NO: 16690 - DNA, 25 bp, Homo sapiens
acgggctgaagtcttgtgtcattgt

SEQ ID NO: 16691 - DNA, 25 bp, Homo sapiens
gtcattgtgatccgggtcttgaggg

SEQ ID NO: 16692 - DNA, 25 bp, Homo sapiens
atttcatcatctttgaggctgctcc

SEQ ID NO: 16693 - DNA, 25 bp, Homo sapiens
gctgctccccaagagacacggggca

SEQ ID NO: 16694 - DNA, 25 bp, Homo sapiens
cttcctcagacggaggctgggcgtg

SEQ ID NO: 16695 - DNA, 25 bp, Homo sapiens
gtcccccaagagggtgcttcgaggg

SEQ ID NO: 16696 - DNA, 25 bp, Homo sapiens
gcttcgagggtgaggacttctctgg

SEQ ID NO: 16697 - DNA, 25 bp, Homo sapiens
gcctggagacctagctccatgttcc

SEQ ID NO: 16698 - DNA, 25 bp, Homo sapiens
cggctacctatttggcagtgacgtg

SEQ ID NO: 16699 - DNA, 25 bp, Homo sapiens
tggcccagttcaacgcagccaatga

SEQ ID NO: 16700 - DNA, 25 bp, Homo sapiens
ccgtgcccaccaactggtgatggaa

SEQ ID NO: 16701 - DNA, 25 bp, Homo sapiens
cggtgctcactgtgtggtcggcacc

SEQ ID NO: 16702 - DNA, 25 bp, Homo sapiens
actactgctaccgctgtgggaatgt

SEQ ID NO: 16703 - DNA, 25 bp, Homo sapiens
tgcctgtatttgagactggagctgc

SEQ ID NO: 16704 - DNA, 25 bp, Homo sapiens
ggagctgcctgtatgaggactggat

SEQ ID NO: 16705 - DNA, 25 bp, Homo sapiens
actggatcaactgctagtcacgtta

SEQ ID NO: 16706 - DNA, 25 bp, Homo sapiens
agtcacgttatatccaaatctgcat

SEQ ID NO: 16707 - DNA, 25 bp, Homo sapiens
gcattatcattgggcacattttcac

SEQ ID NO: 16708 - DNA, 25 bp, Homo sapiens
ttaccttccatcaactctgctaaga

SEQ ID NO: 16709 - DNA, 25 bp, Homo sapiens
gtttttcagccagtgctaacacagt

SEQ ID NO: 16710 - DNA, 25 bp, Homo sapiens
gcgtttattcacttcattatgttca

SEQ ID NO: 16711 - DNA, 25 bp, Homo sapiens
accagtttcaccatttgggagctgt

SEQ ID NO: 16712 - DNA, 25 bp, Homo sapiens
tgtgtcccaggactgcaaatcttta

SEQ ID NO: 16713 - DNA, 25 bp, Homo sapiens
tgtctttttataatctcttccttta

SEQ ID NO: 16714 - DNA, 25 bp, Homo sapiens
gtgagcaagcagctcggttctgtgc

SEQ ID NO: 16715 - DNA, 25 bp, Homo sapiens
tctgtgcagagataaagtcccccaa

SEQ ID NO: 16716 - DNA, 25 bp, Homo sapiens
gcaaccgcacagccagaatcataga

SEQ ID NO: 16717 - DNA, 25 bp, Homo sapiens
agacaaaccccggatcatcgaggtc

SEQ ID NO: 16718 - DNA, 25 bp, Homo sapiens
tagatctatttcccttatcacttca

SEQ ID NO: 16719 - DNA, 25 bp, Homo sapiens
gtgtctacacatcggggtgacctta

SEQ ID NO: 16720 - DNA, 25 bp, Homo sapiens
tgacatcacgggcttcgggattttg

SEQ ID NO: 16721 - DNA, 25 bp, Homo sapiens
ggattttgggccatgcgcagaacct

SEQ ID NO: 16722 - DNA, 25 bp, Homo sapiens
gtcgtttgtaattcacaacctcccg

SEQ ID NO: 16723 - DNA, 25 bp, Homo sapiens
gatggctgcggtgagcaaggcctgc

SEQ ID NO: 16724 - DNA, 25 bp, Homo sapiens
gcctgcggaaacatgttcggcctca

SEQ ID NO: 16725 - DNA, 25 bp, Homo sapiens
gtttggatggtggaaggtctcattt

SEQ ID NO: 16726 - DNA, 25 bp, Homo sapiens
ggaaatagaacctctaggcaccctc

SEQ ID NO: 16727 - DNA, 25 bp, Homo sapiens
gtggctgcagtagcatagaggcgcc

SEQ ID NO: 16728 - DNA, 25 bp, Homo sapiens
tagaggcgcctagaaattccacttg

SEQ ID NO: 16729 - DNA, 25 bp, Homo sapiens
ccacttgcaccgtagggcatgctga

SEQ ID NO: 16730 - DNA, 25 bp, Homo sapiens
ggcatgctgataccatcccaatagc

SEQ ID NO: 16731 - DNA, 25 bp, Homo sapiens
tcccaatagctgttgcccattgacc

SEQ ID NO: 16732 - DNA, 25 bp, Homo sapiens
tgcccattgacctctagtggtgagt

SEQ ID NO: 16733 - DNA, 25 bp, Homo sapiens
gtgagtttctagaatactggtccat

SEQ ID NO: 16734 - DNA, 25 bp, Homo sapiens
agtattctcacttctgggttatcag

SEQ ID NO: 16735 - DNA, 25 bp, Homo sapiens
gtagtgtcagaggatactgtggctt

SEQ ID NO: 16736 - DNA, 25 bp, Homo sapiens
tctggctagatgcctatcttcacca

SEQ ID NO: 16737 - DNA, 25 bp, Homo sapiens
tcttcaccaataacaacagccaccc

SEQ ID NO: 16738 - DNA, 25 bp, Homo sapiens
ccaccctgcccagtctggaagaaga

SEQ ID NO: 16739 - DNA, 25 bp, Homo sapiens
gagggacaatgccactatagtttaa

SEQ ID NO: 16740 - DNA, 25 bp, Homo sapiens
tggggacataaagcctctgactcaa

SEQ ID NO: 16741 - DNA, 25 bp, Homo sapiens
cttttatcttctagccacagttcta

SEQ ID NO: 16742 - DNA, 25 bp, Homo sapiens
ctagccacagttctaagacccaaag

SEQ ID NO: 16743 - DNA, 25 bp, Homo sapiens
tcctttttctagtttggcacatgca

SEQ ID NO: 16744 - DNA, 25 bp, Homo sapiens
ggcacatgcaggtagttggtgaaca

SEQ ID NO: 16745 - DNA, 25 bp, Homo sapiens
gaggagggacctactgaacccagag

SEQ ID NO: 16746 - DNA, 25 bp, Homo sapiens
aacactaaaattccactcatgccgg

SEQ ID NO: 16747 - DNA, 25 bp, Homo sapiens
ggcttcctcactccaaaataggtgc

SEQ ID NO: 16748 - DNA, 25 bp, Homo sapiens
aataggtgctgatccttcctattcc

SEQ ID NO: 16749 - DNA, 25 bp, Homo sapiens
gccaccttttgggtgtggtgtcacc

SEQ ID NO: 16750 - DNA, 25 bp, Homo sapiens
ggcataggctgcccaatctgagcaa

SEQ ID NO: 16751 - DNA, 25 bp, Homo sapiens
tcaaagcacctgaaccactgtggcc

SEQ ID NO: 16752 - DNA, 25 bp, Homo sapiens
agcagtgtggtctcttacatggcca

SEQ ID NO: 16753 - DNA, 25 bp, Homo sapiens
ggaaaagctgcctctggtcaagtag

SEQ ID NO: 16754 - DNA, 25 bp, Homo sapiens
aactccaacttctatgtttatcttt

SEQ ID NO: 16755 - DNA, 25 bp, Homo sapiens
tcacttttttacaacctggccagag

SEQ ID NO: 16756 - DNA, 25 bp, Homo sapiens
atcagtattctttttgtgtgtgcca

SEQ ID NO: 16757 - DNA, 25 bp, Homo sapiens
gtgccaattttgttatcacatccct

SEQ ID NO: 16758 - DNA, 25 bp, Homo sapiens
ggaagtggtggtgcatggacgactg

SEQ ID NO: 16759 - DNA, 25 bp, Homo sapiens
tggacgactgaccacaatcaactgt

SEQ ID NO: 16760 - DNA, 25 bp, Homo sapiens
gataaactgaaactcacctgctttg

SEQ ID NO: 16761 - DNA, 25 bp, Homo sapiens
ctcacctgctttgaattggcaccga

SEQ ID NO: 16762 - DNA, 25 bp, Homo sapiens
ttcatagtcacatcaaggtcatcaa

SEQ ID NO: 16763 - DNA, 25 bp, Homo sapiens
gacatactcaatcctgattccaagt

SEQ ID NO: 16764 - DNA, 25 bp, Homo sapiens
gaaacttcaccagactttttcttct

SEQ ID NO: 16765 - DNA, 25 bp, Homo sapiens
tacaacactatacatacacaccacc

SEQ ID NO: 16766 - DNA, 25 bp, Homo sapiens
tacacaccaccatatatactagctg

SEQ ID NO: 16767 - DNA, 25 bp, Homo sapiens
gaatggggtattgggagtgcttttt

SEQ ID NO: 16768 - DNA, 25 bp, Homo sapiens
ggcatattttgcatctacaacttct

SEQ ID NO: 16769 - DNA, 25 bp, Homo sapiens
tttggagacccccttgtgcaaaaat

SEQ ID NO: 16770 - DNA, 25 bp, Homo sapiens
gcttccctcggactgtgaggcaggc

SEQ ID NO: 16771 - DNA, 25 bp, Homo sapiens
ggcagaaatgctcgatgacctcatg

SEQ ID NO: 16772 - DNA, 25 bp, Homo sapiens
gattgaattcagcatcccagactct

SEQ ID NO: 16773 - DNA, 25 bp, Homo sapiens
agactctctgctgatccgaagaatc

SEQ ID NO: 16774 - DNA, 25 bp, Homo sapiens
tcacaggaaggctgattcaccccaa

SEQ ID NO: 16775 - DNA, 25 bp, Homo sapiens
taccacgaggagttcaaccctccaa

SEQ ID NO: 16776 - DNA, 25 bp, Homo sapiens
aaagatgacatcaccggggaaccct

SEQ ID NO: 16777 - DNA, 25 bp, Homo sapiens
gaacccttgatccgtcgatcagatg

SEQ ID NO: 16778 - DNA, 25 bp, Homo sapiens
aaaccaccccactcatagagtacta

SEQ ID NO: 16779 - DNA, 25 bp, Homo sapiens
cgatgtcgtgttcgcaagcatccta

SEQ ID NO: 16780 - DNA, 25 bp, Homo sapiens
aatgggatgggtttcttcacctcat

SEQ ID NO: 16781 - DNA, 25 bp, Homo sapiens
aatgctgaccagaacgctcttgagc

SEQ ID NO: 16782 - DNA, 25 bp, Homo sapiens
tgagcccaggcatcgttgagcatta

SEQ ID NO: 16783 - DNA, 25 bp, Homo sapiens
gtctcatctcagcaatgctgccacc

SEQ ID NO: 16784 - DNA, 25 bp, Homo sapiens
gtttactccattctttgtgacacga

SEQ ID NO: 16785 - DNA, 25 bp, Homo sapiens
cacgagtcaagtggctcacaacctc

SEQ ID NO: 16786 - DNA, 25 bp, Homo sapiens
ggactcactcactggttgctgtgat

SEQ ID NO: 16787 - DNA, 25 bp, Homo sapiens
tgtgatgatatccagtgtccctctg

SEQ ID NO: 16788 - DNA, 25 bp, Homo sapiens
atccccaaccacatttgactgtagc

SEQ ID NO: 16789 - DNA, 25 bp, Homo sapiens
gactgtagcattgcatctgtgtcct

SEQ ID NO: 16790 - DNA, 25 bp, Homo sapiens
atctgtgtcctgttgtcatttatgt

SEQ ID NO: 16791 - DNA, 25 bp, Homo sapiens
ttcaggggccgcatgtccatgaagg

SEQ ID NO: 16792 - DNA, 25 bp, Homo sapiens
gaaaacggctgtctgtgacatccca

SEQ ID NO: 16793 - DNA, 25 bp, Homo sapiens
ccaccttcattggcaacagcacggc

SEQ ID NO: 16794 - DNA, 25 bp, Homo sapiens
acagcacggccatccaggagctgtt

SEQ ID NO: 16795 - DNA, 25 bp, Homo sapiens
caggagctgttcaagcgcatctccg

SEQ ID NO: 16796 - DNA, 25 bp, Homo sapiens
tgcactggtacacgggcgagggcat

SEQ ID NO: 16797 - DNA, 25 bp, Homo sapiens
acgagatggagttcaccgaggccga

SEQ ID NO: 16798 - DNA, 25 bp, Homo sapiens
gtaccagcagtaccaggatgccaca

SEQ ID NO: 16799 - DNA, 25 bp, Homo sapiens
gaggaggaggtggcctagagccttc

SEQ ID NO: 16800 - DNA, 25 bp, Homo sapiens
tgtgaactctttattcactcccagc

SEQ ID NO: 16801 - DNA, 25 bp, Homo sapiens
atccatgctgtacagacaccaccat

SEQ ID NO: 16802 - DNA, 25 bp, Homo sapiens
tcggacccaaaggcgtgaacatcgg

SEQ ID NO: 16803 - DNA, 25 bp, Homo sapiens
ggctcctacatctacgagaagcccc

SEQ ID NO: 16804 - DNA, 25 bp, Homo sapiens
gcccgcgctgcagcaagaaggtgta

SEQ ID NO: 16805 - DNA, 25 bp, Homo sapiens
aaggtgacgtctctgggcaaggatt

SEQ ID NO: 16806 - DNA, 25 bp, Homo sapiens
ctgggcaaggattggcaccggccct

SEQ ID NO: 16807 - DNA, 25 bp, Homo sapiens
gagcgctgcgggaagacactgaccc

SEQ ID NO: 16808 - DNA, 25 bp, Homo sapiens
atcctcttcggacccaagggagtga

SEQ ID NO: 16809 - DNA, 25 bp, Homo sapiens
tgcggtgggcagctacatctatgac

SEQ ID NO: 16810 - DNA, 25 bp, Homo sapiens
atctatgaccgggaccccgaaggca

SEQ ID NO: 16811 - DNA, 25 bp, Homo sapiens
tacagcggctctcatgatgtgggct

SEQ ID NO: 16812 - DNA, 25 bp, Homo sapiens
gctctgctgggagagtgctagccgc

SEQ ID NO: 16813 - DNA, 25 bp, Homo sapiens
tgctccgtctcagaggtgggatgca

SEQ ID NO: 16814 - DNA, 25 bp, Homo sapiens
aatcttcgtgaagacactcactggc

SEQ ID NO: 16815 - DNA, 25 bp, Homo sapiens
gaagacactcactggcaagaccatc

SEQ ID NO: 16816 - DNA, 25 bp, Homo sapiens
gcattcctcctgaccagcagaggtt

SEQ ID NO: 16817 - DNA, 25 bp, Homo sapiens
ccagcagaggttgatctttgccgga

SEQ ID NO: 16818 - DNA, 25 bp, Homo sapiens
tgatctttgccggaaagcagctgga

SEQ ID NO: 16819 - DNA, 25 bp, Homo sapiens
gtgctccgtctcagaggtgggatgc

SEQ ID NO: 16820 - DNA, 25 bp, Homo sapiens
caccatcgagaatgtcaaggcaaag

SEQ ID NO: 16821 - DNA, 25 bp, Homo sapiens
ataaggaaggcatccctcctgatca

SEQ ID NO: 16822 - DNA, 25 bp, Homo sapiens
cagctggaagatggacgcaccctgt

SEQ ID NO: 16823 - DNA, 25 bp, Homo sapiens
ttaaggtttcaacaaatttcattgc

SEQ ID NO: 16824 - DNA, 25 bp, Homo sapiens
ttaaccatacctccttgaactactt

SEQ ID NO: 16825 - DNA, 25 bp, Homo sapiens
gatactgcggctgaaaagcactagt

SEQ ID NO: 16826 - DNA, 25 bp, Homo sapiens
tgaccaaaaccctccaactttgaag

SEQ ID NO: 16827 - DNA, 25 bp, Homo sapiens
aaacctttccattattgcattacat

SEQ ID NO: 16828 - DNA, 25 bp, Homo sapiens
acatgttgtggaatctctcgagtgc

SEQ ID NO: 16829 - DNA, 25 bp, Homo sapiens
gaatctctcgagtgcaaagactgtc

SEQ ID NO: 16830 - DNA, 25 bp, Homo sapiens
ggctatttctactgatgaactgctt

SEQ ID NO: 16831 - DNA, 25 bp, Homo sapiens
gaactgcttcaggtgggggagggaa

SEQ ID NO: 16832 - DNA, 25 bp, Homo sapiens
atttgcctgatttaagtgtctgaga

SEQ ID NO: 16833 - DNA, 25 bp, Homo sapiens
taggctgcaatggaacaactttacc

SEQ ID NO: 16834 - DNA, 25 bp, Homo sapiens
acatgctcagcaaactgcaccagtt

SEQ ID NO: 16835 - DNA, 25 bp, Homo sapiens
tctacattctcatctactcattgtc

SEQ ID NO: 16836 - DNA, 25 bp, Homo sapiens
acattctcatctactcattgtctca

SEQ ID NO: 16837 - DNA, 25 bp, Homo sapiens
ctcattgtctcagtgctggtggagt

SEQ ID NO: 16838 - DNA, 25 bp, Homo sapiens
gtctcagtgctggtggagttgacat

SEQ ID NO: 16839 - DNA, 25 bp, Homo sapiens
agtgctggtggagttgacatttgac

SEQ ID NO: 16840 - DNA, 25 bp, Homo sapiens
ccgtcccttggaaagttcagccaga

SEQ ID NO: 16841 - DNA, 25 bp, Homo sapiens
gaaagttcagccagaatcttcgtcc

SEQ ID NO: 16842 - DNA, 25 bp, Homo sapiens
aagttcagccagaatcttcgtcctg

SEQ ID NO: 16843 - DNA, 25 bp, Homo sapiens
tagcccacttgtcatccataaagca

SEQ ID NO: 16844 - DNA, 25 bp, Homo sapiens
agcccacttgtcatccataaagcaa

SEQ ID NO: 16845 - DNA, 25 bp, Homo sapiens
gtcatccataaagcaagctcaacct

SEQ ID NO: 16846 - DNA, 25 bp, Homo sapiens
gagcttccccaactcataaatgcca

SEQ ID NO: 16847 - DNA, 25 bp, Homo sapiens
atgccaattttccagtggatcccca

SEQ ID NO: 16848 - DNA, 25 bp, Homo sapiens
aggatgtctatttttggccactcca

SEQ ID NO: 16849 - DNA, 25 bp, Homo sapiens
gaggtcatggagctctgatctgtgc

SEQ ID NO: 16850 - DNA, 25 bp, Homo sapiens
ctgtactctgtccctggggcaaaaa

SEQ ID NO: 16851 - DNA, 25 bp, Homo sapiens
gaaggcttatgatgctacccacctt

SEQ ID NO: 16852 - DNA, 25 bp, Homo sapiens
gctacccaccttgtgaaatcctatc

SEQ ID NO: 16853 - DNA, 25 bp, Homo sapiens
aggatctcagctggacatactaatt

SEQ ID NO: 16854 - DNA, 25 bp, Homo sapiens
gatgaccagtttcttttagatggac

SEQ ID NO: 16855 - DNA, 25 bp, Homo sapiens
ggacagttactccctgataacttca

SEQ ID NO: 16856 - DNA, 25 bp, Homo sapiens
gataacttcatagctgcctgtacag

SEQ ID NO: 16857 - DNA, 25 bp, Homo sapiens
ggactgcacagttcatggaggctgc

SEQ ID NO: 16858 - DNA, 25 bp, Homo sapiens
atgaggccttggatgctctggatgc

SEQ ID NO: 16859 - DNA, 25 bp, Homo sapiens
tggagatccctggtccagaattcca

SEQ ID NO: 16860 - DNA, 25 bp, Homo sapiens
ttccatttaccttctgggccagata

SEQ ID NO: 16861 - DNA, 25 bp, Homo sapiens
ggtcccattattggtcctggtggta

SEQ ID NO: 16862 - DNA, 25 bp, Homo sapiens
ccaacttcgctgccaactttggtgc

SEQ ID NO: 16863 - DNA, 25 bp, Homo sapiens
gtgccattggtttcttctgggttga

SEQ ID NO: 16864 - DNA, 25 bp, Homo sapiens
tcccctgtgtgagctgaagcctcag

SEQ ID NO: 16865 - DNA, 25 bp, Homo sapiens
ctatctagagagccacatcctgttg

SEQ ID NO: 16866 - DNA, 25 bp, Homo sapiens
atttatttgctgttccttgtctact

SEQ ID NO: 16867 - DNA, 25 bp, Homo sapiens
tttttccccttgtgtgctgtcaagt

SEQ ID NO: 16868 - DNA, 25 bp, Homo sapiens
gttgaactcatgtttcagttcgcga

SEQ ID NO: 16869 - DNA, 25 bp, Homo sapiens
cagttcgcgaacattgactccttac

SEQ ID NO: 16870 - DNA, 25 bp, Homo sapiens
gactccttacgaaagtcacttcatt

SEQ ID NO: 16871 - DNA, 25 bp, Homo sapiens
tcattctaactagatgcgcccactt

SEQ ID NO: 16872 - DNA, 25 bp, Homo sapiens
tttccttccctttcacatgaggatc

SEQ ID NO: 16873 - DNA, 25 bp, Homo sapiens
atgaggatctgccgttcatgttgct

SEQ ID NO: 16874 - DNA, 25 bp, Homo sapiens
gccagcaattttaatctagcagtgt

SEQ ID NO: 16875 - DNA, 25 bp, Homo sapiens
ggaattttttggcgcaatccatgta

SEQ ID NO: 16876 - DNA, 25 bp, Homo sapiens
gcaatccatgtagcagtgacccagg

SEQ ID NO: 16877 - DNA, 25 bp, Homo sapiens
tgacccaggcttgggagccagaaac

SEQ ID NO: 16878 - DNA, 25 bp, Homo sapiens
ttctgtggacaatgtaaccctaaac

SEQ ID NO: 16879 - DNA, 25 bp, Homo sapiens
agaacatgatggctgcctgtgaccc

SEQ ID NO: 16880 - DNA, 25 bp, Homo sapiens
ctgtcttccgtggtcggatgtccat

SEQ ID NO: 16881 - DNA, 25 bp, Homo sapiens
tcaagacagccgtctgtgacatccc

SEQ ID NO: 16882 - DNA, 25 bp, Homo sapiens
ccacctcgtggcctcaagatggcag

SEQ ID NO: 16883 - DNA, 25 bp, Homo sapiens
ggcagtcaccttcattggcaatagc

SEQ ID NO: 16884 - DNA, 25 bp, Homo sapiens
gcaatagcacagccatccaggagct

SEQ ID NO: 16885 - DNA, 25 bp, Homo sapiens
caagcgcatctcggagcagttcact

SEQ ID NO: 16886 - DNA, 25 bp, Homo sapiens
ggagttcaccgaggctgagagcaac

SEQ ID NO: 16887 - DNA, 25 bp, Homo sapiens
tgaacgacctcgtctctgagtatca

SEQ ID NO: 16888 - DNA, 25 bp, Homo sapiens
agaggaggcctaaggcagagccccc

SEQ ID NO: 16889 - DNA, 25 bp, Homo sapiens
ttcctctccctcagaatttgtgttt

SEQ ID NO: 16890 - DNA, 25 bp, Homo sapiens
gggggaagatttcgtgaagaccctg

SEQ ID NO: 16891 - DNA, 25 bp, Homo sapiens
cgtgaagaccctgaagtgagccgct

SEQ ID NO: 16892 - DNA, 25 bp, Homo sapiens
aggcatcatgtcactgcaaagccgt

SEQ ID NO: 16893 - DNA, 25 bp, Homo sapiens
catcatgtcactgcaaagccgttgc

SEQ ID NO: 16894 - DNA, 25 bp, Homo sapiens
gtcactgcaaagccgttgcagataa

SEQ ID NO: 16895 - DNA, 25 bp, Homo sapiens
ggtcaaggctaaagccggagcaggc

SEQ ID NO: 16896 - DNA, 25 bp, Homo sapiens
gtggaatgttccttcgttaagtcac

SEQ ID NO: 16897 - DNA, 25 bp, Homo sapiens
gaatgttccttcgttaagtcacagg

SEQ ID NO: 16898 - DNA, 25 bp, Homo sapiens
gtcacaggaaacggaatgtacctac

SEQ ID NO: 16899 - DNA, 25 bp, Homo sapiens
aagaacctgggcatcggcaaagtct

SEQ ID NO: 16900 - DNA, 25 bp, Homo sapiens
tcggcaaagtctcctcttttgagga

SEQ ID NO: 16901 - DNA, 25 bp, Homo sapiens
tctggctaggctctcatgtccagac

SEQ ID NO: 16902 - DNA, 25 bp, Homo sapiens
tccttcctcctctgtttagcaaagg

SEQ ID NO: 16903 - DNA, 25 bp, Homo sapiens
gcagctcacttggatgtccttacaa

SEQ ID NO: 16904 - DNA, 25 bp, Homo sapiens
ccctggccccaggttgagcaataag

SEQ ID NO: 16905 - DNA, 25 bp, Homo sapiens
gcctggggccattgagccccagcct

SEQ ID NO: 16906 - DNA, 25 bp, Homo sapiens
gcgtttgcaagccagtggccactgt

SEQ ID NO: 16907 - DNA, 25 bp, Homo sapiens
ggtggagcaccaggtaccacacagc

SEQ ID NO: 16908 - DNA, 25 bp, Homo sapiens
gctcggagtctgcaggaactggcct

SEQ ID NO: 16909 - DNA, 25 bp, Homo sapiens
gtgaggatggatgcgggcgctgtcc

SEQ ID NO: 16910 - DNA, 25 bp, Homo sapiens
aagttgcagtggcttgttcacacct

SEQ ID NO: 16911 - DNA, 25 bp, Homo sapiens
gaagtgaagactttctccttgcatt

SEQ ID NO: 16912 - DNA, 25 bp, Homo sapiens
aaggaattgtagcaggccccatgaa

SEQ ID NO: 16913 - DNA, 25 bp, Homo sapiens
gaggcattgatcatgggcccagaag

SEQ ID NO: 16914 - DNA, 25 bp, Homo sapiens
catcccaacatctaccctgatggga

SEQ ID NO: 16915 - DNA, 25 bp, Homo sapiens
agcggtggagtcctgtgcagagtgt

SEQ ID NO: 16916 - DNA, 25 bp, Homo sapiens
aagatcctgctgtcggtggtgagca

SEQ ID NO: 16917 - DNA, 25 bp, Homo sapiens
catgctggcagagcccaatgacgaa

SEQ ID NO: 16918 - DNA, 25 bp, Homo sapiens
gtggagctaacgtggatgcgtccaa

SEQ ID NO: 16919 - DNA, 25 bp, Homo sapiens
aaatgtggcgcgatgaccgggagca

SEQ ID NO: 16920 - DNA, 25 bp, Homo sapiens
attgccaagcagatcgtccagaagt

SEQ ID NO: 16921 - DNA, 25 bp, Homo sapiens
cccccggcacacttagtgacagtga

SEQ ID NO: 16922 - DNA, 25 bp, Homo sapiens
gacagtgatgctctgtgctggtacc

SEQ ID NO: 16923 - DNA, 25 bp, Homo sapiens
agcaaatatcaggcctgtcgcacac

SEQ ID NO: 16924 - DNA, 25 bp, Homo sapiens
tgtcgcacacgggcggcatttaaat

SEQ ID NO: 16925 - DNA, 25 bp, Homo sapiens
taagggatggtctatgaggcataca

SEQ ID NO: 16926 - DNA, 25 bp, Homo sapiens
agatttgatgtgatccttttctccc

SEQ ID NO: 16927 - DNA, 25 bp, Homo sapiens
ccctcccttccataatggatcgtgg

SEQ ID NO: 16928 - DNA, 25 bp, Homo sapiens
gatcgtggtctgtgtgactgaaccc

SEQ ID NO: 16929 - DNA, 25 bp, Homo sapiens
gactgaacccacacagagtgtcatg

SEQ ID NO: 16930 - DNA, 25 bp, Homo sapiens
gtcatgggtgacagtttctggttga

SEQ ID NO: 16931 - DNA, 25 bp, Homo sapiens
gtttctggttgaagtagctccacgc

SEQ ID NO: 16932 - DNA, 25 bp, Homo sapiens
ggacagcagattcttttccttctca

SEQ ID NO: 16933 - DNA, 25 bp, Homo sapiens
tttccttctcacaaggggctcattt

SEQ ID NO: 16934 - DNA, 25 bp, Homo sapiens
gaaggctggattctatctacataag

SEQ ID NO: 16935 - DNA, 25 bp, Homo sapiens
cataagtcctttcaattccaccagg

SEQ ID NO: 16936 - DNA, 25 bp, Homo sapiens
caccactgtgcacttagccatgatg

SEQ ID NO: 16937 - DNA, 25 bp, Homo sapiens
gcccttaactatcaccagtgcatca

SEQ ID NO: 16938 - DNA, 25 bp, Homo sapiens
cagtgcatcacatctgcacactctc

SEQ ID NO: 16939 - DNA, 25 bp, Homo sapiens
gcaggaacttctagctcatttaaca

SEQ ID NO: 16940 - DNA, 25 bp, Homo sapiens
gctagacaatgatttggccaggcct

SEQ ID NO: 16941 - DNA, 25 bp, Homo sapiens
ggcctagtaaccaaggccctgtctc

SEQ ID NO: 16942 - DNA, 25 bp, Homo sapiens
accacgaggctgattcctctcattt

SEQ ID NO: 16943 - DNA, 25 bp, Homo sapiens
tctcagtttctgcctgggcaatggc

SEQ ID NO: 16944 - DNA, 25 bp, Homo sapiens
gcatctgtctgctctgcatatatgt

SEQ ID NO: 16945 - DNA, 25 bp, Homo sapiens
gagattggtcttttgggctattgta

SEQ ID NO: 16946 - DNA, 25 bp, Homo sapiens
tgagatggagtcttgctctctcacc

SEQ ID NO: 16947 - DNA, 25 bp, Homo sapiens
gcagtagtgcaatcttggcccactg

SEQ ID NO: 16948 - DNA, 25 bp, Homo sapiens
tcctgggctcgagtgattctctgcc

SEQ ID NO: 16949 - DNA, 25 bp, Homo sapiens
tgggactacaggcatgtgccaccgc

SEQ ID NO: 16950 - DNA, 25 bp, Homo sapiens
atgtgccaccgcactggctaatttt

SEQ ID NO: 16951 - DNA, 25 bp, Homo sapiens
gatggggttttgctatgttggccag

SEQ ID NO: 16952 - DNA, 25 bp, Homo sapiens
ctggtcttgaattcctgacctcagg

SEQ ID NO: 16953 - DNA, 25 bp, Homo sapiens
caccatgcccagcctggttattgta

SEQ ID NO: 16954 - DNA, 25 bp, Homo sapiens
gatattgggattttgctagctctct

SEQ ID NO: 16955 - DNA, 25 bp, Homo sapiens
aactgtatatctttttctgtgcatt

SEQ ID NO: 16956 - DNA, 25 bp, Homo sapiens
ggggcagagtccatgcaacttcaac

SEQ ID NO: 16957 - DNA, 25 bp, Homo sapiens
caccagaaaatgatcctaactactt

SEQ ID NO: 16958 - DNA, 25 bp, Homo sapiens
tgaaccaacattttatacatctgat

SEQ ID NO: 16959 - DNA, 25 bp, Homo sapiens
catctgatggtgttcctttcactgc

SEQ ID NO: 16960 - DNA, 25 bp, Homo sapiens
ttcctttcactgcagctgatccaga

SEQ ID NO: 16961 - DNA, 25 bp, Homo sapiens
gagaggacttttttccagattatga

SEQ ID NO: 16962 - DNA, 25 bp, Homo sapiens
ggaacagatttatccggggctggtg

SEQ ID NO: 16963 - DNA, 25 bp, Homo sapiens
cggggctggtgatccatacttggat

SEQ ID NO: 16964 - DNA, 25 bp, Homo sapiens
aaatgtgtcacatctataccaaatt

SEQ ID NO: 16965 - DNA, 25 bp, Homo sapiens
ttgtttaacactatctgccaaaata

SEQ ID NO: 16966 - DNA, 25 bp, Homo sapiens
gttaattctactgttttggctgcaa

SEQ ID NO: 16967 - DNA, 25 bp, Homo sapiens
atctcacttgttttagttctgatcc

SEQ ID NO: 16968 - DNA, 25 bp, Homo sapiens
agatcacccctctaattatttctga

SEQ ID NO: 16969 - DNA, 25 bp, Homo sapiens
tggaaaaggattctctgcctcgctt

SEQ ID NO: 16970 - DNA, 25 bp, Homo sapiens
ctcgctttgtgcgctctgagtttta

SEQ ID NO: 16971 - DNA, 25 bp, Homo sapiens
tcatcctgtgagttatttcctccat

SEQ ID NO: 16972 - DNA, 25 bp, Homo sapiens
tatttcctccataataaccctgcat

SEQ ID NO: 16973 - DNA, 25 bp, Homo sapiens
cctgcatttcccattaatctacata

SEQ ID NO: 16974 - DNA, 25 bp, Homo sapiens
ttcccacagcagctttgctcagtga

SEQ ID NO: 16975 - DNA, 25 bp, Homo sapiens
gggatgttgcttactctttttgccc

SEQ ID NO: 16976 - DNA, 25 bp, Homo sapiens
ctttttgcccacactgctttggata

SEQ ID NO: 16977 - DNA, 25 bp, Homo sapiens
tacttatctactgtccgaaggcctt

SEQ ID NO: 16978 - DNA, 25 bp, Homo sapiens
atttaaaatattgatccttcccttg

SEQ ID NO: 16979 - DNA, 25 bp, Homo sapiens
ggaccaccttcatgttagttgggta

SEQ ID NO: 16980 - DNA, 25 bp, Homo sapiens
ctgcccatagtcaccaaattctgtt

SEQ ID NO: 16981 - DNA, 25 bp, Homo sapiens
atgtatttatgctgctagactgtgg

SEQ ID NO: 16982 - DNA, 25 bp, Homo sapiens
gactgtgggtcaaatgtttccattt

SEQ ID NO: 16983 - DNA, 25 bp, Homo sapiens
aaatgaaactgttgctccattggag

SEQ ID NO: 16984 - DNA, 25 bp, Homo sapiens
tgctccattggagtagtctcccacc

SEQ ID NO: 16985 - DNA, 25 bp, Homo sapiens
gagtagtctcccacctaaatatcaa

SEQ ID NO: 16986 - DNA, 25 bp, Homo sapiens
gctaattgtcctatgatgctattat

SEQ ID NO: 16987 - DNA, 25 bp, Homo sapiens
atgacatttatcttcaaaacaccaa

SEQ ID NO: 16988 - DNA, 25 bp, Homo sapiens
ggtagaggccttctaggtgagacac

SEQ ID NO: 16989 - DNA, 25 bp, Homo sapiens
agacagctgtttagggtcttctccc

SEQ ID NO: 16990 - DNA, 25 bp, Homo sapiens
ggtgcctcacaaacttgattgtgca

SEQ ID NO: 16991 - DNA, 25 bp, Homo sapiens
agctcccaggtaaggcggaggctgc

SEQ ID NO: 16992 - DNA, 25 bp, Homo sapiens
ggtgtgaggaccatgctgtgagcag

SEQ ID NO: 16993 - DNA, 25 bp, Homo sapiens
agcagggcgagagtgcccagggctg

SEQ ID NO: 16994 - DNA, 25 bp, Homo sapiens
atattggaaatatcacccctgaagc

SEQ ID NO: 16995 - DNA, 25 bp, Homo sapiens
accccagggattgcccgtgaagact

SEQ ID NO: 16996 - DNA, 25 bp, Homo sapiens
ggattgcccgtgaagactttggcct

SEQ ID NO: 16997 - DNA, 25 bp, Homo sapiens
gtgttggttatgtgagtgttgtttt

SEQ ID NO: 16998 - DNA, 25 bp, Homo sapiens
tgattgccaatctgcatttcttacc

SEQ ID NO: 16999 - DNA, 25 bp, Homo sapiens
gcatttcttaccagtgtgaccacac

SEQ ID NO: 17000 - DNA, 25 bp, Homo sapiens
ggctgaagatgcaatcaaggccgcc

SEQ ID NO: 17001 - DNA, 25 bp, Homo sapiens
cttcctctccactgaagagctatga

SEQ ID NO: 17002 - DNA, 25 bp, Homo sapiens
gagctatgagatacgcacaatactt

SEQ ID NO: 17003 - DNA, 25 bp, Homo sapiens
acttgctgttcacgttatgactctc

SEQ ID NO: 17004 - DNA, 25 bp, Homo sapiens
tcacgttatgactctcatgcaagca

SEQ ID NO: 17005 - DNA, 25 bp, Homo sapiens
cacagtttcattgttctgaatcctg

SEQ ID NO: 17006 - DNA, 25 bp, Homo sapiens
tgttctgaatcctgtggtttctttc

SEQ ID NO: 17007 - DNA, 25 bp, Homo sapiens
tgcaagttttgatagcccgtgaagt

SEQ ID NO: 17008 - DNA, 25 bp, Homo sapiens
tagcccgtgaagtgcataagtatct

SEQ ID NO: 17009 - DNA, 25 bp, Homo sapiens
gggggaaattaccagtagaatgcct

SEQ ID NO: 17010 - DNA, 25 bp, Homo sapiens
gtagaatgccttggtctgaatattt

SEQ ID NO: 17011 - DNA, 25 bp, Homo sapiens
gagtgatgcacgaactttgaacatt

SEQ ID NO: 17012 - DNA, 25 bp, Homo sapiens
gtcgtctgccagagcagggtctggg

SEQ ID NO: 17013 - DNA, 25 bp, Homo sapiens
gtctgggagggtccatgcagttccc

SEQ ID NO: 17014 - DNA, 25 bp, Homo sapiens
tgcagttcccgctggtgtggaggga

SEQ ID NO: 17015 - DNA, 25 bp, Homo sapiens
tggagggaaatgccctggtctggcc

SEQ ID NO: 17016 - DNA, 25 bp, Homo sapiens
ccctcccctcatttgtaagaatagc

SEQ ID NO: 17017 - DNA, 25 bp, Homo sapiens
ggtaactaggttatgggctctacat

SEQ ID NO: 17018 - DNA, 25 bp, Homo sapiens
ggctctacattgtcagctacttggg

SEQ ID NO: 17019 - DNA, 25 bp, Homo sapiens
tctttagttctttactgtcactgtc

SEQ ID NO: 17020 - DNA, 25 bp, Homo sapiens
actgtcactgtcatgtaatcagcta

SEQ ID NO: 17021 - DNA, 25 bp, Homo sapiens
aagtatgcatgttcctttcatgtgt

SEQ ID NO: 17022 - DNA, 25 bp, Homo sapiens
ccccctgcatgctgtttatgaaagg

SEQ ID NO: 17023 - DNA, 25 bp, Homo sapiens
aaaggaactcctcaagaaccacgct

SEQ ID NO: 17024 - DNA, 25 bp, Homo sapiens
accacgctgtggtttcagcaagcag

SEQ ID NO: 17025 - DNA, 25 bp, Homo sapiens
agcagttttgatatcttctcagatg

SEQ ID NO: 17026 - DNA, 25 bp, Homo sapiens
gaggttcgacagggactcaaagcct

SEQ ID NO: 17027 - DNA, 25 bp, Homo sapiens
caaagcctattccagttggcctacc

SEQ ID NO: 17028 - DNA, 25 bp, Homo sapiens
cctatcctcagctctatgtttctgg

SEQ ID NO: 17029 - DNA, 25 bp, Homo sapiens
gatacaatttgtcccaaagctccca

SEQ ID NO: 17030 - DNA, 25 bp, Homo sapiens
aagcttctgtgatgctctttatgaa

SEQ ID NO: 17031 - DNA, 25 bp, Homo sapiens
ctcaaattggccaacataccctcag

SEQ ID NO: 17032 - DNA, 25 bp, Homo sapiens
aatggtgaattgctgcctatactga

SEQ ID NO: 17033 - DNA, 25 bp, Homo sapiens
taggacctgaggacctcacttggcc

SEQ ID NO: 17034 - DNA, 25 bp, Homo sapiens
ccctgcaaggcccgcttttcaggga

SEQ ID NO: 17035 - DNA, 25 bp, Homo sapiens
ccatctcctccacgttgagtgaagc

SEQ ID NO: 17036 - DNA, 25 bp, Homo sapiens
aagctcatcccaagcaaggagcccc

SEQ ID NO: 17037 - DNA, 25 bp, Homo sapiens
tggctgtaaatacctggctcctgcc

SEQ ID NO: 17038 - DNA, 25 bp, Homo sapiens
gctcctgccagcagctgagctgggt

SEQ ID NO: 17039 - DNA, 25 bp, Homo sapiens
accatccaggtgcaccactgaagtg

SEQ ID NO: 17040 - DNA, 25 bp, Homo sapiens
aggcgcctgctcatgttgaagtgcg

SEQ ID NO: 17041 - DNA, 25 bp, Homo sapiens
aagcagctgcagtgttgctgccacc

SEQ ID NO: 17042 - DNA, 25 bp, Homo sapiens
gcctcttcaaagtctcctgtgacat

SEQ ID NO: 17043 - DNA, 25 bp, Homo sapiens
aaagatacgtgccggggccaggtgt

SEQ ID NO: 17044 - DNA, 25 bp, Homo sapiens
agaaaagacgcgtgcctgcggtgag

SEQ ID NO: 17045 - DNA, 25 bp, Homo sapiens
ggtgaggaagctgggcgctgttttc

SEQ ID NO: 17046 - DNA, 25 bp, Homo sapiens
ggcgctgttttcgagttcaggtgaa

SEQ ID NO: 17047 - DNA, 25 bp, Homo sapiens
tcaggtgaattagcctcaatccccc

SEQ ID NO: 17048 - DNA, 25 bp, Homo sapiens
ctcccatagccctcttgatggatca

SEQ ID NO: 17049 - DNA, 25 bp, Homo sapiens
agatgaggtctacactgtccttcat

SEQ ID NO: 17050 - DNA, 25 bp, Homo sapiens
tattagcaccaaacttctacaaacc

SEQ ID NO: 17051 - DNA, 25 bp, Homo sapiens
cttctacaaaccaagctcagggccc

SEQ ID NO: 17052 - DNA, 25 bp, Homo sapiens
gggatggaaaacgggcctggctaga

SEQ ID NO: 17053 - DNA, 25 bp, Homo sapiens
ggctagagctacgggtgtgtgtgtc

SEQ ID NO: 17054 - DNA, 25 bp, Homo sapiens
tgtgtgtgtctgtctatgtgtatgc

SEQ ID NO: 17055 - DNA, 25 bp, Homo sapiens
aatgccagtacttgtttgctgtgga

SEQ ID NO: 17056 - DNA, 25 bp, Homo sapiens
ctaaagtaagcactaccaccatcca

SEQ ID NO: 17057 - DNA, 25 bp, Homo sapiens
ccacgttttcactcaacacagtgcc

SEQ ID NO: 17058 - DNA, 25 bp, Homo sapiens
acacagtgccttttaattggtgact

SEQ ID NO: 17059 - DNA, 25 bp, Homo sapiens
agaaaccatgtgtacatccctgtgc

SEQ ID NO: 17060 - DNA, 25 bp, Homo sapiens
tccctgtgcctcttagattgctaag

SEQ ID NO: 17061 - DNA, 25 bp, Homo sapiens
agattgctaagttctgctctcattc

SEQ ID NO: 17062 - DNA, 25 bp, Homo sapiens
tctgctctcattcttacttcaaagg

SEQ ID NO: 17063 - DNA, 25 bp, Homo sapiens
attccatcatccagggagaaccact

SEQ ID NO: 17064 - DNA, 25 bp, Homo sapiens
aataccatgactgtcttgctgtgtc

SEQ ID NO: 17065 - DNA, 25 bp, Homo sapiens
atttctacatctcttaatggctgca

SEQ ID NO: 17066 - DNA, 25 bp, Homo sapiens
aaaggccagggttctctatgattat

SEQ ID NO: 17067 - DNA, 25 bp, Homo sapiens
agtactgaattatcacttctggcag

SEQ ID NO: 17068 - DNA, 25 bp, Homo sapiens
gaatcagcagtacacatgcccatca

SEQ ID NO: 17069 - DNA, 25 bp, Homo sapiens
catcaccttcgctgtctgaatgact

SEQ ID NO: 17070 - DNA, 25 bp, Homo sapiens
gatgacttactatgcacagtgttac

SEQ ID NO: 17071 - DNA, 25 bp, Homo sapiens
gttaccagtatatgttggacctcca

SEQ ID NO: 17072 - DNA, 25 bp, Homo sapiens
agttttccatccaattatcttagta

SEQ ID NO: 17073 - DNA, 25 bp, Homo sapiens
aatcagacttctgtgacacctgtac

SEQ ID NO: 17074 - DNA, 25 bp, Homo sapiens
gacacctgtaccatcagttttacca

SEQ ID NO: 17075 - DNA, 25 bp, Homo sapiens
caaatgcgattggttcttctgccat

SEQ ID NO: 17076 - DNA, 25 bp, Homo sapiens
caagtggcctagtaatcacctctcc

SEQ ID NO: 17077 - DNA, 25 bp, Homo sapiens
cctgcaaggttccacgctttgagaa

SEQ ID NO: 17078 - DNA, 25 bp, Homo sapiens
gaagcacctgtacaatgctgctgcc

SEQ ID NO: 17079 - DNA, 25 bp, Homo sapiens
ctgccttcaaagcccggaccaaggc

SEQ ID NO: 17080 - DNA, 25 bp, Homo sapiens
gaccaaggctcgaagccgtgtgcgg

SEQ ID NO: 17081 - DNA, 25 bp, Homo sapiens
gccgtgtgcgggacaagcaggcaga

SEQ ID NO: 17082 - DNA, 25 bp, Homo sapiens
agaggagactttctatgcccttggt

SEQ ID NO: 17083 - DNA, 25 bp, Homo sapiens
tgcccttggtccgtatttttaacag

SEQ ID NO: 17084 - DNA, 25 bp, Homo sapiens
gacagtgcaacaactggtctccacc

SEQ ID NO: 17085 - DNA, 25 bp, Homo sapiens
taaatatgtgccttcctcagggctg

SEQ ID NO: 17086 - DNA, 25 bp, Homo sapiens
cccaggatgacccactcttaggggg

SEQ ID NO: 17087 - DNA, 25 bp, Homo sapiens
ggtggggtggcaaagctacctggaa

SEQ ID NO: 17088 - DNA, 25 bp, Homo sapiens
atcatcagatcgactcttatacgag

SEQ ID NO: 17089 - DNA, 25 bp, Homo sapiens
aaattttagcgtgctcactgacctg

SEQ ID NO: 17090 - DNA, 25 bp, Homo sapiens
agctaggatgtgcattctccagcca

SEQ ID NO: 17091 - DNA, 25 bp, Homo sapiens
agagactgagtcaagttgttcctta

SEQ ID NO: 17092 - DNA, 25 bp, Homo sapiens
agcagactcagctctgacattctga

SEQ ID NO: 17093 - DNA, 25 bp, Homo sapiens
atcggaatcctgtcgattagactgg

SEQ ID NO: 17094 - DNA, 25 bp, Homo sapiens
tagactggacagcttgtggcaagtg

SEQ ID NO: 17095 - DNA, 25 bp, Homo sapiens
gttagcctcaatttctgaacaccat

SEQ ID NO: 17096 - DNA, 25 bp, Homo sapiens
aatgtaaagcttgtctgatcgttca

SEQ ID NO: 17097 - DNA, 25 bp, Homo sapiens
gacagtccgtcaaaacagattgttt

SEQ ID NO: 17098 - DNA, 25 bp, Homo sapiens
gcaaaggggaggcatcagtgtcttg

SEQ ID NO: 17099 - DNA, 25 bp, Homo sapiens
gaaatttgccctatgtctatatccc

SEQ ID NO: 17100 - DNA, 25 bp, Homo sapiens
ctatatcccctctaagacggacctg

SEQ ID NO: 17101 - DNA, 25 bp, Homo sapiens
ccccacctgtgtgataatggtcaag

SEQ ID NO: 17102 - DNA, 25 bp, Homo sapiens
ggtcaagccccatgaggagtaccag

SEQ ID NO: 17103 - DNA, 25 bp, Homo sapiens
gtaccaggaggcttacgatgagtgc

SEQ ID NO: 17104 - DNA, 25 bp, Homo sapiens
acccctatgaggggctccggtagca

SEQ ID NO: 17105 - DNA, 25 bp, Homo sapiens
cacctgccgctggaagctattgggc

SEQ ID NO: 17106 - DNA, 25 bp, Homo sapiens
ctggcagcaggacgactggctgtcc

SEQ ID NO: 17107 - DNA, 25 bp, Homo sapiens
cagctctaacagccctttcatgaag

SEQ ID NO: 17108 - DNA, 25 bp, Homo sapiens
aggtaatgctagtcttctgtccatc

SEQ ID NO: 17109 - DNA, 25 bp, Homo sapiens
gtccatcagtgccatttcctgtaga

SEQ ID NO: 17110 - DNA, 25 bp, Homo sapiens
gcctcaggaactcctccgagtgagg

SEQ ID NO: 17111 - DNA, 25 bp, Homo sapiens
ctcctttcccaggatcaaggccaca

SEQ ID NO: 17112 - DNA, 25 bp, Homo sapiens
gaagattgcacgggcactgttctga

SEQ ID NO: 17113 - DNA, 25 bp, Homo sapiens
actgttctgaggaggaagccccgtt

SEQ ID NO: 17114 - DNA, 25 bp, Homo sapiens
agccccgttggcttacagaagtcat

SEQ ID NO: 17115 - DNA, 25 bp, Homo sapiens
gttggatacctgtgtatagcttccc

SEQ ID NO: 17116 - DNA, 25 bp, Homo sapiens
gattcttggccatatcctaacatgc

SEQ ID NO: 17117 - DNA, 25 bp, Homo sapiens
caaaggcttcaaggctctgagcccc

SEQ ID NO: 17118 - DNA, 25 bp, Homo sapiens
aatgtaggtcctcgcaggagctctt

SEQ ID NO: 17119 - DNA, 25 bp, Homo sapiens
ttcttcccactctgggggtttctat

SEQ ID NO: 17120 - DNA, 25 bp, Homo sapiens
tgggggtttctatcactgtgacaac

SEQ ID NO: 17121 - DNA, 25 bp, Homo sapiens
cccaccccgtggacgagaggctggg

SEQ ID NO: 17122 - DNA, 25 bp, Homo sapiens
tggacgagaggctgggggtccaccc

SEQ ID NO: 17123 - DNA, 25 bp, Homo sapiens
ttcgatgttcccatcttcactgaag

SEQ ID NO: 17124 - DNA, 25 bp, Homo sapiens
ttcactgaagagttcttggaccaaa

SEQ ID NO: 17125 - DNA, 25 bp, Homo sapiens
ggaccaaaacaaagcgcgtgaggcg

SEQ ID NO: 17126 - DNA, 25 bp, Homo sapiens
tcggcgcttgcggaagatgaatgtg

SEQ ID NO: 17127 - DNA, 25 bp, Homo sapiens
tgtggccttcgaggagcagaacgcg

SEQ ID NO: 17128 - DNA, 25 bp, Homo sapiens
agaacgcggtactgcagaggcacac

SEQ ID NO: 17129 - DNA, 25 bp, Homo sapiens
ccagcacgagaagctcatcgtccgc

SEQ ID NO: 17130 - DNA, 25 bp, Homo sapiens
gctcatcgtccgcatcaaggaaatc

SEQ ID NO: 17131 - DNA, 25 bp, Homo sapiens
gccagcgagcacctgtgaggagtgg

SEQ ID NO: 17132 - DNA, 25 bp, Homo sapiens
tacaccacaatggctgagcacttcc

SEQ ID NO: 17133 - DNA, 25 bp, Homo sapiens
gcacttcctgacgttgctggtagtg

SEQ ID NO: 17134 - DNA, 25 bp, Homo sapiens
tgctggtagtgcctgccatcaagaa

SEQ ID NO: 17135 - DNA, 25 bp, Homo sapiens
tgctgtggcttcaccaactatacgg

SEQ ID NO: 17136 - DNA, 25 bp, Homo sapiens
gattttgaggactcaccctacttca

SEQ ID NO: 17137 - DNA, 25 bp, Homo sapiens
gagggttgcttcaatcagcttttgt

SEQ ID NO: 17138 - DNA, 25 bp, Homo sapiens
gtggcagctggaattgggggcctcg

SEQ ID NO: 17139 - DNA, 25 bp, Homo sapiens
agctggctgccatgattgtttccat

SEQ ID NO: 17140 - DNA, 25 bp, Homo sapiens
ctacaataagtccacttctgcctct

SEQ ID NO: 17141 - DNA, 25 bp, Homo sapiens
gccagaatggacctggcctttctgc

SEQ ID NO: 17142 - DNA, 25 bp, Homo sapiens
ttctgctcccagacttgggggctag

SEQ ID NO: 17143 - DNA, 25 bp, Homo sapiens
tgttcactggtacgttggggagggg

SEQ ID NO: 17144 - DNA, 25 bp, Homo sapiens
cactggtacgttggggaggggatgg

SEQ ID NO: 17145 - DNA, 25 bp, Homo sapiens
agttaaaacgtcacaaaggtgctgc

SEQ ID NO: 17146 - DNA, 25 bp, Homo sapiens
aggtgctgcttttacagggaagctt

SEQ ID NO: 17147 - DNA, 25 bp, Homo sapiens
gggaagcttattctgttttaaacat

SEQ ID NO: 17148 - DNA, 25 bp, Homo sapiens
gttgtggtctgatcagttaatttgt

SEQ ID NO: 17149 - DNA, 25 bp, Homo sapiens
gtatgtagcagtgtatgctctcata

SEQ ID NO: 17150 - DNA, 25 bp, Homo sapiens
caattactgacctatgctctaaaac

SEQ ID NO: 17151 - DNA, 25 bp, Homo sapiens
tactgacctatgctctaaaacatga

SEQ ID NO: 17152 - DNA, 25 bp, Homo sapiens
ctttgttacagacccaagctgtcca

SEQ ID NO: 17153 - DNA, 25 bp, Homo sapiens
tgttacagacccaagctgtccattt

SEQ ID NO: 17154 - DNA, 25 bp, Homo sapiens
tagcacctgctatagcggtgtcatg

SEQ ID NO: 17155 - DNA, 25 bp, Homo sapiens
cggtgtcatgttggatcgcttttgt

SEQ ID NO: 17156 - DNA, 25 bp, Homo sapiens
ttgtgactgttcatctgtccttgac

SEQ ID NO: 17157 - DNA, 25 bp, Homo sapiens
gacgtagttttcgcatccttgaatt

SEQ ID NO: 17158 - DNA, 25 bp, Homo sapiens
aagcaaaactccatggactctgtcc

SEQ ID NO: 17159 - DNA, 25 bp, Homo sapiens
gtcactaacctgtctcagtgtggcc

SEQ ID NO: 17160 - DNA, 25 bp, Homo sapiens
ttctgtaacccctgtttgtggtacg

SEQ ID NO: 17161 - DNA, 25 bp, Homo sapiens
atgcatttgctctcctaggacagtg

SEQ ID NO: 17162 - DNA, 25 bp, Homo sapiens
aagacatgcgagactggtggcctgc

SEQ ID NO: 17163 - DNA, 25 bp, Homo sapiens
gtggcctgcaaatagcatccgtcaa

SEQ ID NO: 17164 - DNA, 25 bp, Homo sapiens
catccgtcaatctgtgttaactgca

SEQ ID NO: 17165 - DNA, 25 bp, Homo sapiens
ggccaccctggagaaatgtgccacg

SEQ ID NO: 17166 - DNA, 25 bp, Homo sapiens
tggagaaatgtgccacgtgctccca

SEQ ID NO: 17167 - DNA, 25 bp, Homo sapiens
gcgggctatggggaaggcctaccac

SEQ ID NO: 17168 - DNA, 25 bp, Homo sapiens
ttcacagtggatgctacgagccaga

SEQ ID NO: 17169 - DNA, 25 bp, Homo sapiens
gctacgagccagatccactgtattg

SEQ ID NO: 17170 - DNA, 25 bp, Homo sapiens
gatccactgtattgaggactttcac

SEQ ID NO: 17171 - DNA, 25 bp, Homo sapiens
ctttcacaggaagtttgccccaaga

SEQ ID NO: 17172 - DNA, 25 bp, Homo sapiens
ccccaagatgctcagtgtgcggtgg

SEQ ID NO: 17173 - DNA, 25 bp, Homo sapiens
gagccaggtcaggaggagactgtga

SEQ ID NO: 17174 - DNA, 25 bp, Homo sapiens
gtgagaattgttgctctggatcgaa

SEQ ID NO: 17175 - DNA, 25 bp, Homo sapiens
tggatcgaagttttcacattggctg

SEQ ID NO: 17176 - DNA, 25 bp, Homo sapiens
atcatggttccattacaggcctatt

SEQ ID NO: 17177 - DNA, 25 bp, Homo sapiens
acaggcctattaacatcatacattg

SEQ ID NO: 17178 - DNA, 25 bp, Homo sapiens
aagtttgacaaagcataccacatga

SEQ ID NO: 17179 - DNA, 25 bp, Homo sapiens
gaattcagatttacctcaatgctaa

SEQ ID NO: 17180 - DNA, 25 bp, Homo sapiens
ggaaagtcattttgacctcaggtag

SEQ ID NO: 17181 - DNA, 25 bp, Homo sapiens
tgaaaaaattatgcctctggtttaa

SEQ ID NO: 17182 - DNA, 25 bp, Homo sapiens
attggtgattacacactctttctct

SEQ ID NO: 17183 - DNA, 25 bp, Homo sapiens
tctttctcttacccttgtgtattga

SEQ ID NO: 17184 - DNA, 25 bp, Homo sapiens
cccttgtgtattgaactatgtccat

SEQ ID NO: 17185 - DNA, 25 bp, Homo sapiens
aagctgtcagtgtgtattggtttca

SEQ ID NO: 17186 - DNA, 25 bp, Homo sapiens
accaataaccactgcttgatcctta

SEQ ID NO: 17187 - DNA, 25 bp, Homo sapiens
tctgcagcctacgcatgaataggtt

SEQ ID NO: 17188 - DNA, 25 bp, Homo sapiens
gcagcctacgcatgaataggttggc

SEQ ID NO: 17189 - DNA, 25 bp, Homo sapiens
gcatgaataggttggcaggtgtggg

SEQ ID NO: 17190 - DNA, 25 bp, Homo sapiens
agcctgctgcaatccgtggaagagc

SEQ ID NO: 17191 - DNA, 25 bp, Homo sapiens
gctgcaatccgtggaagagcccatg

SEQ ID NO: 17192 - DNA, 25 bp, Homo sapiens
gcaatccgtggaagagcccatggtg

SEQ ID NO: 17193 - DNA, 25 bp, Homo sapiens
tccgtggaagagcccatggtgcacc

SEQ ID NO: 17194 - DNA, 25 bp, Homo sapiens
ccatgtccctctcagcagacaagtt

SEQ ID NO: 17195 - DNA, 25 bp, Homo sapiens
atgtccctctcagcagacaagttcc

SEQ ID NO: 17196 - DNA, 25 bp, Homo sapiens
tccctctcagcagacaagttccagg

SEQ ID NO: 17197 - DNA, 25 bp, Homo sapiens
cctctcagcagacaagttccaggtc

SEQ ID NO: 17198 - DNA, 25 bp, Homo sapiens
gacctgtacatagcacaacatgatc

SEQ ID NO: 17199 - DNA, 25 bp, Homo sapiens
atatactgttcatgtacatccacaa

SEQ ID NO: 17200 - DNA, 25 bp, Homo sapiens
acatccacaaatacaccttgtacca

SEQ ID NO: 17201 - DNA, 25 bp, Homo sapiens
accttgtaccaaataatgctttctt

SEQ ID NO: 17202 - DNA, 25 bp, Homo sapiens
gattttagcaggttttctttcctat

SEQ ID NO: 17203 - DNA, 25 bp, Homo sapiens
tctttcctattcattgtttcttatc

SEQ ID NO: 17204 - DNA, 25 bp, Homo sapiens
aaggattcctttaagcatgtcagat

SEQ ID NO: 17205 - DNA, 25 bp, Homo sapiens
cacctattgctggacttctgttgta

SEQ ID NO: 17206 - DNA, 25 bp, Homo sapiens
agttggcaaacactggctggaactg

SEQ ID NO: 17207 - DNA, 25 bp, Homo sapiens
gacaagagcctaacaagtgccaact

SEQ ID NO: 17208 - DNA, 25 bp, Homo sapiens
aagtgccaacttacagatgattacg

SEQ ID NO: 17209 - DNA, 25 bp, Homo sapiens
tttggtgcagctgctagtcagtccc

SEQ ID NO: 17210 - DNA, 25 bp, Homo sapiens
agtccctgactgacattgccaagta

SEQ ID NO: 17211 - DNA, 25 bp, Homo sapiens
caataggcagactgcggcctcactt

SEQ ID NO: 17212 - DNA, 25 bp, Homo sapiens
cggcctcacttcttggatgtttgtg

SEQ ID NO: 17213 - DNA, 25 bp, Homo sapiens
gactgggcaagactcttacgcccca

SEQ ID NO: 17214 - DNA, 25 bp, Homo sapiens
ccccacactgcaatttggtcttgtt

SEQ ID NO: 17215 - DNA, 25 bp, Homo sapiens
gtcttgttgccgtatccatttatgt

SEQ ID NO: 17216 - DNA, 25 bp, Homo sapiens
ggcctttctcgagtttctgattata

SEQ ID NO: 17217 - DNA, 25 bp, Homo sapiens
gactggactcattcagggagctctg

SEQ ID NO: 17218 - DNA, 25 bp, Homo sapiens
gaggaggactctcatacaactctgc

SEQ ID NO: 17219 - DNA, 25 bp, Homo sapiens
aatcactatccgagcaatcaccagc

SEQ ID NO: 17220 - DNA, 25 bp, Homo sapiens
ggaaatccattggttgtccatcatc

SEQ ID NO: 17221 - DNA, 25 bp, Homo sapiens
aaacttaccactactatcagcttcc

SEQ ID NO: 17222 - DNA, 25 bp, Homo sapiens
agatacgtcacaaaagccttagcct

SEQ ID NO: 17223 - DNA, 25 bp, Homo sapiens
gaattctgtgccacatgcagctcag

SEQ ID NO: 17224 - DNA, 25 bp, Homo sapiens
gtagatgacttgccaatccggggct

SEQ ID NO: 17225 - DNA, 25 bp, Homo sapiens
taggactctggacccatttggactt

SEQ ID NO: 17226 - DNA, 25 bp, Homo sapiens
tgccaatgtttcagtgcgggacgtc

SEQ ID NO: 17227 - DNA, 25 bp, Homo sapiens
tgggttacgacctgacgagttccta

SEQ ID NO: 17228 - DNA, 25 bp, Homo sapiens
ccttacccacacttatagcgtgcgc

SEQ ID NO: 17229 - DNA, 25 bp, Homo sapiens
cgtgcgctggtctgagacttcagtg

SEQ ID NO: 17230 - DNA, 25 bp, Homo sapiens
tggagcgtcggagtgacaggcgccg

SEQ ID NO: 17231 - DNA, 25 bp, Homo sapiens
atgtttttatcgtactctttggaga

SEQ ID NO: 17232 - DNA, 25 bp, Homo sapiens
tatcgtactctttggagatgcccat

SEQ ID NO: 17233 - DNA, 25 bp, Homo sapiens
tactctttggagatgcccattctac

SEQ ID NO: 17234 - DNA, 25 bp, Homo sapiens
ttggagatgcccattctacttttga

SEQ ID NO: 17235 - DNA, 25 bp, Homo sapiens
ggagatgcccattctacttttgaat

SEQ ID NO: 17236 - DNA, 25 bp, Homo sapiens
tagcttttactaattcgcatctgga

SEQ ID NO: 17237 - DNA, 25 bp, Homo sapiens
tttactaattcgcatctggaagctc

SEQ ID NO: 17238 - DNA, 25 bp, Homo sapiens
gctcagcaagtgcacaagccttact

SEQ ID NO: 17239 - DNA, 25 bp, Homo sapiens
gcaagtgcacaagccttactttggt

SEQ ID NO: 17240 - DNA, 25 bp, Homo sapiens
gtgcacaagccttactttggttacc

SEQ ID NO: 17241 - DNA, 25 bp, Homo sapiens
cacaagccttactttggttaccgtg

SEQ ID NO: 17242 - DNA, 25 bp, Homo sapiens
gcacgccatcaatgccatcgtgcgc

SEQ ID NO: 17243 - DNA, 25 bp, Homo sapiens
tcacgggcaacgacagtctgcacga

SEQ ID NO: 17244 - DNA, 25 bp, Homo sapiens
gggcaacgacagtctgcacgagtcg

SEQ ID NO: 17245 - DNA, 25 bp, Homo sapiens
gcaacgacagtctgcacgagtcggc

SEQ ID NO: 17246 - DNA, 25 bp, Homo sapiens
aacgacagtctgcacgagtcggcgc

SEQ ID NO: 17247 - DNA, 25 bp, Homo sapiens
gggcagcgacgtggacatggacgtg

SEQ ID NO: 17248 - DNA, 25 bp, Homo sapiens
gcgacgtggacatggacgtgctcac

SEQ ID NO: 17249 - DNA, 25 bp, Homo sapiens
acgtggacatggacgtgctcaccac

SEQ ID NO: 17250 - DNA, 25 bp, Homo sapiens
cacgagaaggactatgacagcctgg

SEQ ID NO: 17251 - DNA, 25 bp, Homo sapiens
accccgtccatggtgctaagcgggc

SEQ ID NO: 17252 - DNA, 25 bp, Homo sapiens
cccgtccatggtgctaagcgggccc

SEQ ID NO: 17253 - DNA, 25 bp, Homo sapiens
tgttcgaatgccttatagccttcct

SEQ ID NO: 17254 - DNA, 25 bp, Homo sapiens
ggattgtgactgactctgcattttt

SEQ ID NO: 17255 - DNA, 25 bp, Homo sapiens
gcttcaggactacatatgacccaga

SEQ ID NO: 17256 - DNA, 25 bp, Homo sapiens
gcaaggtggctgaactatagtctgg

SEQ ID NO: 17257 - DNA, 25 bp, Homo sapiens
gcacatctcaccactcattggttaa

SEQ ID NO: 17258 - DNA, 25 bp, Homo sapiens
atcatagcgagcacttttcctttcc

SEQ ID NO: 17259 - DNA, 25 bp, Homo sapiens
cgcagccacgccgatggttatacag

SEQ ID NO: 17260 - DNA, 25 bp, Homo sapiens
acttcacctcttcctattgagtttg

SEQ ID NO: 17261 - DNA, 25 bp, Homo sapiens
gacagcatcaggcaactctgaactg

SEQ ID NO: 17262 - DNA, 25 bp, Homo sapiens
ttggcaaccttcatgttaccccaaa

SEQ ID NO: 17263 - DNA, 25 bp, Homo sapiens
atgacgtctctattgtacaacctcc

SEQ ID NO: 17264 - DNA, 25 bp, Homo sapiens
tgtttcctcatagctagttctcaag

SEQ ID NO: 17265 - DNA, 25 bp, Homo sapiens
gctagttctcaagctgcatgtaaga

SEQ ID NO: 17266 - DNA, 25 bp, Homo sapiens
aaaataggcctggacctgaaggtct

SEQ ID NO: 17267 - DNA, 25 bp, Homo sapiens
aggaaagaagtgtttgccgcatcaa

SEQ ID NO: 17268 - DNA, 25 bp, Homo sapiens
gtgtttgccgcatcaagtgtaaaga

SEQ ID NO: 17269 - DNA, 25 bp, Homo sapiens
aacagagactgcatgctttgcttat

SEQ ID NO: 17270 - DNA, 25 bp, Homo sapiens
gcatgctttgcttatagttcttaat

SEQ ID NO: 17271 - DNA, 25 bp, Homo sapiens
gttcatgcttttaggcctttggggg

SEQ ID NO: 17272 - DNA, 25 bp, Homo sapiens
aaaatggtctttgcacacactacac

SEQ ID NO: 17273 - DNA, 25 bp, Homo sapiens
atatacaatgtgctcccgaactttc

SEQ ID NO: 17274 - DNA, 25 bp, Homo sapiens
gctcccgaactttcgcattagtctt

SEQ ID NO: 17275 - DNA, 25 bp, Homo sapiens
gaaatatcactgacactccagacta

SEQ ID NO: 17276 - DNA, 25 bp, Homo sapiens
gagtctaggtttctgcaattttgtt

SEQ ID NO: 17277 - DNA, 25 bp, Homo sapiens
ctttagtaaactcaccttgcatggt

SEQ ID NO: 17278 - DNA, 25 bp, Homo sapiens
gagatctggtggctatttccacatt

SEQ ID NO: 17279 - DNA, 25 bp, Homo sapiens
ctgacagtggtgagcatccttttta

SEQ ID NO: 17280 - DNA, 25 bp, Homo sapiens
gattgcctgataaccagtttcaatg

SEQ ID NO: 17281 - DNA, 25 bp, Homo sapiens
gagaaccgttttaatctggattttg

SEQ ID NO: 17282 - DNA, 25 bp, Homo sapiens
ggattttgttttgtcacacctggaa

SEQ ID NO: 17283 - DNA, 25 bp, Homo sapiens
ttttatgatcacatggttcactacc

SEQ ID NO: 17284 - DNA, 25 bp, Homo sapiens
ggttcactaccaaatgaccctcaaa

SEQ ID NO: 17285 - DNA, 25 bp, Homo sapiens
aaatgaccctcaaataagccagatg

SEQ ID NO: 17286 - DNA, 25 bp, Homo sapiens
atcgccttccatggtttttaaatgc

SEQ ID NO: 17287 - DNA, 25 bp, Homo sapiens
cccctgctttcagcctgatggatat

SEQ ID NO: 17288 - DNA, 25 bp, Homo sapiens
gagcagacgtacgcagagatgccta

SEQ ID NO: 17289 - DNA, 25 bp, Homo sapiens
gcggagaagaacgctgtctcccatc

SEQ ID NO: 17290 - DNA, 25 bp, Homo sapiens
ggagtactttggcagtttggcagct

SEQ ID NO: 17291 - DNA, 25 bp, Homo sapiens
gtttggcagcttgacttctgcagct

SEQ ID NO: 17292 - DNA, 25 bp, Homo sapiens
cccctcaggccggggatctggggag

SEQ ID NO: 17293 - DNA, 25 bp, Homo sapiens
gtttcccctttgtgagggtgtcaag

SEQ ID NO: 17294 - DNA, 25 bp, Homo sapiens
agctggctctgctctgagaaactct

SEQ ID NO: 17295 - DNA, 25 bp, Homo sapiens
tggcaagtggacgccattctcttgc

SEQ ID NO: 17296 - DNA, 25 bp, Homo sapiens
ggaggaaccatgcaaatcgccttcc

SEQ ID NO: 17297 - DNA, 25 bp, Homo sapiens
aaatccctcaaacgattgctgagag

SEQ ID NO: 17298 - DNA, 25 bp, Homo sapiens
ttgctgagagcctgattgtggaaag

SEQ ID NO: 17299 - DNA, 25 bp, Homo sapiens
gaagtgagatgcaccttattttcaa

SEQ ID NO: 17300 - DNA, 25 bp, Homo sapiens
caagaagtcctgggaagcgctctcc

SEQ ID NO: 17301 - DNA, 25 bp, Homo sapiens
ctagcacgtccatttccaggaggag

SEQ ID NO: 17302 - DNA, 25 bp, Homo sapiens
ttttccattttgtcatccaaggtag

SEQ ID NO: 17303 - DNA, 25 bp, Homo sapiens
tccaaggtagctgtgcacttgcctt

SEQ ID NO: 17304 - DNA, 25 bp, Homo sapiens
aaatgtgttgcttctgagttatata

SEQ ID NO: 17305 - DNA, 25 bp, Homo sapiens
aaggctacttcatgacaagactgct

SEQ ID NO: 17306 - DNA, 25 bp, Homo sapiens
caagactgctttgtaatatttcact

SEQ ID NO: 17307 - DNA, 25 bp, Homo sapiens
tgcattgtttacatagttctcatgg

SEQ ID NO: 17308 - DNA, 25 bp, Homo sapiens
tctcgccggcggatgacgagctgta

SEQ ID NO: 17309 - DNA, 25 bp, Homo sapiens
cgagctgtatcagcggacgcgcatc

SEQ ID NO: 17310 - DNA, 25 bp, Homo sapiens
gaggccgctcaggcaatgtacatcg

SEQ ID NO: 17311 - DNA, 25 bp, Homo sapiens
aacagccgcggcttcatgataaacg

SEQ ID NO: 17312 - DNA, 25 bp, Homo sapiens
tcccgcactcggtggtgcagtggaa

SEQ ID NO: 17313 - DNA, 25 bp, Homo sapiens
acatcaccgaagacagcttttccct

SEQ ID NO: 17314 - DNA, 25 bp, Homo sapiens
gttgctggagccccggatagagatc

SEQ ID NO: 17315 - DNA, 25 bp, Homo sapiens
tggagaccggaccgagaggctgcag

SEQ ID NO: 17316 - DNA, 25 bp, Homo sapiens
caggagggacttcacttacatcttt

SEQ ID NO: 17317 - DNA, 25 bp, Homo sapiens
caagctgctcaatgaaccgccagga

SEQ ID NO: 17318 - DNA, 25 bp, Homo sapiens
ccgccaggaactgacctgctgactg

SEQ ID NO: 17319 - DNA, 25 bp, Homo sapiens
gaagaaaggccagttctcgtttgga

SEQ ID NO: 17320 - DNA, 25 bp, Homo sapiens
gaaaaccttggcattcctgaagaag

SEQ ID NO: 17321 - DNA, 25 bp, Homo sapiens
attggcccaacaggaatggcttcaa

SEQ ID NO: 17322 - DNA, 25 bp, Homo sapiens
caagctgcccaacaagcccagcttg

SEQ ID NO: 17323 - DNA, 25 bp, Homo sapiens
tgcctcagccagtgcatctaatcag

SEQ ID NO: 17324 - DNA, 25 bp, Homo sapiens
atcaggcgggatcttctcaggatga

SEQ ID NO: 17325 - DNA, 25 bp, Homo sapiens
accagctgagtttctatttcttcta

SEQ ID NO: 17326 - DNA, 25 bp, Homo sapiens
ctataaatgtttttccctgcacaac

SEQ ID NO: 17327 - DNA, 25 bp, Homo sapiens
ttgtatgcatcttggtggacttgtc

SEQ ID NO: 17328 - DNA, 25 bp, Homo sapiens
ggtggacttgtcattggtattctag

SEQ ID NO: 17329 - DNA, 25 bp, Homo sapiens
gatagcagcgagtccttcgtttgat

SEQ ID NO: 17330 - DNA, 25 bp, Homo sapiens
gatagtcggaatagagccgccccaa

SEQ ID NO: 17331 - DNA, 25 bp, Homo sapiens
aactcagatcctacaacacgcaagt

SEQ ID NO: 17332 - DNA, 25 bp, Homo sapiens
caacacgcaagttccttcttgaacc

SEQ ID NO: 17333 - DNA, 25 bp, Homo sapiens
ccctatggccctgaatggtgcactg

SEQ ID NO: 17334 - DNA, 25 bp, Homo sapiens
cccctcacaaatgcagccaagtcat

SEQ ID NO: 17335 - DNA, 25 bp, Homo sapiens
gagaattgcgggttctacccagtca

SEQ ID NO: 17336 - DNA, 25 bp, Homo sapiens
ctacccagtcagaagatcacaccat

SEQ ID NO: 17337 - DNA, 25 bp, Homo sapiens
gatcacaccatggagactttctact

SEQ ID NO: 17338 - DNA, 25 bp, Homo sapiens
aacttcaccttccattaagtgttca

SEQ ID NO: 17339 - DNA, 25 bp, Homo sapiens
gaagcctgaaattgtgccgtgttgc

SEQ ID NO: 17340 - DNA, 25 bp, Homo sapiens
tgccgtgttgccttatatgaatatg

SEQ ID NO: 17341 - DNA, 25 bp, Homo sapiens
gaacctgactgatgaggagctgcag

SEQ ID NO: 17342 - DNA, 25 bp, Homo sapiens
gtcagtgagcaagagttcctgcgca

SEQ ID NO: 17343 - DNA, 25 bp, Homo sapiens
gaccagcctctattaagatcagtgt

SEQ ID NO: 17344 - DNA, 25 bp, Homo sapiens
catggtgtgaaatctggcttttgag

SEQ ID NO: 17345 - DNA, 25 bp, Homo sapiens
gacctccctttatcactttaatagt

SEQ ID NO: 17346 - DNA, 25 bp, Homo sapiens
gagcctattttagccgtttggaagt

SEQ ID NO: 17347 - DNA, 25 bp, Homo sapiens
aaatgacctgcgaattaccctaatt

SEQ ID NO: 17348 - DNA, 25 bp, Homo sapiens
gatcttaaagctttgagcacctgcc

SEQ ID NO: 17349 - DNA, 25 bp, Homo sapiens
gcatttccacatatccacaaacaca

SEQ ID NO: 17350 - DNA, 25 bp, Homo sapiens
caagcacatgttacacctgtgttgc

SEQ ID NO: 17351 - DNA, 25 bp, Homo sapiens
tcattcttgacggctccagttttta

SEQ ID NO: 17352 - DNA, 25 bp, Homo sapiens
gccgtctcaaagtttcttagctgac

SEQ ID NO: 17353 - DNA, 25 bp, Homo sapiens
cttagctgactttggctttcacatt

SEQ ID NO: 17354 - DNA, 25 bp, Homo sapiens
ggaatgccttctcctaagagtcagt

SEQ ID NO: 17355 - DNA, 25 bp, Homo sapiens
ggttagggaatggtcacttctgatt

SEQ ID NO: 17356 - DNA, 25 bp, Homo sapiens
gaagagatcttgattcctttgggaa

SEQ ID NO: 17357 - DNA, 25 bp, Homo sapiens
ggtccctttatgagttattccttct

SEQ ID NO: 17358 - DNA, 25 bp, Homo sapiens
agttcatctcactggagcacagcca

SEQ ID NO: 17359 - DNA, 25 bp, Homo sapiens
tggtttgtgggacaggggcagcttg

SEQ ID NO: 17360 - DNA, 25 bp, Homo sapiens
gaataacgcaggtcccttttcttgg

SEQ ID NO: 17361 - DNA, 25 bp, Homo sapiens
aggcttgtactatggccatgacagt

SEQ ID NO: 17362 - DNA, 25 bp, Homo sapiens
atgatccctctccaaagtggttgtc

SEQ ID NO: 17363 - DNA, 25 bp, Homo sapiens
tttgctatcagctcttctgctatga

SEQ ID NO: 17364 - DNA, 25 bp, Homo sapiens
aactgacagacctaactgaagcaca

SEQ ID NO: 17365 - DNA, 25 bp, Homo sapiens
cagacttatgcatccaagacatcag

SEQ ID NO: 17366 - DNA, 25 bp, Homo sapiens
caatgaacacatccagctgatccca

SEQ ID NO: 17367 - DNA, 25 bp, Homo sapiens
aggagacaagtgacgacagccattc

SEQ ID NO: 17368 - DNA, 25 bp, Homo sapiens
cctttgcagctatctactgtagtga

SEQ ID NO: 17369 - DNA, 25 bp, Homo sapiens
actgtagtgacagccatttcttggt

SEQ ID NO: 17370 - DNA, 25 bp, Homo sapiens
gaagaattacactggcctttgtttt

SEQ ID NO: 17371 - DNA, 25 bp, Homo sapiens
gaaatgccgaccatggagatgcttt

SEQ ID NO: 17372 - DNA, 25 bp, Homo sapiens
ggagatgctttagagtcttctcaaa

SEQ ID NO: 17373 - DNA, 25 bp, Homo sapiens
ggccctcagaagttctccttaaatt

SEQ ID NO: 17374 - DNA, 25 bp, Homo sapiens
gggtcaactgacatccattgtatat

SEQ ID NO: 17375 - DNA, 25 bp, Homo sapiens
agtttctttcatgctatttttattt

SEQ ID NO: 17376 - DNA, 25 bp, Homo sapiens
gtaagtgcatatcctaacttgccca

SEQ ID NO: 17377 - DNA, 25 bp, Homo sapiens
aacttgcccatattctaaatcatct

SEQ ID NO: 17378 - DNA, 25 bp, Homo sapiens
tcatctggttggttttcagcctaga

SEQ ID NO: 17379 - DNA, 25 bp, Homo sapiens
agctatgttggggcacatgtcctgc

SEQ ID NO: 17380 - DNA, 25 bp, Homo sapiens
gtcctgcaaatatggccctagaaac

SEQ ID NO: 17381 - DNA, 25 bp, Homo sapiens
gctttgtcatccgtttttaattatt

SEQ ID NO: 17382 - DNA, 25 bp, Homo sapiens
ttaactgacccttgacaatcttgtc

SEQ ID NO: 17383 - DNA, 25 bp, Homo sapiens
tgaacaatcccggtgtgtcaggacc

SEQ ID NO: 17384 - DNA, 25 bp, Homo sapiens
cccccaaatgtcacttctgcataaa

SEQ ID NO: 17385 - DNA, 25 bp, Homo sapiens
ggagcaatccaagccacatatcttc

SEQ ID NO: 17386 - DNA, 25 bp, Homo sapiens
atctggtattgcattttgccttccc

SEQ ID NO: 17387 - DNA, 25 bp, Homo sapiens
cttccctgttcatacctcaaattga

SEQ ID NO: 17388 - DNA, 25 bp, Homo sapiens
aagtgacggattctgttgtggtttg

SEQ ID NO: 17389 - DNA, 25 bp, Homo sapiens
gaatgcagtaccagtgttctcttcg

SEQ ID NO: 17390 - DNA, 25 bp, Homo sapiens
gtagacctgggtcactgtaggcata

SEQ ID NO: 17391 - DNA, 25 bp, Homo sapiens
ggacttggattgcttcagatggttt

SEQ ID NO: 17392 - DNA, 25 bp, Homo sapiens
tcttttcctggggacttgtttccat

SEQ ID NO: 17393 - DNA, 25 bp, Homo sapiens
atagaggctcacagcggcataagct

SEQ ID NO: 17394 - DNA, 25 bp, Homo sapiens
tggactttgtcgccactagatgaca

SEQ ID NO: 17395 - DNA, 25 bp, Homo sapiens
ccacatctgtgtatctcaagggact

SEQ ID NO: 17396 - DNA, 25 bp, Homo sapiens
aacatgccgcagggagggctgtggt

SEQ ID NO: 17397 - DNA, 25 bp, Homo sapiens
tgccggtgcttccaacaaggacagc

SEQ ID NO: 17398 - DNA, 25 bp, Homo sapiens
tgcagacaggctctgaggggcacgc

SEQ ID NO: 17399 - DNA, 25 bp, Homo sapiens
ccctcctcagcgagaggcagcaagg

SEQ ID NO: 17400 - DNA, 25 bp, Homo sapiens
cagtgtcactggtcaggtgcttctc

SEQ ID NO: 17401 - DNA, 25 bp, Homo sapiens
tcaggtgcttctcaccacgggaaag

SEQ ID NO: 17402 - DNA, 25 bp, Homo sapiens
ccgacctgtgactcgcttgagatgg

SEQ ID NO: 17403 - DNA, 25 bp, Homo sapiens
agatgggaaagcggcgccacagacc

SEQ ID NO: 17404 - DNA, 25 bp, Homo sapiens
ttgtcctggctcgcagggtgcagga

SEQ ID NO: 17405 - DNA, 25 bp, Homo sapiens
agctgcgccggacagagtggggagc

SEQ ID NO: 17406 - DNA, 25 bp, Homo sapiens
agagtggggagctcctagtttgtgg

SEQ ID NO: 17407 - DNA, 25 bp, Homo sapiens
atgttgagcatgctgcgagctgctg

SEQ ID NO: 17408 - DNA, 25 bp, Homo sapiens
tctgtatgggccgaagacccttctt

SEQ ID NO: 17409 - DNA, 25 bp, Homo sapiens
gctccttgttacacatgttcttttt

SEQ ID NO: 17410 - DNA, 25 bp, Homo sapiens
tttttatccgatcaacctgtgcact

SEQ ID NO: 17411 - DNA, 25 bp, Homo sapiens
cttccttaattcctcgcgtagagac

SEQ ID NO: 17412 - DNA, 25 bp, Homo sapiens
gtagagacggtctcaggtgccgtgg

SEQ ID NO: 17413 - DNA, 25 bp, Homo sapiens
ctcccaccgtgtttgtctggtgtca

SEQ ID NO: 17414 - DNA, 25 bp, Homo sapiens
gtgtgctccatagcgtgtagcttta

SEQ ID NO: 17415 - DNA, 25 bp, Homo sapiens
ctcggagatgagtgctttgacccag

SEQ ID NO: 17416 - DNA, 25 bp, Homo sapiens
ggagctcagctaagtgtatccacgc

SEQ ID NO: 17417 - DNA, 25 bp, Homo sapiens
gtatccacgctgtggttcagcagcc

SEQ ID NO: 17418 - DNA, 25 bp, Homo sapiens
tgtctccccgctatctaaaaaagta

SEQ ID NO: 17419 - DNA, 25 bp, Homo sapiens
acagcgagaatcttggaggcccatc

SEQ ID NO: 17420 - DNA, 25 bp, Homo sapiens
ggaggcccatcagaatgtagctcag

SEQ ID NO: 17421 - DNA, 25 bp, Homo sapiens
tattcaagcttggcagtcactacct

SEQ ID NO: 17422 - DNA, 25 bp, Homo sapiens
gcagtcactacctgaatttggcatc

SEQ ID NO: 17423 - DNA, 25 bp, Homo sapiens
atttggcatcactcacttcattgca

SEQ ID NO: 17424 - DNA, 25 bp, Homo sapiens
gattcggatggatgccagcactgga

SEQ ID NO: 17425 - DNA, 25 bp, Homo sapiens
tcattggtggctacatatttctctc

SEQ ID NO: 17426 - DNA, 25 bp, Homo sapiens
tacatatttctctcaacacgtgcaa

SEQ ID NO: 17427 - DNA, 25 bp, Homo sapiens
gagatgttctacaaacttaccagtg

SEQ ID NO: 17428 - DNA, 25 bp, Homo sapiens
gtttaatgaaactccacggccataa

SEQ ID NO: 17429 - DNA, 25 bp, Homo sapiens
aaaatgctattagtccgtcgtgctt

SEQ ID NO: 17430 - DNA, 25 bp, Homo sapiens
acacttttagtattcaccagcataa

SEQ ID NO: 17431 - DNA, 25 bp, Homo sapiens
actactcacaactagcagatggctt

SEQ ID NO: 17432 - DNA, 25 bp, Homo sapiens
gcaatctctgcgttaattaaatgcc

SEQ ID NO: 17433 - DNA, 25 bp, Homo sapiens
tgatttgccacaatgtccttaactc

SEQ ID NO: 17434 - DNA, 25 bp, Homo sapiens
ccttaactctaatgcctggactggc

SEQ ID NO: 17435 - DNA, 25 bp, Homo sapiens
tgcctggactggccatgttctagtc

SEQ ID NO: 17436 - DNA, 25 bp, Homo sapiens
tgttctagtctgttgcgctgttaca

SEQ ID NO: 17437 - DNA, 25 bp, Homo sapiens
gcgctgttacaatctgtattggtgc

SEQ ID NO: 17438 - DNA, 25 bp, Homo sapiens
aaaattcctagctcacatagcccaa

SEQ ID NO: 17439 - DNA, 25 bp, Homo sapiens
gtattgttcaataatccatggttca

SEQ ID NO: 17440 - DNA, 25 bp, Homo sapiens
ctttggtacccgagatgtgtgcaca

SEQ ID NO: 17441 - DNA, 25 bp, Homo sapiens
gatgtgtgcacagaattactccctc

SEQ ID NO: 17442 - DNA, 25 bp, Homo sapiens
tagcatcatgagcgtcagagccctt

SEQ ID NO: 17443 - DNA, 25 bp, Homo sapiens
gcagaagttccgcagtgagaccatc

SEQ ID NO: 17444 - DNA, 25 bp, Homo sapiens
gctggtggggctcatgaacaagttt

SEQ ID NO: 17445 - DNA, 25 bp, Homo sapiens
ccagcagcgcatacggggtgacgaa

SEQ ID NO: 17446 - DNA, 25 bp, Homo sapiens
gacgaagattggcgtcaccgttctg

SEQ ID NO: 17447 - DNA, 25 bp, Homo sapiens
aggggacaagatcctcctgaatgcc

SEQ ID NO: 17448 - DNA, 25 bp, Homo sapiens
agaactgacatggcgggacccaagg

SEQ ID NO: 17449 - DNA, 25 bp, Homo sapiens
gtggtgagctgggctcacagctcca

SEQ ID NO: 17450 - DNA, 25 bp, Homo sapiens
ccattttgtaccttgtcctgagttg

SEQ ID NO: 17451 - DNA, 25 bp, Homo sapiens
ccttcggtcgcaatacttccaagaa

SEQ ID NO: 17452 - DNA, 25 bp, Homo sapiens
caccagccagcaagcattaatgggg

SEQ ID NO: 17453 - DNA, 25 bp, Homo sapiens
gcaagcattaatggggctggtgccc

SEQ ID NO: 17454 - DNA, 25 bp, Homo sapiens
aagcattaatggggctggtgcccac

SEQ ID NO: 17455 - DNA, 25 bp, Homo sapiens
caccctctactgcattaacttcagc

SEQ ID NO: 17456 - DNA, 25 bp, Homo sapiens
cctctactgcattaacttcagccac

SEQ ID NO: 17457 - DNA, 25 bp, Homo sapiens
actgcattaacttcagccacgactc

SEQ ID NO: 17458 - DNA, 25 bp, Homo sapiens
ttcctctgcgcttccagtgataagg

SEQ ID NO: 17459 - DNA, 25 bp, Homo sapiens
ctgcgcttccagtgataagggtact

SEQ ID NO: 17460 - DNA, 25 bp, Homo sapiens
aagggtactgtccatatctttgctc

SEQ ID NO: 17461 - DNA, 25 bp, Homo sapiens
ctgtccatatctttgctctcaagga

SEQ ID NO: 17462 - DNA, 25 bp, Homo sapiens
gattccctgcatcaactaagaaaag

SEQ ID NO: 17463 - DNA, 25 bp, Homo sapiens
ttggtggcgaatgtgttgcgggtcc

SEQ ID NO: 17464 - DNA, 25 bp, Homo sapiens
ctgttgggctgctttctgtattgtc

SEQ ID NO: 17465 - DNA, 25 bp, Homo sapiens
tctcctaaccctctagttttaattg

SEQ ID NO: 17466 - DNA, 25 bp, Homo sapiens
aattggacacttctttgctgttgca

SEQ ID NO: 17467 - DNA, 25 bp, Homo sapiens
ttgctgttgcaatctatgccgtgta

SEQ ID NO: 17468 - DNA, 25 bp, Homo sapiens
atctatgccgtgtatttttgcttta

SEQ ID NO: 17469 - DNA, 25 bp, Homo sapiens
cttggattacaaaacctcgagccct

SEQ ID NO: 17470 - DNA, 25 bp, Homo sapiens
tctcagtagtggtgctgtattgtac

SEQ ID NO: 17471 - DNA, 25 bp, Homo sapiens
gcgtgttctgtaatatttcctctaa

SEQ ID NO: 17472 - DNA, 25 bp, Homo sapiens
atagcatagtaccataccacttata

SEQ ID NO: 17473 - DNA, 25 bp, Homo sapiens
gaagctaatcctgcagagagtttta

SEQ ID NO: 17474 - DNA, 25 bp, Homo sapiens
agaggccagggattgccttctaaat

SEQ ID NO: 17475 - DNA, 25 bp, Homo sapiens
taatcaccggttttatactgtccaa

SEQ ID NO: 17476 - DNA, 25 bp, Homo sapiens
ctgtccaaaatgaagcatccccgtg

SEQ ID NO: 17477 - DNA, 25 bp, Homo sapiens
catccccgtgacaaaccagagtggg

SEQ ID NO: 17478 - DNA, 25 bp, Homo sapiens
gggcagaagcatcgagagcgtgaca

SEQ ID NO: 17479 - DNA, 25 bp, Homo sapiens
agagcgtgacaggaaatcccaagac

SEQ ID NO: 17480 - DNA, 25 bp, Homo sapiens
tcacacgtcgcgtgtacccatagca

SEQ ID NO: 17481 - DNA, 25 bp, Homo sapiens
agaatcacatccggttgtgtcctgt

SEQ ID NO: 17482 - DNA, 25 bp, Homo sapiens
gtgtcctgtgggagggtcagaggca

SEQ ID NO: 17483 - DNA, 25 bp, Homo sapiens
gaggcagaatctacttacagtggtg

SEQ ID NO: 17484 - DNA, 25 bp, Homo sapiens
tctggtactgaatgccgctatcacc

SEQ ID NO: 17485 - DNA, 25 bp, Homo sapiens
cctagtgggattgggcctggtggtc

SEQ ID NO: 17486 - DNA, 25 bp, Homo sapiens
cttcttcttcagttttctactttca

SEQ ID NO: 17487 - DNA, 25 bp, Homo sapiens
ccaagtaccacggctatccttatag

SEQ ID NO: 17488 - DNA, 25 bp, Homo sapiens
aactctataacctcagccttttaat

SEQ ID NO: 17489 - DNA, 25 bp, Homo sapiens
acccaactactctggtaccattgct

SEQ ID NO: 17490 - DNA, 25 bp, Homo sapiens
agactggttgggccatggtgtctct

SEQ ID NO: 17491 - DNA, 25 bp, Homo sapiens
ggtgtctctgtgtatagtctttgct

SEQ ID NO: 17492 - DNA, 25 bp, Homo sapiens
ctttgctatgacttctggccagatg

SEQ ID NO: 17493 - DNA, 25 bp, Homo sapiens
atgtggaaccatatccgtggacctc

SEQ ID NO: 17494 - DNA, 25 bp, Homo sapiens
ggagcagccaggctcagtttgtggc

SEQ ID NO: 17495 - DNA, 25 bp, Homo sapiens
ctctcacacaggtaatgcccagctt

SEQ ID NO: 17496 - DNA, 25 bp, Homo sapiens
tttctgctgctaacacatttggcca

SEQ ID NO: 17497 - DNA, 25 bp, Homo sapiens
tttggccagttgttgcagttgctca

SEQ ID NO: 17498 - DNA, 25 bp, Homo sapiens
gcagttgctcatcatcttgggaaag

SEQ ID NO: 17499 - DNA, 25 bp, Homo sapiens
ggtgtttgtgacttttcagagccca

SEQ ID NO: 17500 - DNA, 25 bp, Homo sapiens
tcagagcccagattcctgttgtcta

SEQ ID NO: 17501 - DNA, 25 bp, Homo sapiens
gctactaccagaagtttttgcccct

SEQ ID NO: 17502 - DNA, 25 bp, Homo sapiens
ctgacgcaagtctagcatctctgcc

SEQ ID NO: 17503 - DNA, 25 bp, Homo sapiens
gagccagtcagcacctacaaagagc

SEQ ID NO: 17504 - DNA, 25 bp, Homo sapiens
ttgtgtctttgacatctaccaccct

SEQ ID NO: 17505 - DNA, 25 bp, Homo sapiens
aatgctgtgcttacaccttatctat

SEQ ID NO: 17506 - DNA, 25 bp, Homo sapiens
tcccaacacccaacaacaattaact

SEQ ID NO: 17507 - DNA, 25 bp, Homo sapiens
catcttgatctgtgcactagtctgt

SEQ ID NO: 17508 - DNA, 25 bp, Homo sapiens
gaaatagttgtgtggttgttgtggg

SEQ ID NO: 17509 - DNA, 25 bp, Homo sapiens
tgtttcggtttccttgaaaggtcat

SEQ ID NO: 17510 - DNA, 25 bp, Homo sapiens
tgaaaggtcatcattctagtgtttt

SEQ ID NO: 17511 - DNA, 25 bp, Homo sapiens
tctagtgttttggtagtccaccttt

SEQ ID NO: 17512 - DNA, 25 bp, Homo sapiens
agtccacctttactacatatatttc

SEQ ID NO: 17513 - DNA, 25 bp, Homo sapiens
agagaaactcacccatgttttcacc

SEQ ID NO: 17514 - DNA, 25 bp, Homo sapiens
cccatgttttcaccatccaaagagt

SEQ ID NO: 17515 - DNA, 25 bp, Homo sapiens
tctgtgcacaggtttttggtttgtt

SEQ ID NO: 17516 - DNA, 25 bp, Homo sapiens
ggttgtggtcattctatctgtaata

SEQ ID NO: 17517 - DNA, 25 bp, Homo sapiens
aaatgtgaccctcgccatggtaaat

SEQ ID NO: 17518 - DNA, 25 bp, Homo sapiens
acatggcttgctgcctgttataccg

SEQ ID NO: 17519 - DNA, 25 bp, Homo sapiens
tataccgtggtgacgtggttcccaa

SEQ ID NO: 17520 - DNA, 25 bp, Homo sapiens
atgtcaatgctgccattgccaccat

SEQ ID NO: 17521 - DNA, 25 bp, Homo sapiens
tgccccactggcttcaaggttggca

SEQ ID NO: 17522 - DNA, 25 bp, Homo sapiens
ttggcattaattaccagcctcccac

SEQ ID NO: 17523 - DNA, 25 bp, Homo sapiens
gcctggaccacaagtttgacctgat

SEQ ID NO: 17524 - DNA, 25 bp, Homo sapiens
gacctgatgtatgccaagcgtgcct

SEQ ID NO: 17525 - DNA, 25 bp, Homo sapiens
cgtgaggacatggctgcccttgaga

SEQ ID NO: 17526 - DNA, 25 bp, Homo sapiens
gtgtgctgtacttttacactccttt

SEQ ID NO: 17527 - DNA, 25 bp, Homo sapiens
tacactcctttgtcttggaactgtc

SEQ ID NO: 17528 - DNA, 25 bp, Homo sapiens
cctagctcaggtggcttcagggcct

SEQ ID NO: 17529 - DNA, 25 bp, Homo sapiens
ggcctccagcactttttatatttac

SEQ ID NO: 17530 - DNA, 25 bp, Homo sapiens
atatttacgtattctccaaagcagt

SEQ ID NO: 17531 - DNA, 25 bp, Homo sapiens
aagcagtgttcacacgggagccagc

SEQ ID NO: 17532 - DNA, 25 bp, Homo sapiens
acaggttggcgctggaggagccggg

SEQ ID NO: 17533 - DNA, 25 bp, Homo sapiens
cacctacattccatagtgggcccgt

SEQ ID NO: 17534 - DNA, 25 bp, Homo sapiens
gggctcctggtgcatcttaataaag

SEQ ID NO: 17535 - DNA, 25 bp, Homo sapiens
cttcgccatgaccatgtactgccaa

SEQ ID NO: 17536 - DNA, 25 bp, Homo sapiens
caaggcagacacctactgcgcgtag

SEQ ID NO: 17537 - DNA, 25 bp, Homo sapiens
gccaaaaggacgcccacggggagat

SEQ ID NO: 17538 - DNA, 25 bp, Homo sapiens
agggagggacaggtgcctggagccc

SEQ ID NO: 17539 - DNA, 25 bp, Homo sapiens
gctgcctgggtgccatcaaggagaa

SEQ ID NO: 17540 - DNA, 25 bp, Homo sapiens
tcttcttcgcctacacggacaagat

SEQ ID NO: 17541 - DNA, 25 bp, Homo sapiens
gattgacaggtatgcccagcaagac

SEQ ID NO: 17542 - DNA, 25 bp, Homo sapiens
gaagaaaggcttgcacctgtacggc

SEQ ID NO: 17543 - DNA, 25 bp, Homo sapiens
acctgtacggcacgcagggcaacgt

SEQ ID NO: 17544 - DNA, 25 bp, Homo sapiens
cgtctccaactacactgactggttc

SEQ ID NO: 17545 - DNA, 25 bp, Homo sapiens
tggttcgaggtgtacaacgccacgc

SEQ ID NO: 17546 - DNA, 25 bp, Homo sapiens
gctgcttggagttcagtgagagctg

SEQ ID NO: 17547 - DNA, 25 bp, Homo sapiens
gcgccgtgctacgagacggtgaagg

SEQ ID NO: 17548 - DNA, 25 bp, Homo sapiens
gtggcttcaggagaacctgctggct

SEQ ID NO: 17549 - DNA, 25 bp, Homo sapiens
cttcgccatgaccatgtactgccaa

SEQ ID NO: 17550 - DNA, 25 bp, Homo sapiens
gaagacaaatcaactgcaacgcatc

SEQ ID NO: 17551 - DNA, 25 bp, Homo sapiens
aacgcatcattcggacaggccgtac

SEQ ID NO: 17552 - DNA, 25 bp, Homo sapiens
ggccgtacaggtcactggttgaacc

SEQ ID NO: 17553 - DNA, 25 bp, Homo sapiens
atccccaaggcttcaaccagggtct

SEQ ID NO: 17554 - DNA, 25 bp, Homo sapiens
ggttcgttccaccagtcataaacca

SEQ ID NO: 17555 - DNA, 25 bp, Homo sapiens
tatctcctggcactcgcaagattga

SEQ ID NO: 17556 - DNA, 25 bp, Homo sapiens
ggacgaccacacaatgtgcaaccca

SEQ ID NO: 17557 - DNA, 25 bp, Homo sapiens
aatgtgcaacccaactggatcaccc

SEQ ID NO: 17558 - DNA, 25 bp, Homo sapiens
ggatcacccttggaaaccaactgga

SEQ ID NO: 17559 - DNA, 25 bp, Homo sapiens
tggatgggatccacctactagaccc

SEQ ID NO: 17560 - DNA, 25 bp, Homo sapiens
gccatggctctgtaagctaaacctg

SEQ ID NO: 17561 - DNA, 25 bp, Homo sapiens
actcttctggccgtaggttccagga

SEQ ID NO: 17562 - DNA, 25 bp, Homo sapiens
gttccaggaaagctcgtggaagctt

SEQ ID NO: 17563 - DNA, 25 bp, Homo sapiens
aaagctcgtggaagctttggggctc

SEQ ID NO: 17564 - DNA, 25 bp, Homo sapiens
aaatcatgtgactgtcacgtgctgg

SEQ ID NO: 17565 - DNA, 25 bp, Homo sapiens
gtgactgtcacgtgctggaaaataa

SEQ ID NO: 17566 - DNA, 25 bp, Homo sapiens
atttatattctctataggggacaga

SEQ ID NO: 17567 - DNA, 25 bp, Homo sapiens
gccatcactctttttggatcattta

SEQ ID NO: 17568 - DNA, 25 bp, Homo sapiens
gatcatttaggtctcttgtatcctt

SEQ ID NO: 17569 - DNA, 25 bp, Homo sapiens
aggtctcttgtatcctttgttttag

SEQ ID NO: 17570 - DNA, 25 bp, Homo sapiens
gaaccagtttcattaaagttgcctt

SEQ ID NO: 17571 - DNA, 25 bp, Homo sapiens
agtttcattaaagttgccttcctgg

SEQ ID NO: 17572 - DNA, 25 bp, Homo sapiens
gaccagttcttcggagagcacctgt

SEQ ID NO: 17573 - DNA, 25 bp, Homo sapiens
agagcacctgttggagtctgatctt

SEQ ID NO: 17574 - DNA, 25 bp, Homo sapiens
ggcacccagctggtttgacactgga

SEQ ID NO: 17575 - DNA, 25 bp, Homo sapiens
gctggtttgacactggactctcaga

SEQ ID NO: 17576 - DNA, 25 bp, Homo sapiens
ggacaggttctctgtcaacctggat

SEQ ID NO: 17577 - DNA, 25 bp, Homo sapiens
gttccacaggaaataccggatccca

SEQ ID NO: 17578 - DNA, 25 bp, Homo sapiens
aataccggatcccagctgatgtaga

SEQ ID NO: 17579 - DNA, 25 bp, Homo sapiens
atccctgtcatctgatggggtcctc

SEQ ID NO: 17580 - DNA, 25 bp, Homo sapiens
accattcccatcacccgtgaaaaga

SEQ ID NO: 17581 - DNA, 25 bp, Homo sapiens
aaaagatgccctttcttgaattgca

SEQ ID NO: 17582 - DNA, 25 bp, Homo sapiens
gaaagtttccccaccagtgaatgaa

SEQ ID NO: 17583 - DNA, 25 bp, Homo sapiens
tgaacaccttctacagcaaactctt

SEQ ID NO: 17584 - DNA, 25 bp, Homo sapiens
aagtccagtttcatccctgtaaggc

SEQ ID NO: 17585 - DNA, 25 bp, Homo sapiens
ggcaaatgtcttttcacgcagaaag

SEQ ID NO: 17586 - DNA, 25 bp, Homo sapiens
agggcagtagagagcacttacccga

SEQ ID NO: 17587 - DNA, 25 bp, Homo sapiens
agagatgccctgaggatggtggtta

SEQ ID NO: 17588 - DNA, 25 bp, Homo sapiens
gaaatgtacacacagattcctgtcc

SEQ ID NO: 17589 - DNA, 25 bp, Homo sapiens
acttgcacacagtaactaccagctc

SEQ ID NO: 17590 - DNA, 25 bp, Homo sapiens
ttctctcaaacttgtatttctcctg

SEQ ID NO: 17591 - DNA, 25 bp, Homo sapiens
ccacttcaacgattctttctttggg

SEQ ID NO: 17592 - DNA, 25 bp, Homo sapiens
ggttcttgcagttctatcatctaaa

SEQ ID NO: 17593 - DNA, 25 bp, Homo sapiens
tagacgaaacaagttcccctaggca

SEQ ID NO: 17594 - DNA, 25 bp, Homo sapiens
tctccctcccgaccattggaggatc

SEQ ID NO: 17595 - DNA, 25 bp, Homo sapiens
attggaggatcccaagctctcatgt

SEQ ID NO: 17596 - DNA, 25 bp, Homo sapiens
gttgcccttattgtcaccagtgaca

SEQ ID NO: 17597 - DNA, 25 bp, Homo sapiens
ctgcgagcccgtcatggaggaaaaa

SEQ ID NO: 17598 - DNA, 25 bp, Homo sapiens
ggagaatgggacagtccaccaggga

SEQ ID NO: 17599 - DNA, 25 bp, Homo sapiens
ccaccagggagacacctcgtggggc

SEQ ID NO: 17600 - DNA, 25 bp, Homo sapiens
cgactggccagccgaggacatgttt

SEQ ID NO: 17601 - DNA, 25 bp, Homo sapiens
ccgaggacatgtttgaccatcccac

SEQ ID NO: 17602 - DNA, 25 bp, Homo sapiens
gtcagaggagtccctctctgacctt

SEQ ID NO: 17603 - DNA, 25 bp, Homo sapiens
gtaacaagatgccaacttttttcct

SEQ ID NO: 17604 - DNA, 25 bp, Homo sapiens
gagaagggcttccggagctgtattt

SEQ ID NO: 17605 - DNA, 25 bp, Homo sapiens
gggattttcttgtagttcttatata

SEQ ID NO: 17606 - DNA, 25 bp, Homo sapiens
ttgactgtcagctacatgttggtaa

SEQ ID NO: 17607 - DNA, 25 bp, Homo sapiens
atatatttttacgtgcctttggctt

SEQ ID NO: 17608 - DNA, 25 bp, Homo sapiens
catcagatgttgtcacttatttcca

SEQ ID NO: 17609 - DNA, 25 bp, Homo sapiens
gtcacttatttccattgggattcca

SEQ ID NO: 17610 - DNA, 25 bp, Homo sapiens
gattccattgtaagctgtgtatgtg

SEQ ID NO: 17611 - DNA, 25 bp, Homo sapiens
gtgtatgtgcgtgtttggaaaagtg

SEQ ID NO: 17612 - DNA, 25 bp, Homo sapiens
aaaggcacaggttactcatgatgct

SEQ ID NO: 17613 - DNA, 25 bp, Homo sapiens
ttactcatgatgcttctgcagagac

SEQ ID NO: 17614 - DNA, 25 bp, Homo sapiens
gagactgtgggctacaccacatatg

SEQ ID NO: 17615 - DNA, 25 bp, Homo sapiens
gcattacataggtacttcaagcaac

SEQ ID NO: 17616 - DNA, 25 bp, Homo sapiens
gaaatgcttggatccttaaggagtt

SEQ ID NO: 17617 - DNA, 25 bp, Homo sapiens
ggagtttacgaaatctgctgtttta

SEQ ID NO: 17618 - DNA, 25 bp, Homo sapiens
aaaaaattgcttattactcttcatt

SEQ ID NO: 17619 - DNA, 25 bp, Homo sapiens
gtcactaagtttcatgtctgtacag

SEQ ID NO: 17620 - DNA, 25 bp, Homo sapiens
aaaaaatgttctctgcttgctacca

SEQ ID NO: 17621 - DNA, 25 bp, Homo sapiens
gttctctgcttgctaccaaaggaca

SEQ ID NO: 17622 - DNA, 25 bp, Homo sapiens
ggcataatggcaaatccttcaagca

SEQ ID NO: 17623 - DNA, 25 bp, Homo sapiens
gatgaccgcatctagattatttttt

SEQ ID NO: 17624 - DNA, 25 bp, Homo sapiens
gattttcactatagctatgttacgc

SEQ ID NO: 17625 - DNA, 25 bp, Homo sapiens
gttacgctaagctactgtccaatct

SEQ ID NO: 17626 - DNA, 25 bp, Homo sapiens
gctactgtccaatctcttgtgatgt

SEQ ID NO: 17627 - DNA, 25 bp, Homo sapiens
gtgctacagatactacatttcaaag

SEQ ID NO: 17628 - DNA, 25 bp, Homo sapiens
catttcaaagagttggcattttccc

SEQ ID NO: 17629 - DNA, 25 bp, Homo sapiens
gtacaagatactacattccattgaa

SEQ ID NO: 17630 - DNA, 25 bp, Homo sapiens
atgttggctatgtcctaaccaggca

SEQ ID NO: 17631 - DNA, 25 bp, Homo sapiens
gtcctaaccaggcaaccagataaca

SEQ ID NO: 17632 - DNA, 25 bp, Homo sapiens
ttgagtcttttatctaggtagttct

SEQ ID NO: 17633 - DNA, 25 bp, Homo sapiens
ggtagttctaattattcagctactt

SEQ ID NO: 17634 - DNA, 25 bp, Homo sapiens
gtagacttttcattgtataggcaca

SEQ ID NO: 17635 - DNA, 25 bp, Homo sapiens
taggcacaaccaaagagtcagactg

SEQ ID NO: 17636 - DNA, 25 bp, Homo sapiens
aagaatgctacaaaatcctgacatc

SEQ ID NO: 17637 - DNA, 25 bp, Homo sapiens
taaaatttcgagcccacaaatctat

SEQ ID NO: 17638 - DNA, 25 bp, Homo sapiens
agcttcctgacgacatgaaataatt

SEQ ID NO: 17639 - DNA, 25 bp, Homo sapiens
gacatgaaataattgggggttttgt

SEQ ID NO: 17640 - DNA, 25 bp, Homo sapiens
gttgtttagttacattaggctttgc

SEQ ID NO: 17641 - DNA, 25 bp, Homo sapiens
agttacattaggctttgctatatcc

SEQ ID NO: 17642 - DNA, 25 bp, Homo sapiens
tttgctatatccccaggccaaatag

SEQ ID NO: 17643 - DNA, 25 bp, Homo sapiens
tatccccaggccaaatagcatgtga

SEQ ID NO: 17644 - DNA, 25 bp, Homo sapiens
caggccaaatagcatgtgacacagg

SEQ ID NO: 17645 - DNA, 25 bp, Homo sapiens
gtgacacaggacagccatagtatag

SEQ ID NO: 17646 - DNA, 25 bp, Homo sapiens
cagccatagtatagtgtgtcactcg

SEQ ID NO: 17647 - DNA, 25 bp, Homo sapiens
tgccctgtcaaaggtccctatttga

SEQ ID NO: 17648 - DNA, 25 bp, Homo sapiens
gtcaaaggtccctatttgaaatgtg

SEQ ID NO: 17649 - DNA, 25 bp, Homo sapiens
agaagtctccctgcaattaatttcc

SEQ ID NO: 17650 - DNA, 25 bp, Homo sapiens
gtctccctgcaattaatttccaatg

SEQ ID NO: 17651 - DNA, 25 bp, Homo sapiens
gcaattaatttccaatgtttacatt

SEQ ID NO: 17652 - DNA, 25 bp, Homo sapiens
ttacattttttaactagactgtgga

SEQ ID NO: 17653 - DNA, 25 bp, Homo sapiens
tagactgtggaatttctacagatta

SEQ ID NO: 17654 - DNA, 25 bp, Homo sapiens
gagctcatggtccgtttgtgtgtta

SEQ ID NO: 17655 - DNA, 25 bp, Homo sapiens
ggtccgtttgtgtgttagatatgct

SEQ ID NO: 17656 - DNA, 25 bp, Homo sapiens
tgtgtgttagatatgctgtagctga

SEQ ID NO: 17657 - DNA, 25 bp, Homo sapiens
tgctgtagctgaagccctgtttgtc

SEQ ID NO: 17658 - DNA, 25 bp, Homo sapiens
gctgaagccctgtttgtcttttaaa

SEQ ID NO: 17659 - DNA, 25 bp, Homo sapiens
taaagactctgtaatgctcactccc

SEQ ID NO: 17660 - DNA, 25 bp, Homo sapiens
attttgcgtgtttgcatagcataaa

SEQ ID NO: 17661 - DNA, 25 bp, Homo sapiens
gcataaaatcagtagacaacaccac

SEQ ID NO: 17662 - DNA, 25 bp, Homo sapiens
accactgaggtcgttacgatcaacg

SEQ ID NO: 17663 - DNA, 25 bp, Homo sapiens
acgatcaacgatatccacagtctct

SEQ ID NO: 17664 - DNA, 25 bp, Homo sapiens
aacgatatccacagtctctttttag

SEQ ID NO: 17665 - DNA, 25 bp, Homo sapiens
tatccacagtctctttttagtctct

SEQ ID NO: 17666 - DNA, 25 bp, Homo sapiens
gtctctttttagtctctgttacatg

SEQ ID NO: 17667 - DNA, 25 bp, Homo sapiens
tacatgaagttttattccagttact

SEQ ID NO: 17668 - DNA, 25 bp, Homo sapiens
ccagttacttttcatggaatgacct

SEQ ID NO: 17669 - DNA, 25 bp, Homo sapiens
ggaatgacctattttgaacaagtaa

SEQ ID NO: 17670 - DNA, 25 bp, Homo sapiens
ttcagtattttcacggatatgaatg

SEQ ID NO: 17671 - DNA, 25 bp, Homo sapiens
ccttccagggctgaccagtttgagt

SEQ ID NO: 17672 - DNA, 25 bp, Homo sapiens
ctatgggggcctgctcatgaggctg

SEQ ID NO: 17673 - DNA, 25 bp, Homo sapiens
gaggctgcagggggatgccaacaac

SEQ ID NO: 17674 - DNA, 25 bp, Homo sapiens
gccaacaacctgcatggattcgagg

SEQ ID NO: 17675 - DNA, 25 bp, Homo sapiens
ggactccagagtttatctcctgatg

SEQ ID NO: 17676 - DNA, 25 bp, Homo sapiens
aagaagctagccttctgaacctcgc

SEQ ID NO: 17677 - DNA, 25 bp, Homo sapiens
aagtcactcaggtcatgggcattgt

SEQ ID NO: 17678 - DNA, 25 bp, Homo sapiens
gggcattgttcaagcctgagtggca

SEQ ID NO: 17679 - DNA, 25 bp, Homo sapiens
cgctcttgctcacctgttgaggaag

SEQ ID NO: 17680 - DNA, 25 bp, Homo sapiens
cgtggcggcatctttaactggcctc

SEQ ID NO: 17681 - DNA, 25 bp, Homo sapiens
caatgggaaactgactcgcctgtga

SEQ ID NO: 17682 - DNA, 25 bp, Homo sapiens
gcctgtcttgagtagacttggaccc

SEQ ID NO: 17683 - DNA, 25 bp, Homo sapiens
gtcttgagtagacttggacccaaaa

SEQ ID NO: 17684 - DNA, 25 bp, Homo sapiens
tgagtagacttggacccaaaaaatc

SEQ ID NO: 17685 - DNA, 25 bp, Homo sapiens
aaaaaatcatctcaccttgagccca

SEQ ID NO: 17686 - DNA, 25 bp, Homo sapiens
tgcggaaatacctgaaatacagcaa

SEQ ID NO: 17687 - DNA, 25 bp, Homo sapiens
acagcaaaaatatcctggaccggca

SEQ ID NO: 17688 - DNA, 25 bp, Homo sapiens
aatatcctggaccggcaagatcctc

SEQ ID NO: 17689 - DNA, 25 bp, Homo sapiens
aatggaaatggcacttaccagtcct

SEQ ID NO: 17690 - DNA, 25 bp, Homo sapiens
tggaaatggcacttaccagtcctgg

SEQ ID NO: 17691 - DNA, 25 bp, Homo sapiens
cagctaggaagcaagggttggaggc

SEQ ID NO: 17692 - DNA, 25 bp, Homo sapiens
accacagaaatcacagtcaatggat

SEQ ID NO: 17693 - DNA, 25 bp, Homo sapiens
gaattctcgaactgcatgtattgtg

SEQ ID NO: 17694 - DNA, 25 bp, Homo sapiens
tgccaatctgtcctgagtgttcatg

SEQ ID NO: 17695 - DNA, 25 bp, Homo sapiens
gagtgttcatgctttgtaccaaatt

SEQ ID NO: 17696 - DNA, 25 bp, Homo sapiens
gaacgcgtgttctgtaatcaaactg

SEQ ID NO: 17697 - DNA, 25 bp, Homo sapiens
acatccaaaatgacggctgctatat

SEQ ID NO: 17698 - DNA, 25 bp, Homo sapiens
aataactttatgtggcactgcctag

SEQ ID NO: 17699 - DNA, 25 bp, Homo sapiens
atgactaggctgtgtatttcttttc

SEQ ID NO: 17700 - DNA, 25 bp, Homo sapiens
tcagggatttttctaccttcagggt

SEQ ID NO: 17701 - DNA, 25 bp, Homo sapiens
attaccatagccaacctgtagtttt

SEQ ID NO: 17702 - DNA, 25 bp, Homo sapiens
gaatattttccacaagatgctgcaa

SEQ ID NO: 17703 - DNA, 25 bp, Homo sapiens
gtgagttatcacttcatttatctta

SEQ ID NO: 17704 - DNA, 25 bp, Homo sapiens
gaagcccacaattgacctttgacta

SEQ ID NO: 17705 - DNA, 25 bp, Homo sapiens
ggagaaaagcttgtgagctcaccaa

SEQ ID NO: 17706 - DNA, 25 bp, Homo sapiens
gagctcaccaaacaaggatttcagt

SEQ ID NO: 17707 - DNA, 25 bp, Homo sapiens
ttcagtgtagattttgtctttcttg

SEQ ID NO: 17708 - DNA, 25 bp, Homo sapiens
ggaaaagcctgctgttgttccacat

SEQ ID NO: 17709 - DNA, 25 bp, Homo sapiens
ttccacatctcgttgctgtttacat

SEQ ID NO: 17710 - DNA, 25 bp, Homo sapiens
cctgcatcttcctaagctttttagc

SEQ ID NO: 17711 - DNA, 25 bp, Homo sapiens
gaacacttctgtttcatggttgaga

SEQ ID NO: 17712 - DNA, 25 bp, Homo sapiens
ctctgtctttttccatgactcttat

SEQ ID NO: 17713 - DNA, 25 bp, Homo sapiens
tttccatgactcttatatactgcct

SEQ ID NO: 17714 - DNA, 25 bp, Homo sapiens
atatactgcctcatcttgatttata

SEQ ID NO: 17715 - DNA, 25 bp, Homo sapiens
ggagagagtcgttcgacctgctgct

SEQ ID NO: 17716 - DNA, 25 bp, Homo sapiens
aaaatggagtggctgccttccacgc

SEQ ID NO: 17717 - DNA, 25 bp, Homo sapiens
ctccagggcacaccagatctttgag

SEQ ID NO: 17718 - DNA, 25 bp, Homo sapiens
ttcatttgcagtgaggcccctaaag

SEQ ID NO: 17719 - DNA, 25 bp, Homo sapiens
tcaacattgaccatgagacccgcga

SEQ ID NO: 17720 - DNA, 25 bp, Homo sapiens
agacccgcgagctgacgaggatgaa

SEQ ID NO: 17721 - DNA, 25 bp, Homo sapiens
cgaggatgaacctgcagactgccac

SEQ ID NO: 17722 - DNA, 25 bp, Homo sapiens
ctgccacagccacatgctttgatgc

SEQ ID NO: 17723 - DNA, 25 bp, Homo sapiens
atgcggctcaggggaagacacgtac

SEQ ID NO: 17724 - DNA, 25 bp, Homo sapiens
cctgagtctccacggcagtgaggaa

SEQ ID NO: 17725 - DNA, 25 bp, Homo sapiens
gaagagaggttgagtcacccatccc

SEQ ID NO: 17726 - DNA, 25 bp, Homo sapiens
agtcaaatgccaaacactagctctg

SEQ ID NO: 17727 - DNA, 25 bp, Homo sapiens
gggagaagacattggtttgttgaca

SEQ ID NO: 17728 - DNA, 25 bp, Homo sapiens
gacaataacagtacatcttttcaag

SEQ ID NO: 17729 - DNA, 25 bp, Homo sapiens
cttttcaagttctcagctatttctt

SEQ ID NO: 17730 - DNA, 25 bp, Homo sapiens
tacctctccctatcttacatttgag

SEQ ID NO: 17731 - DNA, 25 bp, Homo sapiens
ggtaacttatgtcatctatgttgaa

SEQ ID NO: 17732 - DNA, 25 bp, Homo sapiens
taaagcacaaagcatacatttcctg

SEQ ID NO: 17733 - DNA, 25 bp, Homo sapiens
gcatacatttcctgactggtctaga

SEQ ID NO: 17734 - DNA, 25 bp, Homo sapiens
tcctgactggtctagagaactgatg

SEQ ID NO: 17735 - DNA, 25 bp, Homo sapiens
gaactgatgtttcaatttacccctc

SEQ ID NO: 17736 - DNA, 25 bp, Homo sapiens
tcaatttacccctctgctaaataaa

SEQ ID NO: 17737 - DNA, 25 bp, Homo sapiens
gaaatcatggctatattgtttttat

SEQ ID NO: 17738 - DNA, 25 bp, Homo sapiens
aacactagttgttccagcattgtac

SEQ ID NO: 17739 - DNA, 25 bp, Homo sapiens
gttgttccagcattgtactttgata

SEQ ID NO: 17740 - DNA, 25 bp, Homo sapiens
gtctgtacattgacgtgtatggact

SEQ ID NO: 17741 - DNA, 25 bp, Homo sapiens
attagggtcatttggcacttctcag

SEQ ID NO: 17742 - DNA, 25 bp, Homo sapiens
cacttctcagcaagtaggatacttc

SEQ ID NO: 17743 - DNA, 25 bp, Homo sapiens
aatggcttaagaccagcgtctctgt

SEQ ID NO: 17744 - DNA, 25 bp, Homo sapiens
gaccagcgtctctgtatgacattgt

SEQ ID NO: 17745 - DNA, 25 bp, Homo sapiens
tgtgtggttgaccctctgagataac

SEQ ID NO: 17746 - DNA, 25 bp, Homo sapiens
gagataactgttttcatctacagaa

SEQ ID NO: 17747 - DNA, 25 bp, Homo sapiens
agtcattatctgtttggtccttata

SEQ ID NO: 17748 - DNA, 25 bp, Homo sapiens
tctgaaaacggccctcttgaagggg

SEQ ID NO: 17749 - DNA, 25 bp, Homo sapiens
aacggccctcttgaagggggatatg

SEQ ID NO: 17750 - DNA, 25 bp, Homo sapiens
gaagggggatatgaatggagatttg

SEQ ID NO: 17751 - DNA, 25 bp, Homo sapiens
gaatggagatttgaaggtctgcaag

SEQ ID NO: 17752 - DNA, 25 bp, Homo sapiens
gaaggtctgcaagaacctgactcgt

SEQ ID NO: 17753 - DNA, 25 bp, Homo sapiens
tctgcaagaacctgactcgtctgac

SEQ ID NO: 17754 - DNA, 25 bp, Homo sapiens
aagaacctgactcgtctgactgtgt

SEQ ID NO: 17755 - DNA, 25 bp, Homo sapiens
aacctgactcgtctgactgtgtgtg

SEQ ID NO: 17756 - DNA, 25 bp, Homo sapiens
gccatggaggcagaatcctggccct

SEQ ID NO: 17757 - DNA, 25 bp, Homo sapiens
tgttggcccaagctcttgtggtaca

SEQ ID NO: 17758 - DNA, 25 bp, Homo sapiens
ttggcccaagctcttgtggtacaca

SEQ ID NO: 17759 - DNA, 25 bp, Homo sapiens
attccatgcacctctaatcatcgat

SEQ ID NO: 17760 - DNA, 25 bp, Homo sapiens
aagttttgtttgccacgataggaat

SEQ ID NO: 17761 - DNA, 25 bp, Homo sapiens
gatagaccaactgtgaacctacaag

SEQ ID NO: 17762 - DNA, 25 bp, Homo sapiens
agacgtcttggacaactgaagttta

SEQ ID NO: 17763 - DNA, 25 bp, Homo sapiens
tatccacagggttttattttgcttg

SEQ ID NO: 17764 - DNA, 25 bp, Homo sapiens
ctcttagagctattgcaaacttccc

SEQ ID NO: 17765 - DNA, 25 bp, Homo sapiens
gcaaacttcccaagatccagatgac

SEQ ID NO: 17766 - DNA, 25 bp, Homo sapiens
gattcccaactcattgaaggtctta

SEQ ID NO: 17767 - DNA, 25 bp, Homo sapiens
gagaccattggccatccaggaaatt

SEQ ID NO: 17768 - DNA, 25 bp, Homo sapiens
ggccatccaggaaatttcgtacagc

SEQ ID NO: 17769 - DNA, 25 bp, Homo sapiens
gttcaacatcagtttacttgcagct

SEQ ID NO: 17770 - DNA, 25 bp, Homo sapiens
tcggacactggccttgggaacaatg

SEQ ID NO: 17771 - DNA, 25 bp, Homo sapiens
ttgccccttgactgtaggagccaga

SEQ ID NO: 17772 - DNA, 25 bp, Homo sapiens
caggtgtgcatagctctctgtagac

SEQ ID NO: 17773 - DNA, 25 bp, Homo sapiens
tagacatttttacccaaacctgttg

SEQ ID NO: 17774 - DNA, 25 bp, Homo sapiens
aacctgttggtaaagtgcccatctg

SEQ ID NO: 17775 - DNA, 25 bp, Homo sapiens
tgcccatctggtgctcaagagagcc

SEQ ID NO: 17776 - DNA, 25 bp, Homo sapiens
agatctccacattgtcttgatccag

SEQ ID NO: 17777 - DNA, 25 bp, Homo sapiens
gatccagaccagctctgtgatcaga

SEQ ID NO: 17778 - DNA, 25 bp, Homo sapiens
tcaagcctgtgctcaggttgccttg

SEQ ID NO: 17779 - DNA, 25 bp, Homo sapiens
ggttgccttgaatgtggactctgga

SEQ ID NO: 17780 - DNA, 25 bp, Homo sapiens
gctgggctgcgagagtgttgctgcc

SEQ ID NO: 17781 - DNA, 25 bp, Homo sapiens
tgccaaagtgtccatagggcgcctg

SEQ ID NO: 17782 - DNA, 25 bp, Homo sapiens
gtcctcacttcttgagtgtctgcaa

SEQ ID NO: 17783 - DNA, 25 bp, Homo sapiens
tgagtgtctgcaaccctgatttcag

SEQ ID NO: 17784 - DNA, 25 bp, Homo sapiens
gcaaccctgatttcagccagatcaa

SEQ ID NO: 17785 - DNA, 25 bp, Homo sapiens
gatcaactgctctgaaggctacatt

SEQ ID NO: 17786 - DNA, 25 bp, Homo sapiens
aggctacattcagaactacagatgc

SEQ ID NO: 17787 - DNA, 25 bp, Homo sapiens
gaactacagatgcagaggtgatgac

SEQ ID NO: 17788 - DNA, 25 bp, Homo sapiens
atgacagcaaagtccaggaagccag

SEQ ID NO: 17789 - DNA, 25 bp, Homo sapiens
ggaagccaggaagtccttcttctct

SEQ ID NO: 17790 - DNA, 25 bp, Homo sapiens
ccttctccatgtacactatgctgta

SEQ ID NO: 17791 - DNA, 25 bp, Homo sapiens
tatttggtgctatacctgcaggccc

SEQ ID NO: 17792 - DNA, 25 bp, Homo sapiens
ctgtgtcaacttccatgggggctac

SEQ ID NO: 17793 - DNA, 25 bp, Homo sapiens
atccaggtctctgagaaccgctgtc

SEQ ID NO: 17794 - DNA, 25 bp, Homo sapiens
cctacaatgcctttcagatccgtgc

SEQ ID NO: 17795 - DNA, 25 bp, Homo sapiens
agatccgtgctggaaactcgcaggg

SEQ ID NO: 17796 - DNA, 25 bp, Homo sapiens
gcaaatcaacaacgtcagcgccatg

SEQ ID NO: 17797 - DNA, 25 bp, Homo sapiens
ggagtacgtgctggacctggagatg

SEQ ID NO: 17798 - DNA, 25 bp, Homo sapiens
tgaattccctcatgagctaccgggc

SEQ ID NO: 17799 - DNA, 25 bp, Homo sapiens
aggctcaccgtctttgtaggggcct

SEQ ID NO: 17800 - DNA, 25 bp, Homo sapiens
ggcctacaccttctgaggagcagga

SEQ ID NO: 17801 - DNA, 25 bp, Homo sapiens
ctaccctagctgaggagcctgttgt

SEQ ID NO: 17802 - DNA, 25 bp, Homo sapiens
atgagtgtgagtctggtgcgcacca

SEQ ID NO: 17803 - DNA, 25 bp, Homo sapiens
gttggttatttgtgttattctggat

SEQ ID NO: 17804 - DNA, 25 bp, Homo sapiens
aatgtggtcctatttaagccagccc

SEQ ID NO: 17805 - DNA, 25 bp, Homo sapiens
cccccacctagggtctatttgtgtg

SEQ ID NO: 17806 - DNA, 25 bp, Homo sapiens
gaaaattcgtgcgtgggcttctttc

SEQ ID NO: 17807 - DNA, 25 bp, Homo sapiens
ttctttctccctggtacaaacgtat

SEQ ID NO: 17808 - DNA, 25 bp, Homo sapiens
aaggggaactgtcaagctggtgtct

SEQ ID NO: 17809 - DNA, 25 bp, Homo sapiens
gctggtgtcttcagccagatgacat

SEQ ID NO: 17810 - DNA, 25 bp, Homo sapiens
agagaatatcccagaaccctctctc

SEQ ID NO: 17811 - DNA, 25 bp, Homo sapiens
aggagagcaggcactgcactgtcca

SEQ ID NO: 17812 - DNA, 25 bp, Homo sapiens
acagtccacggtacacagtcgggtg

SEQ ID NO: 17813 - DNA, 25 bp, Homo sapiens
tcctgggagcattcgtcgtgcccag

SEQ ID NO: 17814 - DNA, 25 bp, Homo sapiens
cagccagctaaccctacagaagagt

SEQ ID NO: 17815 - DNA, 25 bp, Homo sapiens
gaagagtatgcccagctttttgcag

SEQ ID NO: 17816 - DNA, 25 bp, Homo sapiens
gttttgatagattccttacccagtg

SEQ ID NO: 17817 - DNA, 25 bp, Homo sapiens
agaatctacagctgctttacaggct

SEQ ID NO: 17818 - DNA, 25 bp, Homo sapiens
gctttacaggctgctagcttgtata

SEQ ID NO: 17819 - DNA, 25 bp, Homo sapiens
gcgcacttgctgatattgcacagtc

SEQ ID NO: 17820 - DNA, 25 bp, Homo sapiens
agaagtggtacccatagccagtctc

SEQ ID NO: 17821 - DNA, 25 bp, Homo sapiens
gtctcttccagactcatagcatcag

SEQ ID NO: 17822 - DNA, 25 bp, Homo sapiens
gacttagatacaagccttaccaaca

SEQ ID NO: 17823 - DNA, 25 bp, Homo sapiens
gacacattacctttttagctatttt

SEQ ID NO: 17824 - DNA, 25 bp, Homo sapiens
tcttctattttcactcttgataagc

SEQ ID NO: 17825 - DNA, 25 bp, Homo sapiens
gccgcgagctccggaggatgagtga

SEQ ID NO: 17826 - DNA, 25 bp, Homo sapiens
ttcctcgcccgaagagcgcgggcac

SEQ ID NO: 17827 - DNA, 25 bp, Homo sapiens
aacgcagatgcggcaaagctccagc

SEQ ID NO: 17828 - DNA, 25 bp, Homo sapiens
tccagctggacgcgagtcttccagt

SEQ ID NO: 17829 - DNA, 25 bp, Homo sapiens
gaacttgggcaggggaagctccgcc

SEQ ID NO: 17830 - DNA, 25 bp, Homo sapiens
tgccctgggcagccatcttgaatat

SEQ ID NO: 17831 - DNA, 25 bp, Homo sapiens
tacttccctcaggcctatgcaaaaa

SEQ ID NO: 17832 - DNA, 25 bp, Homo sapiens
aaaagaggatccgtgctgtctcctt

SEQ ID NO: 17833 - DNA, 25 bp, Homo sapiens
tggagggagggctgacccagattcc

SEQ ID NO: 17834 - DNA, 25 bp, Homo sapiens
ccttccggtgcgtgtgaagccacgg

SEQ ID NO: 17835 - DNA, 25 bp, Homo sapiens
gagccaggtttaaccgttgcgtcac

SEQ ID NO: 17836 - DNA, 25 bp, Homo sapiens
gagtatgctgtgaagacccaccacc

SEQ ID NO: 17837 - DNA, 25 bp, Homo sapiens
tcccagccctactcgggatgagtgc

SEQ ID NO: 17838 - DNA, 25 bp, Homo sapiens
ctatgaccgggacatcttgaccatt

SEQ ID NO: 17839 - DNA, 25 bp, Homo sapiens
cattgacatcagtcgagtcaccccc

SEQ ID NO: 17840 - DNA, 25 bp, Homo sapiens
tcatgggccacctctgtggaaacca

SEQ ID NO: 17841 - DNA, 25 bp, Homo sapiens
atattcctgggctgatccacaacat

SEQ ID NO: 17842 - DNA, 25 bp, Homo sapiens
tcatcaatgatctgtgtggtccccg

SEQ ID NO: 17843 - DNA, 25 bp, Homo sapiens
tccccgacgtaacatctggcgagac

SEQ ID NO: 17844 - DNA, 25 bp, Homo sapiens
gaggaacgtggctctagtgtctgga

SEQ ID NO: 17845 - DNA, 25 bp, Homo sapiens
gggagcagggctcaactggaggaac

SEQ ID NO: 17846 - DNA, 25 bp, Homo sapiens
gaacaaatatcagctccacctctga

SEQ ID NO: 17847 - DNA, 25 bp, Homo sapiens
gctggaggtgacgctactgagaact

SEQ ID NO: 17848 - DNA, 25 bp, Homo sapiens
gatgtcgggcactctacagatgcca

SEQ ID NO: 17849 - DNA, 25 bp, Homo sapiens
cattggggagctccatccagatgac

SEQ ID NO: 17850 - DNA, 25 bp, Homo sapiens
aacaagcctccggaaactcttatca

SEQ ID NO: 17851 - DNA, 25 bp, Homo sapiens
ttggtggaccaactgggtgatccct

SEQ ID NO: 17852 - DNA, 25 bp, Homo sapiens
gactgaacacctcctcagaagtcag

SEQ ID NO: 17853 - DNA, 25 bp, Homo sapiens
ccgagcctgctttggacacgggaga

SEQ ID NO: 17854 - DNA, 25 bp, Homo sapiens
gccattgctaactacttcaactgac

SEQ ID NO: 17855 - DNA, 25 bp, Homo sapiens
taatatatctctttctttttcttcc

SEQ ID NO: 17856 - DNA, 25 bp, Homo sapiens
tcctttctgcgctcaaatttttcga

SEQ ID NO: 17857 - DNA, 25 bp, Homo sapiens
gtgtgcctttttattcatctacttt

SEQ ID NO: 17858 - DNA, 25 bp, Homo sapiens
agctgatccagcatgccaatgtaca

SEQ ID NO: 17859 - DNA, 25 bp, Homo sapiens
cctcatccgtaacctggagcagctg

SEQ ID NO: 17860 - DNA, 25 bp, Homo sapiens
ggctggagccgagagaacgcatgga

SEQ ID NO: 17861 - DNA, 25 bp, Homo sapiens
tggaccccggtcatcaaggatgtaa

SEQ ID NO: 17862 - DNA, 25 bp, Homo sapiens
tggaggaccggctggacaggaacct

SEQ ID NO: 17863 - DNA, 25 bp, Homo sapiens
gcttcggtcactggcacaagaacaa

SEQ ID NO: 17864 - DNA, 25 bp, Homo sapiens
ccggctcatcgtgtatgtcatgggc

SEQ ID NO: 17865 - DNA, 25 bp, Homo sapiens
gtcatgggcggtgtggccatgtcag

SEQ ID NO: 17866 - DNA, 25 bp, Homo sapiens
gtcagagatgagggccgcctacgag

SEQ ID NO: 17867 - DNA, 25 bp, Homo sapiens
gaccagggccaccgagggaagtggg

SEQ ID NO: 17868 - DNA, 25 bp, Homo sapiens
ggatgacctgaaggcactggacaag

SEQ ID NO: 17869 - DNA, 25 bp, Homo sapiens
gaacagaacctgagtcgtcggactt

SEQ ID NO: 17870 - DNA, 25 bp, Homo sapiens
ggactttcaaaagcctcttcagagc

SEQ ID NO: 17871 - DNA, 25 bp, Homo sapiens
gaggaaatccagttctatgtgcagc

SEQ ID NO: 17872 - DNA, 25 bp, Homo sapiens
cagaggtcctctaaactggtaccga

SEQ ID NO: 17873 - DNA, 25 bp, Homo sapiens
ggacggaagatcctgattccggccc

SEQ ID NO: 17874 - DNA, 25 bp, Homo sapiens
gccctgatggtcacggcggagaagg

SEQ ID NO: 17875 - DNA, 25 bp, Homo sapiens
cggagaaggacttcgtgctcgttcc

SEQ ID NO: 17876 - DNA, 25 bp, Homo sapiens
gcacatggaggactggattccccac

SEQ ID NO: 17877 - DNA, 25 bp, Homo sapiens
tggctggattctgatgcccggaacc

SEQ ID NO: 17878 - DNA, 25 bp, Homo sapiens
ggaacccaccggtggtctcaaagat

SEQ ID NO: 17879 - DNA, 25 bp, Homo sapiens
gtagaacgcagcgtgtgcccacgct

SEQ ID NO: 17880 - DNA, 25 bp, Homo sapiens
gtggagccgggaataactgggccaa

SEQ ID NO: 17881 - DNA, 25 bp, Homo sapiens
actgggccaagggccactacacaga

SEQ ID NO: 17882 - DNA, 25 bp, Homo sapiens
cacagagggagccgagctggtcgac

SEQ ID NO: 17883 - DNA, 25 bp, Homo sapiens
tcgactcggtcctggatgtggtgag

SEQ ID NO: 17884 - DNA, 25 bp, Homo sapiens
cagagagctgtgactgtctccaggg

SEQ ID NO: 17885 - DNA, 25 bp, Homo sapiens
accctgctcatcagcaagatccggg

SEQ ID NO: 17886 - DNA, 25 bp, Homo sapiens
gatccgggaagagtacccagaccgc

SEQ ID NO: 17887 - DNA, 25 bp, Homo sapiens
catgaacaccttcagcgtcatgccc

SEQ ID NO: 17888 - DNA, 25 bp, Homo sapiens
tgccctcacccaaggtgtcagacac

SEQ ID NO: 17889 - DNA, 25 bp, Homo sapiens
gtgtcagacacggtggtggagccct

SEQ ID NO: 17890 - DNA, 25 bp, Homo sapiens
gccagctgaacgcagacctgcgcaa

SEQ ID NO: 17891 - DNA, 25 bp, Homo sapiens
atgtatctcttgggacaacttttaa

SEQ ID NO: 17892 - DNA, 25 bp, Homo sapiens
taggactctactagttggcatacga

SEQ ID NO: 17893 - DNA, 25 bp, Homo sapiens
aaggatggacattttatcgtctcat

SEQ ID NO: 17894 - DNA, 25 bp, Homo sapiens
atcgtctcatagtcatgctttttgg

SEQ ID NO: 17895 - DNA, 25 bp, Homo sapiens
tggaaatttacatcatcctcaagta

SEQ ID NO: 17896 - DNA, 25 bp, Homo sapiens
gattcagcattccatgcacttgctt

SEQ ID NO: 17897 - DNA, 25 bp, Homo sapiens
aatttagtcctgtgcatactgtggt

SEQ ID NO: 17898 - DNA, 25 bp, Homo sapiens
tactgtggtgtttttactgtgcata

SEQ ID NO: 17899 - DNA, 25 bp, Homo sapiens
atcagtggtgcttttgtacctaggt

SEQ ID NO: 17900 - DNA, 25 bp, Homo sapiens
ttgtacctaggttttatgtgatttt

SEQ ID NO: 17901 - DNA, 25 bp, Homo sapiens
catggatagttgtggccacctgctg

SEQ ID NO: 17902 - DNA, 25 bp, Homo sapiens
ttactttccatcttacccagtagtt

SEQ ID NO: 17903 - DNA, 25 bp, Homo sapiens
cgtttgggtggttatgtttgcatgc

SEQ ID NO: 17904 - DNA, 25 bp, Homo sapiens
gtttgcatgcttaagcacacatttg

SEQ ID NO: 17905 - DNA, 25 bp, Homo sapiens
ggatgatggccttgttcctttttaa

SEQ ID NO: 17906 - DNA, 25 bp, Homo sapiens
tctgatgcttgaattctattttcta

SEQ ID NO: 17907 - DNA, 25 bp, Homo sapiens
tttctagtgatttttcacatctccc

SEQ ID NO: 17908 - DNA, 25 bp, Homo sapiens
ctccctttaagtttttgctgcagca

SEQ ID NO: 17909 - DNA, 25 bp, Homo sapiens
gtgggcaccaatctacaactatgtc

SEQ ID NO: 17910 - DNA, 25 bp, Homo sapiens
taaggtctctaagtcattactaaca

SEQ ID NO: 17911 - DNA, 25 bp, Homo sapiens
cagtattgtttttcccattgatttt

SEQ ID NO: 17912 - DNA, 25 bp, Homo sapiens
aagcagatgtaaagtctctcctgaa

SEQ ID NO: 17913 - DNA, 25 bp, Homo sapiens
ggcaccttaagaccaagccatcgga

SEQ ID NO: 17914 - DNA, 25 bp, Homo sapiens
tgctgttcatctatggccactacaa

SEQ ID NO: 17915 - DNA, 25 bp, Homo sapiens
gacataaatacagaacggcccggga

SEQ ID NO: 17916 - DNA, 25 bp, Homo sapiens
ggcccgggatgttggacttcacggg

SEQ ID NO: 17917 - DNA, 25 bp, Homo sapiens
tggacttcacgggcaaggccaagtg

SEQ ID NO: 17918 - DNA, 25 bp, Homo sapiens
agtgggatgcctggaatgagctgaa

SEQ ID NO: 17919 - DNA, 25 bp, Homo sapiens
gagagactggatttggttactgtgc

SEQ ID NO: 17920 - DNA, 25 bp, Homo sapiens
gttactgtgccatgtgtttatccta

SEQ ID NO: 17921 - DNA, 25 bp, Homo sapiens
ctgtctccctggagttcttgcaagt

SEQ ID NO: 17922 - DNA, 25 bp, Homo sapiens
agttcttgcaagtcggccaggatgt

SEQ ID NO: 17923 - DNA, 25 bp, Homo sapiens
tcggccaggatgtctcaggctgagt

SEQ ID NO: 17924 - DNA, 25 bp, Homo sapiens
cctccagcacagggaccaagtgggg

SEQ ID NO: 17925 - DNA, 25 bp, Homo sapiens
gagcctgcagaacctgtccaggcac

SEQ ID NO: 17926 - DNA, 25 bp, Homo sapiens
atggcatggagcttacacctgactg

SEQ ID NO: 17927 - DNA, 25 bp, Homo sapiens
ggatacctggaagactccggtcacc

SEQ ID NO: 17928 - DNA, 25 bp, Homo sapiens
tccttcttgctcagggcctaaaaga

SEQ ID NO: 17929 - DNA, 25 bp, Homo sapiens
gggcctaaaagatgctggtcctccc

SEQ ID NO: 17930 - DNA, 25 bp, Homo sapiens
cctcctgtcacatgctgacgttgga

SEQ ID NO: 17931 - DNA, 25 bp, Homo sapiens
gctgacgttggacttagcaggttct

SEQ ID NO: 17932 - DNA, 25 bp, Homo sapiens
agcaggttctaaggccacatgtgtg

SEQ ID NO: 17933 - DNA, 25 bp, Homo sapiens
taaggccacatgtgtgacctctctg

SEQ ID NO: 17934 - DNA, 25 bp, Homo sapiens
gcctggggaaggactgacagacccc

SEQ ID NO: 17935 - DNA, 25 bp, Homo sapiens
tgtggccgcctctaaagagcgtagc

SEQ ID NO: 17936 - DNA, 25 bp, Homo sapiens
agagcgtagcggagtttctctggct

SEQ ID NO: 17937 - DNA, 25 bp, Homo sapiens
tgaaaaaagcgttggctgccgccgg

SEQ ID NO: 17938 - DNA, 25 bp, Homo sapiens
ctgccgccggctatgatgtggagaa

SEQ ID NO: 17939 - DNA, 25 bp, Homo sapiens
aacagccgtatcaaacttggtctca

SEQ ID NO: 17940 - DNA, 25 bp, Homo sapiens
gcaagggcactctggtgcaaacgaa

SEQ ID NO: 17941 - DNA, 25 bp, Homo sapiens
aacgaaaggcaccggtgcttctggc

SEQ ID NO: 17942 - DNA, 25 bp, Homo sapiens
ggcggcgcaactccgaagaagagcg

SEQ ID NO: 17943 - DNA, 25 bp, Homo sapiens
agaaagcgaagaagccggccgcggc

SEQ ID NO: 17944 - DNA, 25 bp, Homo sapiens
ccgcggccactgtaaccaagaaagt

SEQ ID NO: 17945 - DNA, 25 bp, Homo sapiens
gtcaagcctaagaaggcggcgccca

SEQ ID NO: 17946 - DNA, 25 bp, Homo sapiens
gcgatggtgtcagcaggaacttggt

SEQ ID NO: 17947 - DNA, 25 bp, Homo sapiens
aggaacttggtggtgggcacactgg

SEQ ID NO: 17948 - DNA, 25 bp, Homo sapiens
acgcctattgcaggccattgccaag

SEQ ID NO: 17949 - DNA, 25 bp, Homo sapiens
attgccaaggacaacatcatcccct

SEQ ID NO: 17950 - DNA, 25 bp, Homo sapiens
atggtgaacccacatgggcactcct

SEQ ID NO: 17951 - DNA, 25 bp, Homo sapiens
ccatcttatccatgttctttctgat

SEQ ID NO: 17952 - DNA, 25 bp, Homo sapiens
gttcaagtactatcactgggcgctg

SEQ ID NO: 17953 - DNA, 25 bp, Homo sapiens
ccatgctcatcgccggcatgatcta

SEQ ID NO: 17954 - DNA, 25 bp, Homo sapiens
gccggcatgatctacaaatacatcg

SEQ ID NO: 17955 - DNA, 25 bp, Homo sapiens
tacatcgagtaccaaggggctgaga

SEQ ID NO: 17956 - DNA, 25 bp, Homo sapiens
gagtggggtgacgggatccgaggcc

SEQ ID NO: 17957 - DNA, 25 bp, Homo sapiens
ctggcccacccaggaacagtgaggg

SEQ ID NO: 17958 - DNA, 25 bp, Homo sapiens
ccttgagcgggtgctgttggtgcgc

SEQ ID NO: 17959 - DNA, 25 bp, Homo sapiens
tggccgtgaagtcatcaccatctac

SEQ ID NO: 17960 - DNA, 25 bp, Homo sapiens
atcttgtggcctggagtcgaggtct

SEQ ID NO: 17961 - DNA, 25 bp, Homo sapiens
gtcgaggtcttggccaggacataac

SEQ ID NO: 17962 - DNA, 25 bp, Homo sapiens
ctaggtctccttggaaaccaggcct

SEQ ID NO: 17963 - DNA, 25 bp, Homo sapiens
atggagatggatcccaggtcttgtg

SEQ ID NO: 17964 - DNA, 25 bp, Homo sapiens
ggggactttactatctagcacccca

SEQ ID NO: 17965 - DNA, 25 bp, Homo sapiens
gtaggcctgtcctggccagagaaga

SEQ ID NO: 17966 - DNA, 25 bp, Homo sapiens
cgagtggggtttgaaggcagccggc

SEQ ID NO: 17967 - DNA, 25 bp, Homo sapiens
cccagcccaggagcgctatttattg

SEQ ID NO: 17968 - DNA, 25 bp, Homo sapiens
ggttccgccattatgatttcagaca

SEQ ID NO: 17969 - DNA, 25 bp, Homo sapiens
cggagcgggtgagatcggctttcgc

SEQ ID NO: 17970 - DNA, 25 bp, Homo sapiens
tgcggcctccacttggaaagttctc

SEQ ID NO: 17971 - DNA, 25 bp, Homo sapiens
gcttctagaagcatctgggccaggg

SEQ ID NO: 17972 - DNA, 25 bp, Homo sapiens
ggctcatggctggataatttcccta

SEQ ID NO: 17973 - DNA, 25 bp, Homo sapiens
aacaacccaagcaagcttcgcatcc

SEQ ID NO: 17974 - DNA, 25 bp, Homo sapiens
cttcgcatcctcgttttatttttgg

SEQ ID NO: 17975 - DNA, 25 bp, Homo sapiens
ccagatcacaaagccaaccatgccc

SEQ ID NO: 17976 - DNA, 25 bp, Homo sapiens
cacgaccatcgttctgaattctgac

SEQ ID NO: 17977 - DNA, 25 bp, Homo sapiens
tgaattctgacgacaccgtgagcct

SEQ ID NO: 17978 - DNA, 25 bp, Homo sapiens
gcctgcctttgtacttcaaactcat

SEQ ID NO: 17979 - DNA, 25 bp, Homo sapiens
taaatattcaacaccaatgatctac

SEQ ID NO: 17980 - DNA, 25 bp, Homo sapiens
ttatatctactcttcgcacactaaa

SEQ ID NO: 17981 - DNA, 25 bp, Homo sapiens
taatgtctacatgtgttagggagga

SEQ ID NO: 17982 - DNA, 25 bp, Homo sapiens
atgtgatgaactgtagcccaagccc

SEQ ID NO: 17983 - DNA, 25 bp, Homo sapiens
aaatctaccataggaatgttagtta

SEQ ID NO: 17984 - DNA, 25 bp, Homo sapiens
catttaaatctctgtactatgcatt

SEQ ID NO: 17985 - DNA, 25 bp, Homo sapiens
ctctgtactatgcatttttgtttca

SEQ ID NO: 17986 - DNA, 25 bp, Homo sapiens
aaagcaggccctatgactattgttt

SEQ ID NO: 17987 - DNA, 25 bp, Homo sapiens
ggccctatgactattgttttcaaaa

SEQ ID NO: 17988 - DNA, 25 bp, Homo sapiens
taaataattcagaggggtttttcat

SEQ ID NO: 17989 - DNA, 25 bp, Homo sapiens
taacaggattgcacctatcaatttc

SEQ ID NO: 17990 - DNA, 25 bp, Homo sapiens
ctccgaggcagtgaccagaacgtgg

SEQ ID NO: 17991 - DNA, 25 bp, Homo sapiens
agaacgtggtctcaaggtggtgggg

SEQ ID NO: 17992 - DNA, 25 bp, Homo sapiens
caaggtggtgggggctatgggggct

SEQ ID NO: 17993 - DNA, 25 bp, Homo sapiens
ggctatgggggctgcagggggtagc

SEQ ID NO: 17994 - DNA, 25 bp, Homo sapiens
tgggggctgcagggggtagccctgc

SEQ ID NO: 17995 - DNA, 25 bp, Homo sapiens
cactttgtcacgggagcccagggta

SEQ ID NO: 17996 - DNA, 25 bp, Homo sapiens
tgcactgcgggctaaacatgtttcc

SEQ ID NO: 17997 - DNA, 25 bp, Homo sapiens
ctctcgcctgctctcagcaggaagg

SEQ ID NO: 17998 - DNA, 25 bp, Homo sapiens
ggcccggggtggtgaagtagctgga

SEQ ID NO: 17999 - DNA, 25 bp, Homo sapiens
gtgaagtagctggagcccgatcaca

SEQ ID NO: 18000 - DNA, 25 bp, Homo sapiens
caccttctagatgaccccttaataa

SEQ ID NO: 18001 - DNA, 25 bp, Homo sapiens
ggatctagcatatttcactattctg

SEQ ID NO: 18002 - DNA, 25 bp, Homo sapiens
tgctttttcctgtctggcatggaat

SEQ ID NO: 18003 - DNA, 25 bp, Homo sapiens
ctggcatggaatcacgcagtcacct

SEQ ID NO: 18004 - DNA, 25 bp, Homo sapiens
tgcatgttcatctgaggtgccacat

SEQ ID NO: 18005 - DNA, 25 bp, Homo sapiens
ggtgccacatgggccagttgatcag

SEQ ID NO: 18006 - DNA, 25 bp, Homo sapiens
aatccatagtaattggctgtgctct

SEQ ID NO: 18007 - DNA, 25 bp, Homo sapiens
gaaaactctgacaaggccatcaagc

SEQ ID NO: 18008 - DNA, 25 bp, Homo sapiens
aaggagctggttccaaaactctgca

SEQ ID NO: 18009 - DNA, 25 bp, Homo sapiens
gcagattcaattagtcttcaaacct

SEQ ID NO: 18010 - DNA, 25 bp, Homo sapiens
ggtataaccacttagttgacactga

SEQ ID NO: 18011 - DNA, 25 bp, Homo sapiens
tattccatcaagtatcttcagtttt

SEQ ID NO: 18012 - DNA, 25 bp, Homo sapiens
atcgcaccgtttccagaagctgcgt

SEQ ID NO: 18013 - DNA, 25 bp, Homo sapiens
gaagctgcgttgccaacgtcacatc

SEQ ID NO: 18014 - DNA, 25 bp, Homo sapiens
aaaatagtgttgacatccctgcctg

SEQ ID NO: 18015 - DNA, 25 bp, Homo sapiens
ttgagcaagccaagcatgccagcac

SEQ ID NO: 18016 - DNA, 25 bp, Homo sapiens
tgccagcacctaccgagaagctgcc

SEQ ID NO: 18017 - DNA, 25 bp, Homo sapiens
ggagcagtcctgcgttaactgcggc

SEQ ID NO: 18018 - DNA, 25 bp, Homo sapiens
actgcggccgggaggctatgagcga

SEQ ID NO: 18019 - DNA, 25 bp, Homo sapiens
tgccacaaggtcaactactgctcca

SEQ ID NO: 18020 - DNA, 25 bp, Homo sapiens
aaggatcaccagcacatatgcggcc

SEQ ID NO: 18021 - DNA, 25 bp, Homo sapiens
ccaggcagacgaagtccacgtggct

SEQ ID NO: 18022 - DNA, 25 bp, Homo sapiens
agaaggtgaccgtgtgaggctccat

SEQ ID NO: 18023 - DNA, 25 bp, Homo sapiens
catgcggggcgacatgcaacttttc

SEQ ID NO: 18024 - DNA, 25 bp, Homo sapiens
cttttccagaccttctggtttctct

SEQ ID NO: 18025 - DNA, 25 bp, Homo sapiens
tggtttctctaccataagggccacc

SEQ ID NO: 18026 - DNA, 25 bp, Homo sapiens
gccaaggccactgttttgctagggc

SEQ ID NO: 18027 - DNA, 25 bp, Homo sapiens
cccaaatgctgctgtggttcaacca

SEQ ID NO: 18028 - DNA, 25 bp, Homo sapiens
ggttcaaccaggcaagatcatccgg

SEQ ID NO: 18029 - DNA, 25 bp, Homo sapiens
tccggtgaaagaaccagtccctggg

SEQ ID NO: 18030 - DNA, 25 bp, Homo sapiens
atatgggagggggtttggctgcctg

SEQ ID NO: 18031 - DNA, 25 bp, Homo sapiens
gcccaggagctagactgccttgagg

SEQ ID NO: 18032 - DNA, 25 bp, Homo sapiens
ctgctgtcctttcacagccatggag

SEQ ID NO: 18033 - DNA, 25 bp, Homo sapiens
agaggcctaagttgacactgccctg

SEQ ID NO: 18034 - DNA, 25 bp, Homo sapiens
gggctatatcagaatacattgcaac

SEQ ID NO: 18035 - DNA, 25 bp, Homo sapiens
aagattggtgctttttgcatgtttg

SEQ ID NO: 18036 - DNA, 25 bp, Homo sapiens
acccattttcatgaacttactgcct

SEQ ID NO: 18037 - DNA, 25 bp, Homo sapiens
tactgccttggccaatcagatacca

SEQ ID NO: 18038 - DNA, 25 bp, Homo sapiens
acagcactcaccactgaagagacct

SEQ ID NO: 18039 - DNA, 25 bp, Homo sapiens
agagaccttaactatgctttatcag

SEQ ID NO: 18040 - DNA, 25 bp, Homo sapiens
aggtgtctgtgatcaaagttttggg

SEQ ID NO: 18041 - DNA, 25 bp, Homo sapiens
ttgggattcatgttgcagagcttgc

SEQ ID NO: 18042 - DNA, 25 bp, Homo sapiens
gcagagcttgctaatttccctaagc

SEQ ID NO: 18043 - DNA, 25 bp, Homo sapiens
gagtgtgctaaacagaaagccctgg

SEQ ID NO: 18044 - DNA, 25 bp, Homo sapiens
agccctggaacttgaggagtttcag

SEQ ID NO: 18045 - DNA, 25 bp, Homo sapiens
ttgaggaggttgttcatcatgatca

SEQ ID NO: 18046 - DNA, 25 bp, Homo sapiens
gatcacaacaaggaacggggctcgt

SEQ ID NO: 18047 - DNA, 25 bp, Homo sapiens
gggctcgtttatcaccagtgaggag

SEQ ID NO: 18048 - DNA, 25 bp, Homo sapiens
gaatttggattcagccgcgaagaga

SEQ ID NO: 18049 - DNA, 25 bp, Homo sapiens
agagatttatcagcttaactcagat

SEQ ID NO: 18050 - DNA, 25 bp, Homo sapiens
caggcccacggctcaagtgaatttg

SEQ ID NO: 18051 - DNA, 25 bp, Homo sapiens
gtgtcctaccactctaatcaagaaa

SEQ ID NO: 18052 - DNA, 25 bp, Homo sapiens
attacagactctgattctacagtga

SEQ ID NO: 18053 - DNA, 25 bp, Homo sapiens
gaaggcagagtggtgtcaaatcttt

SEQ ID NO: 18054 - DNA, 25 bp, Homo sapiens
gtcaaatctttgacggcacagatgc

SEQ ID NO: 18055 - DNA, 25 bp, Homo sapiens
acggcacagatgcctgtgtgactcc

SEQ ID NO: 18056 - DNA, 25 bp, Homo sapiens
ctacctcactagtagttcacgtgat

SEQ ID NO: 18057 - DNA, 25 bp, Homo sapiens
gtagttcacgtgatgtctgacagat

SEQ ID NO: 18058 - DNA, 25 bp, Homo sapiens
tgagatactcttgtgaggtcactct

SEQ ID NO: 18059 - DNA, 25 bp, Homo sapiens
cttgtgaggtcactctaatgccctg

SEQ ID NO: 18060 - DNA, 25 bp, Homo sapiens
taagctttcatattctagccttcag

SEQ ID NO: 18061 - DNA, 25 bp, Homo sapiens
catattctagccttcagtcttgttc

SEQ ID NO: 18062 - DNA, 25 bp, Homo sapiens
cagtcttgttcttcaaccattttta

SEQ ID NO: 18063 - DNA, 25 bp, Homo sapiens
ttaggaactttcccataaggttatg

SEQ ID NO: 18064 - DNA, 25 bp, Homo sapiens
ataaggttatgttttccagcccagg

SEQ ID NO: 18065 - DNA, 25 bp, Homo sapiens
tccagcccaggcatggaggatcact

SEQ ID NO: 18066 - DNA, 25 bp, Homo sapiens
ggccacagtgaattaggattgcacc

SEQ ID NO: 18067 - DNA, 25 bp, Homo sapiens
tatggtagttattctgccttccagt

SEQ ID NO: 18068 - DNA, 25 bp, Homo sapiens
atttatttacactcttgattctaca

SEQ ID NO: 18069 - DNA, 25 bp, Homo sapiens
agagtgattggttgcatccaggcct

SEQ ID NO: 18070 - DNA, 25 bp, Homo sapiens
catccaggccttttgtcttggtgtt

SEQ ID NO: 18071 - DNA, 25 bp, Homo sapiens
ttgtcttggtgttcatgatctccct

SEQ ID NO: 18072 - DNA, 25 bp, Homo sapiens
tccctctaagcacattccaaacttt

SEQ ID NO: 18073 - DNA, 25 bp, Homo sapiens
gtgttggctcactacgtagagtcca

SEQ ID NO: 18074 - DNA, 25 bp, Homo sapiens
gggacagtcagttttagggttgcct

SEQ ID NO: 18075 - DNA, 25 bp, Homo sapiens
gcctgtatccagtaactcggggcct

SEQ ID NO: 18076 - DNA, 25 bp, Homo sapiens
gatttctcctcaggctggtagcaag

SEQ ID NO: 18077 - DNA, 25 bp, Homo sapiens
gttctggatcttatacccaacacac

SEQ ID NO: 18078 - DNA, 25 bp, Homo sapiens
ctggatacagaggacatggtgcggc

SEQ ID NO: 18079 - DNA, 25 bp, Homo sapiens
aggacatggtgcggcttcgagagcc

SEQ ID NO: 18080 - DNA, 25 bp, Homo sapiens
atggtgcggcttcgagagcctgact

SEQ ID NO: 18081 - DNA, 25 bp, Homo sapiens
tgcggcttcgagagcctgactggaa

SEQ ID NO: 18082 - DNA, 25 bp, Homo sapiens
gcctgactggaagtgcgtgtacacg

SEQ ID NO: 18083 - DNA, 25 bp, Homo sapiens
ggaagtgcgtgtacacgtacatcca

SEQ ID NO: 18084 - DNA, 25 bp, Homo sapiens
acatccaggaattctaccgctgtct

SEQ ID NO: 18085 - DNA, 25 bp, Homo sapiens
ccaggaattctaccgctgtctggtc

SEQ ID NO: 18086 - DNA, 25 bp, Homo sapiens
tctaccgctgtctggtccaaaaggg

SEQ ID NO: 18087 - DNA, 25 bp, Homo sapiens
taccgctgtctggtccaaaaggggt

SEQ ID NO: 18088 - DNA, 25 bp, Homo sapiens
gctgtctggtccaaaaggggttggt

SEQ ID NO: 18089 - DNA, 25 bp, Homo sapiens
gctatgtactcctctgacacaaggg

SEQ ID NO: 18090 - DNA, 25 bp, Homo sapiens
agctgagcatggagtgttgtcccgc

SEQ ID NO: 18091 - DNA, 25 bp, Homo sapiens
ccagtgaggacccttaccagctgga

SEQ ID NO: 18092 - DNA, 25 bp, Homo sapiens
tgcctgccctgcagtcagaagtgcc

SEQ ID NO: 18093 - DNA, 25 bp, Homo sapiens
gcacacaccagtggttggacggctc

SEQ ID NO: 18094 - DNA, 25 bp, Homo sapiens
tggacggctcagactgtgtactcca

SEQ ID NO: 18095 - DNA, 25 bp, Homo sapiens
tgcctgctgcattacatgcctcagg

SEQ ID NO: 18096 - DNA, 25 bp, Homo sapiens
ccccctgcaggcaaatctcacaagg

SEQ ID NO: 18097 - DNA, 25 bp, Homo sapiens
ggaggatggcttcctactggtagcc

SEQ ID NO: 18098 - DNA, 25 bp, Homo sapiens
gcccctctgtcattttgcaggacag

SEQ ID NO: 18099 - DNA, 25 bp, Homo sapiens
gaggaaactccaggccatggtgatt

SEQ ID NO: 18100 - DNA, 25 bp, Homo sapiens
tggtcattgtacagcttgtctcact

SEQ ID NO: 18101 - DNA, 25 bp, Homo sapiens
gtagctggtagggttggatgtgtgt

SEQ ID NO: 18102 - DNA, 25 bp, Homo sapiens
agttatagtggtcacacctcatcta

SEQ ID NO: 18103 - DNA, 25 bp, Homo sapiens
acctcatctatttactgttactcag

SEQ ID NO: 18104 - DNA, 25 bp, Homo sapiens
tttacacaagcattggctagccttt

SEQ ID NO: 18105 - DNA, 25 bp, Homo sapiens
tggctagcctttttaacctggtcag

SEQ ID NO: 18106 - DNA, 25 bp, Homo sapiens
acatttcccaagtccatgctttaaa

SEQ ID NO: 18107 - DNA, 25 bp, Homo sapiens
gaggtgatgccaacaagacaggtga

SEQ ID NO: 18108 - DNA, 25 bp, Homo sapiens
acctcataggtgtctagcctctaca

SEQ ID NO: 18109 - DNA, 25 bp, Homo sapiens
agcctctacagttctggctgtagtt

SEQ ID NO: 18110 - DNA, 25 bp, Homo sapiens
gctgtagttatgaccttggcttccc

SEQ ID NO: 18111 - DNA, 25 bp, Homo sapiens
ttcttttttatattgtcctccacct

SEQ ID NO: 18112 - DNA, 25 bp, Homo sapiens
aagatagggcttttgctcccttgtt

SEQ ID NO: 18113 - DNA, 25 bp, Homo sapiens
gctcccttgttcttggagggaccat

SEQ ID NO: 18114 - DNA, 25 bp, Homo sapiens
agggaccattattacatctctgaac

SEQ ID NO: 18115 - DNA, 25 bp, Homo sapiens
atctctgaactacctttgtatccaa

SEQ ID NO: 18116 - DNA, 25 bp, Homo sapiens
ccttaaatgaattgctttctcccaa

SEQ ID NO: 18117 - DNA, 25 bp, Homo sapiens
gaagcacccacttttgcaatgttgt

SEQ ID NO: 18118 - DNA, 25 bp, Homo sapiens
gcaatgttgttctaagctatctatc

SEQ ID NO: 18119 - DNA, 25 bp, Homo sapiens
ctctcagcccatgataaagttcctt

SEQ ID NO: 18120 - DNA, 25 bp, Homo sapiens
atcaaggacaagccaccctagtgtc

SEQ ID NO: 18121 - DNA, 25 bp, Homo sapiens
ccaccctagtgtctcatgtttgtat

SEQ ID NO: 18122 - DNA, 25 bp, Homo sapiens
tgtgtacgctagttttcatttttgc

SEQ ID NO: 18123 - DNA, 25 bp, Homo sapiens
tggttcgcccagtagtcttgtggat

SEQ ID NO: 18124 - DNA, 25 bp, Homo sapiens
agagacatcctttctgaatacttct

SEQ ID NO: 18125 - DNA, 25 bp, Homo sapiens
agtgtcagccaccttgtactaagct

SEQ ID NO: 18126 - DNA, 25 bp, Homo sapiens
ggacggagactttgacctactccac

SEQ ID NO: 18127 - DNA, 25 bp, Homo sapiens
gaagtgactatgcctgagtcccagg

SEQ ID NO: 18128 - DNA, 25 bp, Homo sapiens
ttctcatctttggcctgttcaatga

SEQ ID NO: 18129 - DNA, 25 bp, Homo sapiens
atgaaaccattgtttgcccatctct

SEQ ID NO: 18130 - DNA, 25 bp, Homo sapiens
tagtggaactttaggtctcttttca

SEQ ID NO: 18131 - DNA, 25 bp, Homo sapiens
gtctcctcagtcatcaatagttcct

SEQ ID NO: 18132 - DNA, 25 bp, Homo sapiens
ttgatgttgggtggcttttgttctt

SEQ ID NO: 18133 - DNA, 25 bp, Homo sapiens
tatagcaagagccctgggcaacccc

SEQ ID NO: 18134 - DNA, 25 bp, Homo sapiens
ccccaaacctagtcctggtagctga

SEQ ID NO: 18135 - DNA, 25 bp, Homo sapiens
gtagctgagcaccctgtaaggcagg

SEQ ID NO: 18136 - DNA, 25 bp, Homo sapiens
gaggaagaagcctgatccatcacca

SEQ ID NO: 18137 - DNA, 25 bp, Homo sapiens
ccatcaccatctgcttgactatgta

SEQ ID NO: 18138 - DNA, 25 bp, Homo sapiens
tgactatgtagcttggattctcctt

SEQ ID NO: 18139 - DNA, 25 bp, Homo sapiens
gatttggctttaccttcatctatct

SEQ ID NO: 18140 - DNA, 25 bp, Homo sapiens
ttgatcctttcctggccaaatatcc

SEQ ID NO: 18141 - DNA, 25 bp, Homo sapiens
gtgctgtagcttgatcttccttagc

SEQ ID NO: 18142 - DNA, 25 bp, Homo sapiens
ggtggtatcgtagtgccttttgatt

SEQ ID NO: 18143 - DNA, 25 bp, Homo sapiens
ttctttggatctatttggcctctca

SEQ ID NO: 18144 - DNA, 25 bp, Homo sapiens
gaggctggatggacttgctcaagtt

SEQ ID NO: 18145 - DNA, 25 bp, Homo sapiens
aagagaggtccagagtcctggccct

SEQ ID NO: 18146 - DNA, 25 bp, Homo sapiens
atgccgagctcatgccacaaagctc

SEQ ID NO: 18147 - DNA, 25 bp, Homo sapiens
gttccagtggatgagggccagccag

SEQ ID NO: 18148 - DNA, 25 bp, Homo sapiens
ggaagcacaggtccaaggctggtcc

SEQ ID NO: 18149 - DNA, 25 bp, Homo sapiens
tcccacacttatcagcagcaacaac

SEQ ID NO: 18150 - DNA, 25 bp, Homo sapiens
acaactgtcagttcatcctgcatgg

SEQ ID NO: 18151 - DNA, 25 bp, Homo sapiens
atggggctactgtttcagtcctaac

SEQ ID NO: 18152 - DNA, 25 bp, Homo sapiens
ctgtgacccaagaactcctgaaatc

SEQ ID NO: 18153 - DNA, 25 bp, Homo sapiens
gccctgtcattcgtggttgatttca

SEQ ID NO: 18154 - DNA, 25 bp, Homo sapiens
atacactcaagtgccattcatcctt

SEQ ID NO: 18155 - DNA, 25 bp, Homo sapiens
agcaaggtagaggaaggagtcccag

SEQ ID NO: 18156 - DNA, 25 bp, Homo sapiens
gagagtagcagaaggcttttgattt

SEQ ID NO: 18157 - DNA, 25 bp, Homo sapiens
ttgcctgaggcttgaatctgacaaa

SEQ ID NO: 18158 - DNA, 25 bp, Homo sapiens
ttgaatctgacaaacccttggtggg

SEQ ID NO: 18159 - DNA, 25 bp, Homo sapiens
tgaaggttaacccttcacctgctgt

SEQ ID NO: 18160 - DNA, 25 bp, Homo sapiens
cagccacctgtgggtatttatgagt

SEQ ID NO: 18161 - DNA, 25 bp, Homo sapiens
gtttcatatgaagtactgtgcccct

SEQ ID NO: 18162 - DNA, 25 bp, Homo sapiens
ttcctgaaggtcctcactgtttgca

SEQ ID NO: 18163 - DNA, 25 bp, Homo sapiens
cactgtttgcatatcgctcaggcca

SEQ ID NO: 18164 - DNA, 25 bp, Homo sapiens
tccagctgtgatgggttatatcata

SEQ ID NO: 18165 - DNA, 25 bp, Homo sapiens
atatcataaatgcagcttggggttg

SEQ ID NO: 18166 - DNA, 25 bp, Homo sapiens
atagtaccagtaggggcttataata

SEQ ID NO: 18167 - DNA, 25 bp, Homo sapiens
ttttttacattttttgggcagcaat

SEQ ID NO: 18168 - DNA, 25 bp, Homo sapiens
gactatgtaaactacttctcttgtt

SEQ ID NO: 18169 - DNA, 25 bp, Homo sapiens
ttcacctagatttttttcccaattg

SEQ ID NO: 18170 - DNA, 25 bp, Homo sapiens
aaaacataatcactctatttgaaga

SEQ ID NO: 18171 - DNA, 25 bp, Homo sapiens
aaatatcttgttttctgccaataga

SEQ ID NO: 18172 - DNA, 25 bp, Homo sapiens
gtagtcagcaaaatgggggtgggga

SEQ ID NO: 18173 - DNA, 25 bp, Homo sapiens
gggtggggaagcagagcatgtccta

SEQ ID NO: 18174 - DNA, 25 bp, Homo sapiens
ggaagcagagcatgtcctagttcaa

SEQ ID NO: 18175 - DNA, 25 bp, Homo sapiens
gagcatgtcctagttcaatgttgac

SEQ ID NO: 18176 - DNA, 25 bp, Homo sapiens
gacataaaattctttcactttggca

SEQ ID NO: 18177 - DNA, 25 bp, Homo sapiens
aatttgcagctgccttcttggcatt

SEQ ID NO: 18178 - DNA, 25 bp, Homo sapiens
ggcattcattttcatactggcagct

SEQ ID NO: 18179 - DNA, 25 bp, Homo sapiens
tgtgtgtgtgcccaccagtggagac

SEQ ID NO: 18180 - DNA, 25 bp, Homo sapiens
gatgtaagatcccctgcaactggaa

SEQ ID NO: 18181 - DNA, 25 bp, Homo sapiens
gagtgcaaataccagttccaggcct

SEQ ID NO: 18182 - DNA, 25 bp, Homo sapiens
tgacctgaacacagccctgaagacc

SEQ ID NO: 18183 - DNA, 25 bp, Homo sapiens
aactggaagtctgaagcgagccctg

SEQ ID NO: 18184 - DNA, 25 bp, Homo sapiens
ccctgcacaatgccgaatgccagaa

SEQ ID NO: 18185 - DNA, 25 bp, Homo sapiens
tgccagaagactgtcaccatctcca

SEQ ID NO: 18186 - DNA, 25 bp, Homo sapiens
catctccaagccctgtggcaaactg

SEQ ID NO: 18187 - DNA, 25 bp, Homo sapiens
accaagcccaaacctcaagcagaat

SEQ ID NO: 18188 - DNA, 25 bp, Homo sapiens
gactagtcatgcatcatcagtaatt

SEQ ID NO: 18189 - DNA, 25 bp, Homo sapiens
gggtactactagggatatctgtggc

SEQ ID NO: 18190 - DNA, 25 bp, Homo sapiens
gattatgcattccgtagtattattt

SEQ ID NO: 18191 - DNA, 25 bp, Homo sapiens
taatttggggttcattttgcttcct

SEQ ID NO: 18192 - DNA, 25 bp, Homo sapiens
tgcttccttttctttatgcttagat

SEQ ID NO: 18193 - DNA, 25 bp, Homo sapiens
gattatcttactggttcaacatttt

SEQ ID NO: 18194 - DNA, 25 bp, Homo sapiens
tatagtatttcagttccgtgtctta

SEQ ID NO: 18195 - DNA, 25 bp, Homo sapiens
gttccgtgtcttaacagtttgtgat

SEQ ID NO: 18196 - DNA, 25 bp, Homo sapiens
gttgacacttttggcttttatttct

SEQ ID NO: 18197 - DNA, 25 bp, Homo sapiens
ttcacagagtgctttgtagcaggca

SEQ ID NO: 18198 - DNA, 25 bp, Homo sapiens
cagcttgatggtggcgtttttgaaa

SEQ ID NO: 18199 - DNA, 25 bp, Homo sapiens
tacaaataagcacactaacccctcg

SEQ ID NO: 18200 - DNA, 25 bp, Homo sapiens
aagttttaatggattgcacctctgt

SEQ ID NO: 18201 - DNA, 25 bp, Homo sapiens
tgcacctctgtaaactattcctaaa

SEQ ID NO: 18202 - DNA, 25 bp, Homo sapiens
taatagctttgcttgcagccttcca

SEQ ID NO: 18203 - DNA, 25 bp, Homo sapiens
gcagccttccaatctatgttggttt

SEQ ID NO: 18204 - DNA, 25 bp, Homo sapiens
tgttggtttacctgtagtgttttat

SEQ ID NO: 18205 - DNA, 25 bp, Homo sapiens
agtcattttaaccgaatgttcattc

SEQ ID NO: 18206 - DNA, 25 bp, Homo sapiens
gaatgctgtaaagtgtcttctaaaa

SEQ ID NO: 18207 - DNA, 25 bp, Homo sapiens
gtcttctaaaatgatgtagcctgac

SEQ ID NO: 18208 - DNA, 25 bp, Homo sapiens
gtattgtgcactgatttgaccattg

SEQ ID NO: 18209 - DNA, 25 bp, Homo sapiens
atttgaccattgtgaaatcctttct

SEQ ID NO: 18210 - DNA, 25 bp, Homo sapiens
ggagatacattggaagatcccttca

SEQ ID NO: 18211 - DNA, 25 bp, Homo sapiens
acagcacagaaaatgactcaccaac

SEQ ID NO: 18212 - DNA, 25 bp, Homo sapiens
aagggaccctgcaggagtttcacac

SEQ ID NO: 18213 - DNA, 25 bp, Homo sapiens
agtgcatcacacaggtattgctttt

SEQ ID NO: 18214 - DNA, 25 bp, Homo sapiens
taacaccactggctacaatgatcgt

SEQ ID NO: 18215 - DNA, 25 bp, Homo sapiens
atgatcgtgctgtattggagagaga

SEQ ID NO: 18216 - DNA, 25 bp, Homo sapiens
gagagaagtccaatacactctggaa

SEQ ID NO: 18217 - DNA, 25 bp, Homo sapiens
gattttgcaggatcgtggtctttcc

SEQ ID NO: 18218 - DNA, 25 bp, Homo sapiens
tctttccaaatatcctaatctgtta

SEQ ID NO: 18219 - DNA, 25 bp, Homo sapiens
ttacaaccaagtcatagttccccct

SEQ ID NO: 18220 - DNA, 25 bp, Homo sapiens
taattgcctttcttgtggatatcta

SEQ ID NO: 18221 - DNA, 25 bp, Homo sapiens
gtttgtgcgtttttgcttcattaaa

SEQ ID NO: 18222 - DNA, 25 bp, Homo sapiens
ggcatggagtgtacagaagtcttga

SEQ ID NO: 18223 - DNA, 25 bp, Homo sapiens
taatgtttctgttagatgacctagt

SEQ ID NO: 18224 - DNA, 25 bp, Homo sapiens
tccaaagcagttaacccaactccta

SEQ ID NO: 18225 - DNA, 25 bp, Homo sapiens
caacattttcgggggatctgacctt

SEQ ID NO: 18226 - DNA, 25 bp, Homo sapiens
taacacaccttccacaatcatttta

SEQ ID NO: 18227 - DNA, 25 bp, Homo sapiens
gtgagatgtttaacctctcagtaac

SEQ ID NO: 18228 - DNA, 25 bp, Homo sapiens
tctcagtaactcggttctctcatta

SEQ ID NO: 18229 - DNA, 25 bp, Homo sapiens
gtttcatatgaaggtcgtttctgag

SEQ ID NO: 18230 - DNA, 25 bp, Homo sapiens
aagcctggcaaacaataaacactca

SEQ ID NO: 18231 - DNA, 25 bp, Homo sapiens
atccccgtttcagcattctgtaact

SEQ ID NO: 18232 - DNA, 25 bp, Homo sapiens
ttaaagccaagccacatcttatttt

SEQ ID NO: 18233 - DNA, 25 bp, Homo sapiens
gtggagtggcatgcttttgccctat

SEQ ID NO: 18234 - DNA, 25 bp, Homo sapiens
gcttttgccctatcgtggaatttac

SEQ ID NO: 18235 - DNA, 25 bp, Homo sapiens
gggctttgtttgcttattccatgaa

SEQ ID NO: 18236 - DNA, 25 bp, Homo sapiens
gcagcagctatagaccttaccatgg

SEQ ID NO: 18237 - DNA, 25 bp, Homo sapiens
ggattgctgcaagagttacctgttg

SEQ ID NO: 18238 - DNA, 25 bp, Homo sapiens
gtgatgtttcattctgaccttgtcc

SEQ ID NO: 18239 - DNA, 25 bp, Homo sapiens
gctctccatctctagatctggggac

SEQ ID NO: 18240 - DNA, 25 bp, Homo sapiens
atctggggactgactgttgagctga

SEQ ID NO: 18241 - DNA, 25 bp, Homo sapiens
aagctctcacacaaaccggaagcca

SEQ ID NO: 18242 - DNA, 25 bp, Homo sapiens
aatgtcccctatctcttgaatgatc

SEQ ID NO: 18243 - DNA, 25 bp, Homo sapiens
tgaaaaagttctgtgctcagccttg

SEQ ID NO: 18244 - DNA, 25 bp, Homo sapiens
gaatactgcttttctggtacctaca

SEQ ID NO: 18245 - DNA, 25 bp, Homo sapiens
ccttctgcaaggctatcatttcaca

SEQ ID NO: 18246 - DNA, 25 bp, Homo sapiens
gggagcacatccatttcattggcaa

SEQ ID NO: 18247 - DNA, 25 bp, Homo sapiens
cattggcaagatccagggcagcgac

SEQ ID NO: 18248 - DNA, 25 bp, Homo sapiens
gctggactttgggctacatgctgaa

SEQ ID NO: 18249 - DNA, 25 bp, Homo sapiens
tgatcccagctgagcaaccattgtc

SEQ ID NO: 18250 - DNA, 25 bp, Homo sapiens
gccatcataggcttgcttatctttc

SEQ ID NO: 18251 - DNA, 25 bp, Homo sapiens
ctttcacaagccttcatatttctgg

SEQ ID NO: 18252 - DNA, 25 bp, Homo sapiens
aaaatcgtccagggagcattttcct

SEQ ID NO: 18253 - DNA, 25 bp, Homo sapiens
tccatcgcagtgttcaaggccatcc

SEQ ID NO: 18254 - DNA, 25 bp, Homo sapiens
tggagaagctgcttccgcagctgct

SEQ ID NO: 18255 - DNA, 25 bp, Homo sapiens
gacttctagggatctcagacgtggc

SEQ ID NO: 18256 - DNA, 25 bp, Homo sapiens
cccctggtccacagaagcaggcctt

SEQ ID NO: 18257 - DNA, 25 bp, Homo sapiens
caagatctctgggagtctccagcct

SEQ ID NO: 18258 - DNA, 25 bp, Homo sapiens
tgcactgcgggccttggaagtgtcc

SEQ ID NO: 18259 - DNA, 25 bp, Homo sapiens
gggacaatagtgtgcatgccacccg

SEQ ID NO: 18260 - DNA, 25 bp, Homo sapiens
gcaggtagcctgtgtgtttgacaaa

SEQ ID NO: 18261 - DNA, 25 bp, Homo sapiens
ctgccacccgacatcaaagctggcg

SEQ ID NO: 18262 - DNA, 25 bp, Homo sapiens
aaagctggcgtgtgacctttccagc

SEQ ID NO: 18263 - DNA, 25 bp, Homo sapiens
atattccccttggaagatgcttccc

SEQ ID NO: 18264 - DNA, 25 bp, Homo sapiens
gatgcttccccaggctataaatttg

SEQ ID NO: 18265 - DNA, 25 bp, Homo sapiens
gaagacggactttaaggcccagctg

SEQ ID NO: 18266 - DNA, 25 bp, Homo sapiens
gaacgcgtgctctgagatctacatt

SEQ ID NO: 18267 - DNA, 25 bp, Homo sapiens
gtccttgcaggtggctgccaatacc

SEQ ID NO: 18268 - DNA, 25 bp, Homo sapiens
cactgactcggatccgcaacaactc

SEQ ID NO: 18269 - DNA, 25 bp, Homo sapiens
gagtcttcagggtcacacccaagta

SEQ ID NO: 18270 - DNA, 25 bp, Homo sapiens
tatggctcttcgcatgctgagtact

SEQ ID NO: 18271 - DNA, 25 bp, Homo sapiens
gagtactggacctcggaccagagcc

SEQ ID NO: 18272 - DNA, 25 bp, Homo sapiens
ggaagcccaaaggactctgcattga

SEQ ID NO: 18273 - DNA, 25 bp, Homo sapiens
gggtaattgtctcttggtgggccca

SEQ ID NO: 18274 - DNA, 25 bp, Homo sapiens
ggccttcctgagtgtgtgtatgcgg

SEQ ID NO: 18275 - DNA, 25 bp, Homo sapiens
gtatgcggtctgtaactattgccat

SEQ ID NO: 18276 - DNA, 25 bp, Homo sapiens
ggatgaaatgccagtgccggattct

SEQ ID NO: 18277 - DNA, 25 bp, Homo sapiens
tcattatccctggaagcgttcttct

SEQ ID NO: 18278 - DNA, 25 bp, Homo sapiens
gcgttcttctatggcgaatagcccc

SEQ ID NO: 18279 - DNA, 25 bp, Homo sapiens
ggagagtgtgattcccaagacagac

SEQ ID NO: 18280 - DNA, 25 bp, Homo sapiens
caagacagactgcaggttacggcct

SEQ ID NO: 18281 - DNA, 25 bp, Homo sapiens
gttacggcctgacatcagagccatg

SEQ ID NO: 18282 - DNA, 25 bp, Homo sapiens
gagcagcccgcaaaaacaggtccaa

SEQ ID NO: 18283 - DNA, 25 bp, Homo sapiens
ggtggttccatcaaggtcctaatcc

SEQ ID NO: 18284 - DNA, 25 bp, Homo sapiens
ggtcctaatccctacaatggagcac

SEQ ID NO: 18285 - DNA, 25 bp, Homo sapiens
ggactggatttactctggcagctac

SEQ ID NO: 18286 - DNA, 25 bp, Homo sapiens
aagtcagggtgtttggctaatctac

SEQ ID NO: 18287 - DNA, 25 bp, Homo sapiens
gtgtttctctcctgaggcaaagccc

SEQ ID NO: 18288 - DNA, 25 bp, Homo sapiens
ttttgtccacttctccagcaaatta

SEQ ID NO: 18289 - DNA, 25 bp, Homo sapiens
ttgtccacttctccagcaaattaga

SEQ ID NO: 18290 - DNA, 25 bp, Homo sapiens
aattagatttgtctctgggaatgtg

SEQ ID NO: 18291 - DNA, 25 bp, Homo sapiens
ttgtctctgggaatgtgtttgtaac

SEQ ID NO: 18292 - DNA, 25 bp, Homo sapiens
gtgtttgtaacataccaacctactg

SEQ ID NO: 18293 - DNA, 25 bp, Homo sapiens
tgtaacataccaacctactgcagac

SEQ ID NO: 18294 - DNA, 25 bp, Homo sapiens
ggagctcccatgttgaatttgtttg

SEQ ID NO: 18295 - DNA, 25 bp, Homo sapiens
ctttcaccaaaactatttcttggcg

SEQ ID NO: 18296 - DNA, 25 bp, Homo sapiens
aactatttcttggcgacctttgaga

SEQ ID NO: 18297 - DNA, 25 bp, Homo sapiens
tcttggcgacctttgagagatttca

SEQ ID NO: 18298 - DNA, 25 bp, Homo sapiens
tagccctgaagtgtgggccccgtac

SEQ ID NO: 18299 - DNA, 25 bp, Homo sapiens
tctgtacccagcggagttagcgcct

SEQ ID NO: 18300 - DNA, 25 bp, Homo sapiens
aagctcacatctaaacagcctgtag

SEQ ID NO: 18301 - DNA, 25 bp, Homo sapiens
gtcagttttgacagtcgctcagaag

SEQ ID NO: 18302 - DNA, 25 bp, Homo sapiens
gaatgctttgaatggcatccgcttc

SEQ ID NO: 18303 - DNA, 25 bp, Homo sapiens
cgcttcgatcctgaaattccgcaaa

SEQ ID NO: 18304 - DNA, 25 bp, Homo sapiens
aattccgcaaacactacgactagag

SEQ ID NO: 18305 - DNA, 25 bp, Homo sapiens
caagaacaaactcgtagggactcca

SEQ ID NO: 18306 - DNA, 25 bp, Homo sapiens
actgtacctcagttcattgccagag

SEQ ID NO: 18307 - DNA, 25 bp, Homo sapiens
gccatatgagctcacagtgcctgca

SEQ ID NO: 18308 - DNA, 25 bp, Homo sapiens
tttaccccagtagccctgaagtgtg

SEQ ID NO: 18309 - DNA, 25 bp, Homo sapiens
tggaggaatttcacaagcacccgcc

SEQ ID NO: 18310 - DNA, 25 bp, Homo sapiens
cgcccttcccagctggaatatttgt

SEQ ID NO: 18311 - DNA, 25 bp, Homo sapiens
cagcagacaagctgccggaagaggg

SEQ ID NO: 18312 - DNA, 25 bp, Homo sapiens
gagggactggaagaaacccgagtgc

SEQ ID NO: 18313 - DNA, 25 bp, Homo sapiens
aaacccgagtgcaaagtcaggccca

SEQ ID NO: 18314 - DNA, 25 bp, Homo sapiens
ctgcatcaaactgggctctgaggac

SEQ ID NO: 18315 - DNA, 25 bp, Homo sapiens
ccccatagagacccaagttctgcgg

SEQ ID NO: 18316 - DNA, 25 bp, Homo sapiens
gagacccaagttctgcgggaggctg

SEQ ID NO: 18317 - DNA, 25 bp, Homo sapiens
agggtgcagcgggctggtgaggacc

SEQ ID NO: 18318 - DNA, 25 bp, Homo sapiens
agccagcactgagctgcgtggtgcc

SEQ ID NO: 18319 - DNA, 25 bp, Homo sapiens
cgttctatccccagccatgataata

SEQ ID NO: 18320 - DNA, 25 bp, Homo sapiens
tttgtcaggaaaccttggcctctgc

SEQ ID NO: 18321 - DNA, 25 bp, Homo sapiens
gaagtgggagcaccctacagggaca

SEQ ID NO: 18322 - DNA, 25 bp, Homo sapiens
ggacactatcactcatgctggtggc

SEQ ID NO: 18323 - DNA, 25 bp, Homo sapiens
aggcctagcctcttttaacagcctc

SEQ ID NO: 18324 - DNA, 25 bp, Homo sapiens
gacaggcaaatgtacttctcaccca

SEQ ID NO: 18325 - DNA, 25 bp, Homo sapiens
ctcacccagtcttctacacagatgg

SEQ ID NO: 18326 - DNA, 25 bp, Homo sapiens
gcttacctgatctcatgttaggcct

SEQ ID NO: 18327 - DNA, 25 bp, Homo sapiens
taggcctaagaggctttctccagga

SEQ ID NO: 18328 - DNA, 25 bp, Homo sapiens
ggagttctctatactcaggtacctc

SEQ ID NO: 18329 - DNA, 25 bp, Homo sapiens
ttttctaaccctgacacggactgtg

SEQ ID NO: 18330 - DNA, 25 bp, Homo sapiens
tgacacggactgtgcatactttccc

SEQ ID NO: 18331 - DNA, 25 bp, Homo sapiens
attaaccaatactccaagtccttga

SEQ ID NO: 18332 - DNA, 25 bp, Homo sapiens
gttagcttgttagcatatgccctag

SEQ ID NO: 18333 - DNA, 25 bp, Homo sapiens
catatgccctagagggcctccatcc

SEQ ID NO: 18334 - DNA, 25 bp, Homo sapiens
cctccatccctgtattctaatgttt

SEQ ID NO: 18335 - DNA, 25 bp, Homo sapiens
atgtttttactcaaagctctagcct

SEQ ID NO: 18336 - DNA, 25 bp, Homo sapiens
aatcttttatcactttctcaaattc

SEQ ID NO: 18337 - DNA, 25 bp, Homo sapiens
gctggctgacttgccagccacaagc

SEQ ID NO: 18338 - DNA, 25 bp, Homo sapiens
gccacaagctgctcttgcagagttc

SEQ ID NO: 18339 - DNA, 25 bp, Homo sapiens
tgcagagttcttaccattcctgtaa

SEQ ID NO: 18340 - DNA, 25 bp, Homo sapiens
gttgcagaaattcctatctacttta

SEQ ID NO: 18341 - DNA, 25 bp, Homo sapiens
actgtggaaacatcctctcacttgc

SEQ ID NO: 18342 - DNA, 25 bp, Homo sapiens
atgggagttcatttgggctggggtg

SEQ ID NO: 18343 - DNA, 25 bp, Homo sapiens
gagggaagtttcatgattgcatcta

SEQ ID NO: 18344 - DNA, 25 bp, Homo sapiens
atgaatatattgcctgttttgtgaa

SEQ ID NO: 18345 - DNA, 25 bp, Homo sapiens
acatgtccatacctaaaacactcct

SEQ ID NO: 18346 - DNA, 25 bp, Homo sapiens
aaacactcctgagttaagtcccatc

SEQ ID NO: 18347 - DNA, 25 bp, Homo sapiens
ggctggtacccatgataacaattga

SEQ ID NO: 18348 - DNA, 25 bp, Homo sapiens
acaattgagctgaacctggggaccc

SEQ ID NO: 18349 - DNA, 25 bp, Homo sapiens
gagttctatttgagacttccagccc

SEQ ID NO: 18350 - DNA, 25 bp, Homo sapiens
ttgagacttccagccctagaaagct

SEQ ID NO: 18351 - DNA, 25 bp, Homo sapiens
tttgtctcatccttcattctgaata

SEQ ID NO: 18352 - DNA, 25 bp, Homo sapiens
tgaataagatggcagtgttctcctc

SEQ ID NO: 18353 - DNA, 25 bp, Homo sapiens
aagagaggaccatgagaattttaat

SEQ ID NO: 18354 - DNA, 25 bp, Homo sapiens
aatggaccttccaggatttattgtg

SEQ ID NO: 18355 - DNA, 25 bp, Homo sapiens
ggatttattgtggacggatgtggat

SEQ ID NO: 18356 - DNA, 25 bp, Homo sapiens
gatatattctgtacaggaacaacac

SEQ ID NO: 18357 - DNA, 25 bp, Homo sapiens
ggaagtggactgaagcctatgtaga

SEQ ID NO: 18358 - DNA, 25 bp, Homo sapiens
gaagcctatgtagaaacacacacac

SEQ ID NO: 18359 - DNA, 25 bp, Homo sapiens
aaatttaaacatcgtatgcgcataa

SEQ ID NO: 18360 - DNA, 25 bp, Homo sapiens
aaaccagatttcctgtgattctata

SEQ ID NO: 18361 - DNA, 25 bp, Homo sapiens
gatttcctgtgattctatactaata

SEQ ID NO: 18362 - DNA, 25 bp, Homo sapiens
ttttgatataaccctttgcttctta

SEQ ID NO: 18363 - DNA, 25 bp, Homo sapiens
gttgtcgaggctgttcttcaagaat

SEQ ID NO: 18364 - DNA, 25 bp, Homo sapiens
tctccattcgatatcagctcgttcg

SEQ ID NO: 18365 - DNA, 25 bp, Homo sapiens
gctcgttcgactcttctatgatgtc

SEQ ID NO: 18366 - DNA, 25 bp, Homo sapiens
tacctcacagtctctaggattcctg

SEQ ID NO: 18367 - DNA, 25 bp, Homo sapiens
ctttctctgtgatcattggcatcct

SEQ ID NO: 18368 - DNA, 25 bp, Homo sapiens
cagctttttttgcagttatccacac

SEQ ID NO: 18369 - DNA, 25 bp, Homo sapiens
cagttatccacactcacatttcaga

SEQ ID NO: 18370 - DNA, 25 bp, Homo sapiens
gagtcctgactctcaaggaaccact

SEQ ID NO: 18371 - DNA, 25 bp, Homo sapiens
ccagggctaggaacacaggctccac

SEQ ID NO: 18372 - DNA, 25 bp, Homo sapiens
caggctccacggtgacatgtcattt

SEQ ID NO: 18373 - DNA, 25 bp, Homo sapiens
actaagcagggggccacatgctctc

SEQ ID NO: 18374 - DNA, 25 bp, Homo sapiens
gggccacatgctctcaatggagaca

SEQ ID NO: 18375 - DNA, 25 bp, Homo sapiens
acatagtgggtcatcaccctttctc

SEQ ID NO: 18376 - DNA, 25 bp, Homo sapiens
gcttcccaatgagcactcagcagca

SEQ ID NO: 18377 - DNA, 25 bp, Homo sapiens
tgagacctggggcttgacaggcctg

SEQ ID NO: 18378 - DNA, 25 bp, Homo sapiens
aggcctgcgctccttagattaggat

SEQ ID NO: 18379 - DNA, 25 bp, Homo sapiens
aaatgggtcagtgaggggctctcct

SEQ ID NO: 18380 - DNA, 25 bp, Homo sapiens
tcaatctccatctttagggtctcca

SEQ ID NO: 18381 - DNA, 25 bp, Homo sapiens
gaaacctcgaggagctgggctagat

SEQ ID NO: 18382 - DNA, 25 bp, Homo sapiens
gatacttcgagagtagccctgtctt

SEQ ID NO: 18383 - DNA, 25 bp, Homo sapiens
cccctctcactcttgggttggatgc

SEQ ID NO: 18384 - DNA, 25 bp, Homo sapiens
tgggaattacaacccatcactccca

SEQ ID NO: 18385 - DNA, 25 bp, Homo sapiens
ttctcctgctgagggatcccagaga

SEQ ID NO: 18386 - DNA, 25 bp, Homo sapiens
gatttttgcgcagacttatacatgt

SEQ ID NO: 18387 - DNA, 25 bp, Homo sapiens
agttatgatcatcgttttcctgcct

SEQ ID NO: 18388 - DNA, 25 bp, Homo sapiens
cccaccatcatcaaacactcagtta

SEQ ID NO: 18389 - DNA, 25 bp, Homo sapiens
agatgaccactcaacataatgctta

SEQ ID NO: 18390 - DNA, 25 bp, Homo sapiens
gaatggaatttcctctctgtgacag

SEQ ID NO: 18391 - DNA, 25 bp, Homo sapiens
gtccttcagttttgaggccatgtgt

SEQ ID NO: 18392 - DNA, 25 bp, Homo sapiens
gacagcttatacttctcaaaattca

SEQ ID NO: 18393 - DNA, 25 bp, Homo sapiens
ttgtcattgacagaaccccagtttg

SEQ ID NO: 18394 - DNA, 25 bp, Homo sapiens
agaaccccagtttgtatgtacatta

SEQ ID NO: 18395 - DNA, 25 bp, Homo sapiens
acattattcatattcctctctgttg

SEQ ID NO: 18396 - DNA, 25 bp, Homo sapiens
gcatgaagttgcccttaaccactaa

SEQ ID NO: 18397 - DNA, 25 bp, Homo sapiens
atgcatgtttcggggacttggccct

SEQ ID NO: 18398 - DNA, 25 bp, Homo sapiens
tgatgaggggccctcggtactctgg

SEQ ID NO: 18399 - DNA, 25 bp, Homo sapiens
ggtactctggataacgaagcttgtg

SEQ ID NO: 18400 - DNA, 25 bp, Homo sapiens
gaagcttgtgcagagtggtaaccat

SEQ ID NO: 18401 - DNA, 25 bp, Homo sapiens
taaccatgcttacacactaaactat

SEQ ID NO: 18402 - DNA, 25 bp, Homo sapiens
gaagccatgttaatctgagagcagt

SEQ ID NO: 18403 - DNA, 25 bp, Homo sapiens
gagagcagtgtcgccatagttgtgt

SEQ ID NO: 18404 - DNA, 25 bp, Homo sapiens
aaatgggttcctgttgccctgtaat

SEQ ID NO: 18405 - DNA, 25 bp, Homo sapiens
gccctgtaattaaactgctgcccgt

SEQ ID NO: 18406 - DNA, 25 bp, Homo sapiens
taaactgctgcccgtagaggccttt

SEQ ID NO: 18407 - DNA, 25 bp, Homo sapiens
ttccccttcttaacacaagctcaaa

SEQ ID NO: 18408 - DNA, 25 bp, Homo sapiens
tacttaggtcaaatttctgttctct

SEQ ID NO: 18409 - DNA, 25 bp, Homo sapiens
ttaagatgaggcagttcccctgaaa

SEQ ID NO: 18410 - DNA, 25 bp, Homo sapiens
aaaaagttaatgcagctctccatca

SEQ ID NO: 18411 - DNA, 25 bp, Homo sapiens
tccatcagaatccactcttctaggg

SEQ ID NO: 18412 - DNA, 25 bp, Homo sapiens
ttcaccctaaggatccaatggaata

SEQ ID NO: 18413 - DNA, 25 bp, Homo sapiens
tcctctccttggaacgtcaatgttt

SEQ ID NO: 18414 - DNA, 25 bp, Homo sapiens
tgaaaccatctcatgctctgtggct

SEQ ID NO: 18415 - DNA, 25 bp, Homo sapiens
tgtggctccagggtttctgttacta

SEQ ID NO: 18416 - DNA, 25 bp, Homo sapiens
cagggtttctgttactattttatgc

SEQ ID NO: 18417 - DNA, 25 bp, Homo sapiens
tcccatttattgtttggccagctat

SEQ ID NO: 18418 - DNA, 25 bp, Homo sapiens
ggccagctatgccaatgtggtgcta

SEQ ID NO: 18419 - DNA, 25 bp, Homo sapiens
tggatatttatcttgtacccgctgc

SEQ ID NO: 18420 - DNA, 25 bp, Homo sapiens
tacccgctgctaaacacactgcagg

SEQ ID NO: 18421 - DNA, 25 bp, Homo sapiens
cactgcaggagggactctgaaacct

SEQ ID NO: 18422 - DNA, 25 bp, Homo sapiens
gaaacctcaagctgtctacttacat

SEQ ID NO: 18423 - DNA, 25 bp, Homo sapiens
acttacatcttttatctgtgtctgt

SEQ ID NO: 18424 - DNA, 25 bp, Homo sapiens
aaacctttcaaatatcacgcagctt

SEQ ID NO: 18425 - DNA, 25 bp, Homo sapiens
acgcagcttatattcagtttacata

SEQ ID NO: 18426 - DNA, 25 bp, Homo sapiens
gattacatcatgtattttgcctcat

SEQ ID NO: 18427 - DNA, 25 bp, Homo sapiens
gacactgaattaatttcccctgcta

SEQ ID NO: 18428 - DNA, 25 bp, Homo sapiens
ttcccctgctactttgaaaccagaa

SEQ ID NO: 18429 - DNA, 25 bp, Homo sapiens
gactggccattcgttacatctgtct

SEQ ID NO: 18430 - DNA, 25 bp, Homo sapiens
ggggctgagctggtggatgctcttc

SEQ ID NO: 18431 - DNA, 25 bp, Homo sapiens
gatgctcttcagttcgtgtgtggag

SEQ ID NO: 18432 - DNA, 25 bp, Homo sapiens
caagcccacagggtatggctccagc

SEQ ID NO: 18433 - DNA, 25 bp, Homo sapiens
tcggagggcgcctcagacaggtatc

SEQ ID NO: 18434 - DNA, 25 bp, Homo sapiens
atcgtggatgagtgctgcttccgga

SEQ ID NO: 18435 - DNA, 25 bp, Homo sapiens
ctgcttccggagctgtgatctaagg

SEQ ID NO: 18436 - DNA, 25 bp, Homo sapiens
aggctggagatgtattgcgcacccc

SEQ ID NO: 18437 - DNA, 25 bp, Homo sapiens
gacatgcccaagacccagaaggaag

SEQ ID NO: 18438 - DNA, 25 bp, Homo sapiens
tgaagagtgacatgccaccgcagga

SEQ ID NO: 18439 - DNA, 25 bp, Homo sapiens
tttgctctgcacgagttacctgtta

SEQ ID NO: 18440 - DNA, 25 bp, Homo sapiens
agatgggcgtttcccccaatgaaat

SEQ ID NO: 18441 - DNA, 25 bp, Homo sapiens
tcctgaaacttcaaggtccctgcca

SEQ ID NO: 18442 - DNA, 25 bp, Homo sapiens
gctgcatcactgtcctggaaatcac

SEQ ID NO: 18443 - DNA, 25 bp, Homo sapiens
aaagggctgcattctgtgatcacaa

SEQ ID NO: 18444 - DNA, 25 bp, Homo sapiens
taataaatccactctcaactgcagg

SEQ ID NO: 18445 - DNA, 25 bp, Homo sapiens
gaaactcagaacgtctgcagcctgg

SEQ ID NO: 18446 - DNA, 25 bp, Homo sapiens
gcagcctggtatagcccagcagtgg

SEQ ID NO: 18447 - DNA, 25 bp, Homo sapiens
tgacagaagcctgccttaaccagtc

SEQ ID NO: 18448 - DNA, 25 bp, Homo sapiens
tgcccttctgtccagggacttgatc

SEQ ID NO: 18449 - DNA, 25 bp, Homo sapiens
agtaccaagcctacaaggacctcaa

SEQ ID NO: 18450 - DNA, 25 bp, Homo sapiens
tactagacactactgacatccaagg

SEQ ID NO: 18451 - DNA, 25 bp, Homo sapiens
acaaatgggtcttcagccttacccg

SEQ ID NO: 18452 - DNA, 25 bp, Homo sapiens
taccctcgcagcagtgtctctgagg

SEQ ID NO: 18453 - DNA, 25 bp, Homo sapiens
gggggtgggtcattatagtattcag

SEQ ID NO: 18454 - DNA, 25 bp, Homo sapiens
agtgcagtattcacgtgtaactttt

SEQ ID NO: 18455 - DNA, 25 bp, Homo sapiens
tcagtacagtgcttttataccttta

SEQ ID NO: 18456 - DNA, 25 bp, Homo sapiens
aagcttggttggtgctttcgctttt

SEQ ID NO: 18457 - DNA, 25 bp, Homo sapiens
ttgtgctacctttcttggatttttg

SEQ ID NO: 18458 - DNA, 25 bp, Homo sapiens
gttggggtagactgctcctgcagag

SEQ ID NO: 18459 - DNA, 25 bp, Homo sapiens
cagcaaagccggcctaaccaagaaa

SEQ ID NO: 18460 - DNA, 25 bp, Homo sapiens
gaaaacaccctcgtggagtacacta

SEQ ID NO: 18461 - DNA, 25 bp, Homo sapiens
gaactggactggtctcagtgtgagc

SEQ ID NO: 18462 - DNA, 25 bp, Homo sapiens
taaacacatatacaaccccaccgtg

SEQ ID NO: 18463 - DNA, 25 bp, Homo sapiens
gtgcagcagaactacgtcacgtcat

SEQ ID NO: 18464 - DNA, 25 bp, Homo sapiens
tgaagacctactttcaactcctttt

SEQ ID NO: 18465 - DNA, 25 bp, Homo sapiens
tttcccccctctagaagaatcaaat

SEQ ID NO: 18466 - DNA, 25 bp, Homo sapiens
ttgaatcttttacttacctcttgca

SEQ ID NO: 18467 - DNA, 25 bp, Homo sapiens
tgtcaaaagtaccttctgtccacac

SEQ ID NO: 18468 - DNA, 25 bp, Homo sapiens
gcatgtattggttggtggtcctgtc

SEQ ID NO: 18469 - DNA, 25 bp, Homo sapiens
tcctgtcccctaaagatcaagctac

SEQ ID NO: 18470 - DNA, 25 bp, Homo sapiens
gactccttaaagttccatttgctaa

SEQ ID NO: 18471 - DNA, 25 bp, Homo sapiens
atacactgtttgggctggccagttt

SEQ ID NO: 18472 - DNA, 25 bp, Homo sapiens
tggccagtttttcatgcatgcagct

SEQ ID NO: 18473 - DNA, 25 bp, Homo sapiens
gattgagcacagtcaggcctttgta

SEQ ID NO: 18474 - DNA, 25 bp, Homo sapiens
gccaggaagtcctccaatttccttt

SEQ ID NO: 18475 - DNA, 25 bp, Homo sapiens
ttctgttttcaatccctgttcgatt

SEQ ID NO: 18476 - DNA, 25 bp, Homo sapiens
ctgttcgatttgtgcttctgtgctt

SEQ ID NO: 18477 - DNA, 25 bp, Homo sapiens
gcagccctcatgcaggttgaagtat

SEQ ID NO: 18478 - DNA, 25 bp, Homo sapiens
gcctcagcctgatattcttggtgcg

SEQ ID NO: 18479 - DNA, 25 bp, Homo sapiens
gttgagggcgtgaccaccaagacat

SEQ ID NO: 18480 - DNA, 25 bp, Homo sapiens
gacatatatgttgtgcccgtgttca

SEQ ID NO: 18481 - DNA, 25 bp, Homo sapiens
cccgtgttcatcctgtgtatttata

SEQ ID NO: 18482 - DNA, 25 bp, Homo sapiens
gtttcctggtggacagccgggtaat

SEQ ID NO: 18483 - DNA, 25 bp, Homo sapiens
aatgcttttagctgctcgcatgctt

SEQ ID NO: 18484 - DNA, 25 bp, Homo sapiens
tctccatcatctgtttaccttttgg

SEQ ID NO: 18485 - DNA, 25 bp, Homo sapiens
gtggtctcttttaagttttgcagtt

SEQ ID NO: 18486 - DNA, 25 bp, Homo sapiens
tagactagagtcttgcagcaacaca

SEQ ID NO: 18487 - DNA, 25 bp, Homo sapiens
gaaggacctttcttaaatgtgacag

SEQ ID NO: 18488 - DNA, 25 bp, Homo sapiens
gtgacagatggtcctgcagtgtgaa

SEQ ID NO: 18489 - DNA, 25 bp, Homo sapiens
taaagctgggctctagtatactgat

SEQ ID NO: 18490 - DNA, 25 bp, Homo sapiens
tgactttagttttcgacattatttt

SEQ ID NO: 18491 - DNA, 25 bp, Homo sapiens
gagtggcaacttaggattttagggt

SEQ ID NO: 18492 - DNA, 25 bp, Homo sapiens
ggattttagggtgatggctttggaa

SEQ ID NO: 18493 - DNA, 25 bp, Homo sapiens
gacagactattactacgtttgccag

SEQ ID NO: 18494 - DNA, 25 bp, Homo sapiens
aacagctttatttatgttcatgtcc

SEQ ID NO: 18495 - DNA, 25 bp, Homo sapiens
gaaacattacagcccttatctagat

SEQ ID NO: 18496 - DNA, 25 bp, Homo sapiens
taaggatcccacgactttttactgc

SEQ ID NO: 18497 - DNA, 25 bp, Homo sapiens
tttttactgccatctgagctactca

SEQ ID NO: 18498 - DNA, 25 bp, Homo sapiens
gagctactcagtgtttgaatcccaa

SEQ ID NO: 18499 - DNA, 25 bp, Homo sapiens
ttacctctcaggtctgttgtaggac

SEQ ID NO: 18500 - DNA, 25 bp, Homo sapiens
gagctcacagactgacttgggctcc

SEQ ID NO: 18501 - DNA, 25 bp, Homo sapiens
gacctctgttagtcactttacctca

SEQ ID NO: 18502 - DNA, 25 bp, Homo sapiens
tggggactgtgaccgactttaagca

SEQ ID NO: 18503 - DNA, 25 bp, Homo sapiens
attggttttcagttccgctattgct

SEQ ID NO: 18504 - DNA, 25 bp, Homo sapiens
tctcgtcctaatctcaatcttactg

SEQ ID NO: 18505 - DNA, 25 bp, Homo sapiens
gcaccctgaaagtgattccctggtc

SEQ ID NO: 18506 - DNA, 25 bp, Homo sapiens
gggccattctccaaaggacctgaaa

SEQ ID NO: 18507 - DNA, 25 bp, Homo sapiens
agtcttagacaatagctcacatttt

SEQ ID NO: 18508 - DNA, 25 bp, Homo sapiens
tccctgtccatttgtcttataacat

SEQ ID NO: 18509 - DNA, 25 bp, Homo sapiens
tgtcttataacatgacccagcccta

SEQ ID NO: 18510 - DNA, 25 bp, Homo sapiens
tgacccagccctattttacgtcatt

SEQ ID NO: 18511 - DNA, 25 bp, Homo sapiens
gtcattctaaattcagcctcatata

SEQ ID NO: 18512 - DNA, 25 bp, Homo sapiens
gatttcctgtatagcagtcagccaa

SEQ ID NO: 18513 - DNA, 25 bp, Homo sapiens
gccaattcatatgctttgtctctgc

SEQ ID NO: 18514 - DNA, 25 bp, Homo sapiens
ttccatgcgttaacttttcccaata

SEQ ID NO: 18515 - DNA, 25 bp, Homo sapiens
atgagcatacaatccctttgttcta

SEQ ID NO: 18516 - DNA, 25 bp, Homo sapiens
aattagttgctttttcagtatcttc

SEQ ID NO: 18517 - DNA, 25 bp, Homo sapiens
tttcagtatcttctgctttgtctgt

SEQ ID NO: 18518 - DNA, 25 bp, Homo sapiens
gagatcaacaatgtgcagtgggcat

SEQ ID NO: 18519 - DNA, 25 bp, Homo sapiens
cagtgggcatcaactcagcccgact

SEQ ID NO: 18520 - DNA, 25 bp, Homo sapiens
ccatctgctacaacaactgcctgga

SEQ ID NO: 18521 - DNA, 25 bp, Homo sapiens
ctgcctggagatactcagagtgtag

SEQ ID NO: 18522 - DNA, 25 bp, Homo sapiens
agagtgtagtgttggtggcgctgtg

SEQ ID NO: 18523 - DNA, 25 bp, Homo sapiens
tgtgcccacgaggcaggggcttttg

SEQ ID NO: 18524 - DNA, 25 bp, Homo sapiens
gcaggggcttttgtatttcctgcct

SEQ ID NO: 18525 - DNA, 25 bp, Homo sapiens
gatggctcggtgcggatgtttgacc

SEQ ID NO: 18526 - DNA, 25 bp, Homo sapiens
acagcaccatcatttacgaagaccc

SEQ ID NO: 18527 - DNA, 25 bp, Homo sapiens
catttacgaagacccacagcatcac

SEQ ID NO: 18528 - DNA, 25 bp, Homo sapiens
tgcttcgcctctgctggaacaagca

SEQ ID NO: 18529 - DNA, 25 bp, Homo sapiens
gccggttcttacctcttaggtgaag

SEQ ID NO: 18530 - DNA, 25 bp, Homo sapiens
agaattgctgtgcaaggctcaccct

SEQ ID NO: 18531 - DNA, 25 bp, Homo sapiens
agccggagccggatgcagtaggact

SEQ ID NO: 18532 - DNA, 25 bp, Homo sapiens
cagtaggactggactcgggccatat

SEQ ID NO: 18533 - DNA, 25 bp, Homo sapiens
tgccgtcaacatgcctttcatggac

SEQ ID NO: 18534 - DNA, 25 bp, Homo sapiens
ccagaagagctccgtgctctgttcc

SEQ ID NO: 18535 - DNA, 25 bp, Homo sapiens
cctctgcggcaagcctgatgtggcc

SEQ ID NO: 18536 - DNA, 25 bp, Homo sapiens
tgatgtggccgtgtacgatggctcc

SEQ ID NO: 18537 - DNA, 25 bp, Homo sapiens
ctgagaaggcctgagccgtgacctc

SEQ ID NO: 18538 - DNA, 25 bp, Homo sapiens
tgtaactgcggccggtttagtgacc

SEQ ID NO: 18539 - DNA, 25 bp, Homo sapiens
tttagtgaccccatgacttacagcc

SEQ ID NO: 18540 - DNA, 25 bp, Homo sapiens
agctgtctctgctgcaatagttaaa

SEQ ID NO: 18541 - DNA, 25 bp, Homo sapiens
gaacttggattaaacccagagaagg

SEQ ID NO: 18542 - DNA, 25 bp, Homo sapiens
tagtttcctggtcccaagtgggtgt

SEQ ID NO: 18543 - DNA, 25 bp, Homo sapiens
cctggtcccaagtgggtgtggagcc

SEQ ID NO: 18544 - DNA, 25 bp, Homo sapiens
ggtgtggagccttccattatgggaa

SEQ ID NO: 18545 - DNA, 25 bp, Homo sapiens
gggaataggaccaattccagccata

SEQ ID NO: 18546 - DNA, 25 bp, Homo sapiens
gaccaattccagccataaagcaagc

SEQ ID NO: 18547 - DNA, 25 bp, Homo sapiens
taaagcaagctgttacaaaagcagg

SEQ ID NO: 18548 - DNA, 25 bp, Homo sapiens
aagcaggttggtcactggaagatgt

SEQ ID NO: 18549 - DNA, 25 bp, Homo sapiens
gttggtcactggaagatgttgacat

SEQ ID NO: 18550 - DNA, 25 bp, Homo sapiens
atcaatgaagcctttgcagctgtct

SEQ ID NO: 18551 - DNA, 25 bp, Homo sapiens
agacctgttcctggacttgatagca

SEQ ID NO: 18552 - DNA, 25 bp, Homo sapiens
atgtttggtgtcccatctgtgattg

SEQ ID NO: 18553 - DNA, 25 bp, Homo sapiens
tgtggcccggaaccacagagatgct

SEQ ID NO: 18554 - DNA, 25 bp, Homo sapiens
ccaagacggtgataggagaccacgg

SEQ ID NO: 18555 - DNA, 25 bp, Homo sapiens
gagaccacggggatgagctcttctc

SEQ ID NO: 18556 - DNA, 25 bp, Homo sapiens
ggccaactttgctcgcaatggaaac

SEQ ID NO: 18557 - DNA, 25 bp, Homo sapiens
gctcgcaatggaaaccccaatgggg

SEQ ID NO: 18558 - DNA, 25 bp, Homo sapiens
agggtatctgcagattggtgccaac

SEQ ID NO: 18559 - DNA, 25 bp, Homo sapiens
ctgcagattggtgccaacacccagg

SEQ ID NO: 18560 - DNA, 25 bp, Homo sapiens
aagtagctttctggaccaacctctt

SEQ ID NO: 18561 - DNA, 25 bp, Homo sapiens
ccaccccagacagaacacatagagc

SEQ ID NO: 18562 - DNA, 25 bp, Homo sapiens
aggggagctgtactgcgaaacccac

SEQ ID NO: 18563 - DNA, 25 bp, Homo sapiens
gctatgacacggtcactctgtatcc

SEQ ID NO: 18564 - DNA, 25 bp, Homo sapiens
agcttaagtctctgcaggcgtggca

SEQ ID NO: 18565 - DNA, 25 bp, Homo sapiens
ccacgcgcacttacacgagaagaca

SEQ ID NO: 18566 - DNA, 25 bp, Homo sapiens
ggattgtgcagattgtcaactccaa

SEQ ID NO: 18567 - DNA, 25 bp, Homo sapiens
ggctttagacctttatcctattgtt

SEQ ID NO: 18568 - DNA, 25 bp, Homo sapiens
gttttgcaactctttttggggctag

SEQ ID NO: 18569 - DNA, 25 bp, Homo sapiens
ggatgccgctctgtgacaaatgtgg

SEQ ID NO: 18570 - DNA, 25 bp, Homo sapiens
tagtcggtgctgtggtgaaggcgcg

SEQ ID NO: 18571 - DNA, 25 bp, Homo sapiens
gaaggcgcgggataagtaccggcac

SEQ ID NO: 18572 - DNA, 25 bp, Homo sapiens
gcaccctgagtgcttcgtgtgtgcc

SEQ ID NO: 18573 - DNA, 25 bp, Homo sapiens
ctttgactcctctttacaccggaga

SEQ ID NO: 18574 - DNA, 25 bp, Homo sapiens
acaccggagaacggctccagctgtt

SEQ ID NO: 18575 - DNA, 25 bp, Homo sapiens
agctctctttcagttctttgaacct

SEQ ID NO: 18576 - DNA, 25 bp, Homo sapiens
tagggtctataaggttccctctgcc

SEQ ID NO: 18577 - DNA, 25 bp, Homo sapiens
aactccacttccttagggatgtctc

SEQ ID NO: 18578 - DNA, 25 bp, Homo sapiens
ttccctactctatgctcttgtaaaa

SEQ ID NO: 18579 - DNA, 25 bp, Homo sapiens
aaacactatctacttcctttgtcat

SEQ ID NO: 18580 - DNA, 25 bp, Homo sapiens
cattaatattgtcctcctgctagaa

SEQ ID NO: 18581 - DNA, 25 bp, Homo sapiens
gagagcaaggatcctcctgtttacc

SEQ ID NO: 18582 - DNA, 25 bp, Homo sapiens
gtacctccaatgtctggcacttgta

SEQ ID NO: 18583 - DNA, 25 bp, Homo sapiens
tgtcctctggccacatagttttaaa

SEQ ID NO: 18584 - DNA, 25 bp, Homo sapiens
gcagagcgtatagcccaagatttct

SEQ ID NO: 18585 - DNA, 25 bp, Homo sapiens
caagatttctctacatttggccaaa

SEQ ID NO: 18586 - DNA, 25 bp, Homo sapiens
gcaggcagccaatgtgttggccacg

SEQ ID NO: 18587 - DNA, 25 bp, Homo sapiens
aagcagttctccagtgctgatgaag

SEQ ID NO: 18588 - DNA, 25 bp, Homo sapiens
aaacccttactattccagcgcaagg

SEQ ID NO: 18589 - DNA, 25 bp, Homo sapiens
gatcattgatccagcagacaccaga

SEQ ID NO: 18590 - DNA, 25 bp, Homo sapiens
gacaccagactggtcttgggtctca

SEQ ID NO: 18591 - DNA, 25 bp, Homo sapiens
gggtctcagttttagtgcagccctc

SEQ ID NO: 18592 - DNA, 25 bp, Homo sapiens
cagccctcaacgcaccaatagagaa

SEQ ID NO: 18593 - DNA, 25 bp, Homo sapiens
gactgacttcggtatcttcaggatg

SEQ ID NO: 18594 - DNA, 25 bp, Homo sapiens
aacactgtgcattgtacttttctac

SEQ ID NO: 18595 - DNA, 25 bp, Homo sapiens
tattttccaatagtaccccttgtgt

SEQ ID NO: 18596 - DNA, 25 bp, Homo sapiens
acaagcccttcagtactggttagca

SEQ ID NO: 18597 - DNA, 25 bp, Homo sapiens
agacgagtctgtcaacctagtgcct

SEQ ID NO: 18598 - DNA, 25 bp, Homo sapiens
ggagatcctggcacaccagaaagcc

SEQ ID NO: 18599 - DNA, 25 bp, Homo sapiens
cagaaagccacatcaacaagcccat

SEQ ID NO: 18600 - DNA, 25 bp, Homo sapiens
cccagcgttcagaaggccagcattg

SEQ ID NO: 18601 - DNA, 25 bp, Homo sapiens
ccagcattgtcttccatgggagatg

SEQ ID NO: 18602 - DNA, 25 bp, Homo sapiens
gagatgactcttaagccataggggc

SEQ ID NO: 18603 - DNA, 25 bp, Homo sapiens
ttccgtactccaaaccatcaggtgg

SEQ ID NO: 18604 - DNA, 25 bp, Homo sapiens
gtggacacagtcctaggaaccatta

SEQ ID NO: 18605 - DNA, 25 bp, Homo sapiens
atctaactcagtatatttccgtgta

SEQ ID NO: 18606 - DNA, 25 bp, Homo sapiens
ggctggatgccctaaataatttttt

SEQ ID NO: 18607 - DNA, 25 bp, Homo sapiens
gacacattgccttctagtgagttcc

SEQ ID NO: 18608 - DNA, 25 bp, Homo sapiens
gttagattgccaaccagttcatgag

SEQ ID NO: 18609 - DNA, 25 bp, Homo sapiens
gcaactcagtcccaaactacagttc

SEQ ID NO: 18610 - DNA, 25 bp, Homo sapiens
actacagttcttgttgtgaccagtg

SEQ ID NO: 18611 - DNA, 25 bp, Homo sapiens
agtccactcccaacaatactgtgtg

SEQ ID NO: 18612 - DNA, 25 bp, Homo sapiens
gcaagtgattgcttccgttttcaag

SEQ ID NO: 18613 - DNA, 25 bp, Homo sapiens
aagtccattctcatttggtccatta

SEQ ID NO: 18614 - DNA, 25 bp, Homo sapiens
gcagctgccagtttggagcattgcc

SEQ ID NO: 18615 - DNA, 25 bp, Homo sapiens
catgccttatatacattccactaat

SEQ ID NO: 18616 - DNA, 25 bp, Homo sapiens
aacatactcactgtgaacccagcct

SEQ ID NO: 18617 - DNA, 25 bp, Homo sapiens
gaccccattctcttacaaagtctct

SEQ ID NO: 18618 - DNA, 25 bp, Homo sapiens
tacatccatcaataccattccattt

SEQ ID NO: 18619 - DNA, 25 bp, Homo sapiens
aatgggctattgtaatttacccaca

SEQ ID NO: 18620 - DNA, 25 bp, Homo sapiens
atgtgttttattgtactccttcctt

SEQ ID NO: 18621 - DNA, 25 bp, Homo sapiens
tataatcattactgccaaactggaa

SEQ ID NO: 18622 - DNA, 25 bp, Homo sapiens
taatatcccaggccccttgataaaa

SEQ ID NO: 18623 - DNA, 25 bp, Homo sapiens
cccaggccccttgataaaagctgag

SEQ ID NO: 18624 - DNA, 25 bp, Homo sapiens
aaagctgagggttatcatgacctta

SEQ ID NO: 18625 - DNA, 25 bp, Homo sapiens
catgaccttaatgctaattcaatga

SEQ ID NO: 18626 - DNA, 25 bp, Homo sapiens
aaaattccatatatcttccctgcat

SEQ ID NO: 18627 - DNA, 25 bp, Homo sapiens
gcatcttgtcactgtgtaccattca

SEQ ID NO: 18628 - DNA, 25 bp, Homo sapiens
tgaggagccagcgtctagggcagca

SEQ ID NO: 18629 - DNA, 25 bp, Homo sapiens
cagccgcttcctagaagaccaggtc

SEQ ID NO: 18630 - DNA, 25 bp, Homo sapiens
ggtcatgatgatgggcagcgcccga

SEQ ID NO: 18631 - DNA, 25 bp, Homo sapiens
gacctggctgaggagctgggccatc

SEQ ID NO: 18632 - DNA, 25 bp, Homo sapiens
agaggcagtaaccatgcccgcatag

SEQ ID NO: 18633 - DNA, 25 bp, Homo sapiens
catagatgccacggaaggtccctca

SEQ ID NO: 18634 - DNA, 25 bp, Homo sapiens
ccctcagacatccccgattgaaaga

SEQ ID NO: 18635 - DNA, 25 bp, Homo sapiens
gaaacctcgggaaacttagatcatc

SEQ ID NO: 18636 - DNA, 25 bp, Homo sapiens
tagatcatcagtcaccgaaggtcct

SEQ ID NO: 18637 - DNA, 25 bp, Homo sapiens
aaatgtcctgccttttaacgtagat

SEQ ID NO: 18638 - DNA, 25 bp, Homo sapiens
ttaacgtagatatatgccttccccc

SEQ ID NO: 18639 - DNA, 25 bp, Homo sapiens
tcctaggctacatccagcttggcca

SEQ ID NO: 18640 - DNA, 25 bp, Homo sapiens
aactcctctgtggcggagagcgttt

SEQ ID NO: 18641 - DNA, 25 bp, Homo sapiens
aagcctactgtctttggtggcgtgc

SEQ ID NO: 18642 - DNA, 25 bp, Homo sapiens
ggtggcgtgcaggatgacatgagaa

SEQ ID NO: 18643 - DNA, 25 bp, Homo sapiens
tgagagggccaacaacaccaggtat

SEQ ID NO: 18644 - DNA, 25 bp, Homo sapiens
caccaggtatggcctggctgcggct

SEQ ID NO: 18645 - DNA, 25 bp, Homo sapiens
tctggacaaggccatgtacttcacc

SEQ ID NO: 18646 - DNA, 25 bp, Homo sapiens
ggtaaacacctacaacatcgtcacc

SEQ ID NO: 18647 - DNA, 25 bp, Homo sapiens
ctgccacacgccatttggagggttt

SEQ ID NO: 18648 - DNA, 25 bp, Homo sapiens
gaggatgggcttaaggcctacacag

SEQ ID NO: 18649 - DNA, 25 bp, Homo sapiens
taaagccaagaacaccctttctttg

SEQ ID NO: 18650 - DNA, 25 bp, Homo sapiens
aaatatacatactaggcaaatccat

SEQ ID NO: 18651 - DNA, 25 bp, Homo sapiens
agtggttgccaggggatagaggagt

SEQ ID NO: 18652 - DNA, 25 bp, Homo sapiens
gaggagtaattgttagtgggcatgg

SEQ ID NO: 18653 - DNA, 25 bp, Homo sapiens
gtgggcatgggatttgtttttggga

SEQ ID NO: 18654 - DNA, 25 bp, Homo sapiens
tttttgacacggagtctcactctgt

SEQ ID NO: 18655 - DNA, 25 bp, Homo sapiens
gtagctgggattataggtacatgcc

SEQ ID NO: 18656 - DNA, 25 bp, Homo sapiens
taggtacatgccatcacacctggct

SEQ ID NO: 18657 - DNA, 25 bp, Homo sapiens
gagatgaggtttcaccattttggcc

SEQ ID NO: 18658 - DNA, 25 bp, Homo sapiens
caccattttggccaggctgatcttg

SEQ ID NO: 18659 - DNA, 25 bp, Homo sapiens
tacaggtgggagccacaacacccga

SEQ ID NO: 18660 - DNA, 25 bp, Homo sapiens
acacccgaccatgaattaactccgt

SEQ ID NO: 18661 - DNA, 25 bp, Homo sapiens
ttcctgaagctcttcggctgacagc

SEQ ID NO: 18662 - DNA, 25 bp, Homo sapiens
cgcccctaaggtactatgagttctc

SEQ ID NO: 18663 - DNA, 25 bp, Homo sapiens
aggtactatgagttctcaggggtca

SEQ ID NO: 18664 - DNA, 25 bp, Homo sapiens
cccacacgcccacaaagtggattgc

SEQ ID NO: 18665 - DNA, 25 bp, Homo sapiens
acgcccacaaagtggattgcacaca

SEQ ID NO: 18666 - DNA, 25 bp, Homo sapiens
ctcactgttctgtgcactttttcta

SEQ ID NO: 18667 - DNA, 25 bp, Homo sapiens
tcactgttctgtgcactttttctac

SEQ ID NO: 18668 - DNA, 25 bp, Homo sapiens
ctgtgcactttttctacctacataa

SEQ ID NO: 18669 - DNA, 25 bp, Homo sapiens
gtgcactttttctacctacataaac

SEQ ID NO: 18670 - DNA, 25 bp, Homo sapiens
gcactttttctacctacataaacac

SEQ ID NO: 18671 - DNA, 25 bp, Homo sapiens
ttctacctacataaacacacgcatt

SEQ ID NO: 18672 - DNA, 25 bp, Homo sapiens
gtaattgatgccaatcttgtaccaa

SEQ ID NO: 18673 - DNA, 25 bp, Homo sapiens
ggataagggggattttggcactcaa

SEQ ID NO: 18674 - DNA, 25 bp, Homo sapiens
gaagctgcttgggccataagtaact

SEQ ID NO: 18675 - DNA, 25 bp, Homo sapiens
gatcaagtggcttaccttatccaac

SEQ ID NO: 18676 - DNA, 25 bp, Homo sapiens
tcccacctttttgcaacttgctgac

SEQ ID NO: 18677 - DNA, 25 bp, Homo sapiens
gacatctacaaattggcctatgaga

SEQ ID NO: 18678 - DNA, 25 bp, Homo sapiens
gatcattgatcagttcttctcttca

SEQ ID NO: 18679 - DNA, 25 bp, Homo sapiens
gatattgatgaagaccctagccttg

SEQ ID NO: 18680 - DNA, 25 bp, Homo sapiens
ccctagccttgttccagaggcaatt

SEQ ID NO: 18681 - DNA, 25 bp, Homo sapiens
ggcggaacatttggtttcaattcat

SEQ ID NO: 18682 - DNA, 25 bp, Homo sapiens
tcaattcatctgccaatgtaccaac

SEQ ID NO: 18683 - DNA, 25 bp, Homo sapiens
atagaaggctgctattttttgcaag

SEQ ID NO: 18684 - DNA, 25 bp, Homo sapiens
gtagaattcatctggttatcacctg

SEQ ID NO: 18685 - DNA, 25 bp, Homo sapiens
ggtcctctgaagttaactgatgggc

SEQ ID NO: 18686 - DNA, 25 bp, Homo sapiens
atgggctaaccgatttgtgcacaca

SEQ ID NO: 18687 - DNA, 25 bp, Homo sapiens
gggaattacttactgactgttcaat

SEQ ID NO: 18688 - DNA, 25 bp, Homo sapiens
gcaactaatctcatgctgcaaactt

SEQ ID NO: 18689 - DNA, 25 bp, Homo sapiens
acagtatgttctggttttggccctc

SEQ ID NO: 18690 - DNA, 25 bp, Homo sapiens
gttttggccctcttgcagaaagaag

SEQ ID NO: 18691 - DNA, 25 bp, Homo sapiens
gagcaggaccacatcgatagtattt

SEQ ID NO: 18692 - DNA, 25 bp, Homo sapiens
aaaacacagttcttctttcagcttg

SEQ ID NO: 18693 - DNA, 25 bp, Homo sapiens
cagcttgtcttaagaatggttgcca

SEQ ID NO: 18694 - DNA, 25 bp, Homo sapiens
gcagggctagttattccgatttctt

SEQ ID NO: 18695 - DNA, 25 bp, Homo sapiens
gttattccgatttcttgcacaatta

SEQ ID NO: 18696 - DNA, 25 bp, Homo sapiens
atggattagcatgtacctgtatatt

SEQ ID NO: 18697 - DNA, 25 bp, Homo sapiens
gtgacgtctaattgtatggctagca

SEQ ID NO: 18698 - DNA, 25 bp, Homo sapiens
agagcagtgcactctaacctatgcc

SEQ ID NO: 18699 - DNA, 25 bp, Homo sapiens
tctgtgtcctctttaatgcctaaag

SEQ ID NO: 18700 - DNA, 25 bp, Homo sapiens
gctgtgcctagaaatttcatctgtc

SEQ ID NO: 18701 - DNA, 25 bp, Homo sapiens
gtttctgtactgctattctatattt

SEQ ID NO: 18702 - DNA, 25 bp, Homo sapiens
gaattcatggtatcctggttatttt

SEQ ID NO: 18703 - DNA, 25 bp, Homo sapiens
gaaaacctgtttatcactccagtga

SEQ ID NO: 18704 - DNA, 25 bp, Homo sapiens
tgcagtttcacaatcagttcttcat

SEQ ID NO: 18705 - DNA, 25 bp, Homo sapiens
ctgtcccagtgtaggttagtattcc

SEQ ID NO: 18706 - DNA, 25 bp, Homo sapiens
taggttagtattccttcacatcctc

SEQ ID NO: 18707 - DNA, 25 bp, Homo sapiens
acatcctctcctggcttaagaatgt

SEQ ID NO: 18708 - DNA, 25 bp, Homo sapiens
tcctctcctggcttaagaatgtccc

SEQ ID NO: 18709 - DNA, 25 bp, Homo sapiens
tctcctggcttaagaatgtcccact

SEQ ID NO: 18710 - DNA, 25 bp, Homo sapiens
tggcttaagaatgtcccacttccta

SEQ ID NO: 18711 - DNA, 25 bp, Homo sapiens
gcttaagaatgtcccacttcctaac

SEQ ID NO: 18712 - DNA, 25 bp, Homo sapiens
taagaatgtcccacttcctaacgtg

SEQ ID NO: 18713 - DNA, 25 bp, Homo sapiens
ccacttcctaacgtgactccaaact

SEQ ID NO: 18714 - DNA, 25 bp, Homo sapiens
tcctaacgtgactccaaactgcatc

SEQ ID NO: 18715 - DNA, 25 bp, Homo sapiens
ctgcatctctacatttaggaacaga

SEQ ID NO: 18716 - DNA, 25 bp, Homo sapiens
gcacctttctggaggagtactcagc

SEQ ID NO: 18717 - DNA, 25 bp, Homo sapiens
agtactcagctgtgaagtccctgga

SEQ ID NO: 18718 - DNA, 25 bp, Homo sapiens
gtccctggaagtgattgtccgggcc

SEQ ID NO: 18719 - DNA, 25 bp, Homo sapiens
agaacttgatgctccgagatgcctc

SEQ ID NO: 18720 - DNA, 25 bp, Homo sapiens
cctccacagtgatcccagtgatggt

SEQ ID NO: 18721 - DNA, 25 bp, Homo sapiens
gatggtatacttggaccccatggct

SEQ ID NO: 18722 - DNA, 25 bp, Homo sapiens
ggcagaaggagtgccctggtgggtc

SEQ ID NO: 18723 - DNA, 25 bp, Homo sapiens
tgctggtgctagcactgctggtgct

SEQ ID NO: 18724 - DNA, 25 bp, Homo sapiens
ttcaaacgggcgaagcaccccgagg

SEQ ID NO: 18725 - DNA, 25 bp, Homo sapiens
gtaccatgcggtgaagattcctcgg

SEQ ID NO: 18726 - DNA, 25 bp, Homo sapiens
gattcctcgggaagaccgacagcag

SEQ ID NO: 18727 - DNA, 25 bp, Homo sapiens
agctataccatgctacttctgggct

SEQ ID NO: 18728 - DNA, 25 bp, Homo sapiens
gtgggctacctgctgggtagtgcca

SEQ ID NO: 18729 - DNA, 25 bp, Homo sapiens
gtacctggctgtattatgccctgtc

SEQ ID NO: 18730 - DNA, 25 bp, Homo sapiens
tgtcctcaccagcttggtcattatg

SEQ ID NO: 18731 - DNA, 25 bp, Homo sapiens
aatgcctacctataccgcaagagga

SEQ ID NO: 18732 - DNA, 25 bp, Homo sapiens
agaggatccaaccatgagctcttcc

SEQ ID NO: 18733 - DNA, 25 bp, Homo sapiens
gcctaggggaagcctggatttgccc

SEQ ID NO: 18734 - DNA, 25 bp, Homo sapiens
tagggacctgttgaactctctcagc

SEQ ID NO: 18735 - DNA, 25 bp, Homo sapiens
aactctctcagctgagtcaggggac

SEQ ID NO: 18736 - DNA, 25 bp, Homo sapiens
acacctcaggcactgggacagttgg

SEQ ID NO: 18737 - DNA, 25 bp, Homo sapiens
ttggaggcccgtgtgtgaattcctg

SEQ ID NO: 18738 - DNA, 25 bp, Homo sapiens
caactggatcctacccgaatttatg

SEQ ID NO: 18739 - DNA, 25 bp, Homo sapiens
tgaagagctgccaaacactgctgcc

SEQ ID NO: 18740 - DNA, 25 bp, Homo sapiens
tgacattcacggcagaggcaaggct

SEQ ID NO: 18741 - DNA, 25 bp, Homo sapiens
cctccgccatcccacagatgatgga

SEQ ID NO: 18742 - DNA, 25 bp, Homo sapiens
ctcttgggctctaggtcctggagaa

SEQ ID NO: 18743 - DNA, 25 bp, Homo sapiens
ggctctaggtcctggagaatgttgt

SEQ ID NO: 18744 - DNA, 25 bp, Homo sapiens
aatacatagtattcttcttctcaag

SEQ ID NO: 18745 - DNA, 25 bp, Homo sapiens
attcttcttctcaagacgtgggggg

SEQ ID NO: 18746 - DNA, 25 bp, Homo sapiens
gacgtggggggaaattatctcatta

SEQ ID NO: 18747 - DNA, 25 bp, Homo sapiens
gaaattatctcattatcgaggccct

SEQ ID NO: 18748 - DNA, 25 bp, Homo sapiens
tgtctgggcgtgttgtatgtcctgc

SEQ ID NO: 18749 - DNA, 25 bp, Homo sapiens
gctgtggtccagctgagatctgcaa

SEQ ID NO: 18750 - DNA, 25 bp, Homo sapiens
gattgtaagacagcctgtgctccct

SEQ ID NO: 18751 - DNA, 25 bp, Homo sapiens
tctcgaaccgaacagcagtgcttcc

SEQ ID NO: 18752 - DNA, 25 bp, Homo sapiens
ggatcagggaccagactcagcatcc

SEQ ID NO: 18753 - DNA, 25 bp, Homo sapiens
gcatccggccaaatatccagaaccc

SEQ ID NO: 18754 - DNA, 25 bp, Homo sapiens
tgacaagtctgtctgcctattcacc

SEQ ID NO: 18755 - DNA, 25 bp, Homo sapiens
gagcaacagtgctgtggcctggagc

SEQ ID NO: 18756 - DNA, 25 bp, Homo sapiens
gcatgtgcaaacgccttcaacaaca

SEQ ID NO: 18757 - DNA, 25 bp, Homo sapiens
tccccagcccagaaagttcctgtga

SEQ ID NO: 18758 - DNA, 25 bp, Homo sapiens
cagtgattgggttccgaatcctcct

SEQ ID NO: 18759 - DNA, 25 bp, Homo sapiens
aagtggccgggtttaatctgctcat

SEQ ID NO: 18760 - DNA, 25 bp, Homo sapiens
gtcgacatactcatttggtttaagc

SEQ ID NO: 18761 - DNA, 25 bp, Homo sapiens
aggtcattttctattcaccatcctt

SEQ ID NO: 18762 - DNA, 25 bp, Homo sapiens
tctattcaccatcctttactattaa

SEQ ID NO: 18763 - DNA, 25 bp, Homo sapiens
aagtagcaaccttcattttacattc

SEQ ID NO: 18764 - DNA, 25 bp, Homo sapiens
gggaattgtgtactccgaaacaagt

SEQ ID NO: 18765 - DNA, 25 bp, Homo sapiens
aagtgctgtttgagggattttatta

SEQ ID NO: 18766 - DNA, 25 bp, Homo sapiens
accaaagcaatatttccctggaatt

SEQ ID NO: 18767 - DNA, 25 bp, Homo sapiens
gtttgtggcatacaacctgagcctt

SEQ ID NO: 18768 - DNA, 25 bp, Homo sapiens
acaacctgagccttttcttatataa

SEQ ID NO: 18769 - DNA, 25 bp, Homo sapiens
acatcttggtatgtggccatattta

SEQ ID NO: 18770 - DNA, 25 bp, Homo sapiens
agaatgctgaactcaatgtgcaagt

SEQ ID NO: 18771 - DNA, 25 bp, Homo sapiens
tggatgttagcggtactcttccact

SEQ ID NO: 18772 - DNA, 25 bp, Homo sapiens
ccaagtgtatggttgctttgcctaa

SEQ ID NO: 18773 - DNA, 25 bp, Homo sapiens
aagaggaatccctctatttcacctg

SEQ ID NO: 18774 - DNA, 25 bp, Homo sapiens
tatttcacctgttctggaggcacca

SEQ ID NO: 18775 - DNA, 25 bp, Homo sapiens
gacggtctcaatctaaaagcacttc

SEQ ID NO: 18776 - DNA, 25 bp, Homo sapiens
aaagggcaaccagcttgggtgctac

SEQ ID NO: 18777 - DNA, 25 bp, Homo sapiens
tgatactttatgtctttgctcaccc

SEQ ID NO: 18778 - DNA, 25 bp, Homo sapiens
cctcatccccaaactacttgaaaag

SEQ ID NO: 18779 - DNA, 25 bp, Homo sapiens
gaaaagggcatttggcaccactctc

SEQ ID NO: 18780 - DNA, 25 bp, Homo sapiens
acaacacagtcactctagcaaggcc

SEQ ID NO: 18781 - DNA, 25 bp, Homo sapiens
ctagcaaggcccccaaagggccctg

SEQ ID NO: 18782 - DNA, 25 bp, Homo sapiens
gagagctcgctttgagtgactgggt

SEQ ID NO: 18783 - DNA, 25 bp, Homo sapiens
ctgggttttgtgattgcctctgaag

SEQ ID NO: 18784 - DNA, 25 bp, Homo sapiens
gcctctgaagcctatgtatgccatg

SEQ ID NO: 18785 - DNA, 25 bp, Homo sapiens
ggcactaacaaactctgaggtttcc

SEQ ID NO: 18786 - DNA, 25 bp, Homo sapiens
cagcagggtttcaggttccaatcag

SEQ ID NO: 18787 - DNA, 25 bp, Homo sapiens
gttggcaaggtgacatttccatgca

SEQ ID NO: 18788 - DNA, 25 bp, Homo sapiens
aatgcgatccacagaaggtcctggt

SEQ ID NO: 18789 - DNA, 25 bp, Homo sapiens
gaaggtcctggtggtatttgtaact

SEQ ID NO: 18790 - DNA, 25 bp, Homo sapiens
atgtcagtagtttatacttctctat

SEQ ID NO: 18791 - DNA, 25 bp, Homo sapiens
acttctctattatctcaaactactg

SEQ ID NO: 18792 - DNA, 25 bp, Homo sapiens
gcagcttttcaatgttagccacagt

SEQ ID NO: 18793 - DNA, 25 bp, Homo sapiens
gcaacaatccaaatggccatgggca

SEQ ID NO: 18794 - DNA, 25 bp, Homo sapiens
acatggagagattgaccctgctacg

SEQ ID NO: 18795 - DNA, 25 bp, Homo sapiens
ggaggaggcgattatgcagcccctt

SEQ ID NO: 18796 - DNA, 25 bp, Homo sapiens
tgcagccccttgatcataagaatct

SEQ ID NO: 18797 - DNA, 25 bp, Homo sapiens
ggatgtgccatactttgcagatgtg

SEQ ID NO: 18798 - DNA, 25 bp, Homo sapiens
gctgtttatatctgggacaacctcc

SEQ ID NO: 18799 - DNA, 25 bp, Homo sapiens
ggacaacctccagaaagttcttcct

SEQ ID NO: 18800 - DNA, 25 bp, Homo sapiens
agcattgcacaaagcccagtttctt

SEQ ID NO: 18801 - DNA, 25 bp, Homo sapiens
gttgtacgtacacattgtgctctgg

SEQ ID NO: 18802 - DNA, 25 bp, Homo sapiens
tgtgctctggagtgcctatttattg

SEQ ID NO: 18803 - DNA, 25 bp, Homo sapiens
gcgagccaccgattgtacagtaaat

SEQ ID NO: 18804 - DNA, 25 bp, Homo sapiens
tctcctctagcctgtttgttgtggg

SEQ ID NO: 18805 - DNA, 25 bp, Homo sapiens
tcctctagcctgtttgttgtggggt

SEQ ID NO: 18806 - DNA, 25 bp, Homo sapiens
ctctagcctgtttgttgtggggtgg

SEQ ID NO: 18807 - DNA, 25 bp, Homo sapiens
tgggggtatattttgtaaccactgg

SEQ ID NO: 18808 - DNA, 25 bp, Homo sapiens
acctgttctcggcaccttaaattat

SEQ ID NO: 18809 - DNA, 25 bp, Homo sapiens
tgttctcggcaccttaaattattag

SEQ ID NO: 18810 - DNA, 25 bp, Homo sapiens
tctcggcaccttaaattattagacc

SEQ ID NO: 18811 - DNA, 25 bp, Homo sapiens
aattattagaccccggggcagtcag

SEQ ID NO: 18812 - DNA, 25 bp, Homo sapiens
tattagaccccggggcagtcaggtg

SEQ ID NO: 18813 - DNA, 25 bp, Homo sapiens
tgctccggacacccgaaggcaataa

SEQ ID NO: 18814 - DNA, 25 bp, Homo sapiens
gctccggacacccgaaggcaataaa

SEQ ID NO: 18815 - DNA, 25 bp, Homo sapiens
agccggctacgcactgtatggcagt

SEQ ID NO: 18816 - DNA, 25 bp, Homo sapiens
accatgctggtccttgccatggact

SEQ ID NO: 18817 - DNA, 25 bp, Homo sapiens
tggactgtggggtcaactgcttcat

SEQ ID NO: 18818 - DNA, 25 bp, Homo sapiens
gacccggccatcggggagttcattt

SEQ ID NO: 18819 - DNA, 25 bp, Homo sapiens
gggctacgccaaggactttgaccct

SEQ ID NO: 18820 - DNA, 25 bp, Homo sapiens
tggtggctgatgttcatcgcactct

SEQ ID NO: 18821 - DNA, 25 bp, Homo sapiens
atcgcactctggtctacggagggat

SEQ ID NO: 18822 - DNA, 25 bp, Homo sapiens
cggagggatatttctgtaccccgct

SEQ ID NO: 18823 - DNA, 25 bp, Homo sapiens
gactgctgtacgaatgcaaccccat

SEQ ID NO: 18824 - DNA, 25 bp, Homo sapiens
tagacgtcattcccacagacattca

SEQ ID NO: 18825 - DNA, 25 bp, Homo sapiens
acgtgctcgagttcctgaaggtgta

SEQ ID NO: 18826 - DNA, 25 bp, Homo sapiens
gcatgaggtctgccagaaggccctg

SEQ ID NO: 18827 - DNA, 25 bp, Homo sapiens
agaggatggctctatgctggtgact

SEQ ID NO: 18828 - DNA, 25 bp, Homo sapiens
cacatcgcctctggttaaatctctc

SEQ ID NO: 18829 - DNA, 25 bp, Homo sapiens
ctcctgcttggcgacttcagtaagc

SEQ ID NO: 18830 - DNA, 25 bp, Homo sapiens
gtaagctacagctaagcccatcggc

SEQ ID NO: 18831 - DNA, 25 bp, Homo sapiens
gctaagcccatcggccggaaaagaa

SEQ ID NO: 18832 - DNA, 25 bp, Homo sapiens
tctggttgcctatagtgctctggga

SEQ ID NO: 18833 - DNA, 25 bp, Homo sapiens
ctaccagctgcagcgtggggttgtg

SEQ ID NO: 18834 - DNA, 25 bp, Homo sapiens
tgtggtcctggccaagagctacaat

SEQ ID NO: 18835 - DNA, 25 bp, Homo sapiens
tgacccttgatatttttgctggccc

SEQ ID NO: 18836 - DNA, 25 bp, Homo sapiens
cccccctaattatccattttctgat

SEQ ID NO: 18837 - DNA, 25 bp, Homo sapiens
gccaagccaaggtctgcatttttct

SEQ ID NO: 18838 - DNA, 25 bp, Homo sapiens
tcagaacacccaatagtcctaggcc

SEQ ID NO: 18839 - DNA, 25 bp, Homo sapiens
gcaagctaaataagcatcttcccac

SEQ ID NO: 18840 - DNA, 25 bp, Homo sapiens
atcttcccactgcgagttggggcat

SEQ ID NO: 18841 - DNA, 25 bp, Homo sapiens
ggcatgacccagcctatggtttgcc

SEQ ID NO: 18842 - DNA, 25 bp, Homo sapiens
tttctccgttttttcattaattgtg

SEQ ID NO: 18843 - DNA, 25 bp, Homo sapiens
ttgcacccctctagtcgaaatattt

SEQ ID NO: 18844 - DNA, 25 bp, Homo sapiens
gtcgaaatattttgtgcttacccca

SEQ ID NO: 18845 - DNA, 25 bp, Homo sapiens
gcttaccccaatatatgtgtgtgac

SEQ ID NO: 18846 - DNA, 25 bp, Homo sapiens
gtgtgtgactattgaactctattcg

SEQ ID NO: 18847 - DNA, 25 bp, Homo sapiens
ctctattcgtagactgcttgtacta

SEQ ID NO: 18848 - DNA, 25 bp, Homo sapiens
aatgctttttgttgatgcccactct

SEQ ID NO: 18849 - DNA, 25 bp, Homo sapiens
actctggttcccttgtttatctgag

SEQ ID NO: 18850 - DNA, 25 bp, Homo sapiens
tttatctgagtctgttggtacccca

SEQ ID NO: 18851 - DNA, 25 bp, Homo sapiens
ccttccctgtttagtactggccaga

SEQ ID NO: 18852 - DNA, 25 bp, Homo sapiens
gagttttttctagagctctgtcact

SEQ ID NO: 18853 - DNA, 25 bp, Homo sapiens
tggctgcaaacccagtgctgtgagg

SEQ ID NO: 18854 - DNA, 25 bp, Homo sapiens
aaagacaggccgtgtgagccagtcc

SEQ ID NO: 18855 - DNA, 25 bp, Homo sapiens
tgaatggttccttgctgactttggg

SEQ ID NO: 18856 - DNA, 25 bp, Homo sapiens
gacacatgtaccacatactggctca

SEQ ID NO: 18857 - DNA, 25 bp, Homo sapiens
atcttgtcactcttttggttttctt

SEQ ID NO: 18858 - DNA, 25 bp, Homo sapiens
caaatctctgttttatgtcctgtcc

SEQ ID NO: 18859 - DNA, 25 bp, Homo sapiens
gtcttccacactggtgctaactggc

SEQ ID NO: 18860 - DNA, 25 bp, Homo sapiens
gcagctggaggctacgcatggcctc

SEQ ID NO: 18861 - DNA, 25 bp, Homo sapiens
cagctggagagggcttctgtccctg

SEQ ID NO: 18862 - DNA, 25 bp, Homo sapiens
ctcgtggaggtgccgtgctttaaag

SEQ ID NO: 18863 - DNA, 25 bp, Homo sapiens
taaagaggccttagtgcccgggatg

SEQ ID NO: 18864 - DNA, 25 bp, Homo sapiens
tgctctcctggtcactgcagaatga

SEQ ID NO: 18865 - DNA, 25 bp, Homo sapiens
gaaggtgaagctccatgcatgtgtg

SEQ ID NO: 18866 - DNA, 25 bp, Homo sapiens
gtgtgcgcgggtgtatgtgcgctca

SEQ ID NO: 18867 - DNA, 25 bp, Homo sapiens
tgcgctcagggtctctgtttaagta

SEQ ID NO: 18868 - DNA, 25 bp, Homo sapiens
gagaccaacaggctacagtgtccct

SEQ ID NO: 18869 - DNA, 25 bp, Homo sapiens
ggggagatgcggttcacaatgcctc

SEQ ID NO: 18870 - DNA, 25 bp, Homo sapiens
tcagaaggcagtctttcggggcagt

SEQ ID NO: 18871 - DNA, 25 bp, Homo sapiens
ggcagtaacgcccggttatgacttc

SEQ ID NO: 18872 - DNA, 25 bp, Homo sapiens
ttatgacttcatggcccgactaaga

SEQ ID NO: 18873 - DNA, 25 bp, Homo sapiens
tgggatggagtcgattcttcctccc

SEQ ID NO: 18874 - DNA, 25 bp, Homo sapiens
catcaccaacgccaaaaccagagaa

SEQ ID NO: 18875 - DNA, 25 bp, Homo sapiens
gaaaatcacttagtctccacttttt

SEQ ID NO: 18876 - DNA, 25 bp, Homo sapiens
gacctcattaaggtcctcctagcca

SEQ ID NO: 18877 - DNA, 25 bp, Homo sapiens
tcagtggacgactggacatctcccc

SEQ ID NO: 18878 - DNA, 25 bp, Homo sapiens
atctccccgcaggacaaagggcagc

SEQ ID NO: 18879 - DNA, 25 bp, Homo sapiens
ggatatcatgttgtccctggcaaac

SEQ ID NO: 18880 - DNA, 25 bp, Homo sapiens
ctggcaaacctggtgagactcaacc

SEQ ID NO: 18881 - DNA, 25 bp, Homo sapiens
acagttctgatgcccttgtggaacg

SEQ ID NO: 18882 - DNA, 25 bp, Homo sapiens
gaccgccttgctcgggaaggaaggt

SEQ ID NO: 18883 - DNA, 25 bp, Homo sapiens
ggaaggaaggtgccatggcctgcac

SEQ ID NO: 18884 - DNA, 25 bp, Homo sapiens
tggcctgcaccgtggcggtggaaga

SEQ ID NO: 18885 - DNA, 25 bp, Homo sapiens
gagagcatagcacatcactacaaca

SEQ ID NO: 18886 - DNA, 25 bp, Homo sapiens
gagcttgagcaccatgacataggcc

SEQ ID NO: 18887 - DNA, 25 bp, Homo sapiens
tgacataggcctcgaccatgatgca

SEQ ID NO: 18888 - DNA, 25 bp, Homo sapiens
tgcagaattggctccagcctatgcc

SEQ ID NO: 18889 - DNA, 25 bp, Homo sapiens
cagcctatgccgtcctgaagagcat

SEQ ID NO: 18890 - DNA, 25 bp, Homo sapiens
gagcattatccaggccggatgcaga

SEQ ID NO: 18891 - DNA, 25 bp, Homo sapiens
atccgggtggatcatgcaggcgaat

SEQ ID NO: 18892 - DNA, 25 bp, Homo sapiens
tacttttgcaaactgtcctctacat

SEQ ID NO: 18893 - DNA, 25 bp, Homo sapiens
ttcctggcccatcaactgtattggg

SEQ ID NO: 18894 - DNA, 25 bp, Homo sapiens
gtattgggccttttggatatgctga

SEQ ID NO: 18895 - DNA, 25 bp, Homo sapiens
aagggtggaaatcaaccctctcctg

SEQ ID NO: 18896 - DNA, 25 bp, Homo sapiens
tcatatttccccttggacacttggt

SEQ ID NO: 18897 - DNA, 25 bp, Homo sapiens
acacttggttagacgccttccaggt

SEQ ID NO: 18898 - DNA, 25 bp, Homo sapiens
tgtggttccatgcagggttggggca

SEQ ID NO: 18899 - DNA, 25 bp, Homo sapiens
tggggcattatgggttcttccccca

SEQ ID NO: 18900 - DNA, 25 bp, Homo sapiens
gtgaggcattcggggaagctcgaca

SEQ ID NO: 18901 - DNA, 25 bp, Homo sapiens
agctcgacatgtgccacacagtgac

SEQ ID NO: 18902 - DNA, 25 bp, Homo sapiens
tggccccagacgcatagactgaggt

SEQ ID NO: 18903 - DNA, 25 bp, Homo sapiens
tacgctgggtactggaaggccgttc

SEQ ID NO: 18904 - DNA, 25 bp, Homo sapiens
tcaggagctgtggctgcggttgtac

SEQ ID NO: 18905 - DNA, 25 bp, Homo sapiens
gtaccagtccaacctggtgctggtc

SEQ ID NO: 18906 - DNA, 25 bp, Homo sapiens
ggtgggcatagtggaccaggtggtc

SEQ ID NO: 18907 - DNA, 25 bp, Homo sapiens
caggtgcagagcactgcgctgtcag

SEQ ID NO: 18908 - DNA, 25 bp, Homo sapiens
ctgtcagcgatagcccagtggatgg

SEQ ID NO: 18909 - DNA, 25 bp, Homo sapiens
cagtggatggccattccagaccatg

SEQ ID NO: 18910 - DNA, 25 bp, Homo sapiens
tcacgcagcgcgatgcggacgtgca

SEQ ID NO: 18911 - DNA, 25 bp, Homo sapiens
tcgtcagcttcatctccaaagactc

SEQ ID NO: 18912 - DNA, 25 bp, Homo sapiens
ctccatccagaagtccctgcagatg

SEQ ID NO: 18913 - DNA, 25 bp, Homo sapiens
aacgattgggctgccacaggcttac

SEQ ID NO: 18914 - DNA, 25 bp, Homo sapiens
gaacacgcagagagtttccctagat

SEQ ID NO: 18915 - DNA, 25 bp, Homo sapiens
gctgggacacacctttgcaaaatgc

SEQ ID NO: 18916 - DNA, 25 bp, Homo sapiens
agctggggagctgtgttaagtcaaa

SEQ ID NO: 18917 - DNA, 25 bp, Homo sapiens
accctccagtgtttggtgttgtgta

SEQ ID NO: 18918 - DNA, 25 bp, Homo sapiens
taaagaggccaagctgcctgtagtt

SEQ ID NO: 18919 - DNA, 25 bp, Homo sapiens
gtggttcttcttgtgtatttatttg

SEQ ID NO: 18920 - DNA, 25 bp, Homo sapiens
gcatcatttagcagttgtagccatt

SEQ ID NO: 18921 - DNA, 25 bp, Homo sapiens
gtagccattttctagttaactcatg

SEQ ID NO: 18922 - DNA, 25 bp, Homo sapiens
aacataacagtattaccctttcact

SEQ ID NO: 18923 - DNA, 25 bp, Homo sapiens
ccctttcactgttctcacaggacat

SEQ ID NO: 18924 - DNA, 25 bp, Homo sapiens
gtagtcactgtatttctggattttt

SEQ ID NO: 18925 - DNA, 25 bp, Homo sapiens
gagacttgctgattttctggttgga

SEQ ID NO: 18926 - DNA, 25 bp, Homo sapiens
ttttttgtattgccatagtcccttc

SEQ ID NO: 18927 - DNA, 25 bp, Homo sapiens
aatacgcctttccaatctttattgg

SEQ ID NO: 18928 - DNA, 25 bp, Homo sapiens
ctgcctacttcctaatttattctta

SEQ ID NO: 18929 - DNA, 25 bp, Homo sapiens
aaccacgtgtataacagctctgctg

SEQ ID NO: 18930 - DNA, 25 bp, Homo sapiens
gctctgctggacacccaagaaagcc

SEQ ID NO: 18931 - DNA, 25 bp, Homo sapiens
gaaagccatgggaacgccaactgga

SEQ ID NO: 18932 - DNA, 25 bp, Homo sapiens
gggagcctgcgaaggagaggttctg

SEQ ID NO: 18933 - DNA, 25 bp, Homo sapiens
aggttctgtagaatccaagcccaca

SEQ ID NO: 18934 - DNA, 25 bp, Homo sapiens
caccgtccactgtgcgtttgtatgt

SEQ ID NO: 18935 - DNA, 25 bp, Homo sapiens
ctctcttgtccacctattaattgtt

SEQ ID NO: 18936 - DNA, 25 bp, Homo sapiens
ggaaatttggatgaagggagctaga

SEQ ID NO: 18937 - DNA, 25 bp, Homo sapiens
agtacagatgagggttcactatgtt

SEQ ID NO: 18938 - DNA, 25 bp, Homo sapiens
caccgggtgaccggcttacagggat

SEQ ID NO: 18939 - DNA, 25 bp, Homo sapiens
tgaccggcttacagggatattttta

SEQ ID NO: 18940 - DNA, 25 bp, Homo sapiens
ttaatcccgttatggactctgtctc

SEQ ID NO: 18941 - DNA, 25 bp, Homo sapiens
gtctccaggagaggggtctatccac

SEQ ID NO: 18942 - DNA, 25 bp, Homo sapiens
ctatccacccctgctcattggtgga

SEQ ID NO: 18943 - DNA, 25 bp, Homo sapiens
ccacccctgctcattggtggatgtt

SEQ ID NO: 18944 - DNA, 25 bp, Homo sapiens
ggaaaaactactcctcattatcatc

SEQ ID NO: 18945 - DNA, 25 bp, Homo sapiens
atcattattattgctctccactgta

SEQ ID NO: 18946 - DNA, 25 bp, Homo sapiens
ctctacctggcatgtgcttgtcaag

SEQ ID NO: 18947 - DNA, 25 bp, Homo sapiens
ctacccacgcagatttattccagtg

SEQ ID NO: 18948 - DNA, 25 bp, Homo sapiens
tggaacttcaagtaactcctcccag

SEQ ID NO: 18949 - DNA, 25 bp, Homo sapiens
caagtaactcctcccagagtacttc

SEQ ID NO: 18950 - DNA, 25 bp, Homo sapiens
gagtacttccaactctgggttggcc

SEQ ID NO: 18951 - DNA, 25 bp, Homo sapiens
ggccccaaatccaactaatgccacc

SEQ ID NO: 18952 - DNA, 25 bp, Homo sapiens
gcatctctactcttaagagactcag

SEQ ID NO: 18953 - DNA, 25 bp, Homo sapiens
gactcaggccaagaaacgtcttcta

SEQ ID NO: 18954 - DNA, 25 bp, Homo sapiens
taaacccaatccaaatggcgtctgg

SEQ ID NO: 18955 - DNA, 25 bp, Homo sapiens
ggcgtctggaagtccaatgtggcaa

SEQ ID NO: 18956 - DNA, 25 bp, Homo sapiens
cgcgcaccgacggaggggacatggg

SEQ ID NO: 18957 - DNA, 25 bp, Homo sapiens
agagcaatggtggccaggctcgggc

SEQ ID NO: 18958 - DNA, 25 bp, Homo sapiens
atgttaattatgcagtgtttccctc

SEQ ID NO: 18959 - DNA, 25 bp, Homo sapiens
agagagacacagctgcagaggccac

SEQ ID NO: 18960 - DNA, 25 bp, Homo sapiens
acctggattgcgcctaatgtgtttg

SEQ ID NO: 18961 - DNA, 25 bp, Homo sapiens
tgattgaatctacttgcacactctc

SEQ ID NO: 18962 - DNA, 25 bp, Homo sapiens
gcacactctcccattatatttattg

SEQ ID NO: 18963 - DNA, 25 bp, Homo sapiens
aacccaagttagttcaatcctgatt

SEQ ID NO: 18964 - DNA, 25 bp, Homo sapiens
gaaggtttgcagatattctctagtc

SEQ ID NO: 18965 - DNA, 25 bp, Homo sapiens
gacatatcacatgtcagccactgtg

SEQ ID NO: 18966 - DNA, 25 bp, Homo sapiens
atggccagtaagatcaatgtgacgg

SEQ ID NO: 18967 - DNA, 25 bp, Homo sapiens
tgtgacggcagggaaatgtatgtgt

SEQ ID NO: 18968 - DNA, 25 bp, Homo sapiens
cagtgtgtggtcaacatttctcatg

SEQ ID NO: 18969 - DNA, 25 bp, Homo sapiens
gagagcaaagggtgtctgcgtcgtc

SEQ ID NO: 18970 - DNA, 25 bp, Homo sapiens
tgcgtcgtcaccaaatcgtagcgtt

SEQ ID NO: 18971 - DNA, 25 bp, Homo sapiens
gccaaagtgccggtgagacccatgg

SEQ ID NO: 18972 - DNA, 25 bp, Homo sapiens
cccatggctgttggtgggacccgtg

SEQ ID NO: 18973 - DNA, 25 bp, Homo sapiens
gtggctgtcaatgggacctgtggct

SEQ ID NO: 18974 - DNA, 25 bp, Homo sapiens
ggtcggtgggaccctggttattgat

SEQ ID NO: 18975 - DNA, 25 bp, Homo sapiens
ctgttgacgcacctgtggttgttag

SEQ ID NO: 18976 - DNA, 25 bp, Homo sapiens
gtggttgttagtggggcctgaggtc

SEQ ID NO: 18977 - DNA, 25 bp, Homo sapiens
cactgtgctttcagaagtgcccttc

SEQ ID NO: 18978 - DNA, 25 bp, Homo sapiens
gggacggcggcagtattgaagctcg

SEQ ID NO: 18979 - DNA, 25 bp, Homo sapiens
agctcgtgacaagtgccttcacaca

SEQ ID NO: 18980 - DNA, 25 bp, Homo sapiens
aggatagtgcccgaagttgctgctt

SEQ ID NO: 18981 - DNA, 25 bp, Homo sapiens
tggtctactagggccctgaagtcca

SEQ ID NO: 18982 - DNA, 25 bp, Homo sapiens
caccttggctgtcctaacagggcca

SEQ ID NO: 18983 - DNA, 25 bp, Homo sapiens
ctaacagggccaatcaccagtgacc

SEQ ID NO: 18984 - DNA, 25 bp, Homo sapiens
ggagctggagcatgagtgtctgaca

SEQ ID NO: 18985 - DNA, 25 bp, Homo sapiens
gaagcatcatgtccaatgtccagat

SEQ ID NO: 18986 - DNA, 25 bp, Homo sapiens
gtgatagttcagaccaatgccttcc

SEQ ID NO: 18987 - DNA, 25 bp, Homo sapiens
ctcctttatgactgcacttctagcc

SEQ ID NO: 18988 - DNA, 25 bp, Homo sapiens
acttctagccagtagctctgcacaa

SEQ ID NO: 18989 - DNA, 25 bp, Homo sapiens
gctctgcacaagttagctctgtaga

SEQ ID NO: 18990 - DNA, 25 bp, Homo sapiens
gggcttaaatcatgggctatctctc

SEQ ID NO: 18991 - DNA, 25 bp, Homo sapiens
gtgtgtgggtcttttgatggtttct

SEQ ID NO: 18992 - DNA, 25 bp, Homo sapiens
gtgggtcttttgatggtttctattc

SEQ ID NO: 18993 - DNA, 25 bp, Homo sapiens
ggtcttttgatggtttctattctga

SEQ ID NO: 18994 - DNA, 25 bp, Homo sapiens
ttgatggtttctattctgactgaca

SEQ ID NO: 18995 - DNA, 25 bp, Homo sapiens
gatggtttctattctgactgacatc

SEQ ID NO: 18996 - DNA, 25 bp, Homo sapiens
acatcaatttgtctaatcttgtagc

SEQ ID NO: 18997 - DNA, 25 bp, Homo sapiens
tttgtctaatcttgtagcagtacag

SEQ ID NO: 18998 - DNA, 25 bp, Homo sapiens
agcagtacagtacagtcctgattac

SEQ ID NO: 18999 - DNA, 25 bp, Homo sapiens
gtacagtcctgattactgcaacttt

SEQ ID NO: 19000 - DNA, 25 bp, Homo sapiens
ctgattactgcaactttaggaaaag

SEQ ID NO: 19001 - DNA, 25 bp, Homo sapiens
cataattgtaaccaatttcacctct

SEQ ID NO: 19002 - DNA, 25 bp, Homo sapiens
tgtctacacccagatctgcaaatac

SEQ ID NO: 19003 - DNA, 25 bp, Homo sapiens
tctgcaaatacatgtcctggatcaa

SEQ ID NO: 19004 - DNA, 25 bp, Homo sapiens
taaagtcatacgctccaactgatcc

SEQ ID NO: 19005 - DNA, 25 bp, Homo sapiens
gctccaactgatccagatgctacgc

SEQ ID NO: 19006 - DNA, 25 bp, Homo sapiens
tacgctccagctgatccagatgtta

SEQ ID NO: 19007 - DNA, 25 bp, Homo sapiens
tccagatgttatgctcctgctgatc

SEQ ID NO: 19008 - DNA, 25 bp, Homo sapiens
ctgagagcagttactggggtcaccc

SEQ ID NO: 19009 - DNA, 25 bp, Homo sapiens
gactttgggcaagccaagtgccctc

SEQ ID NO: 19010 - DNA, 25 bp, Homo sapiens
aatgggaacaatgacgtgcctacct

SEQ ID NO: 19011 - DNA, 25 bp, Homo sapiens
gtgcctacctcttagacatgttgtg

SEQ ID NO: 19012 - DNA, 25 bp, Homo sapiens
tcctctcgtggggtgtttacccctg

SEQ ID NO: 19013 - DNA, 25 bp, Homo sapiens
tggagcgaccccattacgctaaaga

SEQ ID NO: 19014 - DNA, 25 bp, Homo sapiens
gagcgaccccattacgctaaagatg

SEQ ID NO: 19015 - DNA, 25 bp, Homo sapiens
gaccccattacgctaaagatgaaag

SEQ ID NO: 19016 - DNA, 25 bp, Homo sapiens
gagccaggatctccactgtggagca

SEQ ID NO: 19017 - DNA, 25 bp, Homo sapiens
gaatgggaaattgcccaggtggacc

SEQ ID NO: 19018 - DNA, 25 bp, Homo sapiens
accccaagaagaccattcagatggg

SEQ ID NO: 19019 - DNA, 25 bp, Homo sapiens
gaccattcagatgggatctttccgg

SEQ ID NO: 19020 - DNA, 25 bp, Homo sapiens
gatgggatctttccggatcaatcca

SEQ ID NO: 19021 - DNA, 25 bp, Homo sapiens
ggatctttccggatcaatccagatg

SEQ ID NO: 19022 - DNA, 25 bp, Homo sapiens
tttccggatcaatccagatggcagc

SEQ ID NO: 19023 - DNA, 25 bp, Homo sapiens
tccagatggcagccagtcagtggtg

SEQ ID NO: 19024 - DNA, 25 bp, Homo sapiens
tggtggaggtaactgttactgttcc

SEQ ID NO: 19025 - DNA, 25 bp, Homo sapiens
ctgttcccccaaacaaagtagctca

SEQ ID NO: 19026 - DNA, 25 bp, Homo sapiens
aagtagctcactctggctttggatg

SEQ ID NO: 19027 - DNA, 25 bp, Homo sapiens
ggctttggatgaaattcgactgctt

SEQ ID NO: 19028 - DNA, 25 bp, Homo sapiens
tcgactgcttaaaaaggaccttggt

SEQ ID NO: 19029 - DNA, 25 bp, Homo sapiens
aagatttggctctgtctcatttgga

SEQ ID NO: 19030 - DNA, 25 bp, Homo sapiens
gcttcctggctgcaaaccttaatac

SEQ ID NO: 19031 - DNA, 25 bp, Homo sapiens
cttaatactttgtttctgctgtaga

SEQ ID NO: 19032 - DNA, 25 bp, Homo sapiens
ttctccacatccacatgactggttt

SEQ ID NO: 19033 - DNA, 25 bp, Homo sapiens
gtggtatacatgcaaacatccgttc

SEQ ID NO: 19034 - DNA, 25 bp, Homo sapiens
aaacatccgttcaaaatctgagtcg

SEQ ID NO: 19035 - DNA, 25 bp, Homo sapiens
taaacttgccaaggagggactttct

SEQ ID NO: 19036 - DNA, 25 bp, Homo sapiens
acaattgccttcggttacctcatta

SEQ ID NO: 19037 - DNA, 25 bp, Homo sapiens
ggttacctcattatctactgcagaa

SEQ ID NO: 19038 - DNA, 25 bp, Homo sapiens
gacgagaatgcaaccatacctagat

SEQ ID NO: 19039 - DNA, 25 bp, Homo sapiens
acctagatggacttttccacaagct

SEQ ID NO: 19040 - DNA, 25 bp, Homo sapiens
caagctaaagctggcctcttgatct

SEQ ID NO: 19041 - DNA, 25 bp, Homo sapiens
tccattccttctctctaataatcat

SEQ ID NO: 19042 - DNA, 25 bp, Homo sapiens
tactgttcctcaaagaattgtctac

SEQ ID NO: 19043 - DNA, 25 bp, Homo sapiens
tctcctcttttgcctctgagaaaga

SEQ ID NO: 19044 - DNA, 25 bp, Homo sapiens
gggtaatattctgtggtcctcagcc

SEQ ID NO: 19045 - DNA, 25 bp, Homo sapiens
tcctcagccctgtaccttaataaat

SEQ ID NO: 19046 - DNA, 25 bp, Homo sapiens
gcctcgggcacacccaaggagaaga

SEQ ID NO: 19047 - DNA, 25 bp, Homo sapiens
gaagaagaagcgctccaaggccaag

SEQ ID NO: 19048 - DNA, 25 bp, Homo sapiens
ggccaaggcggagcgagaggcgtcc

SEQ ID NO: 19049 - DNA, 25 bp, Homo sapiens
cgtactgtctgtgcaaccaggtctc

SEQ ID NO: 19050 - DNA, 25 bp, Homo sapiens
tcggctgcgacaacgacgagtgccc

SEQ ID NO: 19051 - DNA, 25 bp, Homo sapiens
catcgagtggttccacttctcgtgc

SEQ ID NO: 19052 - DNA, 25 bp, Homo sapiens
tctcgtgcgtggggctcaatcataa

SEQ ID NO: 19053 - DNA, 25 bp, Homo sapiens
gggcaagtggtactgtcccaagtgc

SEQ ID NO: 19054 - DNA, 25 bp, Homo sapiens
gacaggcgcctggtgtgaggaggac

SEQ ID NO: 19055 - DNA, 25 bp, Homo sapiens
acattgctgcctttgttgaggtgca

SEQ ID NO: 19056 - DNA, 25 bp, Homo sapiens
cagtgattctgtttgccttttgttt

SEQ ID NO: 19057 - DNA, 25 bp, Homo sapiens
cctcctgctcctcaagagtgtggtc

SEQ ID NO: 19058 - DNA, 25 bp, Homo sapiens
tggtctattttgccatcatcacctg

SEQ ID NO: 19059 - DNA, 25 bp, Homo sapiens
acaaggaggccatcttttcctcatc

SEQ ID NO: 19060 - DNA, 25 bp, Homo sapiens
ttcctcatcggttattgtccctaga

SEQ ID NO: 19061 - DNA, 25 bp, Homo sapiens
gaagcgtcttctgaggatctagttg

SEQ ID NO: 19062 - DNA, 25 bp, Homo sapiens
tgggtttgggccatttcagttctca

SEQ ID NO: 19063 - DNA, 25 bp, Homo sapiens
tatagtgtagacatcctgcggcttc

SEQ ID NO: 19064 - DNA, 25 bp, Homo sapiens
tggaagcctttcattttacacgccc

SEQ ID NO: 19065 - DNA, 25 bp, Homo sapiens
cgccctgaagcagtcttctttgcta

SEQ ID NO: 19066 - DNA, 25 bp, Homo sapiens
aaatgatacactactgctgcagctc

SEQ ID NO: 19067 - DNA, 25 bp, Homo sapiens
gctcacaaacacctctgcatattac

SEQ ID NO: 19068 - DNA, 25 bp, Homo sapiens
gggaggccggggaaggatcaggagg

SEQ ID NO: 19069 - DNA, 25 bp, Homo sapiens
gtggtgatgcaagatgttgccccca

SEQ ID NO: 19070 - DNA, 25 bp, Homo sapiens
tcttgaaagagccctgtttcccagc

SEQ ID NO: 19071 - DNA, 25 bp, Homo sapiens
acaatagatgttgcttttcccgtgt

SEQ ID NO: 19072 - DNA, 25 bp, Homo sapiens
gcttttcccgtgtcatgtaaatttg

SEQ ID NO: 19073 - DNA, 25 bp, Homo sapiens
ggctgagctgttagaggggcttctc

SEQ ID NO: 19074 - DNA, 25 bp, Homo sapiens
tgttagaggggcttctccagaggct

SEQ ID NO: 19075 - DNA, 25 bp, Homo sapiens
agaggctcgagagcaggccatttcc

SEQ ID NO: 19076 - DNA, 25 bp, Homo sapiens
gactgtgtttttattgaaggaattt

SEQ ID NO: 19077 - DNA, 25 bp, Homo sapiens
gttgtaaaatagactccatggagac

SEQ ID NO: 19078 - DNA, 25 bp, Homo sapiens
tagactccatggagactcttaggaa

SEQ ID NO: 19079 - DNA, 25 bp, Homo sapiens
ccagcagctgaagtctctttttctt

SEQ ID NO: 19080 - DNA, 25 bp, Homo sapiens
ctttttcttcctctcggctggaaga

SEQ ID NO: 19081 - DNA, 25 bp, Homo sapiens
gatacctttgcgtggatcaagcttg

SEQ ID NO: 19082 - DNA, 25 bp, Homo sapiens
tattcttgtccacattctacttcag

SEQ ID NO: 19083 - DNA, 25 bp, Homo sapiens
ctacttcagctttggatgtggttac

SEQ ID NO: 19084 - DNA, 25 bp, Homo sapiens
accgagtatctgtaacccttgaatt

SEQ ID NO: 19085 - DNA, 25 bp, Homo sapiens
tagacagtattgccacctctggcca

SEQ ID NO: 19086 - DNA, 25 bp, Homo sapiens
gccaaatatgcactttccctagaaa

SEQ ID NO: 19087 - DNA, 25 bp, Homo sapiens
ttccctagaaagccatattccagca

SEQ ID NO: 19088 - DNA, 25 bp, Homo sapiens
gtgctatagtgtataccacctgtac

SEQ ID NO: 19089 - DNA, 25 bp, Homo sapiens
aacaatcactattcttaagcacttt

SEQ ID NO: 19090 - DNA, 25 bp, Homo sapiens
cagcccctatctccaagagacagag

SEQ ID NO: 19091 - DNA, 25 bp, Homo sapiens
gtcaggaggcactgctcatctgtac

SEQ ID NO: 19092 - DNA, 25 bp, Homo sapiens
gtacgagacctgttccagatgaagc

SEQ ID NO: 19093 - DNA, 25 bp, Homo sapiens
tggatacagatgcggacacccggct

SEQ ID NO: 19094 - DNA, 25 bp, Homo sapiens
cccggctctcacgcagagtattaag

SEQ ID NO: 19095 - DNA, 25 bp, Homo sapiens
tacattacgttcgtcaagcctgcct

SEQ ID NO: 19096 - DNA, 25 bp, Homo sapiens
tttgaggaattctgcttgccaacaa

SEQ ID NO: 19097 - DNA, 25 bp, Homo sapiens
tgatgtgatcatccctagaggtgca

SEQ ID NO: 19098 - DNA, 25 bp, Homo sapiens
ggcagaccaatggctgtctcaacgg

SEQ ID NO: 19099 - DNA, 25 bp, Homo sapiens
accccttcacgcaagaggcaggcat

SEQ ID NO: 19100 - DNA, 25 bp, Homo sapiens
caagaggcaggcatcggagtccagc

SEQ ID NO: 19101 - DNA, 25 bp, Homo sapiens
aggctacagacatggtgccatcctc

SEQ ID NO: 19102 - DNA, 25 bp, Homo sapiens
gctcatgtcatggatcaggtgcttt

SEQ ID NO: 19103 - DNA, 25 bp, Homo sapiens
aatgacccatgtggtctgcgtcttc

SEQ ID NO: 19104 - DNA, 25 bp, Homo sapiens
tgcgtcttctgccattggcttgaac

SEQ ID NO: 19105 - DNA, 25 bp, Homo sapiens
aagtctccatctcagctgtatattc

SEQ ID NO: 19106 - DNA, 25 bp, Homo sapiens
tctagtccaaattttcctggctccc

SEQ ID NO: 19107 - DNA, 25 bp, Homo sapiens
gccctgtttgctatttcatgtctgc

SEQ ID NO: 19108 - DNA, 25 bp, Homo sapiens
ccttcacagcatacactgccatggt

SEQ ID NO: 19109 - DNA, 25 bp, Homo sapiens
tgtacatatgcatccacgtgtgtgt

SEQ ID NO: 19110 - DNA, 25 bp, Homo sapiens
agcatgtagctcattctgctcagcc

SEQ ID NO: 19111 - DNA, 25 bp, Homo sapiens
gtccttgccatggccacagacaatc

SEQ ID NO: 19112 - DNA, 25 bp, Homo sapiens
taaagttgcgatgtgacctgctctc

SEQ ID NO: 19113 - DNA, 25 bp, Homo sapiens
gccaagccctcaatgtcaggctgca

SEQ ID NO: 19114 - DNA, 25 bp, Homo sapiens
gcagagggagcccttcgatgggacc

SEQ ID NO: 19115 - DNA, 25 bp, Homo sapiens
ggacctgcctcgggtgcaaggaggc

SEQ ID NO: 19116 - DNA, 25 bp, Homo sapiens
tctcaggccttttccagatggacgt

SEQ ID NO: 19117 - DNA, 25 bp, Homo sapiens
ttcaggccatgcggcaatgccaacc

SEQ ID NO: 19118 - DNA, 25 bp, Homo sapiens
gccaacccccacaagtgggtgcgac

SEQ ID NO: 19119 - DNA, 25 bp, Homo sapiens
aagccacagcgacgcctatgtcatt

SEQ ID NO: 19120 - DNA, 25 bp, Homo sapiens
aatttgagtctcatcgaatcctccg

SEQ ID NO: 19121 - DNA, 25 bp, Homo sapiens
ccacctcagggcgagctgactgtga

SEQ ID NO: 19122 - DNA, 25 bp, Homo sapiens
tgactgtgatgcggtaccaactctc

SEQ ID NO: 19123 - DNA, 25 bp, Homo sapiens
ttgccttctatccgggatatccggg

SEQ ID NO: 19124 - DNA, 25 bp, Homo sapiens
gccagttacctggacgtgtctgtgg

SEQ ID NO: 19125 - DNA, 25 bp, Homo sapiens
ctggagaaccgcgacatgactccct

SEQ ID NO: 19126 - DNA, 25 bp, Homo sapiens
tggacagttaccagtcttgggctct

SEQ ID NO: 19127 - DNA, 25 bp, Homo sapiens
ggaacagccagatgtgttgccaggg

SEQ ID NO: 19128 - DNA, 25 bp, Homo sapiens
ttcgtcgcggccgcaagaaacgcat

SEQ ID NO: 19129 - DNA, 25 bp, Homo sapiens
aacgcattccgtacagcaaggggca

SEQ ID NO: 19130 - DNA, 25 bp, Homo sapiens
gcggctaacaagttcatcaccaagg

SEQ ID NO: 19131 - DNA, 25 bp, Homo sapiens
caagaggcgcaagatctcggcagcc

SEQ ID NO: 19132 - DNA, 25 bp, Homo sapiens
aaggtgaagaacagcgctacccctt

SEQ ID NO: 19133 - DNA, 25 bp, Homo sapiens
taccccttaagagatctccttgcct

SEQ ID NO: 19134 - DNA, 25 bp, Homo sapiens
tgtatggtcgctggccagtgattct

SEQ ID NO: 19135 - DNA, 25 bp, Homo sapiens
tcgctttcctctgataaccacatgg

SEQ ID NO: 19136 - DNA, 25 bp, Homo sapiens
catggacacatcctgaagtcagccc

SEQ ID NO: 19137 - DNA, 25 bp, Homo sapiens
ttcttccttcaggtccctgggtgaa

SEQ ID NO: 19138 - DNA, 25 bp, Homo sapiens
cccgttggatgccctgactgggggc

SEQ ID NO: 19139 - DNA, 25 bp, Homo sapiens
gaagagacagggcacagctggccac

SEQ ID NO: 19140 - DNA, 25 bp, Homo sapiens
gctttgcatcctggacggggagtgt

SEQ ID NO: 19141 - DNA, 25 bp, Homo sapiens
tcagggaccagatgtgtcctgcctc

SEQ ID NO: 19142 - DNA, 25 bp, Homo sapiens
cttccccacgtgaccggggattctg

SEQ ID NO: 19143 - DNA, 25 bp, Homo sapiens
gtgaccggggattctggttgcaata

SEQ ID NO: 19144 - DNA, 25 bp, Homo sapiens
gttgcaataaaacatgctgctgctg

SEQ ID NO: 19145 - DNA, 25 bp, Homo sapiens
gaccgacattgccttggtttgttac

SEQ ID NO: 19146 - DNA, 25 bp, Homo sapiens
ggaaatagtaatcacacctctctgt

SEQ ID NO: 19147 - DNA, 25 bp, Homo sapiens
aagtgaaacctgagatccggctgtt

SEQ ID NO: 19148 - DNA, 25 bp, Homo sapiens
atgtgggtacagctcctgattccca

SEQ ID NO: 19149 - DNA, 25 bp, Homo sapiens
tatccccatgtggaggactatcgcc

SEQ ID NO: 19150 - DNA, 25 bp, Homo sapiens
tatcgccgcaccgtgacagagattg

SEQ ID NO: 19151 - DNA, 25 bp, Homo sapiens
agccttcggctcatcatatcagagc

SEQ ID NO: 19152 - DNA, 25 bp, Homo sapiens
atcgagaagatcaaacggccccgga

SEQ ID NO: 19153 - DNA, 25 bp, Homo sapiens
gccccggagcagcaatgcagagact

SEQ ID NO: 19154 - DNA, 25 bp, Homo sapiens
agagactctgtactgaggccagggc

SEQ ID NO: 19155 - DNA, 25 bp, Homo sapiens
ggactctgtgagtctggctcaagac

SEQ ID NO: 19156 - DNA, 25 bp, Homo sapiens
actgggctttctcctgggaattacg

SEQ ID NO: 19157 - DNA, 25 bp, Homo sapiens
aaagctcagcagggctgtgcttgcc

SEQ ID NO: 19158 - DNA, 25 bp, Homo sapiens
atagtcaggtcttcccagattatct

SEQ ID NO: 19159 - DNA, 25 bp, Homo sapiens
agccagaatccagtatctcttgctc

SEQ ID NO: 19160 - DNA, 25 bp, Homo sapiens
tccatcctacaggtaactcctcagt

SEQ ID NO: 19161 - DNA, 25 bp, Homo sapiens
actcctcagttacctttaatgggat

SEQ ID NO: 19162 - DNA, 25 bp, Homo sapiens
gggatttgtggccagagtccaagaa

SEQ ID NO: 19163 - DNA, 25 bp, Homo sapiens
gaaccagtctttgatgagtctcccc

SEQ ID NO: 19164 - DNA, 25 bp, Homo sapiens
cctcctcctccagaagattacgaag

SEQ ID NO: 19165 - DNA, 25 bp, Homo sapiens
tgaagaggacccaccgtgggctcca

SEQ ID NO: 19166 - DNA, 25 bp, Homo sapiens
tgggctccacgttcttacttggaaa

SEQ ID NO: 19167 - DNA, 25 bp, Homo sapiens
aacactagggccttggaaattcctg

SEQ ID NO: 19168 - DNA, 25 bp, Homo sapiens
gaaattcctgtactgtgtctcatgg

SEQ ID NO: 19169 - DNA, 25 bp, Homo sapiens
gtgtctcatggatttggcactagcc

SEQ ID NO: 19170 - DNA, 25 bp, Homo sapiens
gccaaagcgaggcacccttactggc

SEQ ID NO: 19171 - DNA, 25 bp, Homo sapiens
gtggcctcagctcaatgcagttagc

SEQ ID NO: 19172 - DNA, 25 bp, Homo sapiens
tcttggtaatcccctaaaataacag

SEQ ID NO: 19173 - DNA, 25 bp, Homo sapiens
agcttcagttgcttgtcttctggta

SEQ ID NO: 19174 - DNA, 25 bp, Homo sapiens
cttgtcttctggtactttctgttat

SEQ ID NO: 19175 - DNA, 25 bp, Homo sapiens
gtactttctgttatgggcttttggg

SEQ ID NO: 19176 - DNA, 25 bp, Homo sapiens
gggagccagaagccaatctacaatc

SEQ ID NO: 19177 - DNA, 25 bp, Homo sapiens
gaagccaatctacaatctctttttg

SEQ ID NO: 19178 - DNA, 25 bp, Homo sapiens
ctacagcccgcatcaatgatcagcc

SEQ ID NO: 19179 - DNA, 25 bp, Homo sapiens
gagtcatctgtcactaggcagcacc

SEQ ID NO: 19180 - DNA, 25 bp, Homo sapiens
acatacatgcctgcaacgtcagcta

SEQ ID NO: 19181 - DNA, 25 bp, Homo sapiens
caaggagcctacttgccacagtatg

SEQ ID NO: 19182 - DNA, 25 bp, Homo sapiens
ggaatgacacttacttacgacccaa

SEQ ID NO: 19183 - DNA, 25 bp, Homo sapiens
cgacccaactacagctgctatacag

SEQ ID NO: 19184 - DNA, 25 bp, Homo sapiens
gattttatccttcaccatacagtat

SEQ ID NO: 19185 - DNA, 25 bp, Homo sapiens
ctattacaccctatattgcatctcc

SEQ ID NO: 19186 - DNA, 25 bp, Homo sapiens
caaagtccttcgtggatgcaacctc

SEQ ID NO: 19187 - DNA, 25 bp, Homo sapiens
tgcaacctcaaccatatattctaca

SEQ ID NO: 19188 - DNA, 25 bp, Homo sapiens
attctacagcaccctggtgccgtgt

SEQ ID NO: 19189 - DNA, 25 bp, Homo sapiens
aagccattattctctgatgcactgt

SEQ ID NO: 19190 - DNA, 25 bp, Homo sapiens
cagtaactcactttaaaacctctct

SEQ ID NO: 19191 - DNA, 25 bp, Homo sapiens
ccagggccactgcttgaagaagaat

SEQ ID NO: 19192 - DNA, 25 bp, Homo sapiens
ctgccccgaaagtgctgactatggg

SEQ ID NO: 19193 - DNA, 25 bp, Homo sapiens
ttagctgctgtttttagactccaag

SEQ ID NO: 19194 - DNA, 25 bp, Homo sapiens
caaacctgatacaatttgcccaagg

SEQ ID NO: 19195 - DNA, 25 bp, Homo sapiens
gccaaactgtacagtttcttcccca

SEQ ID NO: 19196 - DNA, 25 bp, Homo sapiens
cctccgtgcttttctggttgagatc

SEQ ID NO: 19197 - DNA, 25 bp, Homo sapiens
tttgtgtttacatctgcatttctac

SEQ ID NO: 19198 - DNA, 25 bp, Homo sapiens
gagacaatttaaggcctgcactctt

SEQ ID NO: 19199 - DNA, 25 bp, Homo sapiens
gcctgcactcttatttcactaaaga

SEQ ID NO: 19200 - DNA, 25 bp, Homo sapiens
ggagagtcacagaacaaatgtttgt

SEQ ID NO: 19201 - DNA, 25 bp, Homo sapiens
aagcgttccaagtattttgccacgt

SEQ ID NO: 19202 - DNA, 25 bp, Homo sapiens
tcttctccctgcacaagccagggtg

SEQ ID NO: 19203 - DNA, 25 bp, Homo sapiens
gcacaagccagggtgtgtctcggta

SEQ ID NO: 19204 - DNA, 25 bp, Homo sapiens
tctcggtagctgtgcgtggtgtgga

SEQ ID NO: 19205 - DNA, 25 bp, Homo sapiens
tagctgtgcgtggtgtggagtgtgt

SEQ ID NO: 19206 - DNA, 25 bp, Homo sapiens
tttcctccctgaagctgtgcggagc

SEQ ID NO: 19207 - DNA, 25 bp, Homo sapiens
cctctgccactgactgcagggacac

SEQ ID NO: 19208 - DNA, 25 bp, Homo sapiens
tgccactgactgcagggacacgggc

SEQ ID NO: 19209 - DNA, 25 bp, Homo sapiens
gctcccaggacacgacttgtaatga

SEQ ID NO: 19210 - DNA, 25 bp, Homo sapiens
gaaagtttggggacatgtgattgat

SEQ ID NO: 19211 - DNA, 25 bp, Homo sapiens
ttcaggccgtgcctaggctggtgaa

SEQ ID NO: 19212 - DNA, 25 bp, Homo sapiens
tcaaccacgccaaccaggaagtgca

SEQ ID NO: 19213 - DNA, 25 bp, Homo sapiens
cctcatctacgacaacgctgacaac

SEQ ID NO: 19214 - DNA, 25 bp, Homo sapiens
gaggagaacgggatcttcgagctgc

SEQ ID NO: 19215 - DNA, 25 bp, Homo sapiens
gatcctgtggaacctttcatccagc

SEQ ID NO: 19216 - DNA, 25 bp, Homo sapiens
ctggccagagacacgctggagcagc

SEQ ID NO: 19217 - DNA, 25 bp, Homo sapiens
agcagctcacagacctggtgttgag

SEQ ID NO: 19218 - DNA, 25 bp, Homo sapiens
ggcggagatcttctacaacgccacc

SEQ ID NO: 19219 - DNA, 25 bp, Homo sapiens
tctcaggccactcgccagaagatgc

SEQ ID NO: 19220 - DNA, 25 bp, Homo sapiens
cagaagatgcgggagtgccacgggc

SEQ ID NO: 19221 - DNA, 25 bp, Homo sapiens
acgccctggacgcgggcaaatgcga

SEQ ID NO: 19222 - DNA, 25 bp, Homo sapiens
catagctgtgctcaacaacctggtg

SEQ ID NO: 19223 - DNA, 25 bp, Homo sapiens
ctgctgtattttgacggactccgaa

SEQ ID NO: 19224 - DNA, 25 bp, Homo sapiens
gacagccccgacagtgagaagtcct

SEQ ID NO: 19225 - DNA, 25 bp, Homo sapiens
ctcctggccaacctgtggcagtaca

SEQ ID NO: 19226 - DNA, 25 bp, Homo sapiens
gacttcctgggcccataggtgaagc

SEQ ID NO: 19227 - DNA, 25 bp, Homo sapiens
ggaggagaaggtgacgtggcccagc

SEQ ID NO: 19228 - DNA, 25 bp, Homo sapiens
tccaagggacagactcagctccagg

SEQ ID NO: 19229 - DNA, 25 bp, Homo sapiens
ggcccctgtgtgcatctttgagggt

SEQ ID NO: 19230 - DNA, 25 bp, Homo sapiens
ttatagctggggacttggcttccgc

SEQ ID NO: 19231 - DNA, 25 bp, Homo sapiens
gctcaaggctgctctggtgtatggg

SEQ ID NO: 19232 - DNA, 25 bp, Homo sapiens
ggcctggcagtatcttgggatagcc

SEQ ID NO: 19233 - DNA, 25 bp, Homo sapiens
ggtgtttccttctgggcagatcagc

SEQ ID NO: 19234 - DNA, 25 bp, Homo sapiens
gctccagccatggtatcagctctgg

SEQ ID NO: 19235 - DNA, 25 bp, Homo sapiens
ggctggggaaggaacgctgtcagag

SEQ ID NO: 19236 - DNA, 25 bp, Homo sapiens
ggccttgcttggcaacagcacagac

SEQ ID NO: 19237 - DNA, 25 bp, Homo sapiens
atccgtcgacaactccgagtttcag

SEQ ID NO: 19238 - DNA, 25 bp, Homo sapiens
ccacacaactgagcccatgctgatg

SEQ ID NO: 19239 - DNA, 25 bp, Homo sapiens
catgctgatggagtaccctgaggct

SEQ ID NO: 19240 - DNA, 25 bp, Homo sapiens
accctgaggctataactcgcctagt

SEQ ID NO: 19241 - DNA, 25 bp, Homo sapiens
ccccaatggcctcctttcaggagat

SEQ ID NO: 19242 - DNA, 25 bp, Homo sapiens
ccattgcggacatggacttctcagc

SEQ ID NO: 19243 - DNA, 25 bp, Homo sapiens
agccctgctgagtcagatcagctcc

SEQ ID NO: 19244 - DNA, 25 bp, Homo sapiens
ccctgctcaggtctagaatcccaag

SEQ ID NO: 19245 - DNA, 25 bp, Homo sapiens
gtgagccgcagatgtgacttttttt

SEQ ID NO: 19246 - DNA, 25 bp, Homo sapiens
tcttcagcaatccagaggttccttg

SEQ ID NO: 19247 - DNA, 25 bp, Homo sapiens
ggttccttgacctcattatttgtcc

SEQ ID NO: 19248 - DNA, 25 bp, Homo sapiens
ctctcccttatagtcctaagccaag

SEQ ID NO: 19249 - DNA, 25 bp, Homo sapiens
gacctttgacatttgacctttgcag

SEQ ID NO: 19250 - DNA, 25 bp, Homo sapiens
gcgtcagtatagaggcctttgcatc

SEQ ID NO: 19251 - DNA, 25 bp, Homo sapiens
ggaggctaaaccctgtctggatttc

SEQ ID NO: 19252 - DNA, 25 bp, Homo sapiens
gacaaccgtgacatcagcagtgctg

SEQ ID NO: 19253 - DNA, 25 bp, Homo sapiens
gtgtgtggactgaacacctgcactt

SEQ ID NO: 19254 - DNA, 25 bp, Homo sapiens
catcatctgtcttgcgtgctatttc

SEQ ID NO: 19255 - DNA, 25 bp, Homo sapiens
gggggtaaagtctttcaccagcaca

SEQ ID NO: 19256 - DNA, 25 bp, Homo sapiens
ctttcaccagcacacaagagtttga

SEQ ID NO: 19257 - DNA, 25 bp, Homo sapiens
attgtacaaatatatcttctgcatt

SEQ ID NO: 19258 - DNA, 25 bp, Homo sapiens
cttctgcattaacatctctgcctgt

SEQ ID NO: 19259 - DNA, 25 bp, Homo sapiens
gttgcttaagatcagttgcttttat

SEQ ID NO: 19260 - DNA, 25 bp, Homo sapiens
gatcagttgcttttatactcagaat

SEQ ID NO: 19261 - DNA, 25 bp, Homo sapiens
aatacctgatcttggctagttttgt

SEQ ID NO: 19262 - DNA, 25 bp, Homo sapiens
tgatttcatttagatttccctccac

SEQ ID NO: 19263 - DNA, 25 bp, Homo sapiens
atttccctccacgaggtcagcaaac

SEQ ID NO: 19264 - DNA, 25 bp, Homo sapiens
tcagcaaactatcatgttcttatgt

SEQ ID NO: 19265 - DNA, 25 bp, Homo sapiens
ttatgtaaacttaggccaaggccag

SEQ ID NO: 19266 - DNA, 25 bp, Homo sapiens
ccctaggttgctacggcttatcatg

SEQ ID NO: 19267 - DNA, 25 bp, Homo sapiens
gctacggcttatcatgtgcttggta

SEQ ID NO: 19268 - DNA, 25 bp, Homo sapiens
ggtgatcgcaggttctcagacgagt

SEQ ID NO: 19269 - DNA, 25 bp, Homo sapiens
gacgagtttactttacatgagatgg

SEQ ID NO: 19270 - DNA, 25 bp, Homo sapiens
gttccaaagaggtggtttctgagga

SEQ ID NO: 19271 - DNA, 25 bp, Homo sapiens
ttctgaggaagtcagagcgcccagg

SEQ ID NO: 19272 - DNA, 25 bp, Homo sapiens
gaggttgtttggaaagtcggtgtga

SEQ ID NO: 19273 - DNA, 25 bp, Homo sapiens
gacacatggatgccatctacttcta

SEQ ID NO: 19274 - DNA, 25 bp, Homo sapiens
atctacttctaggttgctggtgggt

SEQ ID NO: 19275 - DNA, 25 bp, Homo sapiens
gcacaatattccatagctcactgag

SEQ ID NO: 19276 - DNA, 25 bp, Homo sapiens
ggccagagttatcatagtccctagg

SEQ ID NO: 19277 - DNA, 25 bp, Homo sapiens
gaccaatgacccttgccttggaaat

SEQ ID NO: 19278 - DNA, 25 bp, Homo sapiens
taaatgcgtacatggcacctgcttg

SEQ ID NO: 19279 - DNA, 25 bp, Homo sapiens
tgcgttctcctacagctgtaagtgc

SEQ ID NO: 19280 - DNA, 25 bp, Homo sapiens
ggccatggaggtgtcctctgtgatg

SEQ ID NO: 19281 - DNA, 25 bp, Homo sapiens
ggaggatctgtttaacccatgccag

SEQ ID NO: 19282 - DNA, 25 bp, Homo sapiens
tttcaggtctggggcagccctactg

SEQ ID NO: 19283 - DNA, 25 bp, Homo sapiens
gaaggtgtcccgattagagtgcaga

SEQ ID NO: 19284 - DNA, 25 bp, Homo sapiens
actctttcgaatgcactgacggctc

SEQ ID NO: 19285 - DNA, 25 bp, Homo sapiens
gaagtgcggctgtacgaggtgtgtg

SEQ ID NO: 19286 - DNA, 25 bp, Homo sapiens
cccggcagctctgtctttggaaaag

SEQ ID NO: 19287 - DNA, 25 bp, Homo sapiens
gtatacttcttgaccatgtgggact

SEQ ID NO: 19288 - DNA, 25 bp, Homo sapiens
cgtcaacgacatcttcgagcgcatc

SEQ ID NO: 19289 - DNA, 25 bp, Homo sapiens
cccgcctggcgcattacaacaagcg

SEQ ID NO: 19290 - DNA, 25 bp, Homo sapiens
gcattacaacaagcgctcgaccatc

SEQ ID NO: 19291 - DNA, 25 bp, Homo sapiens
tcgaccatcacctccagggagatcc

SEQ ID NO: 19292 - DNA, 25 bp, Homo sapiens
tcaccaagtacaccagttccaagta

SEQ ID NO: 19293 - DNA, 25 bp, Homo sapiens
gaacttaggaagtctcatctgcctg

SEQ ID NO: 19294 - DNA, 25 bp, Homo sapiens
tgactgtgtggatcccacccaaatc

SEQ ID NO: 19295 - DNA, 25 bp, Homo sapiens
aaatccaactcatcctggtttgctg

SEQ ID NO: 19296 - DNA, 25 bp, Homo sapiens
aggtgtttgcacttcatgttacttt

SEQ ID NO: 19297 - DNA, 25 bp, Homo sapiens
atttacttctgttacagacctagtt

SEQ ID NO: 19298 - DNA, 25 bp, Homo sapiens
tacttgccatggactacctttgcta

SEQ ID NO: 19299 - DNA, 25 bp, Homo sapiens
tttttgcagcaccaggcgaacactt

SEQ ID NO: 19300 - DNA, 25 bp, Homo sapiens
ttgcagcaccaggcgaacacttaca

SEQ ID NO: 19301 - DNA, 25 bp, Homo sapiens
ccaggcgaacacttacaccagtgct

SEQ ID NO: 19302 - DNA, 25 bp, Homo sapiens
cgaacacttacaccagtgctttgta

SEQ ID NO: 19303 - DNA, 25 bp, Homo sapiens
taaaggaatcttattgtccaccccg

SEQ ID NO: 19304 - DNA, 25 bp, Homo sapiens
caccccgtgtcttggcaaaagaaca

SEQ ID NO: 19305 - DNA, 25 bp, Homo sapiens
agtgatcacacagattcctacttgg

SEQ ID NO: 19306 - DNA, 25 bp, Homo sapiens
atcacacagattcctacttgggctc

SEQ ID NO: 19307 - DNA, 25 bp, Homo sapiens
ctttcctttaatcttcggaggctga

SEQ ID NO: 19308 - DNA, 25 bp, Homo sapiens
cttcggaggctgagtttgcccaact

SEQ ID NO: 19309 - DNA, 25 bp, Homo sapiens
ttgcccaactcaggtttaaccacca

SEQ ID NO: 19310 - DNA, 25 bp, Homo sapiens
ccggtcccatcttctgagagggctt

SEQ ID NO: 19311 - DNA, 25 bp, Homo sapiens
gtcccatcttctgagagggcttctc

SEQ ID NO: 19312 - DNA, 25 bp, Homo sapiens
gggcttctcagcctggaaactatgg

SEQ ID NO: 19313 - DNA, 25 bp, Homo sapiens
atgaaactttgctatgggccctgca

SEQ ID NO: 19314 - DNA, 25 bp, Homo sapiens
tcctgttcaccctggtggtgtacgg

SEQ ID NO: 19315 - DNA, 25 bp, Homo sapiens
ggtggtgtacggatgaggcggggag

SEQ ID NO: 19316 - DNA, 25 bp, Homo sapiens
ggaggtgggacccccaaacatatat

SEQ ID NO: 19317 - DNA, 25 bp, Homo sapiens
aaacatatatcagcccaacagccct

SEQ ID NO: 19318 - DNA, 25 bp, Homo sapiens
cctaagtctccttctttattattag

SEQ ID NO: 19319 - DNA, 25 bp, Homo sapiens
tgtactgtgtcctcaaatttaatgg

SEQ ID NO: 19320 - DNA, 25 bp, Homo sapiens
taatggattaatgtgtcttgtatat

SEQ ID NO: 19321 - DNA, 25 bp, Homo sapiens
agaacgatgatcgtcacctctgtgc

SEQ ID NO: 19322 - DNA, 25 bp, Homo sapiens
ctccctgttgtctcaaagcggtacc

SEQ ID NO: 19323 - DNA, 25 bp, Homo sapiens
ggaacgaaaccagcgtcctattcca

SEQ ID NO: 19324 - DNA, 25 bp, Homo sapiens
cctcctcattatcgccatggtgaag

SEQ ID NO: 19325 - DNA, 25 bp, Homo sapiens
gaagagcaaccagtacctgtccatc

SEQ ID NO: 19326 - DNA, 25 bp, Homo sapiens
tccatgccataccacttgtcagggc

SEQ ID NO: 19327 - DNA, 25 bp, Homo sapiens
ttgtgaagtcattgcctgctcaaga

SEQ ID NO: 19328 - DNA, 25 bp, Homo sapiens
tcaagaatgtacagtggctccccaa

SEQ ID NO: 19329 - DNA, 25 bp, Homo sapiens
ggctccccaatgccttggagccata

SEQ ID NO: 19330 - DNA, 25 bp, Homo sapiens
cagttctagctctctattacctgtc

SEQ ID NO: 19331 - DNA, 25 bp, Homo sapiens
actcaactgactcatacctgtttcc

SEQ ID NO: 19332 - DNA, 25 bp, Homo sapiens
gcagatgctgcaggacgccatcagc

SEQ ID NO: 19333 - DNA, 25 bp, Homo sapiens
gccatcagcaagatggaccccaccg

SEQ ID NO: 19334 - DNA, 25 bp, Homo sapiens
ccaccgacgcaaagtaccacatgca

SEQ ID NO: 19335 - DNA, 25 bp, Homo sapiens
tcctggggacccattactggaagct

SEQ ID NO: 19336 - DNA, 25 bp, Homo sapiens
agctgttcccaagacgggcgatgag

SEQ ID NO: 19337 - DNA, 25 bp, Homo sapiens
aaggatgtcagtgtgtgacctgccc

SEQ ID NO: 19338 - DNA, 25 bp, Homo sapiens
gacaatcgtcatgcaatttatcctg

SEQ ID NO: 19339 - DNA, 25 bp, Homo sapiens
cttccggcagttcttcactaagatt

SEQ ID NO: 19340 - DNA, 25 bp, Homo sapiens
ttaagacagccgatcgccagtacat

SEQ ID NO: 19341 - DNA, 25 bp, Homo sapiens
aagccttcaaggagcgtgtgcgggg

SEQ ID NO: 19342 - DNA, 25 bp, Homo sapiens
ccctccctgaggaactccagaagtg

SEQ ID NO: 19343 - DNA, 25 bp, Homo sapiens
gtcgtagctataacttcaaattttt

SEQ ID NO: 19344 - DNA, 25 bp, Homo sapiens
aatgtgtgtattcttaaaatgcaat

SEQ ID NO: 19345 - DNA, 25 bp, Homo sapiens
gcaatatttgtaaggcttgttccaa

SEQ ID NO: 19346 - DNA, 25 bp, Homo sapiens
taaggcttgttccaatgccacatac

SEQ ID NO: 19347 - DNA, 25 bp, Homo sapiens
gcttgttccaatgccacatacttgc

SEQ ID NO: 19348 - DNA, 25 bp, Homo sapiens
ttccaatgccacatacttgcagctc

SEQ ID NO: 19349 - DNA, 25 bp, Homo sapiens
agctcccattctatgtgtcatcaat

SEQ ID NO: 19350 - DNA, 25 bp, Homo sapiens
gtgtcatcaatagtgtcctatgcaa

SEQ ID NO: 19351 - DNA, 25 bp, Homo sapiens
gcaataaattatttgcaggtcttta

SEQ ID NO: 19352 - DNA, 25 bp, Homo sapiens
ttcctaaaaatgcttcactgtacgt

SEQ ID NO: 19353 - DNA, 25 bp, Homo sapiens
tgcttcactgtacgtagttaagtcg

SEQ ID NO: 19354 - DNA, 25 bp, Homo sapiens
tgatgctacctggcgtgttttttct

SEQ ID NO: 19355 - DNA, 25 bp, Homo sapiens
ttcagcatccagacgatgtgcccca

SEQ ID NO: 19356 - DNA, 25 bp, Homo sapiens
aacattgcacgtttcttgttctctc

SEQ ID NO: 19357 - DNA, 25 bp, Homo sapiens
ataatgctgtcaacgcaacccttat

SEQ ID NO: 19358 - DNA, 25 bp, Homo sapiens
ctccatgaactctgctcttgggaag

SEQ ID NO: 19359 - DNA, 25 bp, Homo sapiens
agcccttggctcgctgggaatgaac

SEQ ID NO: 19360 - DNA, 25 bp, Homo sapiens
ggaatgaactcaccgtagcagacgt

SEQ ID NO: 19361 - DNA, 25 bp, Homo sapiens
gctgtggtctgtactccagcagatc

SEQ ID NO: 19362 - DNA, 25 bp, Homo sapiens
ggaggctgcagtgtgacagtgccag

SEQ ID NO: 19363 - DNA, 25 bp, Homo sapiens
tgaaaacctggctccttttaacacg

SEQ ID NO: 19364 - DNA, 25 bp, Homo sapiens
tgctctttcatgcctattatcagta

SEQ ID NO: 19365 - DNA, 25 bp, Homo sapiens
acatcgcctgaccggggagaagtgg

SEQ ID NO: 19366 - DNA, 25 bp, Homo sapiens
ggtgggacccttatgagactcagtc

SEQ ID NO: 19367 - DNA, 25 bp, Homo sapiens
tgactgtctaggaggatcccttgcc

SEQ ID NO: 19368 - DNA, 25 bp, Homo sapiens
agaaatcagccgggatgcctgcatc

SEQ ID NO: 19369 - DNA, 25 bp, Homo sapiens
ggtcagctcccctaaaatgggcacg

SEQ ID NO: 19370 - DNA, 25 bp, Homo sapiens
cctggcccccttgagagagggcttg

SEQ ID NO: 19371 - DNA, 25 bp, Homo sapiens
gcttgttggtgagggctgactcctg

SEQ ID NO: 19372 - DNA, 25 bp, Homo sapiens
gccaccttttaaggcaccactagca

SEQ ID NO: 19373 - DNA, 25 bp, Homo sapiens
aggatatggtggcatcagccctggg

SEQ ID NO: 19374 - DNA, 25 bp, Homo sapiens
tgcagtgctcatttggaattcctcc

SEQ ID NO: 19375 - DNA, 25 bp, Homo sapiens
ccattcttcctaacactggcaataa

SEQ ID NO: 19376 - DNA, 25 bp, Homo sapiens
gtgtggctgatctgaagtcagtcgg

SEQ ID NO: 19377 - DNA, 25 bp, Homo sapiens
gcgttgcagcaatcagtgttaaatc

SEQ ID NO: 19378 - DNA, 25 bp, Homo sapiens
gacattcttatgcttcttttacaac

SEQ ID NO: 19379 - DNA, 25 bp, Homo sapiens
caactacatcccattttatatttcc

SEQ ID NO: 19380 - DNA, 25 bp, Homo sapiens
ttctctcaggaaaattgcctttctc

SEQ ID NO: 19381 - DNA, 25 bp, Homo sapiens
tacaagaacaccaatataccccctt

SEQ ID NO: 19382 - DNA, 25 bp, Homo sapiens
ttgcaacaacactttactacctaac

SEQ ID NO: 19383 - DNA, 25 bp, Homo sapiens
atactctaggtatctgtaaacactc

SEQ ID NO: 19384 - DNA, 25 bp, Homo sapiens
gtaaacactctgatgaagtctgtat

SEQ ID NO: 19385 - DNA, 25 bp, Homo sapiens
gactaacccacaggcaggttggttt

SEQ ID NO: 19386 - DNA, 25 bp, Homo sapiens
gtcctatggaaacctatttcaccag

SEQ ID NO: 19387 - DNA, 25 bp, Homo sapiens
gtgtggaagacggactaagcctaga

SEQ ID NO: 19388 - DNA, 25 bp, Homo sapiens
ctagagaggccgcaaggggaccgcc

SEQ ID NO: 19389 - DNA, 25 bp, Homo sapiens
tgcagtagtgccaaaaggccccttc

SEQ ID NO: 19390 - DNA, 25 bp, Homo sapiens
tctgtagcctggtctgtgcattgtg

SEQ ID NO: 19391 - DNA, 25 bp, Homo sapiens
gtgcattgtggctgtcaaatccatg

SEQ ID NO: 19392 - DNA, 25 bp, Homo sapiens
cagccatggctggatgtgcatctgg

SEQ ID NO: 19393 - DNA, 25 bp, Homo sapiens
gctggatgtgcatctggcctatgac

SEQ ID NO: 19394 - DNA, 25 bp, Homo sapiens
tgcctgtgtttcatgttctgtgtca

SEQ ID NO: 19395 - DNA, 25 bp, Homo sapiens
tcatgttctgtgtcacgtgaccctg

SEQ ID NO: 19396 - DNA, 25 bp, Homo sapiens
cctggatgtggccatagtgtttgtc

SEQ ID NO: 19397 - DNA, 25 bp, Homo sapiens
gaagctgctcaacaaagtgtggaag

SEQ ID NO: 19398 - DNA, 25 bp, Homo sapiens
gaaacggattcgggaattctaccag

SEQ ID NO: 19399 - DNA, 25 bp, Homo sapiens
tctaccagtcccgaggtttggaccg

SEQ ID NO: 19400 - DNA, 25 bp, Homo sapiens
cttcagcagctttgaccactctaaa

SEQ ID NO: 19401 - DNA, 25 bp, Homo sapiens
aaagcccactactatcgctatgatg

SEQ ID NO: 19402 - DNA, 25 bp, Homo sapiens
gatgagcagttgaacctgtgcctgg

SEQ ID NO: 19403 - DNA, 25 bp, Homo sapiens
gtatgtccgatgttctgttagagct

SEQ ID NO: 19404 - DNA, 25 bp, Homo sapiens
gttagagctgaggtacgccatctcc

SEQ ID NO: 19405 - DNA, 25 bp, Homo sapiens
ccgcttgatgctaaaccctcagcat

SEQ ID NO: 19406 - DNA, 25 bp, Homo sapiens
tcagcatgtgcagctcctttttgac

SEQ ID NO: 19407 - DNA, 25 bp, Homo sapiens
gacaatgaagttctccctgatcaca

SEQ ID NO: 19408 - DNA, 25 bp, Homo sapiens
aagttctccctgatcacatgacaat

SEQ ID NO: 19409 - DNA, 25 bp, Homo sapiens
gtcatttgtattaaacccagatcta

SEQ ID NO: 19410 - DNA, 25 bp, Homo sapiens
gagtatgtggttcatgctgttgtga

SEQ ID NO: 19411 - DNA, 25 bp, Homo sapiens
ttaccctttgtagctcagagagcac

SEQ ID NO: 19412 - DNA, 25 bp, Homo sapiens
gaacacgacaggatagccagacagt

SEQ ID NO: 19413 - DNA, 25 bp, Homo sapiens
ggagcagaaggcatcttctcactgt

SEQ ID NO: 19414 - DNA, 25 bp, Homo sapiens
gcatcttctcactgtgctgcaaatc

SEQ ID NO: 19415 - DNA, 25 bp, Homo sapiens
gctgcaaatctttatagcctttaca

SEQ ID NO: 19416 - DNA, 25 bp, Homo sapiens
atagcctttacaatacggacttctg

SEQ ID NO: 19417 - DNA, 25 bp, Homo sapiens
atgttatactgattctactctgctt

SEQ ID NO: 19418 - DNA, 25 bp, Homo sapiens
aaacgcctacttgcaagtcttgctt

SEQ ID NO: 19419 - DNA, 25 bp, Homo sapiens
ttatagtgcattttagcctaattca

SEQ ID NO: 19420 - DNA, 25 bp, Homo sapiens
ccacccctgtttcatgtgggcacta

SEQ ID NO: 19421 - DNA, 25 bp, Homo sapiens
gtgggcactaacacgtgtgcgttcc

SEQ ID NO: 19422 - DNA, 25 bp, Homo sapiens
gcactaacacgtgtgcgttcctggc

SEQ ID NO: 19423 - DNA, 25 bp, Homo sapiens
ggcggctgctctgtcatgagaatgt

SEQ ID NO: 19424 - DNA, 25 bp, Homo sapiens
gtcatgagaatgtacggcccgtgga

SEQ ID NO: 19425 - DNA, 25 bp, Homo sapiens
atgtacggcccgtggatgattaacg

SEQ ID NO: 19426 - DNA, 25 bp, Homo sapiens
ggatgattaacgggcctttttcact

SEQ ID NO: 19427 - DNA, 25 bp, Homo sapiens
tgattaacgggcctttttcacttag

SEQ ID NO: 19428 - DNA, 25 bp, Homo sapiens
acgggcctttttcacttagaagctg

SEQ ID NO: 19429 - DNA, 25 bp, Homo sapiens
ggcctttttcacttagaagctgcac

SEQ ID NO: 19430 - DNA, 25 bp, Homo sapiens
agaagctgcacattatggagcatta

SEQ ID NO: 19431 - DNA, 25 bp, Homo sapiens
tgtgtgacagcaagatccgttccaa

SEQ ID NO: 19432 - DNA, 25 bp, Homo sapiens
caccctatacctagcactgtgacac

SEQ ID NO: 19433 - DNA, 25 bp, Homo sapiens
ccacccctaaatcactttgagcctg

SEQ ID NO: 19434 - DNA, 25 bp, Homo sapiens
tgagcctgggaaataagccccctca

SEQ ID NO: 19435 - DNA, 25 bp, Homo sapiens
taccattccttctttaaacactctt

SEQ ID NO: 19436 - DNA, 25 bp, Homo sapiens
cctccaaccaggctcctgtgataga

SEQ ID NO: 19437 - DNA, 25 bp, Homo sapiens
tgggatgaagcctttcgcaagttcc

SEQ ID NO: 19438 - DNA, 25 bp, Homo sapiens
gccacaagagcgccaaggcttcggg

SEQ ID NO: 19439 - DNA, 25 bp, Homo sapiens
gtgccactggctgacagctttaggc

SEQ ID NO: 19440 - DNA, 25 bp, Homo sapiens
atgttggttggcgccttgattactt

SEQ ID NO: 19441 - DNA, 25 bp, Homo sapiens
ttgattactttttgttgtcccactc

SEQ ID NO: 19442 - DNA, 25 bp, Homo sapiens
gagccccacgtggggtgaggctgct

SEQ ID NO: 19443 - DNA, 25 bp, Homo sapiens
cttcaggatccgccacaaacagaca

SEQ ID NO: 19444 - DNA, 25 bp, Homo sapiens
caaacagacactttttgcttcctta

SEQ ID NO: 19445 - DNA, 25 bp, Homo sapiens
ggaagctcggcatttggtttcacta

SEQ ID NO: 19446 - DNA, 25 bp, Homo sapiens
ctaagggccatgtggttccctgcag

SEQ ID NO: 19447 - DNA, 25 bp, Homo sapiens
caaagcaaagggagtcctgccccct

SEQ ID NO: 19448 - DNA, 25 bp, Homo sapiens
taccctgcctgtgcacagtgggtgg

SEQ ID NO: 19449 - DNA, 25 bp, Homo sapiens
atagcaagctctttcgaccatagtt

SEQ ID NO: 19450 - DNA, 25 bp, Homo sapiens
aacactgggccttactgcatgtggt

SEQ ID NO: 19451 - DNA, 25 bp, Homo sapiens
gtggttcattctagcatttctgttc

SEQ ID NO: 19452 - DNA, 25 bp, Homo sapiens
atttctgttctgtgctgtgctaagc

SEQ ID NO: 19453 - DNA, 25 bp, Homo sapiens
aatccattcatcctgattgggcatg

SEQ ID NO: 19454 - DNA, 25 bp, Homo sapiens
gacaccttcgcttgttatcttgtca

SEQ ID NO: 19455 - DNA, 25 bp, Homo sapiens
atcatttcacccttgccagtaaaaa

SEQ ID NO: 19456 - DNA, 25 bp, Homo sapiens
ccattctcagcagactccagtattg

SEQ ID NO: 19457 - DNA, 25 bp, Homo sapiens
ccagtattggcacagtcactcactg

SEQ ID NO: 19458 - DNA, 25 bp, Homo sapiens
actgccattctcacactataacaag

SEQ ID NO: 19459 - DNA, 25 bp, Homo sapiens
gaagtgcataagtctcctgggaaaa

SEQ ID NO: 19460 - DNA, 25 bp, Homo sapiens
ccttctcgtgccatgactggtgatt

SEQ ID NO: 19461 - DNA, 25 bp, Homo sapiens
tgatttcatgactcataagcccctc

SEQ ID NO: 19462 - DNA, 25 bp, Homo sapiens
cccctccgtaggcatcattcaagat

SEQ ID NO: 19463 - DNA, 25 bp, Homo sapiens
tggcccatgcatgctgtttgcagca

SEQ ID NO: 19464 - DNA, 25 bp, Homo sapiens
agacaggagagttattagcactacc

SEQ ID NO: 19465 - DNA, 25 bp, Homo sapiens
tgaaagacaagcagttacaccccca

SEQ ID NO: 19466 - DNA, 25 bp, Homo sapiens
ggaggcaatcaatgacctggtgaag

SEQ ID NO: 19467 - DNA, 25 bp, Homo sapiens
caagctttctcgagcttttgtccgg

SEQ ID NO: 19468 - DNA, 25 bp, Homo sapiens
tccggccctctggtacagaagatgt

SEQ ID NO: 19469 - DNA, 25 bp, Homo sapiens
gatgtcgtccgagtatatgcagaag

SEQ ID NO: 19470 - DNA, 25 bp, Homo sapiens
aaagtgcagatcaccttgcacatga

SEQ ID NO: 19471 - DNA, 25 bp, Homo sapiens
gcacatgaagtgagcttggcagtat

SEQ ID NO: 19472 - DNA, 25 bp, Homo sapiens
ttggcagtatttcagctggctggag

SEQ ID NO: 19473 - DNA, 25 bp, Homo sapiens
gaattggagaaaggccccaaccagg

SEQ ID NO: 19474 - DNA, 25 bp, Homo sapiens
ggattgtctctagatctgtttttct

SEQ ID NO: 19475 - DNA, 25 bp, Homo sapiens
ccgggggcctatggcagtgatgctg

SEQ ID NO: 19476 - DNA, 25 bp, Homo sapiens
ggggcctatggcagtgatgctgtgt

SEQ ID NO: 19477 - DNA, 25 bp, Homo sapiens
cctatggcagtgatgctgtgttggt

SEQ ID NO: 19478 - DNA, 25 bp, Homo sapiens
caaacctggtggattgaaacagcag

SEQ ID NO: 19479 - DNA, 25 bp, Homo sapiens
gaaacagcagaacttgattccctta

SEQ ID NO: 19480 - DNA, 25 bp, Homo sapiens
agcagaacttgattcccttacagtt

SEQ ID NO: 19481 - DNA, 25 bp, Homo sapiens
cagggctgtggtccctttgaaggct

SEQ ID NO: 19482 - DNA, 25 bp, Homo sapiens
ccttggctctttttagcttgtggcg

SEQ ID NO: 19483 - DNA, 25 bp, Homo sapiens
tggctctttttagcttgtggcggca

SEQ ID NO: 19484 - DNA, 25 bp, Homo sapiens
ttagcttgtggcggcagtgggcagt

SEQ ID NO: 19485 - DNA, 25 bp, Homo sapiens
tgatccttattaattaaacctgcaa

SEQ ID NO: 19486 - DNA, 25 bp, Homo sapiens
gccattgactccctgagcattgaga

SEQ ID NO: 19487 - DNA, 25 bp, Homo sapiens
ttgagaaaggctaccggcactggca

SEQ ID NO: 19488 - DNA, 25 bp, Homo sapiens
cacctgcaagctcaagtcgccggtg

SEQ ID NO: 19489 - DNA, 25 bp, Homo sapiens
cgcctggtgtgcttcaccatggagg

SEQ ID NO: 19490 - DNA, 25 bp, Homo sapiens
aagtacccatgtttggcctggaggc

SEQ ID NO: 19491 - DNA, 25 bp, Homo sapiens
gcctggaggccatctggaggaacgg

SEQ ID NO: 19492 - DNA, 25 bp, Homo sapiens
ctggaggaacggccaagtggtgggc

SEQ ID NO: 19493 - DNA, 25 bp, Homo sapiens
tttgggttcgccatcgacaagacca

SEQ ID NO: 19494 - DNA, 25 bp, Homo sapiens
cggtctcgctggactttgtgaagag

SEQ ID NO: 19495 - DNA, 25 bp, Homo sapiens
tgaagagcggggactatgccctgga

SEQ ID NO: 19496 - DNA, 25 bp, Homo sapiens
agaatgggggtgacctatggtgccc

SEQ ID NO: 19497 - DNA, 25 bp, Homo sapiens
cccaactctgagtggcaccaatgat

SEQ ID NO: 19498 - DNA, 25 bp, Homo sapiens
agaaacccatccctgggtacatcgt

SEQ ID NO: 19499 - DNA, 25 bp, Homo sapiens
gggtacatcgtgaggaacttccact

SEQ ID NO: 19500 - DNA, 25 bp, Homo sapiens
cttccactaccttctcatcaaggat

SEQ ID NO: 19501 - DNA, 25 bp, Homo sapiens
gggtgcctgctgtagtgttcaccac

SEQ ID NO: 19502 - DNA, 25 bp, Homo sapiens
gaccagccctgggtagaacgcatca

SEQ ID NO: 19503 - DNA, 25 bp, Homo sapiens
agaacgcatcatccagagactgcag

SEQ ID NO: 19504 - DNA, 25 bp, Homo sapiens
ggacctcagccaagatgaagcgccg

SEQ ID NO: 19505 - DNA, 25 bp, Homo sapiens
atgaagcgccgcagcagttaaccta

SEQ ID NO: 19506 - DNA, 25 bp, Homo sapiens
gcagttaacctatgaccgtgcagag

SEQ ID NO: 19507 - DNA, 25 bp, Homo sapiens
cccgagtccgagtcaagcattgtga

SEQ ID NO: 19508 - DNA, 25 bp, Homo sapiens
aatacttttgtattgctgcttgcaa

SEQ ID NO: 19509 - DNA, 25 bp, Homo sapiens
gtaccagtttaaagctttcacttca

SEQ ID NO: 19510 - DNA, 25 bp, Homo sapiens
tagaagttcccccaattacaaactg

SEQ ID NO: 19511 - DNA, 25 bp, Homo sapiens
aatacctgctttgcatattcacaca

SEQ ID NO: 19512 - DNA, 25 bp, Homo sapiens
atattcacacatggtcaactgggac

SEQ ID NO: 19513 - DNA, 25 bp, Homo sapiens
aaaatcttttttcacttctcatgga

SEQ ID NO: 19514 - DNA, 25 bp, Homo sapiens
tgctccctgcatggctcattagggt

SEQ ID NO: 19515 - DNA, 25 bp, Homo sapiens
ggctcattagggtccaaattataac

SEQ ID NO: 19516 - DNA, 25 bp, Homo sapiens
atttacattttcagcgatattactt

SEQ ID NO: 19517 - DNA, 25 bp, Homo sapiens
tgcctgagttcccatttaaaatcta

SEQ ID NO: 19518 - DNA, 25 bp, Homo sapiens
aaatctaactagacacctaatgggg

SEQ ID NO: 19519 - DNA, 25 bp, Homo sapiens
attgcggagcgtctgggatgcacac

SEQ ID NO: 19520 - DNA, 25 bp, Homo sapiens
gcacactacctcagctagctgttgc

SEQ ID NO: 19521 - DNA, 25 bp, Homo sapiens
tagctgttgcgtggtgcctgagaaa

SEQ ID NO: 19522 - DNA, 25 bp, Homo sapiens
catccactcctgaacaactcattga

SEQ ID NO: 19523 - DNA, 25 bp, Homo sapiens
taacatactgcgcaacaagccctac

SEQ ID NO: 19524 - DNA, 25 bp, Homo sapiens
taaaatagcggcctgtgcccagtac

SEQ ID NO: 19525 - DNA, 25 bp, Homo sapiens
tagcagcttgctgcaacctctagtg

SEQ ID NO: 19526 - DNA, 25 bp, Homo sapiens
gtccctccctggattctttgaggtg

SEQ ID NO: 19527 - DNA, 25 bp, Homo sapiens
ttgaggtgtctgactgtcgctacca

SEQ ID NO: 19528 - DNA, 25 bp, Homo sapiens
tcgctaccactgtgcacatctgaaa

SEQ ID NO: 19529 - DNA, 25 bp, Homo sapiens
gtgcctgaaagttccagggcttcac

SEQ ID NO: 19530 - DNA, 25 bp, Homo sapiens
aaaccaaactggactctcgtgcaga

SEQ ID NO: 19531 - DNA, 25 bp, Homo sapiens
accaaactggactctcgtgcagaaa

SEQ ID NO: 19532 - DNA, 25 bp, Homo sapiens
acgggattacactggctgcagtaca

SEQ ID NO: 19533 - DNA, 25 bp, Homo sapiens
gattacactggctgcagtacatcag

SEQ ID NO: 19534 - DNA, 25 bp, Homo sapiens
gtacatcagagagtttgtcaccagt

SEQ ID NO: 19535 - DNA, 25 bp, Homo sapiens
ttgtcaccagttaagcaggctcctc

SEQ ID NO: 19536 - DNA, 25 bp, Homo sapiens
tcaccagttaagcaggctcctcgga

SEQ ID NO: 19537 - DNA, 25 bp, Homo sapiens
cagttaagcaggctcctcggaagtc

SEQ ID NO: 19538 - DNA, 25 bp, Homo sapiens
ctccgacactgagggtcttgtaaag

SEQ ID NO: 19539 - DNA, 25 bp, Homo sapiens
ggtcttgtaaagagtctgccttctg

SEQ ID NO: 19540 - DNA, 25 bp, Homo sapiens
taaagagtctgccttctggatctca

SEQ ID NO: 19541 - DNA, 25 bp, Homo sapiens
acctcgggatactgcacacggagag

SEQ ID NO: 19542 - DNA, 25 bp, Homo sapiens
gatactgcacacggagaggagggaa

SEQ ID NO: 19543 - DNA, 25 bp, Homo sapiens
gaaaataagcgaggcaccgccgcac

SEQ ID NO: 19544 - DNA, 25 bp, Homo sapiens
agccctggaagagcactactggatg

SEQ ID NO: 19545 - DNA, 25 bp, Homo sapiens
gagcactactggatgtcagcggaga

SEQ ID NO: 19546 - DNA, 25 bp, Homo sapiens
tgtcagcggagaaatggctttgagc

SEQ ID NO: 19547 - DNA, 25 bp, Homo sapiens
acaacgcttttccttttgacattga

SEQ ID NO: 19548 - DNA, 25 bp, Homo sapiens
gacattgaagggagctcagcggttg

SEQ ID NO: 19549 - DNA, 25 bp, Homo sapiens
agctcagcggttggcaggcaagacc

SEQ ID NO: 19550 - DNA, 25 bp, Homo sapiens
agcggttggcaggcaagacccgcct

SEQ ID NO: 19551 - DNA, 25 bp, Homo sapiens
ttggcaggcaagacccgcctgagac

SEQ ID NO: 19552 - DNA, 25 bp, Homo sapiens
tcttttgtcctccttagcacaatgt

SEQ ID NO: 19553 - DNA, 25 bp, Homo sapiens
ggaatggcttgctggggagcccatc

SEQ ID NO: 19554 - DNA, 25 bp, Homo sapiens
ggagcacatagagattcacccatgt

SEQ ID NO: 19555 - DNA, 25 bp, Homo sapiens
gagtcattctcatgcttttctttat

SEQ ID NO: 19556 - DNA, 25 bp, Homo sapiens
attgtatacaacatagccccaaata

SEQ ID NO: 19557 - DNA, 25 bp, Homo sapiens
ggagctcacgcccagagactgggct

SEQ ID NO: 19558 - DNA, 25 bp, Homo sapiens
gaaggtctggcaaagtcaggctcag

SEQ ID NO: 19559 - DNA, 25 bp, Homo sapiens
tgctgcagacctcggtgtggacaca

SEQ ID NO: 19560 - DNA, 25 bp, Homo sapiens
tggacacacgctgcatagagctctc

SEQ ID NO: 19561 - DNA, 25 bp, Homo sapiens
gctgcatagagctctccttgaaaac

SEQ ID NO: 19562 - DNA, 25 bp, Homo sapiens
caagacattctgcctacctattagc

SEQ ID NO: 19563 - DNA, 25 bp, Homo sapiens
agttaaccacagcttcacagactaa

SEQ ID NO: 19564 - DNA, 25 bp, Homo sapiens
cacagactaacatcaagaaatcgcc

SEQ ID NO: 19565 - DNA, 25 bp, Homo sapiens
aaaagtacagtctgtcagccagaat

SEQ ID NO: 19566 - DNA, 25 bp, Homo sapiens
taaaagctacttggccgtaaggcta

SEQ ID NO: 19567 - DNA, 25 bp, Homo sapiens
gagagattcaaggcaacaagcagca

SEQ ID NO: 19568 - DNA, 25 bp, Homo sapiens
acaagcagcacaagccttcatacat

SEQ ID NO: 19569 - DNA, 25 bp, Homo sapiens
gcacaagccttcatacataattcat

SEQ ID NO: 19570 - DNA, 25 bp, Homo sapiens
taaataagttcctgtctcttgccaa

SEQ ID NO: 19571 - DNA, 25 bp, Homo sapiens
cttgccaacaagaggttaccagtga

SEQ ID NO: 19572 - DNA, 25 bp, Homo sapiens
gaaaagagctgctgtccagtttttg

SEQ ID NO: 19573 - DNA, 25 bp, Homo sapiens
gctgtccagtttttgaataatgctt

SEQ ID NO: 19574 - DNA, 25 bp, Homo sapiens
aaggttgcccatcatgactttgtat

SEQ ID NO: 19575 - DNA, 25 bp, Homo sapiens
gaatcagcagtacacatgcccatca

SEQ ID NO: 19576 - DNA, 25 bp, Homo sapiens
catcaccttcgctgtctgaatgact

SEQ ID NO: 19577 - DNA, 25 bp, Homo sapiens
agcccagatgacttactatgcacag

SEQ ID NO: 19578 - DNA, 25 bp, Homo sapiens
agttttccatccaattatcttagta

SEQ ID NO: 19579 - DNA, 25 bp, Homo sapiens
atcagacttctgtgacacctgtacc

SEQ ID NO: 19580 - DNA, 25 bp, Homo sapiens
gacacctgtaccatcagttttacca

SEQ ID NO: 19581 - DNA, 25 bp, Homo sapiens
ttggttcttctgccatggcttcaac

SEQ ID NO: 19582 - DNA, 25 bp, Homo sapiens
caagtggcctagtaatcacctctcc

SEQ ID NO: 19583 - DNA, 25 bp, Homo sapiens
ccttccaacctcagtgaccttaagg

SEQ ID NO: 19584 - DNA, 25 bp, Homo sapiens
aaaggccagggttctctatgattat

SEQ ID NO: 19585 - DNA, 25 bp, Homo sapiens
ggcccgggtctgcggagagaggcct

SEQ ID NO: 19586 - DNA, 25 bp, Homo sapiens
agctttcaattccgtagccagctgc

SEQ ID NO: 19587 - DNA, 25 bp, Homo sapiens
aaccgcccaggatcagattgcatgt

SEQ ID NO: 19588 - DNA, 25 bp, Homo sapiens
gattgcatgtgactctgaagctgac

SEQ ID NO: 19589 - DNA, 25 bp, Homo sapiens
cttccatggccctcattaatgacac

SEQ ID NO: 19590 - DNA, 25 bp, Homo sapiens
taatgacacttgtccccaaatccga

SEQ ID NO: 19591 - DNA, 25 bp, Homo sapiens
gacagaaccttgttatttctcagac

SEQ ID NO: 19592 - DNA, 25 bp, Homo sapiens
aaaggccaaacctctgttcagtgta

SEQ ID NO: 19593 - DNA, 25 bp, Homo sapiens
tccagtgccaacaatcctagtgctt

SEQ ID NO: 19594 - DNA, 25 bp, Homo sapiens
cctatgtgattttaactctgtcttc

SEQ ID NO: 19595 - DNA, 25 bp, Homo sapiens
ttccaaaagtggcctctttgtctaa

SEQ ID NO: 19596 - DNA, 25 bp, Homo sapiens
agagaatatcactccgatggtcggt

SEQ ID NO: 19597 - DNA, 25 bp, Homo sapiens
cgatggtcggtttctgactgtcacg

SEQ ID NO: 19598 - DNA, 25 bp, Homo sapiens
gactgtcacgctaagggcaactgta

SEQ ID NO: 19599 - DNA, 25 bp, Homo sapiens
aatgcactcgcaaccaggtaaactt

SEQ ID NO: 19600 - DNA, 25 bp, Homo sapiens
atagatttactgtacatgacttgta

SEQ ID NO: 19601 - DNA, 25 bp, Homo sapiens
gaactgcagcaatatccatgggtcc

SEQ ID NO: 19602 - DNA, 25 bp, Homo sapiens
gtcctaataattgtagttccccact

SEQ ID NO: 19603 - DNA, 25 bp, Homo sapiens
gtatttttactcgggctatccagaa

SEQ ID NO: 19604 - DNA, 25 bp, Homo sapiens
agccaattctcatttattcagcgaa

SEQ ID NO: 19605 - DNA, 25 bp, Homo sapiens
attcagcgaaaatcctctggggtta

SEQ ID NO: 19606 - DNA, 25 bp, Homo sapiens
gtcactataaacctatcatctttcc

SEQ ID NO: 19607 - DNA, 25 bp, Homo sapiens
cggctctggcatgggaggttctgga

SEQ ID NO: 19608 - DNA, 25 bp, Homo sapiens
gaggttctggaatgggaggctacgg

SEQ ID NO: 19609 - DNA, 25 bp, Homo sapiens
ggttagctgcttatcgatgagtctc

SEQ ID NO: 19610 - DNA, 25 bp, Homo sapiens
gatgagtctcaattttttttctttt

SEQ ID NO: 19611 - DNA, 25 bp, Homo sapiens
gatatggtactcctgatggtttggg

SEQ ID NO: 19612 - DNA, 25 bp, Homo sapiens
tggtttgggtggttatggccgtggt

SEQ ID NO: 19613 - DNA, 25 bp, Homo sapiens
ggaggttactatgggcaaggcggca

SEQ ID NO: 19614 - DNA, 25 bp, Homo sapiens
ggaggtggatggcgtgggatgtact

SEQ ID NO: 19615 - DNA, 25 bp, Homo sapiens
gtcttgacaacagcatctggtctac

SEQ ID NO: 19616 - DNA, 25 bp, Homo sapiens
ggtctactagactttcttacagatt

SEQ ID NO: 19617 - DNA, 25 bp, Homo sapiens
gaactcttcttgaattctactcctg

SEQ ID NO: 19618 - DNA, 25 bp, Homo sapiens
caaagtccaccaagcactcagtgct

SEQ ID NO: 19619 - DNA, 25 bp, Homo sapiens
aaatctatggttgttctcacgaagg

SEQ ID NO: 19620 - DNA, 25 bp, Homo sapiens
ctgtaaaagcctcttctgtgctgcg

SEQ ID NO: 19621 - DNA, 25 bp, Homo sapiens
gctgcgtctcaactcagtgagcaac

SEQ ID NO: 19622 - DNA, 25 bp, Homo sapiens
aacctacagtgtatacatctccttg

SEQ ID NO: 19623 - DNA, 25 bp, Homo sapiens
gaacttttcttataacctgcaatca

SEQ ID NO: 19624 - DNA, 25 bp, Homo sapiens
cctgcaatcagctactcagccaaaa

SEQ ID NO: 19625 - DNA, 25 bp, Homo sapiens
gctgataatcttttacaccttggga

SEQ ID NO: 19626 - DNA, 25 bp, Homo sapiens
atccgtacctgaaggctgattcacc

SEQ ID NO: 19627 - DNA, 25 bp, Homo sapiens
tcctttctgctcttacacagcattg

SEQ ID NO: 19628 - DNA, 25 bp, Homo sapiens
aaagtgcctgagtgtctgctttcac

SEQ ID NO: 19629 - DNA, 25 bp, Homo sapiens
ttactacatcttccgtggggcgaat

SEQ ID NO: 19630 - DNA, 25 bp, Homo sapiens
ccatctctacagccacagggcggaa

SEQ ID NO: 19631 - DNA, 25 bp, Homo sapiens
gccacagggcggaaactgctggtgt

SEQ ID NO: 19632 - DNA, 25 bp, Homo sapiens
gtgtctgggtggtggggtatggtcc

SEQ ID NO: 19633 - DNA, 25 bp, Homo sapiens
ccgccatcccaactatcttggagac

SEQ ID NO: 19634 - DNA, 25 bp, Homo sapiens
tatcttggagacctcatcatggctc

SEQ ID NO: 19635 - DNA, 25 bp, Homo sapiens
agtgcctgcagaagtacggcctggc

SEQ ID NO: 19636 - DNA, 25 bp, Homo sapiens
ggcctggcaggagtactgccggcgt

SEQ ID NO: 19637 - DNA, 25 bp, Homo sapiens
cctcaccaccatggatatcacacat

SEQ ID NO: 19638 - DNA, 25 bp, Homo sapiens
tatcacacatgacgggtttggcttc

SEQ ID NO: 19639 - DNA, 25 bp, Homo sapiens
tcatgctggcgtttggggacatggc

SEQ ID NO: 19640 - DNA, 25 bp, Homo sapiens
tgtgaagctttacgcgcacacggac

SEQ ID NO: 19641 - DNA, 25 bp, Homo sapiens
gtggcattggcatacttgcccttac

SEQ ID NO: 19642 - DNA, 25 bp, Homo sapiens
tggagtatcttcgtcacacatctaa

SEQ ID NO: 19643 - DNA, 25 bp, Homo sapiens
ggatttaccattccttattatcact

SEQ ID NO: 19644 - DNA, 25 bp, Homo sapiens
aactgcttttgtacctagctaggct

SEQ ID NO: 19645 - DNA, 25 bp, Homo sapiens
aatcataaagccttcatcactccca

SEQ ID NO: 19646 - DNA, 25 bp, Homo sapiens
aacaagcgtctagactccttgggac

SEQ ID NO: 19647 - DNA, 25 bp, Homo sapiens
gaccgtgagttcctagagcttggct

SEQ ID NO: 19648 - DNA, 25 bp, Homo sapiens
tgtgcctccaaggactgtctggcaa

SEQ ID NO: 19649 - DNA, 25 bp, Homo sapiens
atatggtgcccttctgatgctaaga

SEQ ID NO: 19650 - DNA, 25 bp, Homo sapiens
gatgctaagactccagaccttttgt

SEQ ID NO: 19651 - DNA, 25 bp, Homo sapiens
cagcacaggcagagtgcacggctga

SEQ ID NO: 19652 - DNA, 25 bp, Homo sapiens
gccagtggcagtccatttgggccag

SEQ ID NO: 19653 - DNA, 25 bp, Homo sapiens
gatgggcgagtctttacaccaggtc

SEQ ID NO: 19654 - DNA, 25 bp, Homo sapiens
ataaaatggctttccgatacccaga

SEQ ID NO: 19655 - DNA, 25 bp, Homo sapiens
tttccgatacccagaacctgaagac

SEQ ID NO: 19656 - DNA, 25 bp, Homo sapiens
ggagtgaatatgattccctgctgcc

SEQ ID NO: 19657 - DNA, 25 bp, Homo sapiens
gattccctgctgccagatgtgtatg

SEQ ID NO: 19658 - DNA, 25 bp, Homo sapiens
tggccagaatctgcatcaagccctc

SEQ ID NO: 19659 - DNA, 25 bp, Homo sapiens
catcaagccctcctgtgataacaga

SEQ ID NO: 19660 - DNA, 25 bp, Homo sapiens
gaatagaagcactcccctgataaat

SEQ ID NO: 19661 - DNA, 25 bp, Homo sapiens
aatactttctgtgctccagggaacc

SEQ ID NO: 19662 - DNA, 25 bp, Homo sapiens
ccaggtgtggctttagctgttattc

SEQ ID NO: 19663 - DNA, 25 bp, Homo sapiens
gtggctttagctgttattctctgta

SEQ ID NO: 19664 - DNA, 25 bp, Homo sapiens
tattctctgtaacacccggcatatt

SEQ ID NO: 19665 - DNA, 25 bp, Homo sapiens
acccggcatattagtgacagtgttt

SEQ ID NO: 19666 - DNA, 25 bp, Homo sapiens
gacagtgttttcctagaagctgcaa

SEQ ID NO: 19667 - DNA, 25 bp, Homo sapiens
agctgcaaaggccctgacaagccaa

SEQ ID NO: 19668 - DNA, 25 bp, Homo sapiens
aggccctgacaagccaattgacaga

SEQ ID NO: 19669 - DNA, 25 bp, Homo sapiens
aattgacagatgaagagctagccca

SEQ ID NO: 19670 - DNA, 25 bp, Homo sapiens
gctagcccaagggagactttaccca

SEQ ID NO: 19671 - DNA, 25 bp, Homo sapiens
tacccaccgcttgctaatattcagg

SEQ ID NO: 19672 - DNA, 25 bp, Homo sapiens
ggaagtttctattaacattgctatt

SEQ ID NO: 19673 - DNA, 25 bp, Homo sapiens
cgccaatgccttcatcatctgtggc

SEQ ID NO: 19674 - DNA, 25 bp, Homo sapiens
tcatcatctgtggcaccttgtacac

SEQ ID NO: 19675 - DNA, 25 bp, Homo sapiens
cagctacacctcagcagatgctacc

SEQ ID NO: 19676 - DNA, 25 bp, Homo sapiens
agatgctaccgtcaactttgcttat

SEQ ID NO: 19677 - DNA, 25 bp, Homo sapiens
ccatcccattcaagaaccgctataa

SEQ ID NO: 19678 - DNA, 25 bp, Homo sapiens
gactacaaccccctggagaagaagc

SEQ ID NO: 19679 - DNA, 25 bp, Homo sapiens
gctctttgcctgggacaacttgaac

SEQ ID NO: 19680 - DNA, 25 bp, Homo sapiens
ggtcacttatgacatcaagctctcc

SEQ ID NO: 19681 - DNA, 25 bp, Homo sapiens
aaggagatgctcagggctcctgggg

SEQ ID NO: 19682 - DNA, 25 bp, Homo sapiens
agctttgactgctttccaagttttc

SEQ ID NO: 19683 - DNA, 25 bp, Homo sapiens
ttcctgaaaaccattgctcttgcat

SEQ ID NO: 19684 - DNA, 25 bp, Homo sapiens
gtggaatccttactgcatgttttgc

SEQ ID NO: 19685 - DNA, 25 bp, Homo sapiens
atgttttgcacgtatggttggatgt

SEQ ID NO: 19686 - DNA, 25 bp, Homo sapiens
aaggacgatccaacacttctgtctt

SEQ ID NO: 19687 - DNA, 25 bp, Homo sapiens
gggagagtacagcttgttgtggggg

SEQ ID NO: 19688 - DNA, 25 bp, Homo sapiens
gaagaagccccttatgatgccattc

SEQ ID NO: 19689 - DNA, 25 bp, Homo sapiens
tgccattcatgtgggagctgcagcc

SEQ ID NO: 19690 - DNA, 25 bp, Homo sapiens
gttgtaccccaggcgctaatagatc

SEQ ID NO: 19691 - DNA, 25 bp, Homo sapiens
gattgatattgcctgttggtcctgc

SEQ ID NO: 19692 - DNA, 25 bp, Homo sapiens
ctgttggtcctgcaggcggaaacca

SEQ ID NO: 19693 - DNA, 25 bp, Homo sapiens
ggcagcatcaaaatgaagcctctga

SEQ ID NO: 19694 - DNA, 25 bp, Homo sapiens
gatgggggtgatatacgtgccttta

SEQ ID NO: 19695 - DNA, 25 bp, Homo sapiens
ctttgctcaaacacctggacactca

SEQ ID NO: 19696 - DNA, 25 bp, Homo sapiens
gtcccaggagaaaaccgcattgcca

SEQ ID NO: 19697 - DNA, 25 bp, Homo sapiens
gagcagacacttccttagagatggc

SEQ ID NO: 19698 - DNA, 25 bp, Homo sapiens
ggctggtgccttgaagccttcagtt

SEQ ID NO: 19699 - DNA, 25 bp, Homo sapiens
ccagggcaggtgcttatctgacctt

SEQ ID NO: 19700 - DNA, 25 bp, Homo sapiens
atctgaccttaacagtgctctcatc

SEQ ID NO: 19701 - DNA, 25 bp, Homo sapiens
gctctcatcatggtggtggttgggt

SEQ ID NO: 19702 - DNA, 25 bp, Homo sapiens
cttgtcccagtaccagttgatgaaa

SEQ ID NO: 19703 - DNA, 25 bp, Homo sapiens
ggctggtttcttcataaactctctc

SEQ ID NO: 19704 - DNA, 25 bp, Homo sapiens
aactgtagcaaccatctcctaatca

SEQ ID NO: 19705 - DNA, 25 bp, Homo sapiens
gcaatttccaacttatctcaagcca

SEQ ID NO: 19706 - DNA, 25 bp, Homo sapiens
acttgcggcgtgaatttggtcgtta

SEQ ID NO: 19707 - DNA, 25 bp, Homo sapiens
atgttccacttgatttctacactcg

SEQ ID NO: 19708 - DNA, 25 bp, Homo sapiens
ctacactcgccgtccaagaggattt

SEQ ID NO: 19709 - DNA, 25 bp, Homo sapiens
gaaatacagtttgcccagggggatc

SEQ ID NO: 19710 - DNA, 25 bp, Homo sapiens
gaatgtgtacagttcttcacgctat

SEQ ID NO: 19711 - DNA, 25 bp, Homo sapiens
gaccgactggaagaccacggcgtag

SEQ ID NO: 19712 - DNA, 25 bp, Homo sapiens
cacggcgtagcagaagccattccga

SEQ ID NO: 19713 - DNA, 25 bp, Homo sapiens
gaccaaactgcagctggaataccca

SEQ ID NO: 19714 - DNA, 25 bp, Homo sapiens
gtacagttctgcttactacacttca

SEQ ID NO: 19715 - DNA, 25 bp, Homo sapiens
aacacgtctctgttcgtcaggaacg

SEQ ID NO: 19716 - DNA, 25 bp, Homo sapiens
gccgacgacaccaggtctgaagact

SEQ ID NO: 19717 - DNA, 25 bp, Homo sapiens
tttgattcctcccgggacagaaaca

SEQ ID NO: 19718 - DNA, 25 bp, Homo sapiens
caagccctttaagtttatgctaggc

SEQ ID NO: 19719 - DNA, 25 bp, Homo sapiens
gcaagcaggaggtgatccgaggctg

SEQ ID NO: 19720 - DNA, 25 bp, Homo sapiens
ggaggtgatccgaggctgggaagaa

SEQ ID NO: 19721 - DNA, 25 bp, Homo sapiens
gggaagaaggggttgcccagatgag

SEQ ID NO: 19722 - DNA, 25 bp, Homo sapiens
gggttgcccagatgagtgtgggtca

SEQ ID NO: 19723 - DNA, 25 bp, Homo sapiens
aactgactatatctccagattatgc

SEQ ID NO: 19724 - DNA, 25 bp, Homo sapiens
ctccagattatgcctatggtgccac

SEQ ID NO: 19725 - DNA, 25 bp, Homo sapiens
gccactctcgtcttcgatgtggagc

SEQ ID NO: 19726 - DNA, 25 bp, Homo sapiens
gtcttcgatgtggagcttctaaaac

SEQ ID NO: 19727 - DNA, 25 bp, Homo sapiens
ggaatgacaggaatggcctcctccc

SEQ ID NO: 19728 - DNA, 25 bp, Homo sapiens
gaaatggaatactgaagggcccttc

SEQ ID NO: 19729 - DNA, 25 bp, Homo sapiens
atactgaagggcccttcactgcctt

SEQ ID NO: 19730 - DNA, 25 bp, Homo sapiens
tcccatgttatgcccagcgtttgat

SEQ ID NO: 19731 - DNA, 25 bp, Homo sapiens
cagcgtttgatgggtagcagagaga

SEQ ID NO: 19732 - DNA, 25 bp, Homo sapiens
cccctgcattctttctgtattgagt

SEQ ID NO: 19733 - DNA, 25 bp, Homo sapiens
gagtatcctttcagtgttattagtg

SEQ ID NO: 19734 - DNA, 25 bp, Homo sapiens
gttattagtgtatgctttgaatgta

SEQ ID NO: 19735 - DNA, 25 bp, Homo sapiens
gaattggcatgtgtatgttcccagt

SEQ ID NO: 19736 - DNA, 25 bp, Homo sapiens
gtatgttcccagttcaactcatgga

SEQ ID NO: 19737 - DNA, 25 bp, Homo sapiens
gttcaactcatggagatggcagctg

SEQ ID NO: 19738 - DNA, 25 bp, Homo sapiens
gatggcagctgtttaaatgtttttc

SEQ ID NO: 19739 - DNA, 25 bp, Homo sapiens
tcttccccgagaacttcactgagag

SEQ ID NO: 19740 - DNA, 25 bp, Homo sapiens
cactgagagggtcccatgacggcgg

SEQ ID NO: 19741 - DNA, 25 bp, Homo sapiens
gcagcctccgggcgtgtgaagaaca

SEQ ID NO: 19742 - DNA, 25 bp, Homo sapiens
gaacacctcctcccgaaaaatgtgt

SEQ ID NO: 19743 - DNA, 25 bp, Homo sapiens
gagacccccaggcagaggggcgttc

SEQ ID NO: 19744 - DNA, 25 bp, Homo sapiens
ttaggtcgttttccaaagagccgcg

SEQ ID NO: 19745 - DNA, 25 bp, Homo sapiens
caagtccggcggaattcaccagtgt

SEQ ID NO: 19746 - DNA, 25 bp, Homo sapiens
caccagtgttcctgaagctgctgtg

SEQ ID NO: 19747 - DNA, 25 bp, Homo sapiens
agctgctgtgtcctctagttgagtt

SEQ ID NO: 19748 - DNA, 25 bp, Homo sapiens
tcttttcctggcagctgctgtgggt

SEQ ID NO: 19749 - DNA, 25 bp, Homo sapiens
cgcagacggtctgtgtgctgtttga

SEQ ID NO: 19750 - DNA, 25 bp, Homo sapiens
cttcccagcaactgtgaatggcacc

SEQ ID NO: 19751 - DNA, 25 bp, Homo sapiens
gaatggcaccgtggagggcggcagt

SEQ ID NO: 19752 - DNA, 25 bp, Homo sapiens
ggtttcatgttcaaggtacaggccc

SEQ ID NO: 19753 - DNA, 25 bp, Homo sapiens
gccactgacacagacgagctgcagc

SEQ ID NO: 19754 - DNA, 25 bp, Homo sapiens
tccccttccagaaccctgaagagca

SEQ ID NO: 19755 - DNA, 25 bp, Homo sapiens
gcaggatgaaggctggctcatgggc

SEQ ID NO: 19756 - DNA, 25 bp, Homo sapiens
aggctggctcatgggcgtgaaggag

SEQ ID NO: 19757 - DNA, 25 bp, Homo sapiens
gggcgtgaaggagagcgactggaac

SEQ ID NO: 19758 - DNA, 25 bp, Homo sapiens
agctggagaagtgccgtggcgtctt

SEQ ID NO: 19759 - DNA, 25 bp, Homo sapiens
tcttccccgagaacttcactgagag

SEQ ID NO: 19760 - DNA, 25 bp, Homo sapiens
gaacttcactgagagggtcccatga

SEQ ID NO: 19761 - DNA, 25 bp, Homo sapiens
gagtacagtactctttgtcatttca

SEQ ID NO: 19762 - DNA, 25 bp, Homo sapiens
ggagcaaggtcatgtaccctaatag

SEQ ID NO: 19763 - DNA, 25 bp, Homo sapiens
agaggggctccgtgaagcattttct

SEQ ID NO: 19764 - DNA, 25 bp, Homo sapiens
gtcctacaaattaccatgtctcctg

SEQ ID NO: 19765 - DNA, 25 bp, Homo sapiens
atgtctcctgacaagccttatttca

SEQ ID NO: 19766 - DNA, 25 bp, Homo sapiens
aatgcaggaagttcccaccttgact

SEQ ID NO: 19767 - DNA, 25 bp, Homo sapiens
cccaccttgactatcccaaagattc

SEQ ID NO: 19768 - DNA, 25 bp, Homo sapiens
ttccttactgaaaccctctacaaag

SEQ ID NO: 19769 - DNA, 25 bp, Homo sapiens
cagaggcttcctttcattacagtat

SEQ ID NO: 19770 - DNA, 25 bp, Homo sapiens
ggaatattactgctgccctgatgaa

SEQ ID NO: 19771 - DNA, 25 bp, Homo sapiens
gaagttcctgaatctgagtcttgag

SEQ ID NO: 19772 - DNA, 25 bp, Homo sapiens
tcgagtgattcgctggatcctgtca

SEQ ID NO: 19773 - DNA, 25 bp, Homo sapiens
ggatcctgtcaattggccttaaaga

SEQ ID NO: 19774 - DNA, 25 bp, Homo sapiens
gagcacttctggccttagatgaaac

SEQ ID NO: 19775 - DNA, 25 bp, Homo sapiens
ggccttagatgaaaccttcgacttc

SEQ ID NO: 19776 - DNA, 25 bp, Homo sapiens
gcactggcactgctgttacagatcc

SEQ ID NO: 19777 - DNA, 25 bp, Homo sapiens
ttacagatcccgacgcagaacacac

SEQ ID NO: 19778 - DNA, 25 bp, Homo sapiens
agaacacacaggctcgtgctgtctt

SEQ ID NO: 19779 - DNA, 25 bp, Homo sapiens
caaccttttggtcatggggactgat

SEQ ID NO: 19780 - DNA, 25 bp, Homo sapiens
gctttaggagagcaccttcatggag

SEQ ID NO: 19781 - DNA, 25 bp, Homo sapiens
aaaggacattcgtggcttagctgct

SEQ ID NO: 19782 - DNA, 25 bp, Homo sapiens
tccctgcaaacttccgggtgacttc

SEQ ID NO: 19783 - DNA, 25 bp, Homo sapiens
cctcagccagggacgaaggcctcaa

SEQ ID NO: 19784 - DNA, 25 bp, Homo sapiens
cctcaaagctgagaggcccctaccg

SEQ ID NO: 19785 - DNA, 25 bp, Homo sapiens
gcccctaccggtgggtgatggatat

SEQ ID NO: 19786 - DNA, 25 bp, Homo sapiens
ggatatcatccccgaacaggtgaag

SEQ ID NO: 19787 - DNA, 25 bp, Homo sapiens
aagggacaactgactagcagcccca

SEQ ID NO: 19788 - DNA, 25 bp, Homo sapiens
ctgcggatcccagcctaaaagacac

SEQ ID NO: 19789 - DNA, 25 bp, Homo sapiens
accagagacctcagctatggagccc

SEQ ID NO: 19790 - DNA, 25 bp, Homo sapiens
tcacagactctggcactggccaggc

SEQ ID NO: 19791 - DNA, 25 bp, Homo sapiens
ccctcctctgatgaacactacagtg

SEQ ID NO: 19792 - DNA, 25 bp, Homo sapiens
acagtggctgaggcatcagcccccg

SEQ ID NO: 19793 - DNA, 25 bp, Homo sapiens
gcttggttgaaagtgcctgtgctgg

SEQ ID NO: 19794 - DNA, 25 bp, Homo sapiens
caagccttccgtcaagagatgctgc

SEQ ID NO: 19795 - DNA, 25 bp, Homo sapiens
tcctgtctaccttaatcatgaaacc

SEQ ID NO: 19796 - DNA, 25 bp, Homo sapiens
ttcatggggttgtattctccccacc

SEQ ID NO: 19797 - DNA, 25 bp, Homo sapiens
tgagggaactgaactctggtgccgt

SEQ ID NO: 19798 - DNA, 25 bp, Homo sapiens
gtgccgtgctagggggtaggggcct

SEQ ID NO: 19799 - DNA, 25 bp, Homo sapiens
ctagggtctcctgtagggcttatga

SEQ ID NO: 19800 - DNA, 25 bp, Homo sapiens
gtagggcttatgactgtgaatcctt

SEQ ID NO: 19801 - DNA, 25 bp, Homo sapiens
atgtgacgattcctaggagtccctg

SEQ ID NO: 19802 - DNA, 25 bp, Homo sapiens
tctcctcggacctctgtgaatattt

SEQ ID NO: 19803 - DNA, 25 bp, Homo sapiens
tattctatttatggttcccgggaag

SEQ ID NO: 19804 - DNA, 25 bp, Homo sapiens
tctgcctatgctggaatagctccct

SEQ ID NO: 19805 - DNA, 25 bp, Homo sapiens
agtcaagctgtccagaaccagccca

SEQ ID NO: 19806 - DNA, 25 bp, Homo sapiens
ccacgcctgcacagccaggagtata

SEQ ID NO: 19807 - DNA, 25 bp, Homo sapiens
acatgagcatcaccgtttccatggc

SEQ ID NO: 19808 - DNA, 25 bp, Homo sapiens
acatgaacccaatgatggcccagat

SEQ ID NO: 19809 - DNA, 25 bp, Homo sapiens
taaatgatcccgcactgagacacac

SEQ ID NO: 19810 - DNA, 25 bp, Homo sapiens
tcatccactgaccttctcaaaacag

SEQ ID NO: 19811 - DNA, 25 bp, Homo sapiens
gtgtttgctgacgtccagtgtacag

SEQ ID NO: 19812 - DNA, 25 bp, Homo sapiens
tgaatctggtaggcggggaccctta

SEQ ID NO: 19813 - DNA, 25 bp, Homo sapiens
agcctggtccactgggaactcaaaa

SEQ ID NO: 19814 - DNA, 25 bp, Homo sapiens
cctccttcagcagctactgactgaa

SEQ ID NO: 19815 - DNA, 25 bp, Homo sapiens
caatctgcagccattcttcaggtcg

SEQ ID NO: 19816 - DNA, 25 bp, Homo sapiens
tgtcatggacccgctacagacagca

SEQ ID NO: 19817 - DNA, 25 bp, Homo sapiens
gacagcatctgtccagtggtttgaa

SEQ ID NO: 19818 - DNA, 25 bp, Homo sapiens
ggatgatagtgccaaccgacggatc

SEQ ID NO: 19819 - DNA, 25 bp, Homo sapiens
ccgacggatctgtttggccgaggca

SEQ ID NO: 19820 - DNA, 25 bp, Homo sapiens
aggcatttcttaccgcagatactat

SEQ ID NO: 19821 - DNA, 25 bp, Homo sapiens
aacggcgcattcggcaagagctgcc

SEQ ID NO: 19822 - DNA, 25 bp, Homo sapiens
agctgcctttcatggccacagagaa

SEQ ID NO: 19823 - DNA, 25 bp, Homo sapiens
tagccgccaggtgcagagattctta

SEQ ID NO: 19824 - DNA, 25 bp, Homo sapiens
gaagaggaggtgtatcccctgttaa

SEQ ID NO: 19825 - DNA, 25 bp, Homo sapiens
aattagtacagcactttcttcttcc

SEQ ID NO: 19826 - DNA, 25 bp, Homo sapiens
tttctcagtctcacatttctcaaca

SEQ ID NO: 19827 - DNA, 25 bp, Homo sapiens
tagctttggggcttctgactgcagt

SEQ ID NO: 19828 - DNA, 25 bp, Homo sapiens
agttcttctgagtgtgctgctatac

SEQ ID NO: 19829 - DNA, 25 bp, Homo sapiens
tataccagtggatcctgtgccaggg

SEQ ID NO: 19830 - DNA, 25 bp, Homo sapiens
tagctgcccagaccgctggatgaaa

SEQ ID NO: 19831 - DNA, 25 bp, Homo sapiens
gaattctgcctagccagagactcac

SEQ ID NO: 19832 - DNA, 25 bp, Homo sapiens
gactcacacctccttgtgataacgg

SEQ ID NO: 19833 - DNA, 25 bp, Homo sapiens
gctccaagttttcctcagtgaggcc

SEQ ID NO: 19834 - DNA, 25 bp, Homo sapiens
agtgaggccttttgctggattggtc

SEQ ID NO: 19835 - DNA, 25 bp, Homo sapiens
tgtgcagacatgcggtgccatcaac

SEQ ID NO: 19836 - DNA, 25 bp, Homo sapiens
atggtcttcaagcctcaagctgtga

SEQ ID NO: 19837 - DNA, 25 bp, Homo sapiens
gaccctcagatctgtcatgtatccc

SEQ ID NO: 19838 - DNA, 25 bp, Homo sapiens
gggtcaggcatcgatgtccaatgag

SEQ ID NO: 19839 - DNA, 25 bp, Homo sapiens
gcaaggagattgtgaccctcgtgga

SEQ ID NO: 19840 - DNA, 25 bp, Homo sapiens
gaccctcgtggaagattttcacaga

SEQ ID NO: 19841 - DNA, 25 bp, Homo sapiens
gaaaccaaagcagtgggtggccgtt

SEQ ID NO: 19842 - DNA, 25 bp, Homo sapiens
gggtggccgtttgtatgcaggggca

SEQ ID NO: 19843 - DNA, 25 bp, Homo sapiens
ggagaacaggaactgccagactttc

SEQ ID NO: 19844 - DNA, 25 bp, Homo sapiens
tttcaaccgcagactcctaggagag

SEQ ID NO: 19845 - DNA, 25 bp, Homo sapiens
gatctcagggagagctctccagcag

SEQ ID NO: 19846 - DNA, 25 bp, Homo sapiens
aggcaggagcttatgaccggctgag

SEQ ID NO: 19847 - DNA, 25 bp, Homo sapiens
gctgagcccccatcattgggagaaa

SEQ ID NO: 19848 - DNA, 25 bp, Homo sapiens
ccaacccccaaattggctgggacag

SEQ ID NO: 19849 - DNA, 25 bp, Homo sapiens
gtttctacacctgtgggttatgaca

SEQ ID NO: 19850 - DNA, 25 bp, Homo sapiens
ggttatgacaaagacaactgccaaa

SEQ ID NO: 19851 - DNA, 25 bp, Homo sapiens
ggactgcaagtatatcgtggtggag

SEQ ID NO: 19852 - DNA, 25 bp, Homo sapiens
ctgttctgtcagtgaatggataatc

SEQ ID NO: 19853 - DNA, 25 bp, Homo sapiens
aatgaatgttctcctgggcagcgtt

SEQ ID NO: 19854 - DNA, 25 bp, Homo sapiens
tgcttctagtaggcacagggctccc

SEQ ID NO: 19855 - DNA, 25 bp, Homo sapiens
ctggcctctaatagtcaatgattgt

SEQ ID NO: 19856 - DNA, 25 bp, Homo sapiens
tgggcagcgttgtgatctttgccac

SEQ ID NO: 19857 - DNA, 25 bp, Homo sapiens
accttcgtgactttatgcaatgcat

SEQ ID NO: 19858 - DNA, 25 bp, Homo sapiens
caatgcatcatgctatttcatacct

SEQ ID NO: 19859 - DNA, 25 bp, Homo sapiens
tcatacctaatgagggagttccagg

SEQ ID NO: 19860 - DNA, 25 bp, Homo sapiens
aaaatgctccgtgaatctggccaac

SEQ ID NO: 19861 - DNA, 25 bp, Homo sapiens
gccaacaagcgctttgttttccacc

SEQ ID NO: 19862 - DNA, 25 bp, Homo sapiens
tctactgcgtgacttgccatgagac

SEQ ID NO: 19863 - DNA, 25 bp, Homo sapiens
aggaatcacttaccaggatcagccc

SEQ ID NO: 19864 - DNA, 25 bp, Homo sapiens
cctggcatgccgattgctttgtgtg

SEQ ID NO: 19865 - DNA, 25 bp, Homo sapiens
tgctttgtgtgtgttacctgctcta

SEQ ID NO: 19866 - DNA, 25 bp, Homo sapiens
gtttcaccgctgtggaggaccagta

SEQ ID NO: 19867 - DNA, 25 bp, Homo sapiens
ggactgtgtcaagagtgagccgccc

SEQ ID NO: 19868 - DNA, 25 bp, Homo sapiens
taaagctaggaagcccccagtgtgc

SEQ ID NO: 19869 - DNA, 25 bp, Homo sapiens
aatcgaagcttagcagctcctcgtg

SEQ ID NO: 19870 - DNA, 25 bp, Homo sapiens
gaaggacaatcctggcacgactact

SEQ ID NO: 19871 - DNA, 25 bp, Homo sapiens
gcataggagataaaacccccactga

SEQ ID NO: 19872 - DNA, 25 bp, Homo sapiens
ggacccaccgtgtagacacacgaca

SEQ ID NO: 19873 - DNA, 25 bp, Homo sapiens
tagacacacgacatgcaagagttgc

SEQ ID NO: 19874 - DNA, 25 bp, Homo sapiens
aagagttgcagcggctgctccaact

SEQ ID NO: 19875 - DNA, 25 bp, Homo sapiens
caaataactaacacgaacttccaga

SEQ ID NO: 19876 - DNA, 25 bp, Homo sapiens
aacatttgaacttagctgtaattct

SEQ ID NO: 19877 - DNA, 25 bp, Homo sapiens
catggaacatgcaggtgatttggga

SEQ ID NO: 19878 - DNA, 25 bp, Homo sapiens
aaagacctgagaaaacgagcctgtt

SEQ ID NO: 19879 - DNA, 25 bp, Homo sapiens
tttcagaggaacatcgtcacaacga

SEQ ID NO: 19880 - DNA, 25 bp, Homo sapiens
gtcacaacgaatacttctggaagct

SEQ ID NO: 19881 - DNA, 25 bp, Homo sapiens
taacaaaactaaccctgctgtcctt

SEQ ID NO: 19882 - DNA, 25 bp, Homo sapiens
atcggtgctcggaacttgctcaaat

SEQ ID NO: 19883 - DNA, 25 bp, Homo sapiens
gcagcaacttcaagccctaatagca

SEQ ID NO: 19884 - DNA, 25 bp, Homo sapiens
aaaacctctgtagcattccagcggc

SEQ ID NO: 19885 - DNA, 25 bp, Homo sapiens
cagcggcttgaccaatgacctatgt

SEQ ID NO: 19886 - DNA, 25 bp, Homo sapiens
gacctatgtcacaagaggtggcgtg

SEQ ID NO: 19887 - DNA, 25 bp, Homo sapiens
ggtggcgtgtaaggaatgcagcccc

SEQ ID NO: 19888 - DNA, 25 bp, Homo sapiens
gccccctgaagacagcactacaagt

SEQ ID NO: 19889 - DNA, 25 bp, Homo sapiens
agcactacaagtctgggggagccag

SEQ ID NO: 19890 - DNA, 25 bp, Homo sapiens
ggagccagttttaacatcagtgcac

SEQ ID NO: 19891 - DNA, 25 bp, Homo sapiens
ctcacctcttatgcttagttggaac

SEQ ID NO: 19892 - DNA, 25 bp, Homo sapiens
gcagtttgtaaactttcatcctttt

SEQ ID NO: 19893 - DNA, 25 bp, Homo sapiens
ctggatgtactggacaaacacctca

SEQ ID NO: 19894 - DNA, 25 bp, Homo sapiens
tcattccagcagctaacactggcga

SEQ ID NO: 19895 - DNA, 25 bp, Homo sapiens
aacactggcgagtccaaggttttct

SEQ ID NO: 19896 - DNA, 25 bp, Homo sapiens
ggggactaccacaggtatctggcag

SEQ ID NO: 19897 - DNA, 25 bp, Homo sapiens
gctgcggagaacagcctagtggctt

SEQ ID NO: 19898 - DNA, 25 bp, Homo sapiens
caccaacgcatcctattcgcttagg

SEQ ID NO: 19899 - DNA, 25 bp, Homo sapiens
atcctattcgcttaggtcttgctct

SEQ ID NO: 19900 - DNA, 25 bp, Homo sapiens
tactacgaaattcttaattcccctg

SEQ ID NO: 19901 - DNA, 25 bp, Homo sapiens
aggactctacacttatcatgcagtt

SEQ ID NO: 19902 - DNA, 25 bp, Homo sapiens
gtgataatctgacactatggacttc

SEQ ID NO: 19903 - DNA, 25 bp, Homo sapiens
ggacttcagacatgcagggtgacgg

SEQ ID NO: 19904 - DNA, 25 bp, Homo sapiens
ctcaccatcggggatcggtttgggg

SEQ ID NO: 19905 - DNA, 25 bp, Homo sapiens
gatcatgggcattggtcaccgagtg

SEQ ID NO: 19906 - DNA, 25 bp, Homo sapiens
aacaacccagacatgcgagtgcaga

SEQ ID NO: 19907 - DNA, 25 bp, Homo sapiens
aaagattacgtcaggcagcacttcc

SEQ ID NO: 19908 - DNA, 25 bp, Homo sapiens
ctcctctgctcgattatgcactgga

SEQ ID NO: 19909 - DNA, 25 bp, Homo sapiens
gaagattaccacctcgaagaagcca

SEQ ID NO: 19910 - DNA, 25 bp, Homo sapiens
agatggtctcatcggagtcgcattt

SEQ ID NO: 19911 - DNA, 25 bp, Homo sapiens
ggagccctcaatggcatctttgtgc

SEQ ID NO: 19912 - DNA, 25 bp, Homo sapiens
atggggttcattggacactatcttg

SEQ ID NO: 19913 - DNA, 25 bp, Homo sapiens
tgaagcaggggctgtatcgtcatcc

SEQ ID NO: 19914 - DNA, 25 bp, Homo sapiens
gtaacagagccaggaaccctactgc

SEQ ID NO: 19915 - DNA, 25 bp, Homo sapiens
agcccttcgagatgccaaactagac

SEQ ID NO: 19916 - DNA, 25 bp, Homo sapiens
gattcatgatattgtcctggttggt

SEQ ID NO: 19917 - DNA, 25 bp, Homo sapiens
ctggttggtggttctactcgtatcc

SEQ ID NO: 19918 - DNA, 25 bp, Homo sapiens
gaagcttctccaagacttcttcaat

SEQ ID NO: 19919 - DNA, 25 bp, Homo sapiens
tgttgcttatggtgcagctgtccag

SEQ ID NO: 19920 - DNA, 25 bp, Homo sapiens
agatttgctgctcttggatgtcact

SEQ ID NO: 19921 - DNA, 25 bp, Homo sapiens
tggtggagtcatgactgtcctcatc

SEQ ID NO: 19922 - DNA, 25 bp, Homo sapiens
tgtcctcatcaagcgtaataccacc

SEQ ID NO: 19923 - DNA, 25 bp, Homo sapiens
acagaccttcactacctattctgac

SEQ ID NO: 19924 - DNA, 25 bp, Homo sapiens
caaccagcctggtgtgcttattcag

SEQ ID NO: 19925 - DNA, 25 bp, Homo sapiens
gaactgaatgctgacctgttccgtg

SEQ ID NO: 19926 - DNA, 25 bp, Homo sapiens
tgggatggagctgaggtaccaccgc

SEQ ID NO: 19927 - DNA, 25 bp, Homo sapiens
ggaaccagatcctatctgtgctggc

SEQ ID NO: 19928 - DNA, 25 bp, Homo sapiens
tgtgctggcaggactggcagccatg

SEQ ID NO: 19929 - DNA, 25 bp, Homo sapiens
gaggaatgatttgtcctcacgctcc

SEQ ID NO: 19930 - DNA, 25 bp, Homo sapiens
tcacgctcccaagactggtttttct

SEQ ID NO: 19931 - DNA, 25 bp, Homo sapiens
caagactggtttttctactctcatg

SEQ ID NO: 19932 - DNA, 25 bp, Homo sapiens
ctactctcatgcattccagaggccc

SEQ ID NO: 19933 - DNA, 25 bp, Homo sapiens
tcctcgttgttggtacagccggaca

SEQ ID NO: 19934 - DNA, 25 bp, Homo sapiens
ttggtacagccggacacggggtgct

SEQ ID NO: 19935 - DNA, 25 bp, Homo sapiens
cacggggtgctgccacccagaataa

SEQ ID NO: 19936 - DNA, 25 bp, Homo sapiens
cgagaggctcgggagtgtctgaccc

SEQ ID NO: 19937 - DNA, 25 bp, Homo sapiens
aactctcgggctagagactgcagga

SEQ ID NO: 19938 - DNA, 25 bp, Homo sapiens
gactgcaggaacatgtgaatacgct

SEQ ID NO: 19939 - DNA, 25 bp, Homo sapiens
aatacgctagtgcaattccagcctg

SEQ ID NO: 19940 - DNA, 25 bp, Homo sapiens
taggaagagtagtctttgggtccct

SEQ ID NO: 19941 - DNA, 25 bp, Homo sapiens
ttgggtccctaaagatcacctgata

SEQ ID NO: 19942 - DNA, 25 bp, Homo sapiens
gacttttctgagcactcttgtggag

SEQ ID NO: 19943 - DNA, 25 bp, Homo sapiens
gaataccatgggcattggcaatgta

SEQ ID NO: 19944 - DNA, 25 bp, Homo sapiens
ctaaccaggtgtgacggcttgcgtc

SEQ ID NO: 19945 - DNA, 25 bp, Homo sapiens
ggcttgcgtctgtactatcatttac

SEQ ID NO: 19946 - DNA, 25 bp, Homo sapiens
gtactatcatttactcggtaggctg

SEQ ID NO: 19947 - DNA, 25 bp, Homo sapiens
ggtaggatagcttaaactctcgggc

SEQ ID NO: 19948 - DNA, 25 bp, Homo sapiens
atcgtggagatcatgcagcaaggtt

SEQ ID NO: 19949 - DNA, 25 bp, Homo sapiens
gcaaggttctcagcttccttgcttc

SEQ ID NO: 19950 - DNA, 25 bp, Homo sapiens
aagagaggttccacatgagcatgac

SEQ ID NO: 19951 - DNA, 25 bp, Homo sapiens
atggcagtatgcggtctatcaccac

SEQ ID NO: 19952 - DNA, 25 bp, Homo sapiens
tcaccaccaaactctatgacggctt

SEQ ID NO: 19953 - DNA, 25 bp, Homo sapiens
gtacctcaccaacggcatcatgtga

SEQ ID NO: 19954 - DNA, 25 bp, Homo sapiens
caccaacggcatcatgtgacacgct

SEQ ID NO: 19955 - DNA, 25 bp, Homo sapiens
gaaggatcatgtggtaactgcgaga

SEQ ID NO: 19956 - DNA, 25 bp, Homo sapiens
ccagctgtggggtccagacttgttg

SEQ ID NO: 19957 - DNA, 25 bp, Homo sapiens
cactgccctccagaaaacagaggtg

SEQ ID NO: 19958 - DNA, 25 bp, Homo sapiens
ttctccttgtaggggtctctcagag

SEQ ID NO: 19959 - DNA, 25 bp, Homo sapiens
atggcctggggctggcatttatctt

SEQ ID NO: 19960 - DNA, 25 bp, Homo sapiens
ttatctttcctttcagcaagcacct

SEQ ID NO: 19961 - DNA, 25 bp, Homo sapiens
gcacctcaaatttgccatgctggct

SEQ ID NO: 19962 - DNA, 25 bp, Homo sapiens
aagagtgctctccatgctctaattt

SEQ ID NO: 19963 - DNA, 25 bp, Homo sapiens
tacccctgagtgtggtcccacagga

SEQ ID NO: 19964 - DNA, 25 bp, Homo sapiens
ctgccgctcagctttgatggaacaa

SEQ ID NO: 19965 - DNA, 25 bp, Homo sapiens
gaaggggctgtcgtgtgtgtggccc

SEQ ID NO: 19966 - DNA, 25 bp, Homo sapiens
ttgtcttgtcatcattcgtcagcga

SEQ ID NO: 19967 - DNA, 25 bp, Homo sapiens
tcgagtccatatagctacattccac

SEQ ID NO: 19968 - DNA, 25 bp, Homo sapiens
ccacccttgtatcctgggtcttaga

SEQ ID NO: 19969 - DNA, 25 bp, Homo sapiens
tgatttgcactcttggttctttgga

SEQ ID NO: 19970 - DNA, 25 bp, Homo sapiens
ctgccaccacgacctggtatttgta

SEQ ID NO: 19971 - DNA, 25 bp, Homo sapiens
gccacttggttgctatggtttccac

SEQ ID NO: 19972 - DNA, 25 bp, Homo sapiens
gtataaaccctctcttttatggctt

SEQ ID NO: 19973 - DNA, 25 bp, Homo sapiens
tggtagtgcttattcaccactgctg

SEQ ID NO: 19974 - DNA, 25 bp, Homo sapiens
tgctggtgcttcacacctcaggaaa

SEQ ID NO: 19975 - DNA, 25 bp, Homo sapiens
gaaaatattgccatctccactatgc

SEQ ID NO: 19976 - DNA, 25 bp, Homo sapiens
tccactatgcacacagactccaaga

SEQ ID NO: 19977 - DNA, 25 bp, Homo sapiens
attgttatctgcctccgcaggagaa

SEQ ID NO: 19978 - DNA, 25 bp, Homo sapiens
acacaatgttgatttccatcgtggt

SEQ ID NO: 19979 - DNA, 25 bp, Homo sapiens
tccatcgtggtgacctttggagcct

SEQ ID NO: 19980 - DNA, 25 bp, Homo sapiens
ctgccccgaatatcttcaatgtcat

SEQ ID NO: 19981 - DNA, 25 bp, Homo sapiens
tgaagtcatcagctttgtgccacca

SEQ ID NO: 19982 - DNA, 25 bp, Homo sapiens
ccaccaccccttgaccaagaagaga

SEQ ID NO: 19983 - DNA, 25 bp, Homo sapiens
acaggctacgtggccactaggtggt

SEQ ID NO: 19984 - DNA, 25 bp, Homo sapiens
agggctcctgagatcatgctgaact

SEQ ID NO: 19985 - DNA, 25 bp, Homo sapiens
gcataatggccgagctgttgactgg

SEQ ID NO: 19986 - DNA, 25 bp, Homo sapiens
agaacattgtttcctggtacagacc

SEQ ID NO: 19987 - DNA, 25 bp, Homo sapiens
aaccccaggggctgagcttttgaag

SEQ ID NO: 19988 - DNA, 25 bp, Homo sapiens
tcagtctttgactcagatgccgaag

SEQ ID NO: 19989 - DNA, 25 bp, Homo sapiens
ctggctgtcgacttgctggagaaga

SEQ ID NO: 19990 - DNA, 25 bp, Homo sapiens
tttgctcagtaccacgatcctgatg

SEQ ID NO: 19991 - DNA, 25 bp, Homo sapiens
tgaaccagtggccgatccttatgat

SEQ ID NO: 19992 - DNA, 25 bp, Homo sapiens
agcaagagtttggccgcactgggct

SEQ ID NO: 19993 - DNA, 25 bp, Homo sapiens
tgggcttcctgacctaagcagtatg

SEQ ID NO: 19994 - DNA, 25 bp, Homo sapiens
gagcagattgcttatgccatgcaga

SEQ ID NO: 19995 - DNA, 25 bp, Homo sapiens
gagcagagtttggccaggcggaatc

SEQ ID NO: 19996 - DNA, 25 bp, Homo sapiens
ttggccaggcggaatcagcagacat

SEQ ID NO: 19997 - DNA, 25 bp, Homo sapiens
cagcagacattgatgccagctcagc

SEQ ID NO: 19998 - DNA, 25 bp, Homo sapiens
gaggaggatgattacgacgtgatgc

SEQ ID NO: 19999 - DNA, 25 bp, Homo sapiens
ggagtagatcccagtgctgatcctg

SEQ ID NO: 20000 - DNA, 25 bp, Homo sapiens
atcccagtgctgatcctgagctggc

SEQ ID NO: 20001 - DNA, 25 bp, Homo sapiens
ttggcccttcgtgtatctatggaag

SEQ ID NO: 20002 - DNA, 25 bp, Homo sapiens
atgccctgctgaagatgaccatcag

SEQ ID NO: 20003 - DNA, 25 bp, Homo sapiens
aaccttccctgatgcgagagagcag

SEQ ID NO: 20004 - DNA, 25 bp, Homo sapiens
gatggctatgggaggtgctatgggc

SEQ ID NO: 20005 - DNA, 25 bp, Homo sapiens
acctgccactatgatgccggatgga

SEQ ID NO: 20006 - DNA, 25 bp, Homo sapiens
tttgggattgaccccaccaacaact

SEQ ID NO: 20007 - DNA, 25 bp, Homo sapiens
aacgctttggtcaggctgctacaat

SEQ ID NO: 20008 - DNA, 25 bp, Homo sapiens
ttggggcaattggtggaactcctcc

SEQ ID NO: 20009 - DNA, 25 bp, Homo sapiens
ctcctggagctgaatttgccccaaa

SEQ ID NO: 20010 - DNA, 25 bp, Homo sapiens
ataagttgcagtgtctagtttctca

SEQ ID NO: 20011 - DNA, 25 bp, Homo sapiens
ggaccctttttggactagccagaat

SEQ ID NO: 20012 - DNA, 25 bp, Homo sapiens
ccaatagttagatctaccctgcctg

SEQ ID NO: 20013 - DNA, 25 bp, Homo sapiens
taccctgcctgtactactctaggga

SEQ ID NO: 20014 - DNA, 25 bp, Homo sapiens
atgaaagagagggctacactgctat

SEQ ID NO: 20015 - DNA, 25 bp, Homo sapiens
gtatctgcaattaggtgttcatttt

SEQ ID NO: 20016 - DNA, 25 bp, Homo sapiens
actgcttgtaggcacaacttctgca

SEQ ID NO: 20017 - DNA, 25 bp, Homo sapiens
aaagtcaaccactggctttgtgaaa

SEQ ID NO: 20018 - DNA, 25 bp, Homo sapiens
gctgggtaaattaacttgcctagtg

SEQ ID NO: 20019 - DNA, 25 bp, Homo sapiens
gaacttctggttctataatcatatt

SEQ ID NO: 20020 - DNA, 25 bp, Homo sapiens
taatggggcttacccttgttgcact

SEQ ID NO: 20021 - DNA, 25 bp, Homo sapiens
tacccttgttgcactcgaaatctga

SEQ ID NO: 20022 - DNA, 25 bp, Homo sapiens
aatctgaggtgtatctagccctgcc

SEQ ID NO: 20023 - DNA, 25 bp, Homo sapiens
tagccctgccactattggctactta

SEQ ID NO: 20024 - DNA, 25 bp, Homo sapiens
gctacttaccctcattaatatccca

SEQ ID NO: 20025 - DNA, 25 bp, Homo sapiens
aatgaaccgacagcaacgcttcttc

SEQ ID NO: 20026 - DNA, 25 bp, Homo sapiens
cgaccagtacaaagaccctcagagt

SEQ ID NO: 20027 - DNA, 25 bp, Homo sapiens
aaggctggtggtatgcccattttga

SEQ ID NO: 20028 - DNA, 25 bp, Homo sapiens
ttgatggaccatggattgcccggca

SEQ ID NO: 20029 - DNA, 25 bp, Homo sapiens
attgcccggcaaatggaactccatc

SEQ ID NO: 20030 - DNA, 25 bp, Homo sapiens
ccacccatcctacttgtggctggta

SEQ ID NO: 20031 - DNA, 25 bp, Homo sapiens
gaagcgtggtgctgagatcttgcca

SEQ ID NO: 20032 - DNA, 25 bp, Homo sapiens
tggaggcatccagtaccttcagaat

SEQ ID NO: 20033 - DNA, 25 bp, Homo sapiens
ttgagagcagacaggctcggcccac

SEQ ID NO: 20034 - DNA, 25 bp, Homo sapiens
ggagcctttgccatggtacttaggt

SEQ ID NO: 20035 - DNA, 25 bp, Homo sapiens
cccccagatttaaccattccataat

SEQ ID NO: 20036 - DNA, 25 bp, Homo sapiens
agccctttgctctggaggaagttct

SEQ ID NO: 20037 - DNA, 25 bp, Homo sapiens
caagcatcaccctgggagtttcctg

SEQ ID NO: 20038 - DNA, 25 bp, Homo sapiens
gggagtttcctgagggttttctcat

SEQ ID NO: 20039 - DNA, 25 bp, Homo sapiens
aaatgagggctgcacattgcctgtt

SEQ ID NO: 20040 - DNA, 25 bp, Homo sapiens
attgcctgttctgcttcgaagtatt

SEQ ID NO: 20041 - DNA, 25 bp, Homo sapiens
aaagtcacccaaacacttctgcttt

SEQ ID NO: 20042 - DNA, 25 bp, Homo sapiens
tgctttcacttaagtgtctggcccg

SEQ ID NO: 20043 - DNA, 25 bp, Homo sapiens
gtctggcccgcaatactgtaggaac

SEQ ID NO: 20044 - DNA, 25 bp, Homo sapiens
tatccacagtactcactttttccaa

SEQ ID NO: 20045 - DNA, 25 bp, Homo sapiens
gaaatatctttctcttacctgttat

SEQ ID NO: 20046 - DNA, 25 bp, Homo sapiens
tatgtgccaaagctttactactgtg

SEQ ID NO: 20047 - DNA, 25 bp, Homo sapiens
gtgccatagtgcaggcttggggagc

SEQ ID NO: 20048 - DNA, 25 bp, Homo sapiens
gcttggggagctttaagcctcagtt

SEQ ID NO: 20049 - DNA, 25 bp, Homo sapiens
cagagcctcctagatgtaacattcc

SEQ ID NO: 20050 - DNA, 25 bp, Homo sapiens
gaggtccatatttagtggtactctg

SEQ ID NO: 20051 - DNA, 25 bp, Homo sapiens
aaattggtcactttcctattacacg

SEQ ID NO: 20052 - DNA, 25 bp, Homo sapiens
gtagcaaattaactttacatccttt

SEQ ID NO: 20053 - DNA, 25 bp, Homo sapiens
tacatcctttttcctacttgttatg

SEQ ID NO: 20054 - DNA, 25 bp, Homo sapiens
ggaccgataagtgtgcttaatcctg

SEQ ID NO: 20055 - DNA, 25 bp, Homo sapiens
gattctactcttatatgctggactg

SEQ ID NO: 20056 - DNA, 25 bp, Homo sapiens
gctggactgcattcacacatggcat

SEQ ID NO: 20057 - DNA, 25 bp, Homo sapiens
gtgtttgtgccatatttgtgccatt

SEQ ID NO: 20058 - DNA, 25 bp, Homo sapiens
cagaccttgtgatattccagttccc

SEQ ID NO: 20059 - DNA, 25 bp, Homo sapiens
gtccctgccattctgaaaggctggt

SEQ ID NO: 20060 - DNA, 25 bp, Homo sapiens
gagagtttgcttacacttacgctgc

SEQ ID NO: 20061 - DNA, 25 bp, Homo sapiens
acacttacgctgccatgtatgacaa

SEQ ID NO: 20062 - DNA, 25 bp, Homo sapiens
gtatgacaaaggacccttccggagt

SEQ ID NO: 20063 - DNA, 25 bp, Homo sapiens
gtggcttccaagtcttagaacctca

SEQ ID NO: 20064 - DNA, 25 bp, Homo sapiens
atatagcattgggcacactccagca

SEQ ID NO: 20065 - DNA, 25 bp, Homo sapiens
ggatgagacaccactgtattttgct

SEQ ID NO: 20066 - DNA, 25 bp, Homo sapiens
agcctctttgacctaaacttccagg

SEQ ID NO: 20067 - DNA, 25 bp, Homo sapiens
ttctgtgggccatcacttgggcaag

SEQ ID NO: 20068 - DNA, 25 bp, Homo sapiens
cttgggcaagtccatcccaactgac

SEQ ID NO: 20069 - DNA, 25 bp, Homo sapiens
ggattcctgaaccttggatcacacc

SEQ ID NO: 20070 - DNA, 25 bp, Homo sapiens
gagaggctcagttatactcagtgga

SEQ ID NO: 20071 - DNA, 25 bp, Homo sapiens
actcagtggacgtgactctggaccc

SEQ ID NO: 20072 - DNA, 25 bp, Homo sapiens
tgatcctctctgataatctgcggca

SEQ ID NO: 20073 - DNA, 25 bp, Homo sapiens
aatctgcggcaagtgcggtacagtt

SEQ ID NO: 20074 - DNA, 25 bp, Homo sapiens
ggtacagttacctccaacaggacct

SEQ ID NO: 20075 - DNA, 25 bp, Homo sapiens
gtctccttctacaacgtgacagaga

SEQ ID NO: 20076 - DNA, 25 bp, Homo sapiens
ggccctacttcagtctgagttactc

SEQ ID NO: 20077 - DNA, 25 bp, Homo sapiens
gaaaagtgcagctcctctgatcatc

SEQ ID NO: 20078 - DNA, 25 bp, Homo sapiens
cagcctgatcgctcagctagaagag

SEQ ID NO: 20079 - DNA, 25 bp, Homo sapiens
agctcctgcaggacattggggacac

SEQ ID NO: 20080 - DNA, 25 bp, Homo sapiens
gctttcaagagcttggtacttccca

SEQ ID NO: 20081 - DNA, 25 bp, Homo sapiens
ccggcagtcctctgtagtccagaga

SEQ ID NO: 20082 - DNA, 25 bp, Homo sapiens
agattagatcttcttggttccctgt

SEQ ID NO: 20083 - DNA, 25 bp, Homo sapiens
ggttccctgtgaggtttcaggcact

SEQ ID NO: 20084 - DNA, 25 bp, Homo sapiens
ctcctcctccaatgggactcaagga

SEQ ID NO: 20085 - DNA, 25 bp, Homo sapiens
gggactcaaggacttgacctccagg

SEQ ID NO: 20086 - DNA, 25 bp, Homo sapiens
cctccaggagtaggcccctggtcag

SEQ ID NO: 20087 - DNA, 25 bp, Homo sapiens
tcctcattcattctttatcatcctg

SEQ ID NO: 20088 - DNA, 25 bp, Homo sapiens
atcatcctgtgttctgtttagttgc

SEQ ID NO: 20089 - DNA, 25 bp, Homo sapiens
ggcttcctggaagttagttgccaaa

SEQ ID NO: 20090 - DNA, 25 bp, Homo sapiens
gcatcacctgtcattcttgtgttgg

SEQ ID NO: 20091 - DNA, 25 bp, Homo sapiens
catactgcatgctcaggacccatag

SEQ ID NO: 20092 - DNA, 25 bp, Homo sapiens
tgaggaaggtgcttgcctgggacca

SEQ ID NO: 20093 - DNA, 25 bp, Homo sapiens
gaccccggaacctgaaggtgctgac

SEQ ID NO: 20094 - DNA, 25 bp, Homo sapiens
gacctgctgctgttgagtgagatct

SEQ ID NO: 20095 - DNA, 25 bp, Homo sapiens
agtgagatcttcaatgcttcctcct

SEQ ID NO: 20096 - DNA, 25 bp, Homo sapiens
caaggcccagacaggctcaggtttc

SEQ ID NO: 20097 - DNA, 25 bp, Homo sapiens
cttccttcgcagcttttagaccaaa

SEQ ID NO: 20098 - DNA, 25 bp, Homo sapiens
acaggcctcgctacaagaacctgct

SEQ ID NO: 20099 - DNA, 25 bp, Homo sapiens
agaacctgctaaggctgcctcagac

SEQ ID NO: 20100 - DNA, 25 bp, Homo sapiens
cccactctcaaatcctgatgctgtt

SEQ ID NO: 20101 - DNA, 25 bp, Homo sapiens
tgtacccttcggagggcactcacat

SEQ ID NO: 20102 - DNA, 25 bp, Homo sapiens
gccccaccacctcaaatttatgatg

SEQ ID NO: 20103 - DNA, 25 bp, Homo sapiens
gatcagccttcagcacagatgcagc

SEQ ID NO: 20104 - DNA, 25 bp, Homo sapiens
agcagtaagtagcaacgccactcct

SEQ ID NO: 20105 - DNA, 25 bp, Homo sapiens
ccttctcagtcttcatcgatcaatg

SEQ ID NO: 20106 - DNA, 25 bp, Homo sapiens
atttcatccatgtccactgagcaga

SEQ ID NO: 20107 - DNA, 25 bp, Homo sapiens
gacgctggcctcagacacagacagc

SEQ ID NO: 20108 - DNA, 25 bp, Homo sapiens
cagacagcagtcttgatgcctcgac

SEQ ID NO: 20109 - DNA, 25 bp, Homo sapiens
agcattgaaggaactctcacctccg

SEQ ID NO: 20110 - DNA, 25 bp, Homo sapiens
aagaaacacaatgccttgccctatt

SEQ ID NO: 20111 - DNA, 25 bp, Homo sapiens
tgtagacgaagctctgcgtcaccca

SEQ ID NO: 20112 - DNA, 25 bp, Homo sapiens
gtcacccatacatcactgtttggta

SEQ ID NO: 20113 - DNA, 25 bp, Homo sapiens
tacggacaacatcctttctgtctga

SEQ ID NO: 20114 - DNA, 25 bp, Homo sapiens
ggggactagaaagaggccctgccct

SEQ ID NO: 20115 - DNA, 25 bp, Homo sapiens
ccctgccctctagaaagctcagatc

SEQ ID NO: 20116 - DNA, 25 bp, Homo sapiens
tgggctccttagtcagatgcctaaa

SEQ ID NO: 20117 - DNA, 25 bp, Homo sapiens
ggacagtgtggcttgtcacaggcct

SEQ ID NO: 20118 - DNA, 25 bp, Homo sapiens
ggggagtgggagtctcagcaatctc

SEQ ID NO: 20119 - DNA, 25 bp, Homo sapiens
agcaatctcttggtcttggcttcat

SEQ ID NO: 20120 - DNA, 25 bp, Homo sapiens
tctcccaactcattagctcctgggc

SEQ ID NO: 20121 - DNA, 25 bp, Homo sapiens
atcctcctgagccacatgtgcaggt

SEQ ID NO: 20122 - DNA, 25 bp, Homo sapiens
tggctcccagagctctaggaactct

SEQ ID NO: 20123 - DNA, 25 bp, Homo sapiens
gatttgcctcttctaagtgtctatg

SEQ ID NO: 20124 - DNA, 25 bp, Homo sapiens
gaactcttcttgaattctactcctg

SEQ ID NO: 20125 - DNA, 25 bp, Homo sapiens
cggctctggcatgggaggttctgga

SEQ ID NO: 20126 - DNA, 25 bp, Homo sapiens
gaggttctggaatgggaggctacgg

SEQ ID NO: 20127 - DNA, 25 bp, Homo sapiens
gatatggtactcctgatggtttggg

SEQ ID NO: 20128 - DNA, 25 bp, Homo sapiens
tggtttgggtggttatggccgtggt

SEQ ID NO: 20129 - DNA, 25 bp, Homo sapiens
ggaggttactatgggcaaggcggca

SEQ ID NO: 20130 - DNA, 25 bp, Homo sapiens
ggcaaggcggcatgagtggaggtgg

SEQ ID NO: 20131 - DNA, 25 bp, Homo sapiens
ggaggtggatggcgtgggatgtact

SEQ ID NO: 20132 - DNA, 25 bp, Homo sapiens
gtcttgacaacagcatctggtctac

SEQ ID NO: 20133 - DNA, 25 bp, Homo sapiens
ggtctactagactttcttacagatt

SEQ ID NO: 20134 - DNA, 25 bp, Homo sapiens
actcctaaagatgtgctgccttcat

SEQ ID NO: 20135 - DNA, 25 bp, Homo sapiens
ggaatgaaccatccatcaacttcta

SEQ ID NO: 20136 - DNA, 25 bp, Homo sapiens
aaccatccatcaacttctataaaag

SEQ ID NO: 20137 - DNA, 25 bp, Homo sapiens
aaagaagaggtgcttctgatctgtc

SEQ ID NO: 20138 - DNA, 25 bp, Homo sapiens
ctgatctgtccagtgaagagggttg

SEQ ID NO: 20139 - DNA, 25 bp, Homo sapiens
gaataaattcccaacttctcttgct

SEQ ID NO: 20140 - DNA, 25 bp, Homo sapiens
cttctcttgctttctatgctgtttg

SEQ ID NO: 20141 - DNA, 25 bp, Homo sapiens
tgctttctatgctgtttgtagtgaa

SEQ ID NO: 20142 - DNA, 25 bp, Homo sapiens
agaatgagcacccattccaaagctt

SEQ ID NO: 20143 - DNA, 25 bp, Homo sapiens
ccattccaaagctttattaccagtg

SEQ ID NO: 20144 - DNA, 25 bp, Homo sapiens
attaccagtggcgttgttgcatgtt

SEQ ID NO: 20145 - DNA, 25 bp, Homo sapiens
agtggcgttgttgcatgtttgaaat

SEQ ID NO: 20146 - DNA, 25 bp, Homo sapiens
gggaagctgacctgcaagttcaagt

SEQ ID NO: 20147 - DNA, 25 bp, Homo sapiens
tagtacgactggcgggttgacctca

SEQ ID NO: 20148 - DNA, 25 bp, Homo sapiens
actactgtgtcgtttttccactact

SEQ ID NO: 20149 - DNA, 25 bp, Homo sapiens
cagctgggctggagaccttgacaag

SEQ ID NO: 20150 - DNA, 25 bp, Homo sapiens
gtcaaaaaccctcctgacatcgttg

SEQ ID NO: 20151 - DNA, 25 bp, Homo sapiens
gaatttgcctgtgtttccagtttgg

SEQ ID NO: 20152 - DNA, 25 bp, Homo sapiens
tagttactgctgtggtcctaggtct

SEQ ID NO: 20153 - DNA, 25 bp, Homo sapiens
ctcactctgctcatcagcatgattc

SEQ ID NO: 20154 - DNA, 25 bp, Homo sapiens
atgattctggctgtcctctatagaa

SEQ ID NO: 20155 - DNA, 25 bp, Homo sapiens
gggattacactggggcccagtcata

SEQ ID NO: 20156 - DNA, 25 bp, Homo sapiens
tatatgcacagttagaccactccgg

SEQ ID NO: 20157 - DNA, 25 bp, Homo sapiens
ggccgtgcggagattcaaggaccta

SEQ ID NO: 20158 - DNA, 25 bp, Homo sapiens
tcaaggacctaagcttccaggagga

SEQ ID NO: 20159 - DNA, 25 bp, Homo sapiens
ggaggagtacagcacactgttccct

SEQ ID NO: 20160 - DNA, 25 bp, Homo sapiens
gtatcacccctggcagtgaggtggc

SEQ ID NO: 20161 - DNA, 25 bp, Homo sapiens
gtgaggtggcaggagcagcctagtg

SEQ ID NO: 20162 - DNA, 25 bp, Homo sapiens
gcaggagcagcctagtgccagaaat

SEQ ID NO: 20163 - DNA, 25 bp, Homo sapiens
gaaatgtccaagatgccagggcatg

SEQ ID NO: 20164 - DNA, 25 bp, Homo sapiens
caagatgccagggcatgcagggcag

SEQ ID NO: 20165 - DNA, 25 bp, Homo sapiens
aattcaggttctccactgactcatt

SEQ ID NO: 20166 - DNA, 25 bp, Homo sapiens
tccttcattgattcttcatgcgttc

SEQ ID NO: 20167 - DNA, 25 bp, Homo sapiens
tgattcttcatgcgttcattcattc

SEQ ID NO: 20168 - DNA, 25 bp, Homo sapiens
tgctggacattctagccgacagccg

SEQ ID NO: 20169 - DNA, 25 bp, Homo sapiens
tccttttatggccagcgcaattcag

SEQ ID NO: 20170 - DNA, 25 bp, Homo sapiens
cccctactggcggggtgctgtgtgg

SEQ ID NO: 20171 - DNA, 25 bp, Homo sapiens
atgtcaactacctggctttgggagc

SEQ ID NO: 20172 - DNA, 25 bp, Homo sapiens
agctccgtgccaacgtggtaggcaa

SEQ ID NO: 20173 - DNA, 25 bp, Homo sapiens
ggcaatgtatggcgccagtaccagg

SEQ ID NO: 20174 - DNA, 25 bp, Homo sapiens
ttgggagcagtacagtgaccgcgat

SEQ ID NO: 20175 - DNA, 25 bp, Homo sapiens
tccacggctggaccagccttgtctt

SEQ ID NO: 20176 - DNA, 25 bp, Homo sapiens
aggaggggagccaagacactcatgc

SEQ ID NO: 20177 - DNA, 25 bp, Homo sapiens
ggacaaaggcttctggcttttgccc

SEQ ID NO: 20178 - DNA, 25 bp, Homo sapiens
taccagtaattcaaaccttcctcat

SEQ ID NO: 20179 - DNA, 25 bp, Homo sapiens
aggtggaagctatgctggttccctg

SEQ ID NO: 20180 - DNA, 25 bp, Homo sapiens
tgagccctacgaggagctggaggcc

SEQ ID NO: 20181 - DNA, 25 bp, Homo sapiens
cgaggagctggaggccgaggagtgc

SEQ ID NO: 20182 - DNA, 25 bp, Homo sapiens
ccgaggagtgcgggatcctggacgg

SEQ ID NO: 20183 - DNA, 25 bp, Homo sapiens
gcatggcctgcgttgacatcaacga

SEQ ID NO: 20184 - DNA, 25 bp, Homo sapiens
acgagtgtgatgaggccgaggctgc

SEQ ID NO: 20185 - DNA, 25 bp, Homo sapiens
cagcccgcttagtctgatgacgagg

SEQ ID NO: 20186 - DNA, 25 bp, Homo sapiens
agtctgatgacgaggaagcccgcca

SEQ ID NO: 20187 - DNA, 25 bp, Homo sapiens
atgacgaggaagcccgccagaaagt

SEQ ID NO: 20188 - DNA, 25 bp, Homo sapiens
agcccgccagaaagtccagaagaag

SEQ ID NO: 20189 - DNA, 25 bp, Homo sapiens
ggaacgacggacgcaaagcggcgcc

SEQ ID NO: 20190 - DNA, 25 bp, Homo sapiens
tgcgcagccacgatgcggaggaggt

SEQ ID NO: 20191 - DNA, 25 bp, Homo sapiens
gcagccacgatgcggaggaggtgct

SEQ ID NO: 20192 - DNA, 25 bp, Homo sapiens
cttcccattgagggccgaaaagaag

SEQ ID NO: 20193 - DNA, 25 bp, Homo sapiens
tgaagagagacctggctacctccga

SEQ ID NO: 20194 - DNA, 25 bp, Homo sapiens
tacctccgacatccagatggtccac

SEQ ID NO: 20195 - DNA, 25 bp, Homo sapiens
tgcaccatccacgggaacacagagg

SEQ ID NO: 20196 - DNA, 25 bp, Homo sapiens
tccacgggaacacagaggagctgcg

SEQ ID NO: 20197 - DNA, 25 bp, Homo sapiens
tcattctggaccagcactgacagcc

SEQ ID NO: 20198 - DNA, 25 bp, Homo sapiens
tgtccacaccacgagtggcacatcc

SEQ ID NO: 20199 - DNA, 25 bp, Homo sapiens
cctggaacccaggctctaaacaagc

SEQ ID NO: 20200 - DNA, 25 bp, Homo sapiens
acccaggctctaaacaagcagggag

SEQ ID NO: 20201 - DNA, 25 bp, Homo sapiens
gcattccaccggcggctacggtggt

SEQ ID NO: 20202 - DNA, 25 bp, Homo sapiens
gctacggtggtggcaattccggcgg

SEQ ID NO: 20203 - DNA, 25 bp, Homo sapiens
tccagcggaggccacaagtcctcct

SEQ ID NO: 20204 - DNA, 25 bp, Homo sapiens
gggcgagtcttcatctaagggacca

SEQ ID NO: 20205 - DNA, 25 bp, Homo sapiens
tggcgcccgacggtagagttctttc

SEQ ID NO: 20206 - DNA, 25 bp, Homo sapiens
ctcccttcacacagaccattaattt

SEQ ID NO: 20207 - DNA, 25 bp, Homo sapiens
aacacttctgtcttgatggtctatg

SEQ ID NO: 20208 - DNA, 25 bp, Homo sapiens
ggtgttttgtggtttctgtatttct

SEQ ID NO: 20209 - DNA, 25 bp, Homo sapiens
gtatttcttcttttcactttaccag

SEQ ID NO: 20210 - DNA, 25 bp, Homo sapiens
caactttctgttctcatttactaat

SEQ ID NO: 20211 - DNA, 25 bp, Homo sapiens
actgatgcaaacgtctgagattact

SEQ ID NO: 20212 - DNA, 25 bp, Homo sapiens
tcagtccattgttccacgtttaaga

SEQ ID NO: 20213 - DNA, 25 bp, Homo sapiens
caattctactgggtcactatcgctt

SEQ ID NO: 20214 - DNA, 25 bp, Homo sapiens
ttttcgtcgtgtccctgtacaagaa

SEQ ID NO: 20215 - DNA, 25 bp, Homo sapiens
gagttttcatgtggggctacagcta

SEQ ID NO: 20216 - DNA, 25 bp, Homo sapiens
gctacagctatgttccagtggtcac

SEQ ID NO: 20217 - DNA, 25 bp, Homo sapiens
tgacaagatgtacacccccttgttc

SEQ ID NO: 20218 - DNA, 25 bp, Homo sapiens
ccccttgttcttcgccagagtaagg

SEQ ID NO: 20219 - DNA, 25 bp, Homo sapiens
tctgtagagcctcaagtccagtcct

SEQ ID NO: 20220 - DNA, 25 bp, Homo sapiens
cagtcctctatcacttttgcatgaa

SEQ ID NO: 20221 - DNA, 25 bp, Homo sapiens
aggggaacagtctcttgatggtttc

SEQ ID NO: 20222 - DNA, 25 bp, Homo sapiens
aagattctttcctgatggccatgtg

SEQ ID NO: 20223 - DNA, 25 bp, Homo sapiens
cctcattccagcctttctatataaa

SEQ ID NO: 20224 - DNA, 25 bp, Homo sapiens
aatgtggtgcacactatagcctcac

SEQ ID NO: 20225 - DNA, 25 bp, Homo sapiens
atagcctcacaaacctgttattcca

SEQ ID NO: 20226 - DNA, 25 bp, Homo sapiens
gttactggcttggtcttatttgcac

SEQ ID NO: 20227 - DNA, 25 bp, Homo sapiens
agtttttgcgtcttgtttgcttctt

SEQ ID NO: 20228 - DNA, 25 bp, Homo sapiens
tctttcccccttttaatttgtgatg

SEQ ID NO: 20229 - DNA, 25 bp, Homo sapiens
atgtcacttgaccccatttatgtgt

SEQ ID NO: 20230 - DNA, 25 bp, Homo sapiens
gtaggagcactacaccattggtttc

SEQ ID NO: 20231 - DNA, 25 bp, Homo sapiens
attggtttccaatactgcacacata

SEQ ID NO: 20232 - DNA, 25 bp, Homo sapiens
gtgcagaaagtatcttcctccaggc

SEQ ID NO: 20233 - DNA, 25 bp, Homo sapiens
cctccaggcttgtaatacccttcac

SEQ ID NO: 20234 - DNA, 25 bp, Homo sapiens
ttaggctggcgttacttttgctgtc

SEQ ID NO: 20235 - DNA, 25 bp, Homo sapiens
agtcaggactaatcacggtgtttca

SEQ ID NO: 20236 - DNA, 25 bp, Homo sapiens
cggtgtttcagtgcggagtgccaag

SEQ ID NO: 20237 - DNA, 25 bp, Homo sapiens
tgccaagagtcctatcctgacgtca

SEQ ID NO: 20238 - DNA, 25 bp, Homo sapiens
tgacgtcaggctctgggtgtcaacc

SEQ ID NO: 20239 - DNA, 25 bp, Homo sapiens
ggtgtcaacctctgacttattctgc

SEQ ID NO: 20240 - DNA, 25 bp, Homo sapiens
tattctgcagatgctctgtgtgtgt

SEQ ID NO: 20241 - DNA, 25 bp, Homo sapiens
gagagggtggtagcacagggcttgg

SEQ ID NO: 20242 - DNA, 25 bp, Homo sapiens
cagggcttgggatatcggcagtgtg

SEQ ID NO: 20243 - DNA, 25 bp, Homo sapiens
atcatctctgctacagtcatgtttc

SEQ ID NO: 20244 - DNA, 25 bp, Homo sapiens
atgtttctgcatgtcagcgagcgac

SEQ ID NO: 20245 - DNA, 25 bp, Homo sapiens
cagccgtccgaaggcgagagcagga

SEQ ID NO: 20246 - DNA, 25 bp, Homo sapiens
ttgaccgagtctgcgaggatcgccc

SEQ ID NO: 20247 - DNA, 25 bp, Homo sapiens
gaggatcgcccgtggcaaaatcaca

SEQ ID NO: 20248 - DNA, 25 bp, Homo sapiens
acctcagtgcagccaaccatgatgc

SEQ ID NO: 20249 - DNA, 25 bp, Homo sapiens
caaccatgatgctgccatctttcca

SEQ ID NO: 20250 - DNA, 25 bp, Homo sapiens
cggccaaggtgctcagaggcgtcga

SEQ ID NO: 20251 - DNA, 25 bp, Homo sapiens
gtggcaagtggccttatgccgggac

SEQ ID NO: 20252 - DNA, 25 bp, Homo sapiens
gggtgccaagcactgcgtgaaggaa

SEQ ID NO: 20253 - DNA, 25 bp, Homo sapiens
ggaagtggtcgaagctcacgtggac

SEQ ID NO: 20254 - DNA, 25 bp, Homo sapiens
tcatgtgcgagacggcactccacta

SEQ ID NO: 20255 - DNA, 25 bp, Homo sapiens
tctttgccgaaacctgcaggcgttc

SEQ ID NO: 20256 - DNA, 25 bp, Homo sapiens
catccgcccatgacacagggagcag

SEQ ID NO: 20257 - DNA, 25 bp, Homo sapiens
gagcagatggatccacgtgctcgcc

SEQ ID NO: 20258 - DNA, 25 bp, Homo sapiens
tgcaggtgctagcattaccacttcc

SEQ ID NO: 20259 - DNA, 25 bp, Homo sapiens
ggattatccactgcaaagttttctt

SEQ ID NO: 20260 - DNA, 25 bp, Homo sapiens
ccaaaatcaggctttgtctgctccc

SEQ ID NO: 20261 - DNA, 25 bp, Homo sapiens
ttactctcacctcgtgatatccaca

SEQ ID NO: 20262 - DNA, 25 bp, Homo sapiens
gtgatatccacaaatgctattcaga

SEQ ID NO: 20263 - DNA, 25 bp, Homo sapiens
cagaactaggagtcttcactgctct

SEQ ID NO: 20264 - DNA, 25 bp, Homo sapiens
gtcaccttcctagttcttatgagct

SEQ ID NO: 20265 - DNA, 25 bp, Homo sapiens
agttcttatgagctagcatggcccg

SEQ ID NO: 20266 - DNA, 25 bp, Homo sapiens
cccgggccttatccagtcaaagcgg

SEQ ID NO: 20267 - DNA, 25 bp, Homo sapiens
gaagtcagtccatcagatttgctct

SEQ ID NO: 20268 - DNA, 25 bp, Homo sapiens
gctctgggccagtggtactgagtct

SEQ ID NO: 20269 - DNA, 25 bp, Homo sapiens
aacagtctggatgctggtgccacta

SEQ ID NO: 20270 - DNA, 25 bp, Homo sapiens
taatgatgtcaccatttctacctgc

SEQ ID NO: 20271 - DNA, 25 bp, Homo sapiens
gccacgtctcggcgaaggttgggac

SEQ ID NO: 20272 - DNA, 25 bp, Homo sapiens
gttgggactcgactggtgtttgatc

SEQ ID NO: 20273 - DNA, 25 bp, Homo sapiens
gagggaccacagtcagcgtgaagca

SEQ ID NO: 20274 - DNA, 25 bp, Homo sapiens
ctacgctacctgtgcgccataagga

SEQ ID NO: 20275 - DNA, 25 bp, Homo sapiens
agaagaaacatgctgcttccccttc

SEQ ID NO: 20276 - DNA, 25 bp, Homo sapiens
ctggaccctatcgtacagaacctgc

SEQ ID NO: 20277 - DNA, 25 bp, Homo sapiens
gaacctgctaaggccatcaaaccta

SEQ ID NO: 20278 - DNA, 25 bp, Homo sapiens
attaaatttctgcagcatcccttta

SEQ ID NO: 20279 - DNA, 25 bp, Homo sapiens
ttaaatttctgcagcatccctttag

SEQ ID NO: 20280 - DNA, 25 bp, Homo sapiens
cagcatccctttagctttcaatctc

SEQ ID NO: 20281 - DNA, 25 bp, Homo sapiens
cctgaacccggaaaaagcactcgct

SEQ ID NO: 20282 - DNA, 25 bp, Homo sapiens
tgaacccggaaaaagcactcgctgc

SEQ ID NO: 20283 - DNA, 25 bp, Homo sapiens
gaacccggaaaaagcactcgctgcg

SEQ ID NO: 20284 - DNA, 25 bp, Homo sapiens
ggaaaaagcactcgctgcgcgatac

SEQ ID NO: 20285 - DNA, 25 bp, Homo sapiens
aaaaagcactcgctgcgcgatacac

SEQ ID NO: 20286 - DNA, 25 bp, Homo sapiens
gaagaacctcacagccgagggtgcc

SEQ ID NO: 20287 - DNA, 25 bp, Homo sapiens
tcactgctggatccggactttttaa

SEQ ID NO: 20288 - DNA, 25 bp, Homo sapiens
cactgctggatccggactttttaaa

SEQ ID NO: 20289 - DNA, 25 bp, Homo sapiens
aacgggctcatcataatgcactgga

SEQ ID NO: 20290 - DNA, 25 bp, Homo sapiens
aagacagctttcacagtttgcggga

SEQ ID NO: 20291 - DNA, 25 bp, Homo sapiens
tcagtcccatcactccaaggagaga

SEQ ID NO: 20292 - DNA, 25 bp, Homo sapiens
cgctccctgggccgtaggaaatgag

SEQ ID NO: 20293 - DNA, 25 bp, Homo sapiens
aaaaccacacacaccagcaagatat

SEQ ID NO: 20294 - DNA, 25 bp, Homo sapiens
gacgacctcaagcggcagaatgctc

SEQ ID NO: 20295 - DNA, 25 bp, Homo sapiens
ttctggagcagcaagtccgtgcact

SEQ ID NO: 20296 - DNA, 25 bp, Homo sapiens
aaggcgaggtcaagtgcccaactgc

SEQ ID NO: 20297 - DNA, 25 bp, Homo sapiens
tctacaccaacgccaagggcagcac

SEQ ID NO: 20298 - DNA, 25 bp, Homo sapiens
ctgagcctgaagagccccaaagcag

SEQ ID NO: 20299 - DNA, 25 bp, Homo sapiens
caatctgcggctgacaaacgggctc

SEQ ID NO: 20300 - DNA, 25 bp, Homo sapiens
gtttgaggatcttgttccctcacca

SEQ ID NO: 20301 - DNA, 25 bp, Homo sapiens
ttccctcaccaacctctgaaaaggc

SEQ ID NO: 20302 - DNA, 25 bp, Homo sapiens
tttctagcgcaaatccatgcccgaa

SEQ ID NO: 20303 - DNA, 25 bp, Homo sapiens
gtggagctaccacaagtaccatgcg

SEQ ID NO: 20304 - DNA, 25 bp, Homo sapiens
agatccctatgtgcagcctgaagat

SEQ ID NO: 20305 - DNA, 25 bp, Homo sapiens
tgaaaatgactctgtccggcagctg

SEQ ID NO: 20306 - DNA, 25 bp, Homo sapiens
cacactcctctcaagcaagctatag

SEQ ID NO: 20307 - DNA, 25 bp, Homo sapiens
gatgatggagagccctgtggccaca

SEQ ID NO: 20308 - DNA, 25 bp, Homo sapiens
aggaagacagcagcctggcagcagc

SEQ ID NO: 20309 - DNA, 25 bp, Homo sapiens
ccccacccctaaagatgtgtcctga

SEQ ID NO: 20310 - DNA, 25 bp, Homo sapiens
gtgcagctaactttttgttctcaga

SEQ ID NO: 20311 - DNA, 25 bp, Homo sapiens
gtcattgaatctcttatgccagttt

SEQ ID NO: 20312 - DNA, 25 bp, Homo sapiens
ccattaagggtccaagaagtctgtc

SEQ ID NO: 20313 - DNA, 25 bp, Homo sapiens
gtttatttcccaggtatcagtcatt

SEQ ID NO: 20314 - DNA, 25 bp, Homo sapiens
gagtattaatagcccatttacacat

SEQ ID NO: 20315 - DNA, 25 bp, Homo sapiens
aatgtaatgggattgcagagctgca

SEQ ID NO: 20316 - DNA, 25 bp, Homo sapiens
tacagtgtaacagtactctcatgca

SEQ ID NO: 20317 - DNA, 25 bp, Homo sapiens
cagtactctcatgcaatttttttca

SEQ ID NO: 20318 - DNA, 25 bp, Homo sapiens
ggcaattattctttgtaagcgggac

SEQ ID NO: 20319 - DNA, 25 bp, Homo sapiens
atgtatatttcaaagtaccacactg

SEQ ID NO: 20320 - DNA, 25 bp, Homo sapiens
accacaactgtgatatatcctaact

SEQ ID NO: 20321 - DNA, 25 bp, Homo sapiens
ataaccagttgttgaggggtatact

SEQ ID NO: 20322 - DNA, 25 bp, Homo sapiens
atgtgtctccattcctggaaggtct

SEQ ID NO: 20323 - DNA, 25 bp, Homo sapiens
gagaaaggcacagcctgctcaacct

SEQ ID NO: 20324 - DNA, 25 bp, Homo sapiens
tacaggcaccacatactgatgacaa

SEQ ID NO: 20325 - DNA, 25 bp, Homo sapiens
ggaagcaagacccagataccaacac

SEQ ID NO: 20326 - DNA, 25 bp, Homo sapiens
catatggtgttggtctccttattgc

SEQ ID NO: 20327 - DNA, 25 bp, Homo sapiens
tgatatgggccctcacattttccaa

SEQ ID NO: 20328 - DNA, 25 bp, Homo sapiens
aacctgtccatctgctaactatttt

SEQ ID NO: 20329 - DNA, 25 bp, Homo sapiens
tgcagagccatgtccattggagccc

SEQ ID NO: 20330 - DNA, 25 bp, Homo sapiens
ttcccaatcagctcgtacttacttg

SEQ ID NO: 20331 - DNA, 25 bp, Homo sapiens
taaacatggtctgcgtgccttaaga

SEQ ID NO: 20332 - DNA, 25 bp, Homo sapiens
taagagagacgcttcctgcagaaca

SEQ ID NO: 20333 - DNA, 25 bp, Homo sapiens
agaattaccagcaggcacagtctcg

SEQ ID NO: 20334 - DNA, 25 bp, Homo sapiens
atctgcatccatcttgtttgggctc

SEQ ID NO: 20335 - DNA, 25 bp, Homo sapiens
gagaagtgcctcagataataccctg

SEQ ID NO: 20336 - DNA, 25 bp, Homo sapiens
taataccctggtggccatggacttc

SEQ ID NO: 20337 - DNA, 25 bp, Homo sapiens
tggccatggacttctctggccatgc

SEQ ID NO: 20338 - DNA, 25 bp, Homo sapiens
gccatgctgggcgtgtcattgagaa

SEQ ID NO: 20339 - DNA, 25 bp, Homo sapiens
aggaagaagacaaaccaccgcctca

SEQ ID NO: 20340 - DNA, 25 bp, Homo sapiens
ctgttcctggtccgggagagtcagc

SEQ ID NO: 20341 - DNA, 25 bp, Homo sapiens
agtgaagcattatctcatcctgccg

SEQ ID NO: 20342 - DNA, 25 bp, Homo sapiens
atctcatcctgccgagcgaggagga

SEQ ID NO: 20343 - DNA, 25 bp, Homo sapiens
gtcgcctgtacttcagcatggatga

SEQ ID NO: 20344 - DNA, 25 bp, Homo sapiens
aaaacagtatggcacctcatcctgc

SEQ ID NO: 20345 - DNA, 25 bp, Homo sapiens
tcatcctgctcgagactacgttgtt

SEQ ID NO: 20346 - DNA, 25 bp, Homo sapiens
ctaacctctgtggatcacgatcgcg

SEQ ID NO: 20347 - DNA, 25 bp, Homo sapiens
gttaatgtgctcttgtccaggtatt

SEQ ID NO: 20348 - DNA, 25 bp, Homo sapiens
gggccaggaaaatccaaactcacct

SEQ ID NO: 20349 - DNA, 25 bp, Homo sapiens
agatccgggattccttcagtaacca

SEQ ID NO: 20350 - DNA, 25 bp, Homo sapiens
gtgatcactgaagcaacgcaaccgc

SEQ ID NO: 20351 - DNA, 25 bp, Homo sapiens
accaccatggtgtttgtttctagaa

SEQ ID NO: 20352 - DNA, 25 bp, Homo sapiens
agaacttttgccagtccttgaagaa

SEQ ID NO: 20353 - DNA, 25 bp, Homo sapiens
gaatgggttctgtgtctaatcctga

SEQ ID NO: 20354 - DNA, 25 bp, Homo sapiens
gcttcctgtttgttgagggtctgta

SEQ ID NO: 20355 - DNA, 25 bp, Homo sapiens
gactaaatgctacctgggtttccag

SEQ ID NO: 20356 - DNA, 25 bp, Homo sapiens
ggtatttcgaaactgccaagggtgc

SEQ ID NO: 20357 - DNA, 25 bp, Homo sapiens
ttaccaatgacaaccctgagtgccg

SEQ ID NO: 20358 - DNA, 25 bp, Homo sapiens
ccctgagtgccgccttgtgaaagaa

SEQ ID NO: 20359 - DNA, 25 bp, Homo sapiens
ttgtgaggtgcggccttgtggacag

SEQ ID NO: 20360 - DNA, 25 bp, Homo sapiens
ttgtggacagccagtgtacagcagc

SEQ ID NO: 20361 - DNA, 25 bp, Homo sapiens
cagtcaggtttacttacgctggatg

SEQ ID NO: 20362 - DNA, 25 bp, Homo sapiens
gaaataccggcccaagtactgcggt

SEQ ID NO: 20363 - DNA, 25 bp, Homo sapiens
gatgcggttccgctgcgaagatggg

SEQ ID NO: 20364 - DNA, 25 bp, Homo sapiens
caaatgcaactacaactgcccgcat

SEQ ID NO: 20365 - DNA, 25 bp, Homo sapiens
gccaatgaagcagcgtttcccttct

SEQ ID NO: 20366 - DNA, 25 bp, Homo sapiens
cccagtctgggcgcttctgggaggg

SEQ ID NO: 20367 - DNA, 25 bp, Homo sapiens
tccttgttagtgtctttccttgaag

SEQ ID NO: 20368 - DNA, 25 bp, Homo sapiens
tttccttgaaggggcgggcaccagg

SEQ ID NO: 20369 - DNA, 25 bp, Homo sapiens
gggcaccaggctaggtccggtgcca

SEQ ID NO: 20370 - DNA, 25 bp, Homo sapiens
tgcaggaggcgcagggtcgcgccga

SEQ ID NO: 20371 - DNA, 25 bp, Homo sapiens
ccgcttggagggctgcctgaagggg

SEQ ID NO: 20372 - DNA, 25 bp, Homo sapiens
ttggagggctgcctgaaggggctgc

SEQ ID NO: 20373 - DNA, 25 bp, Homo sapiens
gtggcacgctcgagaactgcgtggc

SEQ ID NO: 20374 - DNA, 25 bp, Homo sapiens
tcgagaactgcgtggcgcaggcctc

SEQ ID NO: 20375 - DNA, 25 bp, Homo sapiens
ccttcctggccacgaatggcagcgt

SEQ ID NO: 20376 - DNA, 25 bp, Homo sapiens
ttcctggccacgaatggcagcgtcc

SEQ ID NO: 20377 - DNA, 25 bp, Homo sapiens
ttcagaaccacgtcagatataccaa

SEQ ID NO: 20378 - DNA, 25 bp, Homo sapiens
gcagaaaactccggcggtctgaggc

SEQ ID NO: 20379 - DNA, 25 bp, Homo sapiens
gccatggaggtggttgctgcatttg

SEQ ID NO: 20380 - DNA, 25 bp, Homo sapiens
gagtagggggctagatgtggctcct

SEQ ID NO: 20381 - DNA, 25 bp, Homo sapiens
atgtggctcctagtgcaaaccggaa

SEQ ID NO: 20382 - DNA, 25 bp, Homo sapiens
tgcaaaccggaaaccatggcacctt

SEQ ID NO: 20383 - DNA, 25 bp, Homo sapiens
tccagagccgtggtctcaaggagtc

SEQ ID NO: 20384 - DNA, 25 bp, Homo sapiens
acgtgtttcttcatgacagctgctc

SEQ ID NO: 20385 - DNA, 25 bp, Homo sapiens
tgagatagctgaccgagctctggta

SEQ ID NO: 20386 - DNA, 25 bp, Homo sapiens
agctctggtaaatctctttgtcaaa

SEQ ID NO: 20387 - DNA, 25 bp, Homo sapiens
gaaatcctatgcttccatgtacatt

SEQ ID NO: 20388 - DNA, 25 bp, Homo sapiens
ccacgggacaggctggacccagaga

SEQ ID NO: 20389 - DNA, 25 bp, Homo sapiens
acgggacaggctggacccagagact

SEQ ID NO: 20390 - DNA, 25 bp, Homo sapiens
ggacaggctggacccagagactctg

SEQ ID NO: 20391 - DNA, 25 bp, Homo sapiens
gacaggctggacccagagactctgg

SEQ ID NO: 20392 - DNA, 25 bp, Homo sapiens
ctgacctggggtcagacccgtgggc

SEQ ID NO: 20393 - DNA, 25 bp, Homo sapiens
tgacctggggtcagacccgtgggct

SEQ ID NO: 20394 - DNA, 25 bp, Homo sapiens
catgtgggaagtgggctccttcacc

SEQ ID NO: 20395 - DNA, 25 bp, Homo sapiens
gctgttgtgaggggcgctgtgatgc

SEQ ID NO: 20396 - DNA, 25 bp, Homo sapiens
tgttgtgaggggcgctgtgatgcgg

SEQ ID NO: 20397 - DNA, 25 bp, Homo sapiens
gtgatgcggttccaaagcacagggc

SEQ ID NO: 20398 - DNA, 25 bp, Homo sapiens
tgatgcggttccaaagcacagggct

SEQ ID NO: 20399 - DNA, 25 bp, Homo sapiens
agttatactgcagactctcaattaa

SEQ ID NO: 20400 - DNA, 25 bp, Homo sapiens
gactctcaattaatacacagctgtt

SEQ ID NO: 20401 - DNA, 25 bp, Homo sapiens
acacagctgttggcacgtgtggacc

SEQ ID NO: 20402 - DNA, 25 bp, Homo sapiens
ggcacgtgtggaccatctaatgaaa

SEQ ID NO: 20403 - DNA, 25 bp, Homo sapiens
cttcagaccaccgcccaaggtggaa

SEQ ID NO: 20404 - DNA, 25 bp, Homo sapiens
accgcccaaggtggaatccagtgtt

SEQ ID NO: 20405 - DNA, 25 bp, Homo sapiens
atagaacctaagaatccaccaccac

SEQ ID NO: 20406 - DNA, 25 bp, Homo sapiens
accaccacccatcaattttcaggaa

SEQ ID NO: 20407 - DNA, 25 bp, Homo sapiens
gaaaaacaagacactctctgctgca

SEQ ID NO: 20408 - DNA, 25 bp, Homo sapiens
aagtgcagtgcaacaactcttggaa

SEQ ID NO: 20409 - DNA, 25 bp, Homo sapiens
actacagaattcactgttcagtcca

SEQ ID NO: 20410 - DNA, 25 bp, Homo sapiens
tgatggttatgttcagggtccggcc

SEQ ID NO: 20411 - DNA, 25 bp, Homo sapiens
tctgatgcccttgtggaacgtgctg

SEQ ID NO: 20412 - DNA, 25 bp, Homo sapiens
gaccgccttgctcgggaaggaaggt

SEQ ID NO: 20413 - DNA, 25 bp, Homo sapiens
tggcctgcaccgtggcggtggaaga

SEQ ID NO: 20414 - DNA, 25 bp, Homo sapiens
aatacgaggaacttcttcagctgat

SEQ ID NO: 20415 - DNA, 25 bp, Homo sapiens
gagcttgagcaccatgacataggcc

SEQ ID NO: 20416 - DNA, 25 bp, Homo sapiens
tgacataggcctcgaccatgatgca

SEQ ID NO: 20417 - DNA, 25 bp, Homo sapiens
catgatgcagaattggctccagcct

SEQ ID NO: 20418 - DNA, 25 bp, Homo sapiens
cagcctatgccgtcctgaagagcat

SEQ ID NO: 20419 - DNA, 25 bp, Homo sapiens
gagcattatccaggccggatgcaga

SEQ ID NO: 20420 - DNA, 25 bp, Homo sapiens
aaagtgtgtccagttttgcctgtct

SEQ ID NO: 20421 - DNA, 25 bp, Homo sapiens
ggcatcagtatgtcactctggtccc

SEQ ID NO: 20422 - DNA, 25 bp, Homo sapiens
atgtcactctggtccctttaaagag

SEQ ID NO: 20423 - DNA, 25 bp, Homo sapiens
gtcactctggtccctttaaagagca

SEQ ID NO: 20424 - DNA, 25 bp, Homo sapiens
ctggtccctttaaagagcaatcctg

SEQ ID NO: 20425 - DNA, 25 bp, Homo sapiens
gtccctttaaagagcaatcctggaa

SEQ ID NO: 20426 - DNA, 25 bp, Homo sapiens
tgctgttgttgggacatggcaatct

SEQ ID NO: 20427 - DNA, 25 bp, Homo sapiens
gttgggacatggcaatctagaccgg

SEQ ID NO: 20428 - DNA, 25 bp, Homo sapiens
ctgacagcttgggaggaaacctgag

SEQ ID NO: 20429 - DNA, 25 bp, Homo sapiens
ggaaacctgagatctgtgtttttta

SEQ ID NO: 20430 - DNA, 25 bp, Homo sapiens
gttttttaaattgatcgttcttcat

SEQ ID NO: 20431 - DNA, 25 bp, Homo sapiens
taaattgatcgttcttcatgggggt

SEQ ID NO: 20432 - DNA, 25 bp, Homo sapiens
atttccaagaattctcccaataata

SEQ ID NO: 20433 - DNA, 25 bp, Homo sapiens
gagcctgagtaatcaaccgggcact

SEQ ID NO: 20434 - DNA, 25 bp, Homo sapiens
accgggcactccaagggatgatggc

SEQ ID NO: 20435 - DNA, 25 bp, Homo sapiens
cagagtgagagttactcccctagca

SEQ ID NO: 20436 - DNA, 25 bp, Homo sapiens
actcccctagcatgacaatgagcgt

SEQ ID NO: 20437 - DNA, 25 bp, Homo sapiens
gagcgtgtgatccattaccaagtct

SEQ ID NO: 20438 - DNA, 25 bp, Homo sapiens
aagtctcctcatgaaaaccacagtg

SEQ ID NO: 20439 - DNA, 25 bp, Homo sapiens
gtgagtcagcccttcacagaactac

SEQ ID NO: 20440 - DNA, 25 bp, Homo sapiens
gggtcagatggtcccatgggtggat

SEQ ID NO: 20441 - DNA, 25 bp, Homo sapiens
ggaggaatggagtcacatcacatga

SEQ ID NO: 20442 - DNA, 25 bp, Homo sapiens
atcacatgaatggctctttaggctc

SEQ ID NO: 20443 - DNA, 25 bp, Homo sapiens
atgccaacaatgggtctgttctcca

SEQ ID NO: 20444 - DNA, 25 bp, Homo sapiens
gagcttcttccaagtgtgaatgaca

SEQ ID NO: 20445 - DNA, 25 bp, Homo sapiens
gaatgacatcacagctgttggaccg

SEQ ID NO: 20446 - DNA, 25 bp, Homo sapiens
ctgttggaccggcacatttctatgc

SEQ ID NO: 20447 - DNA, 25 bp, Homo sapiens
acaaatgaccactacttctctgatc

SEQ ID NO: 20448 - DNA, 25 bp, Homo sapiens
ggcaaatgttgtttactacagtcca

SEQ ID NO: 20449 - DNA, 25 bp, Homo sapiens
atgttgctgacatattggctcatga

SEQ ID NO: 20450 - DNA, 25 bp, Homo sapiens
tacttgagctggatacactggtgga

SEQ ID NO: 20451 - DNA, 25 bp, Homo sapiens
aatttatctattgatccttcctcgg

SEQ ID NO: 20452 - DNA, 25 bp, Homo sapiens
gtcatcctaatggccagaagctctt

SEQ ID NO: 20453 - DNA, 25 bp, Homo sapiens
gaagctcttcgtgtatgacccgaac

SEQ ID NO: 20454 - DNA, 25 bp, Homo sapiens
gggagagtcccattgctaaaattca

SEQ ID NO: 20455 - DNA, 25 bp, Homo sapiens
attcagctactcagataaattcaga

SEQ ID NO: 20456 - DNA, 25 bp, Homo sapiens
tgcctgtttttgttggtgcacagag

SEQ ID NO: 20457 - DNA, 25 bp, Homo sapiens
ggtgcacagagattgacttgattca

SEQ ID NO: 20458 - DNA, 25 bp, Homo sapiens
agagagacaattcactccatcccta

SEQ ID NO: 20459 - DNA, 25 bp, Homo sapiens
ttcactccatccctatggcagagga

SEQ ID NO: 20460 - DNA, 25 bp, Homo sapiens
gaggaatgggttagccctaatgtag

SEQ ID NO: 20461 - DNA, 25 bp, Homo sapiens
gctttatctgtatatctgaactctt

SEQ ID NO: 20462 - DNA, 25 bp, Homo sapiens
aaaccagccaacctatgttacacgt

SEQ ID NO: 20463 - DNA, 25 bp, Homo sapiens
tgtgcctttattttatgagccccag

SEQ ID NO: 20464 - DNA, 25 bp, Homo sapiens
gagccccagttttctgggcttagtt

SEQ ID NO: 20465 - DNA, 25 bp, Homo sapiens
gacattgcctgtatgatcgggtacc

SEQ ID NO: 20466 - DNA, 25 bp, Homo sapiens
cgaccttgcccctggatgaaatggt

SEQ ID NO: 20467 - DNA, 25 bp, Homo sapiens
tgaaatggtgctggtccttcttcac

SEQ ID NO: 20468 - DNA, 25 bp, Homo sapiens
gcatcttcatcttcaacgttgtgta

SEQ ID NO: 20469 - DNA, 25 bp, Homo sapiens
aacgttgtgtactacgagccgctgg

SEQ ID NO: 20470 - DNA, 25 bp, Homo sapiens
acaacacctacgtgtacccgtggtg

SEQ ID NO: 20471 - DNA, 25 bp, Homo sapiens
ctgcctcctcagggcaaagggcacc

SEQ ID NO: 20472 - DNA, 25 bp, Homo sapiens
gcctccaccacttggagtaccgagc

SEQ ID NO: 20473 - DNA, 25 bp, Homo sapiens
gtaccgagctcaggacgcagatgtc

SEQ ID NO: 20474 - DNA, 25 bp, Homo sapiens
agagcagcaaggtcgtcgtggtgga

SEQ ID NO: 20475 - DNA, 25 bp, Homo sapiens
tttccctgacacttttggggtctgc

SEQ ID NO: 20476 - DNA, 25 bp, Homo sapiens
caggtgcaccactgaagtgaggaca

SEQ ID NO: 20477 - DNA, 25 bp, Homo sapiens
gcaccactgaagtgaggacacaccg

SEQ ID NO: 20478 - DNA, 25 bp, Homo sapiens
cctgctcatgttgaagtgcgctgtt

SEQ ID NO: 20479 - DNA, 25 bp, Homo sapiens
gctcatgttgaagtgcgctgttcac

SEQ ID NO: 20480 - DNA, 25 bp, Homo sapiens
catgttgaagtgcgctgttcacacc

SEQ ID NO: 20481 - DNA, 25 bp, Homo sapiens
cctcttcaaagtctcctgtgacatt

SEQ ID NO: 20482 - DNA, 25 bp, Homo sapiens
caaagtctcctgtgacattttttct

SEQ ID NO: 20483 - DNA, 25 bp, Homo sapiens
aaagatacgtgccggggccaggtgt

SEQ ID NO: 20484 - DNA, 25 bp, Homo sapiens
gctaggcgtagtggttggcacctat

SEQ ID NO: 20485 - DNA, 25 bp, Homo sapiens
ggcgtagtggttggcacctatagtc

SEQ ID NO: 20486 - DNA, 25 bp, Homo sapiens
cgtagtggttggcacctatagtccc

SEQ ID NO: 20487 - DNA, 25 bp, Homo sapiens
gtacctgctgtatgtcaaggcttac

SEQ ID NO: 20488 - DNA, 25 bp, Homo sapiens
tcaaggcttactactgctttccaat

SEQ ID NO: 20489 - DNA, 25 bp, Homo sapiens
gataagcacgctgcctgctattagg

SEQ ID NO: 20490 - DNA, 25 bp, Homo sapiens
gctacggacacattcagtctgttca

SEQ ID NO: 20491 - DNA, 25 bp, Homo sapiens
catggactgatgggtctgctccagg

SEQ ID NO: 20492 - DNA, 25 bp, Homo sapiens
tgctccaggccacatttgtttttta

SEQ ID NO: 20493 - DNA, 25 bp, Homo sapiens
gtaacgtggctaggcttccatttat

SEQ ID NO: 20494 - DNA, 25 bp, Homo sapiens
gtcttagcattatttcctttgtgaa

SEQ ID NO: 20495 - DNA, 25 bp, Homo sapiens
gcagtgtaggattttctctcctcaa

SEQ ID NO: 20496 - DNA, 25 bp, Homo sapiens
gcattcccaaagacttggtccatgc

SEQ ID NO: 20497 - DNA, 25 bp, Homo sapiens
aaattgctcactctaatcctttttc

SEQ ID NO: 20498 - DNA, 25 bp, Homo sapiens
aaaccatctggatcacctaacagtc

SEQ ID NO: 20499 - DNA, 25 bp, Homo sapiens
gatcgggttgaggattggggctagc

SEQ ID NO: 20500 - DNA, 25 bp, Homo sapiens
tgctgtggcgcggattcttaggaac

SEQ ID NO: 20501 - DNA, 25 bp, Homo sapiens
tcttaggaacgctgttctagccggc

SEQ ID NO: 20502 - DNA, 25 bp, Homo sapiens
cggcattatttcctagttcttcttg

SEQ ID NO: 20503 - DNA, 25 bp, Homo sapiens
ggaggggtcagggggctaaggatgc

SEQ ID NO: 20504 - DNA, 25 bp, Homo sapiens
gttgagatttcacaagcaatgcgag

SEQ ID NO: 20505 - DNA, 25 bp, Homo sapiens
taggctctgtgacggcatagttttc

SEQ ID NO: 20506 - DNA, 25 bp, Homo sapiens
gacggcatagttttcagtagcttta

SEQ ID NO: 20507 - DNA, 25 bp, Homo sapiens
gtagctttatcacaatattcacaat

SEQ ID NO: 20508 - DNA, 25 bp, Homo sapiens
gacatggtagcagaaataggccctt

SEQ ID NO: 20509 - DNA, 25 bp, Homo sapiens
gaatggccctactattatcatgcaa

SEQ ID NO: 20510 - DNA, 25 bp, Homo sapiens
ttgttggcacctcagattaatcata

SEQ ID NO: 20511 - DNA, 25 bp, Homo sapiens
attattctgcctttggctaattgag

SEQ ID NO: 20512 - DNA, 25 bp, Homo sapiens
tggctaattgagtaattcccctcca

SEQ ID NO: 20513 - DNA, 25 bp, Homo sapiens
cactagagaccgctcagtgctctta

SEQ ID NO: 20514 - DNA, 25 bp, Homo sapiens
cgctcagtgctcttactagatgaac

SEQ ID NO: 20515 - DNA, 25 bp, Homo sapiens
ctagatgaactcagtaacgccttga

SEQ ID NO: 20516 - DNA, 25 bp, Homo sapiens
gtaacgccttgagctgggttgattg

SEQ ID NO: 20517 - DNA, 25 bp, Homo sapiens
aaggtagctaccacatcattttgaa

SEQ ID NO: 20518 - DNA, 25 bp, Homo sapiens
aaaggaccatgagcaactataagca

SEQ ID NO: 20519 - DNA, 25 bp, Homo sapiens
ggggtagctcttgattttgttaaca

SEQ ID NO: 20520 - DNA, 25 bp, Homo sapiens
gccaaccgactaattcatcaaacca

SEQ ID NO: 20521 - DNA, 25 bp, Homo sapiens
accaacttaatacttcagaccttca

SEQ ID NO: 20522 - DNA, 25 bp, Homo sapiens
cagaccttcaaaactgtggcctgaa

SEQ ID NO: 20523 - DNA, 25 bp, Homo sapiens
agtattgaactgcctttatctgtaa

SEQ ID NO: 20524 - DNA, 25 bp, Homo sapiens
tatcagtccctcctgaagggatcta

SEQ ID NO: 20525 - DNA, 25 bp, Homo sapiens
ggattattgccatcttacaccatat

SEQ ID NO: 20526 - DNA, 25 bp, Homo sapiens
gcatcacttttgctattatcattct

SEQ ID NO: 20527 - DNA, 25 bp, Homo sapiens
gaatttacgccttaatgtgtcatta

SEQ ID NO: 20528 - DNA, 25 bp, Homo sapiens
ggtgtttgtttctgacattttaact

SEQ ID NO: 20529 - DNA, 25 bp, Homo sapiens
aataccagaaccgcagggcacttga

SEQ ID NO: 20530 - DNA, 25 bp, Homo sapiens
atgtgttcgtaagtgccaaccgact

SEQ ID NO: 20531 - DNA, 25 bp, Homo sapiens
ccgctttgcaggtgtattccacgtg

SEQ ID NO: 20532 - DNA, 25 bp, Homo sapiens
aaaatggtcgctacagcatctctcg

SEQ ID NO: 20533 - DNA, 25 bp, Homo sapiens
gctgacctctgcaaggctttcaata

SEQ ID NO: 20534 - DNA, 25 bp, Homo sapiens
tttcaatagcaccttgcccacaatg

SEQ ID NO: 20535 - DNA, 25 bp, Homo sapiens
cttgcccacaatggcccagatggag

SEQ ID NO: 20536 - DNA, 25 bp, Homo sapiens
agctctgagcatcggatttgagacc

SEQ ID NO: 20537 - DNA, 25 bp, Homo sapiens
gtggactcaacggagaggccagcaa

SEQ ID NO: 20538 - DNA, 25 bp, Homo sapiens
caagttttggtggcacgcagcctgg

SEQ ID NO: 20539 - DNA, 25 bp, Homo sapiens
gagtcgtcagaaactccagaccagt

SEQ ID NO: 20540 - DNA, 25 bp, Homo sapiens
tgagcctggcgcagatcgatttgaa

SEQ ID NO: 20541 - DNA, 25 bp, Homo sapiens
atttgaatataacctgccgctttgc

SEQ ID NO: 20542 - DNA, 25 bp, Homo sapiens
aagtactccgtgtgggtcggtggct

SEQ ID NO: 20543 - DNA, 25 bp, Homo sapiens
ggagtatgatgagtcaggcccctcc

SEQ ID NO: 20544 - DNA, 25 bp, Homo sapiens
aggtggactctgacttagttgcgtt

SEQ ID NO: 20545 - DNA, 25 bp, Homo sapiens
agaaaacaacatgagattggcgtgg

SEQ ID NO: 20546 - DNA, 25 bp, Homo sapiens
tcaggatttgaaaaccggaacggcg

SEQ ID NO: 20547 - DNA, 25 bp, Homo sapiens
cggaacggcgaaggtgatagtagtc

SEQ ID NO: 20548 - DNA, 25 bp, Homo sapiens
aaggtgatagtagtcggttggagcg

SEQ ID NO: 20549 - DNA, 25 bp, Homo sapiens
ccccaaagttctacaatgtggccaa

SEQ ID NO: 20550 - DNA, 25 bp, Homo sapiens
aagttctacaatgtggccaaggact

SEQ ID NO: 20551 - DNA, 25 bp, Homo sapiens
tcaactccatagtgaagtctgatgt

SEQ ID NO: 20552 - DNA, 25 bp, Homo sapiens
ccctggcgcctagcattatgaagat

SEQ ID NO: 20553 - DNA, 25 bp, Homo sapiens
caagcgctgtgccgggaagttggat

SEQ ID NO: 20554 - DNA, 25 bp, Homo sapiens
atggcctggggctggcatttatctt

SEQ ID NO: 20555 - DNA, 25 bp, Homo sapiens
ttatctttcctttcagcaagcacct

SEQ ID NO: 20556 - DNA, 25 bp, Homo sapiens
gcacctcaaatttgccatgctggct

SEQ ID NO: 20557 - DNA, 25 bp, Homo sapiens
aagagtgctctccatgctctaattt

SEQ ID NO: 20558 - DNA, 25 bp, Homo sapiens
tacccctgagtgtggtcccacagga

SEQ ID NO: 20559 - DNA, 25 bp, Homo sapiens
ctgccgctcagctttgatggaacaa

SEQ ID NO: 20560 - DNA, 25 bp, Homo sapiens
ttgtcttgtcatcattcgtcagcga

SEQ ID NO: 20561 - DNA, 25 bp, Homo sapiens
tcgagtccatatagctacattccac

SEQ ID NO: 20562 - DNA, 25 bp, Homo sapiens
ccacccttgtatcctgggtcttaga

SEQ ID NO: 20563 - DNA, 25 bp, Homo sapiens
tgatttgcactcttggttctttgga

SEQ ID NO: 20564 - DNA, 25 bp, Homo sapiens
gaaggagcacctgttgaagtatgag

SEQ ID NO: 20565 - DNA, 25 bp, Homo sapiens
gaagtatgagtaccagcctttcgct

SEQ ID NO: 20566 - DNA, 25 bp, Homo sapiens
gagtaccagcctttcgctgggaaga

SEQ ID NO: 20567 - DNA, 25 bp, Homo sapiens
cagcctttcgctgggaagatcaaag

SEQ ID NO: 20568 - DNA, 25 bp, Homo sapiens
agatcaaagacattgcttggactga

SEQ ID NO: 20569 - DNA, 25 bp, Homo sapiens
gacattgcttggactgaagacagta

SEQ ID NO: 20570 - DNA, 25 bp, Homo sapiens
gagaagtttggagcagtcttcctct

SEQ ID NO: 20571 - DNA, 25 bp, Homo sapiens
tggctcttctgtgggcgagattaca

SEQ ID NO: 20572 - DNA, 25 bp, Homo sapiens
gggcgagattacaggacacaacaaa

SEQ ID NO: 20573 - DNA, 25 bp, Homo sapiens
cacgggaagcgatgataactgcgcg

SEQ ID NO: 20574 - DNA, 25 bp, Homo sapiens
tttgtcaactgtgtgcgattctctc

SEQ ID NO: 20575 - DNA, 25 bp, Homo sapiens
ggaacaagacttcaggtcacgctcg

SEQ ID NO: 20576 - DNA, 25 bp, Homo sapiens
tcaggtcacgctcgatatccagaac

SEQ ID NO: 20577 - DNA, 25 bp, Homo sapiens
tgacaagtctgtctgcctattcacc

SEQ ID NO: 20578 - DNA, 25 bp, Homo sapiens
gagcaacagtgctgtggcctggagc

SEQ ID NO: 20579 - DNA, 25 bp, Homo sapiens
gcatgtgcaaacgccttcaacaaca

SEQ ID NO: 20580 - DNA, 25 bp, Homo sapiens
tccccagcccagaaagttcctgtga

SEQ ID NO: 20581 - DNA, 25 bp, Homo sapiens
gttcctgtgatgtcaagctggtcga

SEQ ID NO: 20582 - DNA, 25 bp, Homo sapiens
cagtgattgggttccgaatcctcct

SEQ ID NO: 20583 - DNA, 25 bp, Homo sapiens
aagtggccgggtttaatctgctcat

SEQ ID NO: 20584 - DNA, 25 bp, Homo sapiens
gctgtggtccagctgagatctgcaa

SEQ ID NO: 20585 - DNA, 25 bp, Homo sapiens
gattgtaagacagcctgtgctccct

SEQ ID NO: 20586 - DNA, 25 bp, Homo sapiens
gacaggtaacagtgtctgctgactc

SEQ ID NO: 20587 - DNA, 25 bp, Homo sapiens
tgcctcgggacagactggtcttagg

SEQ ID NO: 20588 - DNA, 25 bp, Homo sapiens
gcctcgggacagactggtcttaggc

SEQ ID NO: 20589 - DNA, 25 bp, Homo sapiens
atgttgaagtcggacgcaacagaga

SEQ ID NO: 20590 - DNA, 25 bp, Homo sapiens
cacgcaggatggtcccttgtatgtc

SEQ ID NO: 20591 - DNA, 25 bp, Homo sapiens
gcaggatggtcccttgtatgtcatc

SEQ ID NO: 20592 - DNA, 25 bp, Homo sapiens
aggatggtcccttgtatgtcatcgt

SEQ ID NO: 20593 - DNA, 25 bp, Homo sapiens
atggtcccttgtatgtcatcgtgga

SEQ ID NO: 20594 - DNA, 25 bp, Homo sapiens
ggtcccttgtatgtcatcgtggagt

SEQ ID NO: 20595 - DNA, 25 bp, Homo sapiens
gtatgtcatcgtggagtatgcctcc

SEQ ID NO: 20596 - DNA, 25 bp, Homo sapiens
catcgtggagtatgcctccaagggc

SEQ ID NO: 20597 - DNA, 25 bp, Homo sapiens
gcgtaagagggctctggtcttccaa

SEQ ID NO: 20598 - DNA, 25 bp, Homo sapiens
tttgagcatcgaatccccaaggaac

SEQ ID NO: 20599 - DNA, 25 bp, Homo sapiens
aactgaggcccatcctcaaaatcct

SEQ ID NO: 20600 - DNA, 25 bp, Homo sapiens
tgacttggacacttcagaccatgcc

SEQ ID NO: 20601 - DNA, 25 bp, Homo sapiens
tgccgtctaaacctctctggagtga

SEQ ID NO: 20602 - DNA, 25 bp, Homo sapiens
agctcacaccctaataagtccacat

SEQ ID NO: 20603 - DNA, 25 bp, Homo sapiens
aagtccacatcttctcagtgtttta

SEQ ID NO: 20604 - DNA, 25 bp, Homo sapiens
tattctgtaccttgcagccatgacc

SEQ ID NO: 20605 - DNA, 25 bp, Homo sapiens
cccagctttatctgtcacacaaggc

SEQ ID NO: 20606 - DNA, 25 bp, Homo sapiens
gctactgctagatatcacttactca

SEQ ID NO: 20607 - DNA, 25 bp, Homo sapiens
aagagtcttggttcctctactactt

SEQ ID NO: 20608 - DNA, 25 bp, Homo sapiens
gaaggagacggtctggcggcttgaa

SEQ ID NO: 20609 - DNA, 25 bp, Homo sapiens
ggacgatttgccagctttgaggctc

SEQ ID NO: 20610 - DNA, 25 bp, Homo sapiens
gaggctcaaggtgcattggccaaca

SEQ ID NO: 20611 - DNA, 25 bp, Homo sapiens
atgacaaagcgctccaactatactc

SEQ ID NO: 20612 - DNA, 25 bp, Homo sapiens
gttcaccccaccagtggtcaatgtc

SEQ ID NO: 20613 - DNA, 25 bp, Homo sapiens
ggtcaatgtcacgtggcttcgaaat

SEQ ID NO: 20614 - DNA, 25 bp, Homo sapiens
agtgtcagagacagtcttcctgccc

SEQ ID NO: 20615 - DNA, 25 bp, Homo sapiens
gaggacgtttacgactgcagggtgg

SEQ ID NO: 20616 - DNA, 25 bp, Homo sapiens
agcctcttctcaagcactgggagtt

SEQ ID NO: 20617 - DNA, 25 bp, Homo sapiens
tgggagtttgatgctccaagccctc

SEQ ID NO: 20618 - DNA, 25 bp, Homo sapiens
ggtgggcatcattattgggaccatc

SEQ ID NO: 20619 - DNA, 25 bp, Homo sapiens
gcagaacatacagctacctgctgca

SEQ ID NO: 20620 - DNA, 25 bp, Homo sapiens
gagacaatgacctacggttggccca

SEQ ID NO: 20621 - DNA, 25 bp, Homo sapiens
ccctcccagtttgaacctctggaca

SEQ ID NO: 20622 - DNA, 25 bp, Homo sapiens
gaagctcatgaggcgttacatagcc

SEQ ID NO: 20623 - DNA, 25 bp, Homo sapiens
tacatagccatgtgccgcgagaagc

SEQ ID NO: 20624 - DNA, 25 bp, Homo sapiens
gcccatggtgccagagtctctggct

SEQ ID NO: 20625 - DNA, 25 bp, Homo sapiens
gtctctggctgactacatcacagca

SEQ ID NO: 20626 - DNA, 25 bp, Homo sapiens
acatcacagcagcatacgtggagat

SEQ ID NO: 20627 - DNA, 25 bp, Homo sapiens
gatgaggcgagaggcttgggctagt

SEQ ID NO: 20628 - DNA, 25 bp, Homo sapiens
agtaaggatgccacctatacttctg

SEQ ID NO: 20629 - DNA, 25 bp, Homo sapiens
ctgctctggcacgtctgagaatggt

SEQ ID NO: 20630 - DNA, 25 bp, Homo sapiens
accccaccacgtaccagatggatgt

SEQ ID NO: 20631 - DNA, 25 bp, Homo sapiens
aatacagctttggtgccacctgcgt

SEQ ID NO: 20632 - DNA, 25 bp, Homo sapiens
acctgcgtgaagaagtgtccccgta

SEQ ID NO: 20633 - DNA, 25 bp, Homo sapiens
gacggcgtccgcaagtgtaagaagt

SEQ ID NO: 20634 - DNA, 25 bp, Homo sapiens
agtgcgaagggccttgccgcaaagt

SEQ ID NO: 20635 - DNA, 25 bp, Homo sapiens
aagactcactctccataaatgctac

SEQ ID NO: 20636 - DNA, 25 bp, Homo sapiens
aacacttcaaaaactgcacctccat

SEQ ID NO: 20637 - DNA, 25 bp, Homo sapiens
ctccatcagtggcgatctccacatc

SEQ ID NO: 20638 - DNA, 25 bp, Homo sapiens
ccacatcctgccggtggcatttagg

SEQ ID NO: 20639 - DNA, 25 bp, Homo sapiens
ttaggggtgactccttcacacatac

SEQ ID NO: 20640 - DNA, 25 bp, Homo sapiens
gacatatttcctgttcccttggaat

SEQ ID NO: 20641 - DNA, 25 bp, Homo sapiens
attcctttctgattggcacacgtgc

SEQ ID NO: 20642 - DNA, 25 bp, Homo sapiens
cctttctgattggcacacgtgcagc

SEQ ID NO: 20643 - DNA, 25 bp, Homo sapiens
ttggcacacgtgcagctcatgacaa

SEQ ID NO: 20644 - DNA, 25 bp, Homo sapiens
gcagctcatgacaatctgtaggata

SEQ ID NO: 20645 - DNA, 25 bp, Homo sapiens
atctgtaggataacaatcagtgtgg

SEQ ID NO: 20646 - DNA, 25 bp, Homo sapiens
agtgtggatttccactcttttcagt

SEQ ID NO: 20647 - DNA, 25 bp, Homo sapiens
actcttttcagtccttcatgttaaa

SEQ ID NO: 20648 - DNA, 25 bp, Homo sapiens
ttcagtccttcatgttaaagattta

SEQ ID NO: 20649 - DNA, 25 bp, Homo sapiens
aagatttagacaccacatacaactg

SEQ ID NO: 20650 - DNA, 25 bp, Homo sapiens
gacaccacatacaactggtaaagga

SEQ ID NO: 20651 - DNA, 25 bp, Homo sapiens
tggtaaaggacgttttcttgagagt

SEQ ID NO: 20652 - DNA, 25 bp, Homo sapiens
catgtgaaaacctccttagctgcga

SEQ ID NO: 20653 - DNA, 25 bp, Homo sapiens
ctgcgaccacattctttcattttgt

SEQ ID NO: 20654 - DNA, 25 bp, Homo sapiens
cacctgcttaccccttaaatgcaat

SEQ ID NO: 20655 - DNA, 25 bp, Homo sapiens
tatttacttttaccactgtcacaga

SEQ ID NO: 20656 - DNA, 25 bp, Homo sapiens
gcaagcccatgtcagggcgatcctg

SEQ ID NO: 20657 - DNA, 25 bp, Homo sapiens
tcaaatgtgccatttcccgggttga

SEQ ID NO: 20658 - DNA, 25 bp, Homo sapiens
gttgatgctgccacactttgtagag

SEQ ID NO: 20659 - DNA, 25 bp, Homo sapiens
gcttagtcagcgtaggaatcctcac

SEQ ID NO: 20660 - DNA, 25 bp, Homo sapiens
ggtgtggattggtgctactttgaac

SEQ ID NO: 20661 - DNA, 25 bp, Homo sapiens
cccctgtggtcttttgttcaacatt

SEQ ID NO: 20662 - DNA, 25 bp, Homo sapiens
gtagaactctgtccaacactaattt

SEQ ID NO: 20663 - DNA, 25 bp, Homo sapiens
ttctttcacaccctgtcgggagaat

SEQ ID NO: 20664 - DNA, 25 bp, Homo sapiens
ctttcacaccctgtcgggagaatgt

SEQ ID NO: 20665 - DNA, 25 bp, Homo sapiens
tgtcgggagaatgtgtgccctgcga

SEQ ID NO: 20666 - DNA, 25 bp, Homo sapiens
tcgggagaatgtgtgccctgcgact

SEQ ID NO: 20667 - DNA, 25 bp, Homo sapiens
atgtgtgccctgcgactgtaatggc

SEQ ID NO: 20668 - DNA, 25 bp, Homo sapiens
gtgtgccctgcgactgtaatggcaa

SEQ ID NO: 20669 - DNA, 25 bp, Homo sapiens
tgccctgcgactgtaatggcaattc

SEQ ID NO: 20670 - DNA, 25 bp, Homo sapiens
taatggcaattccaacgagtgtttg

SEQ ID NO: 20671 - DNA, 25 bp, Homo sapiens
caacgagtgtttggacggctcagga

SEQ ID NO: 20672 - DNA, 25 bp, Homo sapiens
gtgtttggacggctcaggatactgt

SEQ ID NO: 20673 - DNA, 25 bp, Homo sapiens
tttggacggctcaggatactgtgtg

SEQ ID NO: 20674 - DNA, 25 bp, Homo sapiens
ggtgctggaaaaactactatcttgt

SEQ ID NO: 20675 - DNA, 25 bp, Homo sapiens
tgaattcatgcagcccattccaaca

SEQ ID NO: 20676 - DNA, 25 bp, Homo sapiens
attacctcaatactcaagctgttgt

SEQ ID NO: 20677 - DNA, 25 bp, Homo sapiens
gtgaagcacacagcgaacttgcaaa

SEQ ID NO: 20678 - DNA, 25 bp, Homo sapiens
aaagaactccgagatgctctgctcc

SEQ ID NO: 20679 - DNA, 25 bp, Homo sapiens
gctctgctcctgatttttgctaaca

SEQ ID NO: 20680 - DNA, 25 bp, Homo sapiens
ggatgttgctggagcactgtcagta

SEQ ID NO: 20681 - DNA, 25 bp, Homo sapiens
gaactactcagtctccataaattat

SEQ ID NO: 20682 - DNA, 25 bp, Homo sapiens
aaattatgctgtggccgtagctggt

SEQ ID NO: 20683 - DNA, 25 bp, Homo sapiens
ggccgtagctggtatattcagggct

SEQ ID NO: 20684 - DNA, 25 bp, Homo sapiens
tcagggctgtgatgctcgaagtgtt

SEQ ID NO: 20685 - DNA, 25 bp, Homo sapiens
gggtcgttacgttaggattggatgg

SEQ ID NO: 20686 - DNA, 25 bp, Homo sapiens
ggtgctggaaaaactactatcttgt

SEQ ID NO: 20687 - DNA, 25 bp, Homo sapiens
aggatgaattcatgcagcccattcc

SEQ ID NO: 20688 - DNA, 25 bp, Homo sapiens
atgcagcccattccaacaattggtt

SEQ ID NO: 20689 - DNA, 25 bp, Homo sapiens
attacctcaatactcaagctgttgt

SEQ ID NO: 20690 - DNA, 25 bp, Homo sapiens
gtgaagcacacagcgaacttgcaaa

SEQ ID NO: 20691 - DNA, 25 bp, Homo sapiens
aaagaactccgagatgctctgctcc

SEQ ID NO: 20692 - DNA, 25 bp, Homo sapiens
tctgctcctgatttttgctaacaaa

SEQ ID NO: 20693 - DNA, 25 bp, Homo sapiens
tgttgctggagcactgtcagtagaa

SEQ ID NO: 20694 - DNA, 25 bp, Homo sapiens
actactcagtctccataaattatgc

SEQ ID NO: 20695 - DNA, 25 bp, Homo sapiens
ataaattatgctgtggccgtagctg

SEQ ID NO: 20696 - DNA, 25 bp, Homo sapiens
cagttccagttcgtgccatcaagga

SEQ ID NO: 20697 - DNA, 25 bp, Homo sapiens
tctgtgcacaaatccatcaaccgtt

SEQ ID NO: 20698 - DNA, 25 bp, Homo sapiens
cgagcgggaggatatcacccacacc

SEQ ID NO: 20699 - DNA, 25 bp, Homo sapiens
atggccatgcggatccgtgtgggcc

SEQ ID NO: 20700 - DNA, 25 bp, Homo sapiens
ggcagtgactttgacgtctttgccc

SEQ ID NO: 20701 - DNA, 25 bp, Homo sapiens
aacaccgctgaggagtacgtctgcc

SEQ ID NO: 20702 - DNA, 25 bp, Homo sapiens
gcaccgtcagctacaatgggatctt

SEQ ID NO: 20703 - DNA, 25 bp, Homo sapiens
cttggggcccgagtgtggcaccaag

SEQ ID NO: 20704 - DNA, 25 bp, Homo sapiens
tggagcctttctctggtaaagccct

SEQ ID NO: 20705 - DNA, 25 bp, Homo sapiens
aaagccctgtgttcctggagcattt

SEQ ID NO: 20706 - DNA, 25 bp, Homo sapiens
gagcatttgttgaccgccaactgac

SEQ ID NO: 20707 - DNA, 25 bp, Homo sapiens
gccaatcctgaatctgcaacaactt

SEQ ID NO: 20708 - DNA, 25 bp, Homo sapiens
caaggtccttgctgcgaaagtgctc

SEQ ID NO: 20709 - DNA, 25 bp, Homo sapiens
tcaaccttgtgctgccaaacttgtc

SEQ ID NO: 20710 - DNA, 25 bp, Homo sapiens
tccagcgtgctctctcggaataaga

SEQ ID NO: 20711 - DNA, 25 bp, Homo sapiens
tcgacatttataactcagaccccct

SEQ ID NO: 20712 - DNA, 25 bp, Homo sapiens
tgcttcggcatccaactgctgaatg

SEQ ID NO: 20713 - DNA, 25 bp, Homo sapiens
tctgccgatcgcctatgtgacagca

SEQ ID NO: 20714 - DNA, 25 bp, Homo sapiens
tatgaaggtgcctaccatgttctcc

SEQ ID NO: 20715 - DNA, 25 bp, Homo sapiens
tgggtctctcaaaggacagccacgg

SEQ ID NO: 20716 - DNA, 25 bp, Homo sapiens
cccggctcatggtctgggggatgca

SEQ ID NO: 20717 - DNA, 25 bp, Homo sapiens
gatggcttctcagatatggcttgca

SEQ ID NO: 20718 - DNA, 25 bp, Homo sapiens
gtgacgggtgtccaagaagcggttt

SEQ ID NO: 20719 - DNA, 25 bp, Homo sapiens
gaagcggtttccttgggagcttctg

SEQ ID NO: 20720 - DNA, 25 bp, Homo sapiens
tggcgagtctgtgctcgggacaata

SEQ ID NO: 20721 - DNA, 25 bp, Homo sapiens
tttcccgtaacgcacaggacacgtg

SEQ ID NO: 20722 - DNA, 25 bp, Homo sapiens
ttcataggaacggcccagatcgccc

SEQ ID NO: 20723 - DNA, 25 bp, Homo sapiens
tggtacaggtaggtggcgctcacgt

SEQ ID NO: 20724 - DNA, 25 bp, Homo sapiens
agctctcgcatgcagttctattaac

SEQ ID NO: 20725 - DNA, 25 bp, Homo sapiens
aacagccgtctagaagcgatgcttt

SEQ ID NO: 20726 - DNA, 25 bp, Homo sapiens
aagcgatgctttagtggcctaaccc

SEQ ID NO: 20727 - DNA, 25 bp, Homo sapiens
taggggcaccgattagtctactaac

SEQ ID NO: 20728 - DNA, 25 bp, Homo sapiens
gtctactaacagccagaggtccatc

SEQ ID NO: 20729 - DNA, 25 bp, Homo sapiens
gtaccggttacagtacttggcctct

SEQ ID NO: 20730 - DNA, 25 bp, Homo sapiens
tgaacttggcttttgcgcagctcat

SEQ ID NO: 20731 - DNA, 25 bp, Homo sapiens
ggccttaagtcttctccacatggcc

SEQ ID NO: 20732 - DNA, 25 bp, Homo sapiens
ggtcgtgccatgttcttagtggcca

SEQ ID NO: 20733 - DNA, 25 bp, Homo sapiens
gctctggaggctgccatcgagaacc

SEQ ID NO: 20734 - DNA, 25 bp, Homo sapiens
gcatcagggacgtcgtttacttcca

SEQ ID NO: 20735 - DNA, 25 bp, Homo sapiens
gactctaccataccctggggaagac

SEQ ID NO: 20736 - DNA, 25 bp, Homo sapiens
ggggtacccttgataaaccatctct

SEQ ID NO: 20737 - DNA, 25 bp, Homo sapiens
tctagagaggacatccctgctgggc

SEQ ID NO: 20738 - DNA, 25 bp, Homo sapiens
ttttggacttgttcatgtcccctct

SEQ ID NO: 20739 - DNA, 25 bp, Homo sapiens
cccctctctccctataaatgatgta

SEQ ID NO: 20740 - DNA, 25 bp, Homo sapiens
tcctctcagtctactcaattgtgac

SEQ ID NO: 20741 - DNA, 25 bp, Homo sapiens
gtctactcaattgtgactgtccctc

SEQ ID NO: 20742 - DNA, 25 bp, Homo sapiens
tgtccctcctgatgtattttttttc

SEQ ID NO: 20743 - DNA, 25 bp, Homo sapiens
gtccctcctgatgtattttttttct

SEQ ID NO: 20744 - DNA, 25 bp, Homo sapiens
cgctaggtgcctgctaggtgcatgg

SEQ ID NO: 20745 - DNA, 25 bp, Homo sapiens
gctaggtgcctgctaggtgcatggc

SEQ ID NO: 20746 - DNA, 25 bp, Homo sapiens
ctaggtgcctgctaggtgcatggcc

SEQ ID NO: 20747 - DNA, 25 bp, Homo sapiens
cctgctaggtgcatggccacagagc

SEQ ID NO: 20748 - DNA, 25 bp, Homo sapiens
gctaggtgcatggccacagagcatg

SEQ ID NO: 20749 - DNA, 25 bp, Homo sapiens
catctccaggcgctgggaggggggc

SEQ ID NO: 20750 - DNA, 25 bp, Homo sapiens
ctcctctcagtctactcaattgtga

SEQ ID NO: 20751 - DNA, 25 bp, Homo sapiens
actttaagatcatttaccgccgcta

SEQ ID NO: 20752 - DNA, 25 bp, Homo sapiens
atgacaacaacctggcttacctgga

SEQ ID NO: 20753 - DNA, 25 bp, Homo sapiens
gaggccattcacaacttcgtggagg

SEQ ID NO: 20754 - DNA, 25 bp, Homo sapiens
tggacctggtgttcaacttctacaa

SEQ ID NO: 20755 - DNA, 25 bp, Homo sapiens
ggtcgtggacgagatgttcctggct

SEQ ID NO: 20756 - DNA, 25 bp, Homo sapiens
gaaatccgagagaccagccagacga

SEQ ID NO: 20757 - DNA, 25 bp, Homo sapiens
aaacagctgctgatgctacagtccc

SEQ ID NO: 20758 - DNA, 25 bp, Homo sapiens
tggagtgagggcaggcgagccccac

SEQ ID NO: 20759 - DNA, 25 bp, Homo sapiens
acaagggaggagactgcaccccact

SEQ ID NO: 20760 - DNA, 25 bp, Homo sapiens
gccgttgtcgtgtgatgccataagc

SEQ ID NO: 20761 - DNA, 25 bp, Homo sapiens
ctgtgcgtggagtccccaataaacc

SEQ ID NO: 20762 - DNA, 25 bp, Homo sapiens
caaaagggcctggtcatcgccaaga

SEQ ID NO: 20763 - DNA, 25 bp, Homo sapiens
gtccccagcgaccgctataaggtgg

SEQ ID NO: 20764 - DNA, 25 bp, Homo sapiens
tataaggtggagggcttccccacca

SEQ ID NO: 20765 - DNA, 25 bp, Homo sapiens
gacagagatctggagcatttgagca

SEQ ID NO: 20766 - DNA, 25 bp, Homo sapiens
tatagaagaacatgccacaaaactg

SEQ ID NO: 20767 - DNA, 25 bp, Homo sapiens
gagcaggaccaaggaagagctttga

SEQ ID NO: 20768 - DNA, 25 bp, Homo sapiens
agagctttgaaggcctgaggtctgc

SEQ ID NO: 20769 - DNA, 25 bp, Homo sapiens
gaaggcctgaggtctgcggaaggtg

SEQ ID NO: 20770 - DNA, 25 bp, Homo sapiens
gaggccggcaacaaacgacagtatc

SEQ ID NO: 20771 - DNA, 25 bp, Homo sapiens
gacagtatctcggattccttttttt

SEQ ID NO: 20772 - DNA, 25 bp, Homo sapiens
cacttcatgctctgaatactgaata

SEQ ID NO: 20773 - DNA, 25 bp, Homo sapiens
gttctgcgggatggtgcagttcccc

SEQ ID NO: 20774 - DNA, 25 bp, Homo sapiens
ggccagccaggtgtacgagacattg

SEQ ID NO: 20775 - DNA, 25 bp, Homo sapiens
gtacgagacattgctcacctacagt

SEQ ID NO: 20776 - DNA, 25 bp, Homo sapiens
tcacctacagtgacgtcgtgggcgc

SEQ ID NO: 20777 - DNA, 25 bp, Homo sapiens
ggatgtgctggacgaggtggtgact

SEQ ID NO: 20778 - DNA, 25 bp, Homo sapiens
gactgtgctcagtgacactgcgtgg

SEQ ID NO: 20779 - DNA, 25 bp, Homo sapiens
gtggtgagagagcagcgcaaccgtc

SEQ ID NO: 20780 - DNA, 25 bp, Homo sapiens
ttgaagggtagcgctggcccttgga

SEQ ID NO: 20781 - DNA, 25 bp, Homo sapiens
ccttggaggctggcactagctgaca

SEQ ID NO: 20782 - DNA, 25 bp, Homo sapiens
gcactagctgacagcttttcctctc

SEQ ID NO: 20783 - DNA, 25 bp, Homo sapiens
cctctgccttcacttgaacacaaat

SEQ ID NO: 20784 - DNA, 25 bp, Homo sapiens
atgtcaatgctgccattgccaccat

SEQ ID NO: 20785 - DNA, 25 bp, Homo sapiens
tgccccactggcttcaaggttggca

SEQ ID NO: 20786 - DNA, 25 bp, Homo sapiens
aaggttggcatcaactaccagcctc

SEQ ID NO: 20787 - DNA, 25 bp, Homo sapiens
ctcccactgtggtgcctggtggaga

SEQ ID NO: 20788 - DNA, 25 bp, Homo sapiens
acaccacagccattgctgaggcctg

SEQ ID NO: 20789 - DNA, 25 bp, Homo sapiens
gcctggaccacaagtttgacctgat

SEQ ID NO: 20790 - DNA, 25 bp, Homo sapiens
gacctgatgtatgccaagcgtgcct

SEQ ID NO: 20791 - DNA, 25 bp, Homo sapiens
ggcccgtgaagatatggctgccctt

SEQ ID NO: 20792 - DNA, 25 bp, Homo sapiens
ctaattatccattccttttggccct

SEQ ID NO: 20793 - DNA, 25 bp, Homo sapiens
gtcatgctcccagaatttcagcttc

SEQ ID NO: 20794 - DNA, 25 bp, Homo sapiens
tgtcttttccatgtgtacctgtaat

SEQ ID NO: 20795 - DNA, 25 bp, Homo sapiens
gtgctgacactgctggcgatttatg

SEQ ID NO: 20796 - DNA, 25 bp, Homo sapiens
tggcgatttatgcagctggcctggc

SEQ ID NO: 20797 - DNA, 25 bp, Homo sapiens
acccaccgggtggtaagcacacagg

SEQ ID NO: 20798 - DNA, 25 bp, Homo sapiens
aggggctggatggcactgaagctgg

SEQ ID NO: 20799 - DNA, 25 bp, Homo sapiens
gctggtagccctgatctacctagca

SEQ ID NO: 20800 - DNA, 25 bp, Homo sapiens
agcactgcagctgggctgcatcgcc

SEQ ID NO: 20801 - DNA, 25 bp, Homo sapiens
gctagcccagggtgtgctggagcac

SEQ ID NO: 20802 - DNA, 25 bp, Homo sapiens
ggctgcttttctggaatgtgctctt

SEQ ID NO: 20803 - DNA, 25 bp, Homo sapiens
ctggaagtgagatctgcctgtccgg

SEQ ID NO: 20804 - DNA, 25 bp, Homo sapiens
gctgggacagagactccccaaggac

SEQ ID NO: 20805 - DNA, 25 bp, Homo sapiens
attctgcctccttctggggaaataa

SEQ ID NO: 20806 - DNA, 25 bp, Homo sapiens
ttctctccctggggacctatagtgc

SEQ ID NO: 20807 - DNA, 25 bp, Homo sapiens
ggacctatagtgccagtcgcagttt

SEQ ID NO: 20808 - DNA, 25 bp, Homo sapiens
cagtcgcagtttctatggcatggct

SEQ ID NO: 20809 - DNA, 25 bp, Homo sapiens
atgggtctagccttgacccggaatg

SEQ ID NO: 20810 - DNA, 25 bp, Homo sapiens
gggactggactcttcaatacttgac

SEQ ID NO: 20811 - DNA, 25 bp, Homo sapiens
tacttgactgtatcttgtcttccaa

SEQ ID NO: 20812 - DNA, 25 bp, Homo sapiens
agtgctggttcctcaaattcctagg

SEQ ID NO: 20813 - DNA, 25 bp, Homo sapiens
aaattcctaggatctttcatgctgg

SEQ ID NO: 20814 - DNA, 25 bp, Homo sapiens
aacctgtagaccatccactcagagt

SEQ ID NO: 20815 - DNA, 25 bp, Homo sapiens
tttactgtggtagccatttccccac

SEQ ID NO: 20816 - DNA, 25 bp, Homo sapiens
aaagcgacagtcttctatttttgat

SEQ ID NO: 20817 - DNA, 25 bp, Homo sapiens
tgctgttcatctatggccactacaa

SEQ ID NO: 20818 - DNA, 25 bp, Homo sapiens
acagaacggcccgggatgttggact

SEQ ID NO: 20819 - DNA, 25 bp, Homo sapiens
atgttggacttcacgggcaaggcca

SEQ ID NO: 20820 - DNA, 25 bp, Homo sapiens
tggagttcttgcaagtcggccagga

SEQ ID NO: 20821 - DNA, 25 bp, Homo sapiens
ggttactgtgccatgtgtttatcct

SEQ ID NO: 20822 - DNA, 25 bp, Homo sapiens
tgccttgtttttttctaataccgtg

SEQ ID NO: 20823 - DNA, 25 bp, Homo sapiens
aaaccagctactcaaggctgctcac

SEQ ID NO: 20824 - DNA, 25 bp, Homo sapiens
ctcaccatacggctctaacagatta

SEQ ID NO: 20825 - DNA, 25 bp, Homo sapiens
aaaacgattactgactttccttgag

SEQ ID NO: 20826 - DNA, 25 bp, Homo sapiens
tcggccaggatgtctcaggctgagt

SEQ ID NO: 20827 - DNA, 25 bp, Homo sapiens
ggcaccttaagaccaagccatcgga

SEQ ID NO: 20828 - DNA, 25 bp, Homo sapiens
aatcttaacatgcattcctactatt

SEQ ID NO: 20829 - DNA, 25 bp, Homo sapiens
aacggcataagtcctattttagcct

SEQ ID NO: 20830 - DNA, 25 bp, Homo sapiens
gccttacctcctgcatttgcaatac

SEQ ID NO: 20831 - DNA, 25 bp, Homo sapiens
tcagtgggcacagttcttcagctac

SEQ ID NO: 20832 - DNA, 25 bp, Homo sapiens
atattctgactcgacatcttgtccc

SEQ ID NO: 20833 - DNA, 25 bp, Homo sapiens
ttgtccccaatccttccaaaaatat

SEQ ID NO: 20834 - DNA, 25 bp, Homo sapiens
gatttgtgctaccatttactcgttt

SEQ ID NO: 20835 - DNA, 25 bp, Homo sapiens
ttgatcctgctcttatattcttttt

SEQ ID NO: 20836 - DNA, 25 bp, Homo sapiens
caaaagagtgtcccttcttcacacc

SEQ ID NO: 20837 - DNA, 25 bp, Homo sapiens
acacctactcactttacaactttgc

SEQ ID NO: 20838 - DNA, 25 bp, Homo sapiens
acaactttgctcctaactgtgggtt

SEQ ID NO: 20839 - DNA, 25 bp, Homo sapiens
ccaagcgcagcatccagtttgtgga

SEQ ID NO: 20840 - DNA, 25 bp, Homo sapiens
tgccccactggcttcaaggttggca

SEQ ID NO: 20841 - DNA, 25 bp, Homo sapiens
aaggttggcatcaactaccagcctc

SEQ ID NO: 20842 - DNA, 25 bp, Homo sapiens
ctcccactgtggtgcctggtggaga

SEQ ID NO: 20843 - DNA, 25 bp, Homo sapiens
acaccacagccattgctgaggcctg

SEQ ID NO: 20844 - DNA, 25 bp, Homo sapiens
gcctggaccacaagtttgacctgat

SEQ ID NO: 20845 - DNA, 25 bp, Homo sapiens
gacctgatgtatgccaagcgtgcct

SEQ ID NO: 20846 - DNA, 25 bp, Homo sapiens
ggcccgtgaagatatggctgccctt

SEQ ID NO: 20847 - DNA, 25 bp, Homo sapiens
ctaattatccattccttttggccct

SEQ ID NO: 20848 - DNA, 25 bp, Homo sapiens
gtcatgctcccagaatttcagcttc

SEQ ID NO: 20849 - DNA, 25 bp, Homo sapiens
tgtcttttccatgtgtacctgtaat

SEQ ID NO: 20850 - DNA, 25 bp, Homo sapiens
ggacttcatcgtactcgggattttc

SEQ ID NO: 20851 - DNA, 25 bp, Homo sapiens
tactcgggattttcttcatctccct

SEQ ID NO: 20852 - DNA, 25 bp, Homo sapiens
gtcctcaggtacaaaatccgggcag

SEQ ID NO: 20853 - DNA, 25 bp, Homo sapiens
ggaagattagacactgtggccgagg

SEQ ID NO: 20854 - DNA, 25 bp, Homo sapiens
ggccgagggcacgtctagaatcgag

SEQ ID NO: 20855 - DNA, 25 bp, Homo sapiens
tagaaccgcgttgggtttgtgggtg

SEQ ID NO: 20856 - DNA, 25 bp, Homo sapiens
cattcccctttctagctttaactag

SEQ ID NO: 20857 - DNA, 25 bp, Homo sapiens
gatgagaggcttcctcagtccagtc

SEQ ID NO: 20858 - DNA, 25 bp, Homo sapiens
caccaggcaccgtgggtcctggatg

SEQ ID NO: 20859 - DNA, 25 bp, Homo sapiens
gggtcctggatggggaactgcaagc

SEQ ID NO: 20860 - DNA, 25 bp, Homo sapiens
aactgcaagcagcctctcagctgat

SEQ ID NO: 20861 - DNA, 25 bp, Homo sapiens
tatttctctttcaggatgccaaccc

SEQ ID NO: 20862 - DNA, 25 bp, Homo sapiens
gttattccccaacacttcaatggca

SEQ ID NO: 20863 - DNA, 25 bp, Homo sapiens
tatgtgctgacggggctgttggacc

SEQ ID NO: 20864 - DNA, 25 bp, Homo sapiens
tgtacaaattggttttcctcccttg

SEQ ID NO: 20865 - DNA, 25 bp, Homo sapiens
tttcctcccttgcttagtattgtta

SEQ ID NO: 20866 - DNA, 25 bp, Homo sapiens
ttatgctttattggcttgtcttgaa

SEQ ID NO: 20867 - DNA, 25 bp, Homo sapiens
gcctttgttacctgaggctcattca

SEQ ID NO: 20868 - DNA, 25 bp, Homo sapiens
aggctcattcactgattcggcagct

SEQ ID NO: 20869 - DNA, 25 bp, Homo sapiens
tcggcagcttgcaagaaggtgctct

SEQ ID NO: 20870 - DNA, 25 bp, Homo sapiens
gaaggtgctctgaagtgaggctctt

SEQ ID NO: 20871 - DNA, 25 bp, Homo sapiens
tgaggctcttagtggtattttgacc

SEQ ID NO: 20872 - DNA, 25 bp, Homo sapiens
ccccagctcaggaatggacgccagc

SEQ ID NO: 20873 - DNA, 25 bp, Homo sapiens
ttagctgacagcttctatgccatct

SEQ ID NO: 20874 - DNA, 25 bp, Homo sapiens
ccatctcctatctctattacggtgc

SEQ ID NO: 20875 - DNA, 25 bp, Homo sapiens
ccagctgaccactgtgctgtgcgga

SEQ ID NO: 20876 - DNA, 25 bp, Homo sapiens
ctggccccgggattgttgtggtggg

SEQ ID NO: 20877 - DNA, 25 bp, Homo sapiens
tcctgaagaactccccactggaaac

SEQ ID NO: 20878 - DNA, 25 bp, Homo sapiens
aaacaagaagccccctggcttcctg

SEQ ID NO: 20879 - DNA, 25 bp, Homo sapiens
cctgcccaccaatgaggatcgtctg

SEQ ID NO: 20880 - DNA, 25 bp, Homo sapiens
tgaggatcgtctgtttttcttgggg

SEQ ID NO: 20881 - DNA, 25 bp, Homo sapiens
accccctgtgttggacatgatggtg

SEQ ID NO: 20882 - DNA, 25 bp, Homo sapiens
tggaacctcaggatgggccaaaccc

SEQ ID NO: 20883 - DNA, 25 bp, Homo sapiens
ctactgcaaatcctgctacggaaag

SEQ ID NO: 20884 - DNA, 25 bp, Homo sapiens
gctggcacgcttaacatggaccgtg

SEQ ID NO: 20885 - DNA, 25 bp, Homo sapiens
aacatggaccgtggcgagaggctgg

SEQ ID NO: 20886 - DNA, 25 bp, Homo sapiens
tgttcagcctcacaggcctacaaca

SEQ ID NO: 20887 - DNA, 25 bp, Homo sapiens
ggcctacaacaaatccaaacacttc

SEQ ID NO: 20888 - DNA, 25 bp, Homo sapiens
ggaggtgctgagaagtgttccagat

SEQ ID NO: 20889 - DNA, 25 bp, Homo sapiens
gtggggattctgtatatgctgccga

SEQ ID NO: 20890 - DNA, 25 bp, Homo sapiens
gccctggcacaaaaactgtttccga

SEQ ID NO: 20891 - DNA, 25 bp, Homo sapiens
aactgtttccgatgtgcaaagtgtg

SEQ ID NO: 20892 - DNA, 25 bp, Homo sapiens
ggagcaggggctcttgttcatgccc

SEQ ID NO: 20893 - DNA, 25 bp, Homo sapiens
aacatcacacactgagaatctcttc

SEQ ID NO: 20894 - DNA, 25 bp, Homo sapiens
aaatgatacactactgctgcagctc

SEQ ID NO: 20895 - DNA, 25 bp, Homo sapiens
gctcacaaacacctctgcatattac

SEQ ID NO: 20896 - DNA, 25 bp, Homo sapiens
cctcctgctcctcaagagtgtggtc

SEQ ID NO: 20897 - DNA, 25 bp, Homo sapiens
tggtctattttgccatcatcacctg

SEQ ID NO: 20898 - DNA, 25 bp, Homo sapiens
tcacctgctgtctgcttggaagaac

SEQ ID NO: 20899 - DNA, 25 bp, Homo sapiens
acaaggaggccatcttttcctcatc

SEQ ID NO: 20900 - DNA, 25 bp, Homo sapiens
ttcctcatcggttattgtccctaga

SEQ ID NO: 20901 - DNA, 25 bp, Homo sapiens
gaagcgtcttctgaggatctagttg

SEQ ID NO: 20902 - DNA, 25 bp, Homo sapiens
tgggtttgggccatttcagttctca

SEQ ID NO: 20903 - DNA, 25 bp, Homo sapiens
gaatagccatggcgatctccagcac

SEQ ID NO: 20904 - DNA, 25 bp, Homo sapiens
tggaagcctttcattttacacgccc

SEQ ID NO: 20905 - DNA, 25 bp, Homo sapiens
aagcttcagctttggcatgtttaaa

SEQ ID NO: 20906 - DNA, 25 bp, Homo sapiens
atgtcagtgttgcggtcagtactcc

SEQ ID NO: 20907 - DNA, 25 bp, Homo sapiens
gcaggactcatcacacctattgtgt

SEQ ID NO: 20908 - DNA, 25 bp, Homo sapiens
gggtaaactacagccacatgaattc

SEQ ID NO: 20909 - DNA, 25 bp, Homo sapiens
ggcacttttacgatctccaatttag

SEQ ID NO: 20910 - DNA, 25 bp, Homo sapiens
tattaacccacctcaagcatgtatt

SEQ ID NO: 20911 - DNA, 25 bp, Homo sapiens
gaggataaactggtccctgcagata

SEQ ID NO: 20912 - DNA, 25 bp, Homo sapiens
gcatgatgtctgttacactcagttg

SEQ ID NO: 20913 - DNA, 25 bp, Homo sapiens
cactcagttgtgatcaccgggtggt

SEQ ID NO: 20914 - DNA, 25 bp, Homo sapiens
gatggagcagttggagcccagtggc

SEQ ID NO: 20915 - DNA, 25 bp, Homo sapiens
caagaatttctaaactctcccaggt

SEQ ID NO: 20916 - DNA, 25 bp, Homo sapiens
tatgaagctgttcgaacccaatccc

SEQ ID NO: 20917 - DNA, 25 bp, Homo sapiens
cccagttggcagtgcagatccggcg

SEQ ID NO: 20918 - DNA, 25 bp, Homo sapiens
ggcggggacgagaaacactgacctt

SEQ ID NO: 20919 - DNA, 25 bp, Homo sapiens
tttctggctgaggttctgagggcac

SEQ ID NO: 20920 - DNA, 25 bp, Homo sapiens
catgaaggtcacagctggaatctcc

SEQ ID NO: 20921 - DNA, 25 bp, Homo sapiens
atcccttctgatcgtcttcgagagt

SEQ ID NO: 20922 - DNA, 25 bp, Homo sapiens
gtcttcgagagtttctgcatcgtgg

SEQ ID NO: 20923 - DNA, 25 bp, Homo sapiens
aagaagaattcctcctccggaatca

SEQ ID NO: 20924 - DNA, 25 bp, Homo sapiens
tccggaatcagtgggtcccagcggc

SEQ ID NO: 20925 - DNA, 25 bp, Homo sapiens
ccagcggcgctacattggggtgatg

SEQ ID NO: 20926 - DNA, 25 bp, Homo sapiens
gtctgcggcctggtgatgtgatttt

SEQ ID NO: 20927 - DNA, 25 bp, Homo sapiens
gaatttgcccgcatcatgagcattg

SEQ ID NO: 20928 - DNA, 25 bp, Homo sapiens
agcagaccaagtcatggcttccttc

SEQ ID NO: 20929 - DNA, 25 bp, Homo sapiens
cttccttcaagatcctggctgggga

SEQ ID NO: 20930 - DNA, 25 bp, Homo sapiens
tacattaccatggacgagctgcgcc

SEQ ID NO: 20931 - DNA, 25 bp, Homo sapiens
ccgaccaggctgagtactgcatcgc

SEQ ID NO: 20932 - DNA, 25 bp, Homo sapiens
ggcgctgtacggcgagagtgacctc

SEQ ID NO: 20933 - DNA, 25 bp, Homo sapiens
aatagaagcctaatcagcccaccat

SEQ ID NO: 20934 - DNA, 25 bp, Homo sapiens
tgacgtcagcctgtacaggctccca

SEQ ID NO: 20935 - DNA, 25 bp, Homo sapiens
ctcccaggggtggcgtcaaatgcta

SEQ ID NO: 20936 - DNA, 25 bp, Homo sapiens
gaaattgcgctgaatcgtatgcttt

SEQ ID NO: 20937 - DNA, 25 bp, Homo sapiens
tgaatcgtatgctttttccttttga

SEQ ID NO: 20938 - DNA, 25 bp, Homo sapiens
gtgcttaatgccacctggctggtga

SEQ ID NO: 20939 - DNA, 25 bp, Homo sapiens
tggctggtgaacagtgctgcccacc

SEQ ID NO: 20940 - DNA, 25 bp, Homo sapiens
acctcttcggatatcgtccttatga

SEQ ID NO: 20941 - DNA, 25 bp, Homo sapiens
tagcccccgggagaatatcctggtt

SEQ ID NO: 20942 - DNA, 25 bp, Homo sapiens
gtgggtgagggcttccacaactacc

SEQ ID NO: 20943 - DNA, 25 bp, Homo sapiens
gactactctgccagtgagtaccgct

SEQ ID NO: 20944 - DNA, 25 bp, Homo sapiens
atcaacttcaccacattcttcattg

SEQ ID NO: 20945 - DNA, 25 bp, Homo sapiens
aagagtggctgagtttggggtccct

SEQ ID NO: 20946 - DNA, 25 bp, Homo sapiens
gttaacccattccagtacagtattc

SEQ ID NO: 20947 - DNA, 25 bp, Homo sapiens
agccaacaactctgcctttatgatg

SEQ ID NO: 20948 - DNA, 25 bp, Homo sapiens
ccttttcactttattgctatcgccc

SEQ ID NO: 20949 - DNA, 25 bp, Homo sapiens
aagatggtgtgcctgagggagcccc

SEQ ID NO: 20950 - DNA, 25 bp, Homo sapiens
ggccccaacgcaggcgaagttactc

SEQ ID NO: 20951 - DNA, 25 bp, Homo sapiens
ggatcaagtgtggggcttcctatgc

SEQ ID NO: 20952 - DNA, 25 bp, Homo sapiens
gaccgtgggtatccatcccacatgc

SEQ ID NO: 20953 - DNA, 25 bp, Homo sapiens
ggaggtagtcaagctgcgcatctcc

SEQ ID NO: 20954 - DNA, 25 bp, Homo sapiens
caggctgctgagggtaagcgccatc

SEQ ID NO: 20955 - DNA, 25 bp, Homo sapiens
tggctgcaggccaggtttggggggc

SEQ ID NO: 20956 - DNA, 25 bp, Homo sapiens
tcctggagcgcctgtgagatggtca

SEQ ID NO: 20957 - DNA, 25 bp, Homo sapiens
gatggtcagcgtggagcgcaagtgc

SEQ ID NO: 20958 - DNA, 25 bp, Homo sapiens
cccacagggatggctcaggggactg

SEQ ID NO: 20959 - DNA, 25 bp, Homo sapiens
gacctgggtggaaacctaccctgtg

SEQ ID NO: 20960 - DNA, 25 bp, Homo sapiens
agcctccaaggatcatcagttcagt

SEQ ID NO: 20961 - DNA, 25 bp, Homo sapiens
ggtctggttcacgctatataatcac

SEQ ID NO: 20962 - DNA, 25 bp, Homo sapiens
aatcacctgggatcatgtcgttgca

SEQ ID NO: 20963 - DNA, 25 bp, Homo sapiens
ggtactctacagacctgatggccag

SEQ ID NO: 20964 - DNA, 25 bp, Homo sapiens
gatggcaagctgtattcaactcaca

SEQ ID NO: 20965 - DNA, 25 bp, Homo sapiens
aagtcccaatccccagagatggaga

SEQ ID NO: 20966 - DNA, 25 bp, Homo sapiens
ggttcgcgcgcacagtgatggagga

SEQ ID NO: 20967 - DNA, 25 bp, Homo sapiens
caaaatttcaggtgcacccacccta

SEQ ID NO: 20968 - DNA, 25 bp, Homo sapiens
ctttggcatccttgtctacttggaa

SEQ ID NO: 20969 - DNA, 25 bp, Homo sapiens
tgcggctccatcctaagccaaataa

SEQ ID NO: 20970 - DNA, 25 bp, Homo sapiens
gactgaggcattcaggaaccccttc

SEQ ID NO: 20971 - DNA, 25 bp, Homo sapiens
aaggacagcagcagttcagccagtt

SEQ ID NO: 20972 - DNA, 25 bp, Homo sapiens
gatggacagcagctctaccagatcc

SEQ ID NO: 20973 - DNA, 25 bp, Homo sapiens
ggacacccaacacaatttttgccat

SEQ ID NO: 20974 - DNA, 25 bp, Homo sapiens
catacagccccaggcaatggcacag

SEQ ID NO: 20975 - DNA, 25 bp, Homo sapiens
ggctaggacactggtgcactacacc

SEQ ID NO: 20976 - DNA, 25 bp, Homo sapiens
ctggggccgagattctccagcagaa

SEQ ID NO: 20977 - DNA, 25 bp, Homo sapiens
gatcccggtgcagctgaatgccggc

SEQ ID NO: 20978 - DNA, 25 bp, Homo sapiens
gccagctgcagtatatccgcttagc

SEQ ID NO: 20979 - DNA, 25 bp, Homo sapiens
tagcccagcctgtatcaggcactca

SEQ ID NO: 20980 - DNA, 25 bp, Homo sapiens
gcagggacagatccagacacttgcc

SEQ ID NO: 20981 - DNA, 25 bp, Homo sapiens
acttgccaccaatgctcaacagatt

SEQ ID NO: 20982 - DNA, 25 bp, Homo sapiens
tggctaagtcccaccataacagcta

SEQ ID NO: 20983 - DNA, 25 bp, Homo sapiens
tgggagatgatggctcatttccacc

SEQ ID NO: 20984 - DNA, 25 bp, Homo sapiens
acatccacaggcctggacctgggat

SEQ ID NO: 20985 - DNA, 25 bp, Homo sapiens
ggatgtagtttggctcaggtgtccc

SEQ ID NO: 20986 - DNA, 25 bp, Homo sapiens
gtgtccctgcagttggcaaggagtc

SEQ ID NO: 20987 - DNA, 25 bp, Homo sapiens
gcaaggagtcagtactcagtccctg

SEQ ID NO: 20988 - DNA, 25 bp, Homo sapiens
ctcagtccctgagtgtggctgaaat

SEQ ID NO: 20989 - DNA, 25 bp, Homo sapiens
tggctgaaatttgagttctgggcgg

SEQ ID NO: 20990 - DNA, 25 bp, Homo sapiens
gtattcaagttcagtggggacacca

SEQ ID NO: 20991 - DNA, 25 bp, Homo sapiens
gacaccagtggcttcaaactttcct

SEQ ID NO: 20992 - DNA, 25 bp, Homo sapiens
actttcctggtttcatgatatcttg

SEQ ID NO: 20993 - DNA, 25 bp, Homo sapiens
ttagaattgcccagtgctgccagag

SEQ ID NO: 20994 - DNA, 25 bp, Homo sapiens
agtgtaattctcctttcaggtaaag

SEQ ID NO: 20995 - DNA, 25 bp, Homo sapiens
gctatctcaacactgctgagtgatt

SEQ ID NO: 20996 - DNA, 25 bp, Homo sapiens
atatcaaccaatagcattaacccat

SEQ ID NO: 20997 - DNA, 25 bp, Homo sapiens
gcattaacccattttatttcctgtc

SEQ ID NO: 20998 - DNA, 25 bp, Homo sapiens
cctgtccttagtgtctgaagatgct

SEQ ID NO: 20999 - DNA, 25 bp, Homo sapiens
gtctgaagatgctcaccagttttct

SEQ ID NO: 21000 - DNA, 25 bp, Homo sapiens
tgctcaccagttttctgtgtacagt

SEQ ID NO: 21001 - DNA, 25 bp, Homo sapiens
tgtgtacagtaaggcagcatgctaa

SEQ ID NO: 21002 - DNA, 25 bp, Homo sapiens
agtgtgttctctgatggttacctgc

SEQ ID NO: 21003 - DNA, 25 bp, Homo sapiens
tctgatggttacctgcagtggcacc

SEQ ID NO: 21004 - DNA, 25 bp, Homo sapiens
ccaacaaggggctggctcagtacct

SEQ ID NO: 21005 - DNA, 25 bp, Homo sapiens
gctggctcagtacctcaagcaatat

SEQ ID NO: 21006 - DNA, 25 bp, Homo sapiens
ttgacaacatggctagggtggagga

SEQ ID NO: 21007 - DNA, 25 bp, Homo sapiens
gcaggcatttgtcaggccatatgtt

SEQ ID NO: 21008 - DNA, 25 bp, Homo sapiens
gtcaggccatatgttttaaccttat

SEQ ID NO: 21009 - DNA, 25 bp, Homo sapiens
taatactttgctttagtcgttcctc

SEQ ID NO: 21010 - DNA, 25 bp, Homo sapiens
tgctaccagtagcgttttgacccac

SEQ ID NO: 21011 - DNA, 25 bp, Homo sapiens
tgccagtgtttgcttgctctatgtt

SEQ ID NO: 21012 - DNA, 25 bp, Homo sapiens
gtttgcttgctctatgtttcagtag

SEQ ID NO: 21013 - DNA, 25 bp, Homo sapiens
gtttcagtagcagattttcacacat

SEQ ID NO: 21014 - DNA, 25 bp, Homo sapiens
acacatgtgcattgcagagacgtca

SEQ ID NO: 21015 - DNA, 25 bp, Homo sapiens
gaacaggataaagctcgccgggaat

SEQ ID NO: 21016 - DNA, 25 bp, Homo sapiens
gaaagggaccgcttggagcagttag

SEQ ID NO: 21017 - DNA, 25 bp, Homo sapiens
gcgggagcgggagcgcaagatgcgg

SEQ ID NO: 21018 - DNA, 25 bp, Homo sapiens
agaagatgaccttcagcgagcaccc

SEQ ID NO: 21019 - DNA, 25 bp, Homo sapiens
ggcttcgacctcatgaacaagttcc

SEQ ID NO: 21020 - DNA, 25 bp, Homo sapiens
tgacctacttccccgggaggaggat

SEQ ID NO: 21021 - DNA, 25 bp, Homo sapiens
gaggatcagcgctgaggacggcctc

SEQ ID NO: 21022 - DNA, 25 bp, Homo sapiens
caagcatgagtatttccgcgagacc

SEQ ID NO: 21023 - DNA, 25 bp, Homo sapiens
gagcagcagcgtgtgaagcggggca

SEQ ID NO: 21024 - DNA, 25 bp, Homo sapiens
gggctacagccagctgggtgacgac

SEQ ID NO: 21025 - DNA, 25 bp, Homo sapiens
gacctgaaggagacgggcttccacc

SEQ ID NO: 21026 - DNA, 25 bp, Homo sapiens
caccctgtctgactacaacatccag

SEQ ID NO: 21027 - DNA, 25 bp, Homo sapiens
ctggtgctccgtcttagaggtggga

SEQ ID NO: 21028 - DNA, 25 bp, Homo sapiens
ctggtaagaccatcactctcgaagt

SEQ ID NO: 21029 - DNA, 25 bp, Homo sapiens
catccctcctgaccagcagaggttg

SEQ ID NO: 21030 - DNA, 25 bp, Homo sapiens
acatccagaaagagtccaccctgca

SEQ ID NO: 21031 - DNA, 25 bp, Homo sapiens
gtgctccgtctcagaggtgggatgc

SEQ ID NO: 21032 - DNA, 25 bp, Homo sapiens
tgactggtaagaccatcaccctcga

SEQ ID NO: 21033 - DNA, 25 bp, Homo sapiens
tcaccctcgaggtggagcccagtga

SEQ ID NO: 21034 - DNA, 25 bp, Homo sapiens
gagcccagtgacaccatcgagaatg

SEQ ID NO: 21035 - DNA, 25 bp, Homo sapiens
gcatccctcctgatcagcagaggtt

SEQ ID NO: 21036 - DNA, 25 bp, Homo sapiens
gaaagagtccactctgcacttggtc

SEQ ID NO: 21037 - DNA, 25 bp, Homo sapiens
ggactccaccgaatatactgggcct

SEQ ID NO: 21038 - DNA, 25 bp, Homo sapiens
ctgggcctgagagttacgtggcaga

SEQ ID NO: 21039 - DNA, 25 bp, Homo sapiens
aaccttgactggttccccaggatga

SEQ ID NO: 21040 - DNA, 25 bp, Homo sapiens
ctggttccccaggatgagagccatg

SEQ ID NO: 21041 - DNA, 25 bp, Homo sapiens
gagagccatgtcattggtcagcagt

SEQ ID NO: 21042 - DNA, 25 bp, Homo sapiens
ggagtccaccatgaaacttgtcacg

SEQ ID NO: 21043 - DNA, 25 bp, Homo sapiens
gaaacttgtcacgaacctttctggc

SEQ ID NO: 21044 - DNA, 25 bp, Homo sapiens
ggacatcctcctcacatgaatgtca

SEQ ID NO: 21045 - DNA, 25 bp, Homo sapiens
aacccacaacaaccagcataagcaa

SEQ ID NO: 21046 - DNA, 25 bp, Homo sapiens
gagttctgattcacccacgaaggtt

SEQ ID NO: 21047 - DNA, 25 bp, Homo sapiens
tgattgctactctaaaggtttggat

SEQ ID NO: 21048 - DNA, 25 bp, Homo sapiens
gccctcttgatggatcacgtaaaac

SEQ ID NO: 21049 - DNA, 25 bp, Homo sapiens
aaggcagcggggagcagacaaagat

SEQ ID NO: 21050 - DNA, 25 bp, Homo sapiens
agatgaggtctacactgtccttcat

SEQ ID NO: 21051 - DNA, 25 bp, Homo sapiens
gtctacactgtccttcatggggatt

SEQ ID NO: 21052 - DNA, 25 bp, Homo sapiens
actgtccttcatggggattaaagct

SEQ ID NO: 21053 - DNA, 25 bp, Homo sapiens
gctatggttatattagcaccaaact

SEQ ID NO: 21054 - DNA, 25 bp, Homo sapiens
accctagaagggcccaaatgagaga

SEQ ID NO: 21055 - DNA, 25 bp, Homo sapiens
atgagagaatggtacttagggatgg

SEQ ID NO: 21056 - DNA, 25 bp, Homo sapiens
gtgtatatatggttttgtcaggtgt

SEQ ID NO: 21057 - DNA, 25 bp, Homo sapiens
ggttttgtcaggtgtgtaaatttgc

SEQ ID NO: 21058 - DNA, 25 bp, Homo sapiens
aattgtttcctttatatatgtatgt

SEQ ID NO: 21059 - DNA, 25 bp, Homo sapiens
ccgaaagaggagccggaccaggaag

SEQ ID NO: 21060 - DNA, 25 bp, Homo sapiens
caggtggcttgtgagatctgcggca

SEQ ID NO: 21061 - DNA, 25 bp, Homo sapiens
ggcaagatcttccgtgatgtgtatc

SEQ ID NO: 21062 - DNA, 25 bp, Homo sapiens
cctgtgtgtgggttgcggttcaaga

SEQ ID NO: 21063 - DNA, 25 bp, Homo sapiens
gttcaagagaaaagaccgcatgtcc

SEQ ID NO: 21064 - DNA, 25 bp, Homo sapiens
ccgcatgtcctaccatgtgcggtcc

SEQ ID NO: 21065 - DNA, 25 bp, Homo sapiens
accatgtgcggtcccatgatgggtc

SEQ ID NO: 21066 - DNA, 25 bp, Homo sapiens
gtcccatgatgggtccgtgggcaag

SEQ ID NO: 21067 - DNA, 25 bp, Homo sapiens
ccgtgggcaagccttacatctgcca

SEQ ID NO: 21068 - DNA, 25 bp, Homo sapiens
aagccttacatctgccagagctgtg

SEQ ID NO: 21069 - DNA, 25 bp, Homo sapiens
atctgccagagctgtgggaaaggct

SEQ ID NO: 21070 - DNA, 25 bp, Homo sapiens
cccactgcgggaggacttcagtctg

SEQ ID NO: 21071 - DNA, 25 bp, Homo sapiens
ggaggacttcagtctgagtagcagt

SEQ ID NO: 21072 - DNA, 25 bp, Homo sapiens
gagggatgcaggtgggccggaagat

SEQ ID NO: 21073 - DNA, 25 bp, Homo sapiens
gtgggccggaagatcccacgattcc

SEQ ID NO: 21074 - DNA, 25 bp, Homo sapiens
cggaagatcccacgattccgatcga

SEQ ID NO: 21075 - DNA, 25 bp, Homo sapiens
tccgatcgactgccaagcagcagcc

SEQ ID NO: 21076 - DNA, 25 bp, Homo sapiens
atcctgacctcctggactgtaggac

SEQ ID NO: 21077 - DNA, 25 bp, Homo sapiens
gacctcctggactgtaggactatat

SEQ ID NO: 21078 - DNA, 25 bp, Homo sapiens
taggactatataaagtactactgta

SEQ ID NO: 21079 - DNA, 25 bp, Homo sapiens
gtactactgtagaactgcaatttcc

SEQ ID NO: 21080 - DNA, 25 bp, Homo sapiens
tgtagaactgcaatttccattcttt

SEQ ID NO: 21081 - DNA, 25 bp, Homo sapiens
aattctgatacattagcagctatgt

SEQ ID NO: 21082 - DNA, 25 bp, Homo sapiens
agcaggtgtaataagactatcgtct

SEQ ID NO: 21083 - DNA, 25 bp, Homo sapiens
gactatcgtcttcctacacatagga

SEQ ID NO: 21084 - DNA, 25 bp, Homo sapiens
ataggaggctcattctctggacaca

SEQ ID NO: 21085 - DNA, 25 bp, Homo sapiens
atatcaccatgatttaatccagatc

SEQ ID NO: 21086 - DNA, 25 bp, Homo sapiens
atatattaggcactactgatttttt

SEQ ID NO: 21087 - DNA, 25 bp, Homo sapiens
gatgcactacacttttgatgtttga

SEQ ID NO: 21088 - DNA, 25 bp, Homo sapiens
aattgccaaatacctaggcccattg

SEQ ID NO: 21089 - DNA, 25 bp, Homo sapiens
tacctaggcccattgctgacgatta

SEQ ID NO: 21090 - DNA, 25 bp, Homo sapiens
ggcccattgctgacgattagttcta

SEQ ID NO: 21091 - DNA, 25 bp, Homo sapiens
ttccctacttcctctgcaaaaagat

SEQ ID NO: 21092 - DNA, 25 bp, Homo sapiens
gactggacttattactcccaaagca

SEQ ID NO: 21093 - DNA, 25 bp, Homo sapiens
gcaggctttgactctgattatgacc

SEQ ID NO: 21094 - DNA, 25 bp, Homo sapiens
gattatgaccaagctcttgctgaca

SEQ ID NO: 21095 - DNA, 25 bp, Homo sapiens
gaacagagcctcctggaatacctag

SEQ ID NO: 21096 - DNA, 25 bp, Homo sapiens
ggctgtaggaccatagtctattggg

SEQ ID NO: 21097 - DNA, 25 bp, Homo sapiens
gaaccgttaccagctggaaattcct

SEQ ID NO: 21098 - DNA, 25 bp, Homo sapiens
attcctgagaatttcaccactcgca

SEQ ID NO: 21099 - DNA, 25 bp, Homo sapiens
ttcaccactcgcaatttgccagaag

SEQ ID NO: 21100 - DNA, 25 bp, Homo sapiens
agggctgtaaacgatactggaccaa

SEQ ID NO: 21101 - DNA, 25 bp, Homo sapiens
catgcggcgactgttctataacttt

SEQ ID NO: 21102 - DNA, 25 bp, Homo sapiens
ggcagtctgctgtagagtgtatcgc

SEQ ID NO: 21103 - DNA, 25 bp, Homo sapiens
gtcagtcgctgccaggtgtgtatga

SEQ ID NO: 21104 - DNA, 25 bp, Homo sapiens
aaaagcctgtagggtggcacctgcc

SEQ ID NO: 21105 - DNA, 25 bp, Homo sapiens
aacagtcacctcacaaacctgaatg

SEQ ID NO: 21106 - DNA, 25 bp, Homo sapiens
catttgggctagactaccggacact

SEQ ID NO: 21107 - DNA, 25 bp, Homo sapiens
gccctcgggtccatagagatgagcc

SEQ ID NO: 21108 - DNA, 25 bp, Homo sapiens
gtgactattcatggctacctcagaa

SEQ ID NO: 21109 - DNA, 25 bp, Homo sapiens
actgtcttagactgctagctttctc

SEQ ID NO: 21110 - DNA, 25 bp, Homo sapiens
tttctccttaccgtcttgatcggaa

SEQ ID NO: 21111 - DNA, 25 bp, Homo sapiens
atcgctaatcagtcatttcttcatg

SEQ ID NO: 21112 - DNA, 25 bp, Homo sapiens
gtgtttccacacttaaattctctaa

SEQ ID NO: 21113 - DNA, 25 bp, Homo sapiens
gtcctcactcttcaaggaggcccac

SEQ ID NO: 21114 - DNA, 25 bp, Homo sapiens
gtcacccacagcaatgagaagcacg

SEQ ID NO: 21115 - DNA, 25 bp, Homo sapiens
agaagcacgaccttcatgttacctc

SEQ ID NO: 21116 - DNA, 25 bp, Homo sapiens
gcagggcagcagtgaaccagttgtc

SEQ ID NO: 21117 - DNA, 25 bp, Homo sapiens
gaaccagttgtccaagacctggccc

SEQ ID NO: 21118 - DNA, 25 bp, Homo sapiens
gtcataggggttccacagtcttttc

SEQ ID NO: 21119 - DNA, 25 bp, Homo sapiens
gaaatggaaacaccgttgtcagcac

SEQ ID NO: 21120 - DNA, 25 bp, Homo sapiens
gatggttgccgggtcatgttaattg

SEQ ID NO: 21121 - DNA, 25 bp, Homo sapiens
ggaatccagcagggttttctgccca

SEQ ID NO: 21122 - DNA, 25 bp, Homo sapiens
gggttttctgcccaaggatttgcaa

SEQ ID NO: 21123 - DNA, 25 bp, Homo sapiens
aagctgaagctctctgcaaacttga

SEQ ID NO: 21124 - DNA, 25 bp, Homo sapiens
agattgacacactgatcctgccaga

SEQ ID NO: 21125 - DNA, 25 bp, Homo sapiens
gtttattcctactctttatcatttc

SEQ ID NO: 21126 - DNA, 25 bp, Homo sapiens
catttcccaaccaactgtgaggctt

SEQ ID NO: 21127 - DNA, 25 bp, Homo sapiens
gcttgtatgaagcccctgtggcaca

SEQ ID NO: 21128 - DNA, 25 bp, Homo sapiens
tgtggcacatgtttaagcctcctcc

SEQ ID NO: 21129 - DNA, 25 bp, Homo sapiens
tgccgccgttgccatattaagtgtc

SEQ ID NO: 21130 - DNA, 25 bp, Homo sapiens
cccgatcatctcctagaacttcaat

SEQ ID NO: 21131 - DNA, 25 bp, Homo sapiens
tagacggccaagtcgacagcttgcc

SEQ ID NO: 21132 - DNA, 25 bp, Homo sapiens
caaacctagctaactgccttctatg

SEQ ID NO: 21133 - DNA, 25 bp, Homo sapiens
aaatatgatgaccccatggtacccg

SEQ ID NO: 21134 - DNA, 25 bp, Homo sapiens
gatcctcgaatcttttgctttttac

SEQ ID NO: 21135 - DNA, 25 bp, Homo sapiens
ataagccacctctgtaatcggatcc

SEQ ID NO: 21136 - DNA, 25 bp, Homo sapiens
ctcctctccacctgctggtgagagg

SEQ ID NO: 21137 - DNA, 25 bp, Homo sapiens
cccagatgttggaccaacacccctc

SEQ ID NO: 21138 - DNA, 25 bp, Homo sapiens
gagccaatgaacaggcatgcaagtg

SEQ ID NO: 21139 - DNA, 25 bp, Homo sapiens
cttgtcctcagggctacagcagtag

SEQ ID NO: 21140 - DNA, 25 bp, Homo sapiens
cagcagtagggaggtcagtgcttcg

SEQ ID NO: 21141 - DNA, 25 bp, Homo sapiens
tctgccccagataggtggtgccagt

SEQ ID NO: 21142 - DNA, 25 bp, Homo sapiens
ggtgccagtggcttattaattccga

SEQ ID NO: 21143 - DNA, 25 bp, Homo sapiens
tccgatactagtttgctttgctgac

SEQ ID NO: 21144 - DNA, 25 bp, Homo sapiens
tttgctgaccaaatgcctggtacca

SEQ ID NO: 21145 - DNA, 25 bp, Homo sapiens
ggggctctgtatatagctatgaaga

SEQ ID NO: 21146 - DNA, 25 bp, Homo sapiens
gtcgttaccagagatttacccatcg

SEQ ID NO: 21147 - DNA, 25 bp, Homo sapiens
gggagcagtgtggagagcttgcccc

SEQ ID NO: 21148 - DNA, 25 bp, Homo sapiens
cacagcctattccaagcctaaacgg

SEQ ID NO: 21149 - DNA, 25 bp, Homo sapiens
tctggatgtccctgagatcgtcata

SEQ ID NO: 21150 - DNA, 25 bp, Homo sapiens
cagccaagacgtagatccatccaag

SEQ ID NO: 21151 - DNA, 25 bp, Homo sapiens
aggtgagcagtaggtcatccagtcc

SEQ ID NO: 21152 - DNA, 25 bp, Homo sapiens
tgattactacctcaggaccaacctc

SEQ ID NO: 21153 - DNA, 25 bp, Homo sapiens
caactcgaagtcatccatggacccc

SEQ ID NO: 21154 - DNA, 25 bp, Homo sapiens
ggacccctgatgattccacagatac

SEQ ID NO: 21155 - DNA, 25 bp, Homo sapiens
ccatcccaatggcttatcttacact

SEQ ID NO: 21156 - DNA, 25 bp, Homo sapiens
gcaaaatacatctcgcctggtacag

SEQ ID NO: 21157 - DNA, 25 bp, Homo sapiens
cctttctacttactaccagcaatgc

SEQ ID NO: 21158 - DNA, 25 bp, Homo sapiens
cagccaagacgtagatccatccaag

SEQ ID NO: 21159 - DNA, 25 bp, Homo sapiens
aggtgagcagtaggtcatccagtcc

SEQ ID NO: 21160 - DNA, 25 bp, Homo sapiens
tgattactacctcaggaccaacctc

SEQ ID NO: 21161 - DNA, 25 bp, Homo sapiens
gaccaacctcagaaaagccaactcg

SEQ ID NO: 21162 - DNA, 25 bp, Homo sapiens
caactcgaagtcatccatggacccc

SEQ ID NO: 21163 - DNA, 25 bp, Homo sapiens
ggacccctgatgattccacagatac

SEQ ID NO: 21164 - DNA, 25 bp, Homo sapiens
ccatcccaatggcttatcttacact

SEQ ID NO: 21165 - DNA, 25 bp, Homo sapiens
gcaaaatacatctcgcctggtacag

SEQ ID NO: 21166 - DNA, 25 bp, Homo sapiens
caaaagcctttctacttactaccag

SEQ ID NO: 21167 - DNA, 25 bp, Homo sapiens
gacaaggcacttcatgattctctgg

SEQ ID NO: 21168 - DNA, 25 bp, Homo sapiens
gattctctgggaccgttacattttg

SEQ ID NO: 21169 - DNA, 25 bp, Homo sapiens
agctcgaaagagtttgcaaccccat

SEQ ID NO: 21170 - DNA, 25 bp, Homo sapiens
aaccccatcatcagcaaactttacc

SEQ ID NO: 21171 - DNA, 25 bp, Homo sapiens
gggacccaccatcgaagaagtggac

SEQ ID NO: 21172 - DNA, 25 bp, Homo sapiens
gaagtggactaagcttgcactcaag

SEQ ID NO: 21173 - DNA, 25 bp, Homo sapiens
caagtcagcgtaaacctctttgcct

SEQ ID NO: 21174 - DNA, 25 bp, Homo sapiens
gaaatgtccttgtgccaagtacgag

SEQ ID NO: 21175 - DNA, 25 bp, Homo sapiens
attcgaggtttctctttaatgcatt

SEQ ID NO: 21176 - DNA, 25 bp, Homo sapiens
attttgcgtgtttgctgacttgagc

SEQ ID NO: 21177 - DNA, 25 bp, Homo sapiens
gttcgtgcatggagatttgtttgag

SEQ ID NO: 21178 - DNA, 25 bp, Homo sapiens
gagaaaccttaagtttgcacacctg

SEQ ID NO: 21179 - DNA, 25 bp, Homo sapiens
tgcacacctgttctgtagaagcttg

SEQ ID NO: 21180 - DNA, 25 bp, Homo sapiens
gtttaccagagccatgcattcacca

SEQ ID NO: 21181 - DNA, 25 bp, Homo sapiens
tgcattcaccatgcacgatccatct

SEQ ID NO: 21182 - DNA, 25 bp, Homo sapiens
gtgtcataggacagcggatgcctcg

SEQ ID NO: 21183 - DNA, 25 bp, Homo sapiens
acagcggatgcctcgatactgtctt

SEQ ID NO: 21184 - DNA, 25 bp, Homo sapiens
tgggaatactgtcaacctcacaagc

SEQ ID NO: 21185 - DNA, 25 bp, Homo sapiens
acctcacaagccgaacagaaaccac

SEQ ID NO: 21186 - DNA, 25 bp, Homo sapiens
aattcagatccacaattccacttgg

SEQ ID NO: 21187 - DNA, 25 bp, Homo sapiens
tccacttggagcacagaggcccagt

SEQ ID NO: 21188 - DNA, 25 bp, Homo sapiens
atgcaagtttggtttctatccagaa

SEQ ID NO: 21189 - DNA, 25 bp, Homo sapiens
acagactaggttccagttttctcct

SEQ ID NO: 21190 - DNA, 25 bp, Homo sapiens
ccaggagcagttcttccctatggat

SEQ ID NO: 21191 - DNA, 25 bp, Homo sapiens
tttattaatttgcagacccagcccc

SEQ ID NO: 21192 - DNA, 25 bp, Homo sapiens
ataggatcggaaacctgctggtgcc

SEQ ID NO: 21193 - DNA, 25 bp, Homo sapiens
gctggtgcccaatgagaattactgc

SEQ ID NO: 21194 - DNA, 25 bp, Homo sapiens
tgaggactggctgatgcccattctg

SEQ ID NO: 21195 - DNA, 25 bp, Homo sapiens
tggacgccttctaagatgatcgccc

SEQ ID NO: 21196 - DNA, 25 bp, Homo sapiens
gcaaggagatcaacaacccagagtc

SEQ ID NO: 21197 - DNA, 25 bp, Homo sapiens
gtttagtcccgcacttacagacggc

SEQ ID NO: 21198 - DNA, 25 bp, Homo sapiens
tcttccattcctacaagaacccggg

SEQ ID NO: 21199 - DNA, 25 bp, Homo sapiens
tctcctggggcaagatccgggtgga

SEQ ID NO: 21200 - DNA, 25 bp, Homo sapiens
cctgcttgtggctgaaacctttgcc

SEQ ID NO: 21201 - DNA, 25 bp, Homo sapiens
aacgaggactgagcggctgcggtcc

SEQ ID NO: 21202 - DNA, 25 bp, Homo sapiens
gttggtttggatcgtttcaaggcgc

SEQ ID NO: 21203 - DNA, 25 bp, Homo sapiens
cgtttcaaggcgcacagcccagaac

SEQ ID NO: 21204 - DNA, 25 bp, Homo sapiens
gaacctccacaacagctactatagt

SEQ ID NO: 21205 - DNA, 25 bp, Homo sapiens
tactatagtgttcctgagctgccaa

SEQ ID NO: 21206 - DNA, 25 bp, Homo sapiens
gctgccaacgatacctgaggggggt

SEQ ID NO: 21207 - DNA, 25 bp, Homo sapiens
tgatcaagagtgcaccttctttttc

SEQ ID NO: 21208 - DNA, 25 bp, Homo sapiens
aaacactgtgctttccatcttagaa

SEQ ID NO: 21209 - DNA, 25 bp, Homo sapiens
aaccatctgtattagccttgtgcct

SEQ ID NO: 21210 - DNA, 25 bp, Homo sapiens
atgacactgagttcttctactggag

SEQ ID NO: 21211 - DNA, 25 bp, Homo sapiens
gagttggtttctaaatgcctagccg

SEQ ID NO: 21212 - DNA, 25 bp, Homo sapiens
aaatgcctagccgagtattcttctc

SEQ ID NO: 21213 - DNA, 25 bp, Homo sapiens
aaccccaggggctgagcttttgaag

SEQ ID NO: 21214 - DNA, 25 bp, Homo sapiens
tcagtctttgactcagatgccgaag

SEQ ID NO: 21215 - DNA, 25 bp, Homo sapiens
ctggctgtcgacttgctggagaaga

SEQ ID NO: 21216 - DNA, 25 bp, Homo sapiens
tttgctcagtaccacgatcctgatg

SEQ ID NO: 21217 - DNA, 25 bp, Homo sapiens
tgaaccagtggccgatccttatgat

SEQ ID NO: 21218 - DNA, 25 bp, Homo sapiens
tgaagtcatcagctttgtgccacca

SEQ ID NO: 21219 - DNA, 25 bp, Homo sapiens
agagatggagtcctgagcacctggt

SEQ ID NO: 21220 - DNA, 25 bp, Homo sapiens
cacctggtttctgttctgttgatcc

SEQ ID NO: 21221 - DNA, 25 bp, Homo sapiens
gttgatcccacttcactgtgagggg

SEQ ID NO: 21222 - DNA, 25 bp, Homo sapiens
gttgcagagatttcctccatggtgg

SEQ ID NO: 21223 - DNA, 25 bp, Homo sapiens
agaacattgtttcctggtacagacc

SEQ ID NO: 21224 - DNA, 25 bp, Homo sapiens
gcccatgtagctggcaagctgcaaa

SEQ ID NO: 21225 - DNA, 25 bp, Homo sapiens
gcaagctgcaaaaggcctgtgatcc

SEQ ID NO: 21226 - DNA, 25 bp, Homo sapiens
gatccaggaaagatgtcccacaggg

SEQ ID NO: 21227 - DNA, 25 bp, Homo sapiens
agcccacggggcaaagctgctgggc

SEQ ID NO: 21228 - DNA, 25 bp, Homo sapiens
acctgctgctgtatgaatagctgtg

SEQ ID NO: 21229 - DNA, 25 bp, Homo sapiens
ccacctgttgtcctgaactgtgagt

SEQ ID NO: 21230 - DNA, 25 bp, Homo sapiens
tgaactgtgagtcctgatcctaacc

SEQ ID NO: 21231 - DNA, 25 bp, Homo sapiens
aggactctagaagctcaggttccct

SEQ ID NO: 21232 - DNA, 25 bp, Homo sapiens
tctagaagctcaggttccctgccac

SEQ ID NO: 21233 - DNA, 25 bp, Homo sapiens
ttccctgccacactatttgagttgg

SEQ ID NO: 21234 - DNA, 25 bp, Homo sapiens
ccacactatttgagttggccaagaa

SEQ ID NO: 21235 - DNA, 25 bp, Homo sapiens
cagtaacacctgaggctttttctgg

SEQ ID NO: 21236 - DNA, 25 bp, Homo sapiens
cacctgaggctttttctggaactgt

SEQ ID NO: 21237 - DNA, 25 bp, Homo sapiens
gaggctttttctggaactgttatag

SEQ ID NO: 21238 - DNA, 25 bp, Homo sapiens
gaaaaagaatttgtatcaccttcct

SEQ ID NO: 21239 - DNA, 25 bp, Homo sapiens
cactacccactattccagaacgaaa

SEQ ID NO: 21240 - DNA, 25 bp, Homo sapiens
tacccactattccagaacgaaagga

SEQ ID NO: 21241 - DNA, 25 bp, Homo sapiens
tttaaagctgccagattgcaacaga

SEQ ID NO: 21242 - DNA, 25 bp, Homo sapiens
gattgcaacagaaagactaggccct

SEQ ID NO: 21243 - DNA, 25 bp, Homo sapiens
cagaaagactaggccctgtctagga

SEQ ID NO: 21244 - DNA, 25 bp, Homo sapiens
gactaggccctgtctaggaaatggg

SEQ ID NO: 21245 - DNA, 25 bp, Homo sapiens
ggccctgtctaggaaatgggaattt

SEQ ID NO: 21246 - DNA, 25 bp, Homo sapiens
tctgtgcacaaatccatcaaccgtt

SEQ ID NO: 21247 - DNA, 25 bp, Homo sapiens
cgagcgggaggatatcacccacacc

SEQ ID NO: 21248 - DNA, 25 bp, Homo sapiens
atggccatgcggatccgtgtgggcc

SEQ ID NO: 21249 - DNA, 25 bp, Homo sapiens
ggcagtgactttgacgtctttgccc

SEQ ID NO: 21250 - DNA, 25 bp, Homo sapiens
aacaccgctgaggagtacgtctgcc

SEQ ID NO: 21251 - DNA, 25 bp, Homo sapiens
gcaccgtcagctacaatgggatctt

SEQ ID NO: 21252 - DNA, 25 bp, Homo sapiens
tggagcctttctctggtaaagccct

SEQ ID NO: 21253 - DNA, 25 bp, Homo sapiens
aaagccctgtgttcctggagcattt

SEQ ID NO: 21254 - DNA, 25 bp, Homo sapiens
ttgaccgccaactgacaacatgcta

SEQ ID NO: 21255 - DNA, 25 bp, Homo sapiens
gcatgtgtgatttcaccccacagac

SEQ ID NO: 21256 - DNA, 25 bp, Homo sapiens
accccacagacacttacatggcgct

SEQ ID NO: 21257 - DNA, 25 bp, Homo sapiens
ggagctgaatatgccacttaccaga

SEQ ID NO: 21258 - DNA, 25 bp, Homo sapiens
taccagactaaatcaaccactccag

SEQ ID NO: 21259 - DNA, 25 bp, Homo sapiens
aatagattccacaacctggtttgcc

SEQ ID NO: 21260 - DNA, 25 bp, Homo sapiens
acttatagttgtgatcctgcacctg

SEQ ID NO: 21261 - DNA, 25 bp, Homo sapiens
gcacctggaccagatccattttcac

SEQ ID NO: 21262 - DNA, 25 bp, Homo sapiens
agtgtggagtcgtgctgctccagag

SEQ ID NO: 21263 - DNA, 25 bp, Homo sapiens
gtttttacctcgatggcagcgacac

SEQ ID NO: 21264 - DNA, 25 bp, Homo sapiens
ggcagcgacacaattgtctgtgaca

SEQ ID NO: 21265 - DNA, 25 bp, Homo sapiens
gtaacagtacttgggatcccccagt

SEQ ID NO: 21266 - DNA, 25 bp, Homo sapiens
gtcctaggcctacttacaagcctcc

SEQ ID NO: 21267 - DNA, 25 bp, Homo sapiens
tacaagcctccagtctcaaattatc

SEQ ID NO: 21268 - DNA, 25 bp, Homo sapiens
tttgtggtgggcgctggggaagtac

SEQ ID NO: 21269 - DNA, 25 bp, Homo sapiens
gtgggcgctggggaagtacgtccca

SEQ ID NO: 21270 - DNA, 25 bp, Homo sapiens
gctggggaagtacgtcccagcggcc

SEQ ID NO: 21271 - DNA, 25 bp, Homo sapiens
tcccagcggcctcagggtctaagga

SEQ ID NO: 21272 - DNA, 25 bp, Homo sapiens
ggcctcagggtctaaggagcgctag

SEQ ID NO: 21273 - DNA, 25 bp, Homo sapiens
tctaaggagcgctagtgccttgccc

SEQ ID NO: 21274 - DNA, 25 bp, Homo sapiens
ccacaggtgcgggaccatctgatgt

SEQ ID NO: 21275 - DNA, 25 bp, Homo sapiens
ggtgcgggaccatctgatgtgatgt

SEQ ID NO: 21276 - DNA, 25 bp, Homo sapiens
gatgtgatgtgaatactcttcccac

SEQ ID NO: 21277 - DNA, 25 bp, Homo sapiens
tgaatactcttcccacatacattaa

SEQ ID NO: 21278 - DNA, 25 bp, Homo sapiens
ttcccacatacattaaacacactta

SEQ ID NO: 21279 - DNA, 25 bp, Homo sapiens
gggctgagctggtggatgctcttca

SEQ ID NO: 21280 - DNA, 25 bp, Homo sapiens
gatgctcttcagttcgtgtgtggag

SEQ ID NO: 21281 - DNA, 25 bp, Homo sapiens
ggagacaggggcttttatttcaaca

SEQ ID NO: 21282 - DNA, 25 bp, Homo sapiens
ttttatttcaacaagcccacagggt

SEQ ID NO: 21283 - DNA, 25 bp, Homo sapiens
tcaacaagcccacagggtatggctc

SEQ ID NO: 21284 - DNA, 25 bp, Homo sapiens
tatggctccagcagtcggagggcgc

SEQ ID NO: 21285 - DNA, 25 bp, Homo sapiens
atcgtggatgagtgctgcttccgga

SEQ ID NO: 21286 - DNA, 25 bp, Homo sapiens
ctgcttccggagctgtgatctaagg

SEQ ID NO: 21287 - DNA, 25 bp, Homo sapiens
aggctggagatgtattgcgcacccc

SEQ ID NO: 21288 - DNA, 25 bp, Homo sapiens
catgcccaagacccagaaggaagta

SEQ ID NO: 21289 - DNA, 25 bp, Homo sapiens
ggatgtaggaagaccctcctgagga

SEQ ID NO: 21290 - DNA, 25 bp, Homo sapiens
ctccacctctgggaagctgagcatg

SEQ ID NO: 21291 - DNA, 25 bp, Homo sapiens
gagcatgtggtcctggaaatccctt

SEQ ID NO: 21292 - DNA, 25 bp, Homo sapiens
gaaatcccttattgagggcccagac

SEQ ID NO: 21293 - DNA, 25 bp, Homo sapiens
cagacagggcatccccaagcagaaa

SEQ ID NO: 21294 - DNA, 25 bp, Homo sapiens
gcatccccaagcagaaaggcaacca

SEQ ID NO: 21295 - DNA, 25 bp, Homo sapiens
ggcaaccatggcaggtgggctagcc

SEQ ID NO: 21296 - DNA, 25 bp, Homo sapiens
aacctgtctcccagggagcagggga

SEQ ID NO: 21297 - DNA, 25 bp, Homo sapiens
ggcccatccatcttatgaggatccc

SEQ ID NO: 21298 - DNA, 25 bp, Homo sapiens
ggctggctatgggagtctgagtgtg

SEQ ID NO: 21299 - DNA, 25 bp, Homo sapiens
ggagtctgagtgtgcacaagcagtg

SEQ ID NO: 21300 - DNA, 25 bp, Homo sapiens
gtgaaagaggatccagccctgagca

SEQ ID NO: 21301 - DNA, 25 bp, Homo sapiens
gagtattacattggccttgggggac

SEQ ID NO: 21302 - DNA, 25 bp, Homo sapiens
gaagttctgacttttcagggctacc

SEQ ID NO: 21303 - DNA, 25 bp, Homo sapiens
ttcagggctaccttatttctactaa

SEQ ID NO: 21304 - DNA, 25 bp, Homo sapiens
ttatttctactaaggacccagagca

SEQ ID NO: 21305 - DNA, 25 bp, Homo sapiens
tgccattccttcgcacagatgaaac

SEQ ID NO: 21306 - DNA, 25 bp, Homo sapiens
gaaactgagctgggactggaaagga

SEQ ID NO: 21307 - DNA, 25 bp, Homo sapiens
cctgggttctgggtataatttgcac

SEQ ID NO: 21308 - DNA, 25 bp, Homo sapiens
tttgcacttttgagactggtagcta

SEQ ID NO: 21309 - DNA, 25 bp, Homo sapiens
ggtagctaaccatcttatgagtgcc

SEQ ID NO: 21310 - DNA, 25 bp, Homo sapiens
acaattactgtcaggtgtcatcact

SEQ ID NO: 21311 - DNA, 25 bp, Homo sapiens
gtgaatttgctgcttctgagaggca

SEQ ID NO: 21312 - DNA, 25 bp, Homo sapiens
tcagatgtgtggtcctttggcgtgc

SEQ ID NO: 21313 - DNA, 25 bp, Homo sapiens
ggcgtgctcctctgggagctgatga

SEQ ID NO: 21314 - DNA, 25 bp, Homo sapiens
ctgcccagaccccttatatgaagta

SEQ ID NO: 21315 - DNA, 25 bp, Homo sapiens
gctggcaccctaaagccgaaatgcg

SEQ ID NO: 21316 - DNA, 25 bp, Homo sapiens
gcccatccttttctgaactggtgtc

SEQ ID NO: 21317 - DNA, 25 bp, Homo sapiens
actggtgtcccggatatcagcgatc

SEQ ID NO: 21318 - DNA, 25 bp, Homo sapiens
cgatcttctctactttcattgggga

SEQ ID NO: 21319 - DNA, 25 bp, Homo sapiens
ccagcctccttctgggagacatcat

SEQ ID NO: 21320 - DNA, 25 bp, Homo sapiens
aacagtccacactttgtccaatggt

SEQ ID NO: 21321 - DNA, 25 bp, Homo sapiens
gtccaatggttttttcactgcctga

SEQ ID NO: 21322 - DNA, 25 bp, Homo sapiens
aaggccatcgatattctttgctctt

SEQ ID NO: 21323 - DNA, 25 bp, Homo sapiens
tgcttatgccatgcagatgtccctg

SEQ ID NO: 21324 - DNA, 25 bp, Homo sapiens
gtttggccaggcggaatcagcagac

SEQ ID NO: 21325 - DNA, 25 bp, Homo sapiens
tgccagctcagctatggacacatcc

SEQ ID NO: 21326 - DNA, 25 bp, Homo sapiens
acacatccgagccagccaaggagga

SEQ ID NO: 21327 - DNA, 25 bp, Homo sapiens
tgattacgacgtgatgcaggacccc

SEQ ID NO: 21328 - DNA, 25 bp, Homo sapiens
gagttccttcagagtgtcctagaga

SEQ ID NO: 21329 - DNA, 25 bp, Homo sapiens
tgggtcttggtgccagtgactttga

SEQ ID NO: 21330 - DNA, 25 bp, Homo sapiens
gtagatcccagtgctgatcctgagc

SEQ ID NO: 21331 - DNA, 25 bp, Homo sapiens
cagctgcagcttctgctgctgaggc

SEQ ID NO: 21332 - DNA, 25 bp, Homo sapiens
gacgatgccctgctgaagatgacca

SEQ ID NO: 21333 - DNA, 25 bp, Homo sapiens
agcaagagtttggccgcactgggct

SEQ ID NO: 21334 - DNA, 25 bp, Homo sapiens
agatgcgcatcctgatggtgggcct

SEQ ID NO: 21335 - DNA, 25 bp, Homo sapiens
tggatgccgcaggaaagaccaccat

SEQ ID NO: 21336 - DNA, 25 bp, Homo sapiens
gaccaccatcctatacaagctgaaa

SEQ ID NO: 21337 - DNA, 25 bp, Homo sapiens
gaaactgggggagatcgtcaccacc

SEQ ID NO: 21338 - DNA, 25 bp, Homo sapiens
caccatccctaccattgggttcaat

SEQ ID NO: 21339 - DNA, 25 bp, Homo sapiens
ccaggacaagattcgacccctctgg

SEQ ID NO: 21340 - DNA, 25 bp, Homo sapiens
tgctgtactccttgtctttgcaaac

SEQ ID NO: 21341 - DNA, 25 bp, Homo sapiens
ggatctgcctaatgctatgaacgct

SEQ ID NO: 21342 - DNA, 25 bp, Homo sapiens
cccttcgtcaccgtaactggtacat

SEQ ID NO: 21343 - DNA, 25 bp, Homo sapiens
gacgggctgtacgaaggcctggact

SEQ ID NO: 21344 - DNA, 25 bp, Homo sapiens
gaaagccagacagccctaacaaagc

SEQ ID NO: 21345 - DNA, 25 bp, Homo sapiens
gaagacattcaaggaacccagaacc

SEQ ID NO: 21346 - DNA, 25 bp, Homo sapiens
aacagcagcttctgaggaaaccttg

SEQ ID NO: 21347 - DNA, 25 bp, Homo sapiens
tgaggaaaccttgttcaacgcgtcc

SEQ ID NO: 21348 - DNA, 25 bp, Homo sapiens
cgtcccagcgcatcagcgagttaga

SEQ ID NO: 21349 - DNA, 25 bp, Homo sapiens
gcggaaagctgcccaaaactccggg

SEQ ID NO: 21350 - DNA, 25 bp, Homo sapiens
gaaaatggagatgcctagcacccca

SEQ ID NO: 21351 - DNA, 25 bp, Homo sapiens
gtgaacgagttgaaagcctttctca

SEQ ID NO: 21352 - DNA, 25 bp, Homo sapiens
gaggttattcttcagcatagtgctg

SEQ ID NO: 21353 - DNA, 25 bp, Homo sapiens
ttgccagagctgagatgttgttaga

SEQ ID NO: 21354 - DNA, 25 bp, Homo sapiens
gaagcagaaaaggcccaggtcgcag

SEQ ID NO: 21355 - DNA, 25 bp, Homo sapiens
aggcccaggtcgcagcagagaaggc

SEQ ID NO: 21356 - DNA, 25 bp, Homo sapiens
caggattggccaagtccatcggggt

SEQ ID NO: 21357 - DNA, 25 bp, Homo sapiens
caacttcaaccacaggctgctggag

SEQ ID NO: 21358 - DNA, 25 bp, Homo sapiens
gatgatcctcaacaagccagggctc

SEQ ID NO: 21359 - DNA, 25 bp, Homo sapiens
tcaagtacaagcctgtctgcaacca

SEQ ID NO: 21360 - DNA, 25 bp, Homo sapiens
gtggaatgtcatccttacttcaacc

SEQ ID NO: 21361 - DNA, 25 bp, Homo sapiens
tctggttgcctatagtgctctggga

SEQ ID NO: 21362 - DNA, 25 bp, Homo sapiens
ctaccagctgcagcgtggggttgtg

SEQ ID NO: 21363 - DNA, 25 bp, Homo sapiens
tgtggtcctggccaagagctacaat

SEQ ID NO: 21364 - DNA, 25 bp, Homo sapiens
tgacccttgatatttttgctggccc

SEQ ID NO: 21365 - DNA, 25 bp, Homo sapiens
cccccctaattatccattttctgat

SEQ ID NO: 21366 - DNA, 25 bp, Homo sapiens
gagggtgttgcacgacatctagcag

SEQ ID NO: 21367 - DNA, 25 bp, Homo sapiens
ctggctggaagcctggcagtgacac

SEQ ID NO: 21368 - DNA, 25 bp, Homo sapiens
ggctggaagcctggcagtgacacga

SEQ ID NO: 21369 - DNA, 25 bp, Homo sapiens
ctggaagcctggcagtgacacgatt

SEQ ID NO: 21370 - DNA, 25 bp, Homo sapiens
ccctccaaactccacaagtatggga

SEQ ID NO: 21371 - DNA, 25 bp, Homo sapiens
aaactccacaagtatgggaccctgg

SEQ ID NO: 21372 - DNA, 25 bp, Homo sapiens
tgggaccctggaggggtagggcaag

SEQ ID NO: 21373 - DNA, 25 bp, Homo sapiens
gtagggcaagggccttctcaatgcc

SEQ ID NO: 21374 - DNA, 25 bp, Homo sapiens
tagggcaagggccttctcaatgcct

SEQ ID NO: 21375 - DNA, 25 bp, Homo sapiens
gcctccacctagaagttgaattgtg

SEQ ID NO: 21376 - DNA, 25 bp, Homo sapiens
caacccaggcggacaaaaggcctag

SEQ ID NO: 21377 - DNA, 25 bp, Homo sapiens
gcggacaaaaggcctagaggtaaca

SEQ ID NO: 21378 - DNA, 25 bp, Homo sapiens
agtgcacttcttgtatttctaataa

SEQ ID NO: 21379 - DNA, 25 bp, Homo sapiens
gagatttgttatgttctggctttta

SEQ ID NO: 21380 - DNA, 25 bp, Homo sapiens
ccaaaagttaaggtcagcttgttca

SEQ ID NO: 21381 - DNA, 25 bp, Homo sapiens
gaagaagttcactcagaccttcctg

SEQ ID NO: 21382 - DNA, 25 bp, Homo sapiens
ttcactcagaccttcctgaattcag

SEQ ID NO: 21383 - DNA, 25 bp, Homo sapiens
gagggaaatctggcgaaaccttcgt

SEQ ID NO: 21384 - DNA, 25 bp, Homo sapiens
gaaaccttcgtttgagggactgatg

SEQ ID NO: 21385 - DNA, 25 bp, Homo sapiens
gatgtgagtgtatgtccacctcact

SEQ ID NO: 21386 - DNA, 25 bp, Homo sapiens
gtatgtccacctcactggtggcacc

SEQ ID NO: 21387 - DNA, 25 bp, Homo sapiens
gtggcaccgagaaacttacttcctt

SEQ ID NO: 21388 - DNA, 25 bp, Homo sapiens
tacttccttgtattaagtgcacttc

SEQ ID NO: 21389 - DNA, 25 bp, Homo sapiens
gattgcatagtctgtaatcctctca

SEQ ID NO: 21390 - DNA, 25 bp, Homo sapiens
aaaacctctctgaatgatgaccctt

SEQ ID NO: 21391 - DNA, 25 bp, Homo sapiens
aatgatgacccttccttaatactgg

SEQ ID NO: 21392 - DNA, 25 bp, Homo sapiens
gggtgatgtgtgaatatttgtttgt

SEQ ID NO: 21393 - DNA, 25 bp, Homo sapiens
ggcagacagggtctcactttgtcac

SEQ ID NO: 21394 - DNA, 25 bp, Homo sapiens
actttgtcacccaggctaggagtgc

SEQ ID NO: 21395 - DNA, 25 bp, Homo sapiens
gagtgcagtggtgcaatctcagctc

SEQ ID NO: 21396 - DNA, 25 bp, Homo sapiens
cctctgcctcctgagttcaagtgat

SEQ ID NO: 21397 - DNA, 25 bp, Homo sapiens
ctacaggtatgcaccaccatgcctg

SEQ ID NO: 21398 - DNA, 25 bp, Homo sapiens
acaggcataagccactgcgcctggc

SEQ ID NO: 21399 - DNA, 25 bp, Homo sapiens
cgcctggccttgatgtgtgaatatt

SEQ ID NO: 21400 - DNA, 25 bp, Homo sapiens
acctcttcggatatcgtccttatga

SEQ ID NO: 21401 - DNA, 25 bp, Homo sapiens
ttagcccccgggagaatatcctggt

SEQ ID NO: 21402 - DNA, 25 bp, Homo sapiens
atatcctggtttcacttggagctgt

SEQ ID NO: 21403 - DNA, 25 bp, Homo sapiens
gtgggtgagggcttccacaactacc

SEQ ID NO: 21404 - DNA, 25 bp, Homo sapiens
gactactctgccagtgagtaccgct

SEQ ID NO: 21405 - DNA, 25 bp, Homo sapiens
ggagtacgctagacttgtctgacct

SEQ ID NO: 21406 - DNA, 25 bp, Homo sapiens
gcttgtgccctggtatttctggggt

SEQ ID NO: 21407 - DNA, 25 bp, Homo sapiens
aacagtgtgttcgttgccactttct

SEQ ID NO: 21408 - DNA, 25 bp, Homo sapiens
ttgccactttcttgcgatatgctgt

SEQ ID NO: 21409 - DNA, 25 bp, Homo sapiens
gctgtggtgcttaatgccacctggc

SEQ ID NO: 21410 - DNA, 25 bp, Homo sapiens
tggctggtgaacagtgctgcccacc

SEQ ID NO: 21411 - DNA, 25 bp, Homo sapiens
gcctgaggtcgtgcgcaaggactac

SEQ ID NO: 21412 - DNA, 25 bp, Homo sapiens
cgccaagatggagacctactgcagc

SEQ ID NO: 21413 - DNA, 25 bp, Homo sapiens
ctactgcagcagtggctccacagac

SEQ ID NO: 21414 - DNA, 25 bp, Homo sapiens
accaccccatggactactactggtg

SEQ ID NO: 21415 - DNA, 25 bp, Homo sapiens
gaatgcagatcatgacccacttgcc

SEQ ID NO: 21416 - DNA, 25 bp, Homo sapiens
ctggagccatctccgacatgatcta

SEQ ID NO: 21417 - DNA, 25 bp, Homo sapiens
tacatccgctgaagagtctcgctgt

SEQ ID NO: 21418 - DNA, 25 bp, Homo sapiens
tatccaccatgccaggaagacccat

SEQ ID NO: 21419 - DNA, 25 bp, Homo sapiens
gtgagtgacttgggccttcacaaac

SEQ ID NO: 21420 - DNA, 25 bp, Homo sapiens
cagaggcctctaaatctcagggcaa

SEQ ID NO: 21421 - DNA, 25 bp, Homo sapiens
acatggtgaatctatctctccggag

SEQ ID NO: 21422 - DNA, 25 bp, Homo sapiens
cagggacacgtggggtgtgctgctg

SEQ ID NO: 21423 - DNA, 25 bp, Homo sapiens
ggacagggctgtggagatggctccg

SEQ ID NO: 21424 - DNA, 25 bp, Homo sapiens
tggctccggcggcttggggaaagcc

SEQ ID NO: 21425 - DNA, 25 bp, Homo sapiens
attgccaaaactcaagtcacctcag

SEQ ID NO: 21426 - DNA, 25 bp, Homo sapiens
gtcacctcagtaccatccaggaggc

SEQ ID NO: 21427 - DNA, 25 bp, Homo sapiens
ggaggctgggtattgtcctgcctct

SEQ ID NO: 21428 - DNA, 25 bp, Homo sapiens
ctgccttttctgtctcagcgggcag

SEQ ID NO: 21429 - DNA, 25 bp, Homo sapiens
ggccatcagtatttattgcctccgt

SEQ ID NO: 21430 - DNA, 25 bp, Homo sapiens
ttccctgacccagccaggaacaaac

SEQ ID NO: 21431 - DNA, 25 bp, Homo sapiens
tgcacacattgctgagagccgtctc

SEQ ID NO: 21432 - DNA, 25 bp, Homo sapiens
ccaggctcaggcagaggcgcctgtc

SEQ ID NO: 21433 - DNA, 25 bp, Homo sapiens
aaagtcacccaaacacttctgcttt

SEQ ID NO: 21434 - DNA, 25 bp, Homo sapiens
tgctttcacttaagtgtctggcccg

SEQ ID NO: 21435 - DNA, 25 bp, Homo sapiens
gtctggcccgcaatactgtaggaac

SEQ ID NO: 21436 - DNA, 25 bp, Homo sapiens
aatatccacagtactcactttttcc

SEQ ID NO: 21437 - DNA, 25 bp, Homo sapiens
gtactcactttttccaaatgatcct

SEQ ID NO: 21438 - DNA, 25 bp, Homo sapiens
gaaatatctttctcttacctgttat

SEQ ID NO: 21439 - DNA, 25 bp, Homo sapiens
tatgtgccaaagctttactactgtg

SEQ ID NO: 21440 - DNA, 25 bp, Homo sapiens
gggagtttcctgagggttttctcat

SEQ ID NO: 21441 - DNA, 25 bp, Homo sapiens
aaatgagggctgcacattgcctgtt

SEQ ID NO: 21442 - DNA, 25 bp, Homo sapiens
attgcctgttctgcttcgaagtatt

SEQ ID NO: 21443 - DNA, 25 bp, Homo sapiens
gaaagcatatgcagccaaccaagat

SEQ ID NO: 21444 - DNA, 25 bp, Homo sapiens
ggcaccagcatttggttcttctcaa

SEQ ID NO: 21445 - DNA, 25 bp, Homo sapiens
agttgaccattatctctattcttaa

SEQ ID NO: 21446 - DNA, 25 bp, Homo sapiens
ttcacagctggcccgttggaagaag

SEQ ID NO: 21447 - DNA, 25 bp, Homo sapiens
gaagaagagcggtttggcttccctg

SEQ ID NO: 21448 - DNA, 25 bp, Homo sapiens
ggtctccctctttggggagctttct

SEQ ID NO: 21449 - DNA, 25 bp, Homo sapiens
ttctcttgtgtctgccactttggaa

SEQ ID NO: 21450 - DNA, 25 bp, Homo sapiens
gcttccatttcaagtctgggtcctt

SEQ ID NO: 21451 - DNA, 25 bp, Homo sapiens
agaaactcttgggccagttctctga

SEQ ID NO: 21452 - DNA, 25 bp, Homo sapiens
aaaagaaacgcatcctgcactgcct

SEQ ID NO: 21453 - DNA, 25 bp, Homo sapiens
tgcactgcctggggcttgcagaaga

SEQ ID NO: 21454 - DNA, 25 bp, Homo sapiens
gtagcacttccaagatggcaccagc

SEQ ID NO: 21455 - DNA, 25 bp, Homo sapiens
gagaagctgctcaattatgcacccc

SEQ ID NO: 21456 - DNA, 25 bp, Homo sapiens
tgctcaattatgcacccctggagaa

SEQ ID NO: 21457 - DNA, 25 bp, Homo sapiens
attatgcacccctggagaagtgacc

SEQ ID NO: 21458 - DNA, 25 bp, Homo sapiens
ggcatccgggagctggcgtaatgcc

SEQ ID NO: 21459 - DNA, 25 bp, Homo sapiens
tccgggagctggcgtaatgcctggc

SEQ ID NO: 21460 - DNA, 25 bp, Homo sapiens
ggaaccatccagtaaaggtctttca

SEQ ID NO: 21461 - DNA, 25 bp, Homo sapiens
ctgcttcacttgtggcaagatcgtc

SEQ ID NO: 21462 - DNA, 25 bp, Homo sapiens
cacttgtggcaagatcgtcggcaac

SEQ ID NO: 21463 - DNA, 25 bp, Homo sapiens
ggcaagatcgtcggcaacaagtggg

SEQ ID NO: 21464 - DNA, 25 bp, Homo sapiens
ggcaacaagtgggaggcttacctgg

SEQ ID NO: 21465 - DNA, 25 bp, Homo sapiens
caagtgggaggcttacctggggctg

SEQ ID NO: 21466 - DNA, 25 bp, Homo sapiens
gactatgtaaactacttctcttgtt

SEQ ID NO: 21467 - DNA, 25 bp, Homo sapiens
ttcacctagatttttttcccaattg

SEQ ID NO: 21468 - DNA, 25 bp, Homo sapiens
aactggaagtctgaagcgagccctg

SEQ ID NO: 21469 - DNA, 25 bp, Homo sapiens
ccctgcacaatgccgaatgccagaa

SEQ ID NO: 21470 - DNA, 25 bp, Homo sapiens
tgccagaagactgtcaccatctcca

SEQ ID NO: 21471 - DNA, 25 bp, Homo sapiens
catctccaagccctgtggcaaactg

SEQ ID NO: 21472 - DNA, 25 bp, Homo sapiens
gtggcaaactgaccaagcccaaacc

SEQ ID NO: 21473 - DNA, 25 bp, Homo sapiens
caagcccaaacctcaagcagaatct

SEQ ID NO: 21474 - DNA, 25 bp, Homo sapiens
gattaaaagatgtcacctgtggaac

SEQ ID NO: 21475 - DNA, 25 bp, Homo sapiens
aggacatcagcaaacaggatcagtt

SEQ ID NO: 21476 - DNA, 25 bp, Homo sapiens
tatgtaccgtaggctttgtattcaa

SEQ ID NO: 21477 - DNA, 25 bp, Homo sapiens
atgaccaaagcttctattttgccaa

SEQ ID NO: 21478 - DNA, 25 bp, Homo sapiens
aaatggccttaagtgtattcctgac

SEQ ID NO: 21479 - DNA, 25 bp, Homo sapiens
actcaaggtgccccttcagaattaa

SEQ ID NO: 21480 - DNA, 25 bp, Homo sapiens
ttgccattactcccagttagttacc

SEQ ID NO: 21481 - DNA, 25 bp, Homo sapiens
gttagttacccttgtcatttggcat

SEQ ID NO: 21482 - DNA, 25 bp, Homo sapiens
atttccaacttatgccttccagaaa

SEQ ID NO: 21483 - DNA, 25 bp, Homo sapiens
aacactactgcctaacacaaatctg

SEQ ID NO: 21484 - DNA, 25 bp, Homo sapiens
acaggctgtgccttattttgataat

SEQ ID NO: 21485 - DNA, 25 bp, Homo sapiens
ctgattccctagaagagaaccctct

SEQ ID NO: 21486 - DNA, 25 bp, Homo sapiens
gaaccctctactttttgtaagcact

SEQ ID NO: 21487 - DNA, 25 bp, Homo sapiens
taagcactactgactctcgctgtat

SEQ ID NO: 21488 - DNA, 25 bp, Homo sapiens
aaatgtgaccctcgccatggtaaat

SEQ ID NO: 21489 - DNA, 25 bp, Homo sapiens
acatggcttgctgcctgttataccg

SEQ ID NO: 21490 - DNA, 25 bp, Homo sapiens
tataccgtggtgacgtggttcccaa

SEQ ID NO: 21491 - DNA, 25 bp, Homo sapiens
atgtcaatgctgccattgccaccat

SEQ ID NO: 21492 - DNA, 25 bp, Homo sapiens
tgccccactggcttcaaggttggca

SEQ ID NO: 21493 - DNA, 25 bp, Homo sapiens
ttggcattaattaccagcctcccac

SEQ ID NO: 21494 - DNA, 25 bp, Homo sapiens
gcaataccacagctgttgccgaggc

SEQ ID NO: 21495 - DNA, 25 bp, Homo sapiens
gcctggaccacaagtttgacctgat

SEQ ID NO: 21496 - DNA, 25 bp, Homo sapiens
gacctgatgtatgccaagcgtgcct

SEQ ID NO: 21497 - DNA, 25 bp, Homo sapiens
cgtgaggacatggctgcccttgaga

SEQ ID NO: 21498 - DNA, 25 bp, Homo sapiens
tacactcctttgtcttggaactgtc

SEQ ID NO: 21499 - DNA, 25 bp, Homo sapiens
gctctttcctgaagcgcagcaagct

SEQ ID NO: 21500 - DNA, 25 bp, Homo sapiens
gggcaccgtcatgtatgtaggtctc

SEQ ID NO: 21501 - DNA, 25 bp, Homo sapiens
ggtctcacagatttcaagcctggct

SEQ ID NO: 21502 - DNA, 25 bp, Homo sapiens
gcctggctactggattggtgtccgc

SEQ ID NO: 21503 - DNA, 25 bp, Homo sapiens
gtgtccgctatgatgagccactggg

SEQ ID NO: 21504 - DNA, 25 bp, Homo sapiens
aatgccaggccaagtatggcgcctt

SEQ ID NO: 21505 - DNA, 25 bp, Homo sapiens
atggcgcctttgtcaagccagcagt

SEQ ID NO: 21506 - DNA, 25 bp, Homo sapiens
gccagcagtcgtgacggtgggggac

SEQ ID NO: 21507 - DNA, 25 bp, Homo sapiens
tgacacctaaggaattcccctgctt

SEQ ID NO: 21508 - DNA, 25 bp, Homo sapiens
tctcctgaccccattttaattttat

SEQ ID NO: 21509 - DNA, 25 bp, Homo sapiens
tttattcattttttcctttgccatt

SEQ ID NO: 21510 - DNA, 25 bp, Homo sapiens
acaatgtcaaacatcacagccggcc

SEQ ID NO: 21511 - DNA, 25 bp, Homo sapiens
gccgccaggaccagatacagcaagt

SEQ ID NO: 21512 - DNA, 25 bp, Homo sapiens
gtgaatcatggattagtcccattcc

SEQ ID NO: 21513 - DNA, 25 bp, Homo sapiens
ggccgtgaccaactataccagtggt

SEQ ID NO: 21514 - DNA, 25 bp, Homo sapiens
agattgtgtaccttgttcactgtgg

SEQ ID NO: 21515 - DNA, 25 bp, Homo sapiens
gaaccgttgatgaacctcttaactg

SEQ ID NO: 21516 - DNA, 25 bp, Homo sapiens
gattattctggttatcctggatgcc

SEQ ID NO: 21517 - DNA, 25 bp, Homo sapiens
atttcaaatatctttcaggctgctg

SEQ ID NO: 21518 - DNA, 25 bp, Homo sapiens
atgagtctgtgtataaggcttcgtt

SEQ ID NO: 21519 - DNA, 25 bp, Homo sapiens
acctctgaaggctacactttccaag

SEQ ID NO: 21520 - DNA, 25 bp, Homo sapiens
ctttccaagttcaggatggggctcc

SEQ ID NO: 21521 - DNA, 25 bp, Homo sapiens
aagggttcctgctttcacagaatta

SEQ ID NO: 21522 - DNA, 25 bp, Homo sapiens
tcagggtggtgacttcacacgccat

SEQ ID NO: 21523 - DNA, 25 bp, Homo sapiens
ggcactggtggcaagtccatctatg

SEQ ID NO: 21524 - DNA, 25 bp, Homo sapiens
taaagcatacgggtcctggcatctt

SEQ ID NO: 21525 - DNA, 25 bp, Homo sapiens
cctggcatcttgtccatggcaaatg

SEQ ID NO: 21526 - DNA, 25 bp, Homo sapiens
ggacccaacacaaatggttcccagt

SEQ ID NO: 21527 - DNA, 25 bp, Homo sapiens
gtttttcatctgcactgccaagact

SEQ ID NO: 21528 - DNA, 25 bp, Homo sapiens
ggagcgctttgggtccaggaatggc

SEQ ID NO: 21529 - DNA, 25 bp, Homo sapiens
tcttaaccaccagatcattccttct

SEQ ID NO: 21530 - DNA, 25 bp, Homo sapiens
atcctagaatctttgtgctctcgct

SEQ ID NO: 21531 - DNA, 25 bp, Homo sapiens
ctcccatgcctagctggattgcagg

SEQ ID NO: 21532 - DNA, 25 bp, Homo sapiens
tggactgtttgtctttgttctctgc

SEQ ID NO: 21533 - DNA, 25 bp, Homo sapiens
tgcctcttgtattctagcatccgca

SEQ ID NO: 21534 - DNA, 25 bp, Homo sapiens
gacagcgtcatccttggtgatacaa

SEQ ID NO: 21535 - DNA, 25 bp, Homo sapiens
gcagtatagctactccttattccac

SEQ ID NO: 21536 - DNA, 25 bp, Homo sapiens
tgcttggcttccttgtacatcatga

SEQ ID NO: 21537 - DNA, 25 bp, Homo sapiens
tgatgaccctgaccagctggtacag

SEQ ID NO: 21538 - DNA, 25 bp, Homo sapiens
gagcatgaccagcaagtggccagct

SEQ ID NO: 21539 - DNA, 25 bp, Homo sapiens
gtgtgggtcaagatcagctccagct

SEQ ID NO: 21540 - DNA, 25 bp, Homo sapiens
gacttcagctgaacctctgagtgcc

SEQ ID NO: 21541 - DNA, 25 bp, Homo sapiens
gtgccaaggacaccactggaactca

SEQ ID NO: 21542 - DNA, 25 bp, Homo sapiens
ggaactcacaaaggtctccttcacc

SEQ ID NO: 21543 - DNA, 25 bp, Homo sapiens
aggggaggacagacgttcacactgc

SEQ ID NO: 21544 - DNA, 25 bp, Homo sapiens
ttcacactgccacgtatgtctacgt

SEQ ID NO: 21545 - DNA, 25 bp, Homo sapiens
agaagtgaccagttcacctctgtgt

SEQ ID NO: 21546 - DNA, 25 bp, Homo sapiens
cacctctgtgtccttttgaaacatc

SEQ ID NO: 21547 - DNA, 25 bp, Homo sapiens
atcagcagtagggtccattccaaga

SEQ ID NO: 21548 - DNA, 25 bp, Homo sapiens
tgacgtcaggccctgtaacctgtgt

SEQ ID NO: 21549 - DNA, 25 bp, Homo sapiens
cagttgctcacattcaccaaagttt

SEQ ID NO: 21550 - DNA, 25 bp, Homo sapiens
gtttgttttcatgatcctgatggcc

SEQ ID NO: 21551 - DNA, 25 bp, Homo sapiens
ttcccccaaggattttcacacacgg

SEQ ID NO: 21552 - DNA, 25 bp, Homo sapiens
ctacgtctgcgaggattgcggctac

SEQ ID NO: 21553 - DNA, 25 bp, Homo sapiens
acctgcacgtgaacagtgcccatcc

SEQ ID NO: 21554 - DNA, 25 bp, Homo sapiens
cagccttcctcagggccaaggagga

SEQ ID NO: 21555 - DNA, 25 bp, Homo sapiens
ggagcagcaggatgacacagtctac

SEQ ID NO: 21556 - DNA, 25 bp, Homo sapiens
gcaaagtgaccttctcatgtgcggc

SEQ ID NO: 21557 - DNA, 25 bp, Homo sapiens
gcggctggttttggacagcgacacc

SEQ ID NO: 21558 - DNA, 25 bp, Homo sapiens
tggtgctgacccaggagcagctgca

SEQ ID NO: 21559 - DNA, 25 bp, Homo sapiens
agaaacgtgggttaagctcttcctg

SEQ ID NO: 21560 - DNA, 25 bp, Homo sapiens
tggcctctgccataatttgttgttc

SEQ ID NO: 21561 - DNA, 25 bp, Homo sapiens
ccctccttcctgaggggcctcaggg

SEQ ID NO: 21562 - DNA, 25 bp, Homo sapiens
tggggggtaggctgagaccccacca

SEQ ID NO: 21563 - DNA, 25 bp, Homo sapiens
ggttaagtgaggtccccttgattga

SEQ ID NO: 21564 - DNA, 25 bp, Homo sapiens
attgaggacttcaccccttgattaa

SEQ ID NO: 21565 - DNA, 25 bp, Homo sapiens
aggtcatcctgtacagttctacagc

SEQ ID NO: 21566 - DNA, 25 bp, Homo sapiens
cagcatgaataggcctgcctctcgc

SEQ ID NO: 21567 - DNA, 25 bp, Homo sapiens
ctccttccattacttcacaaacaag

SEQ ID NO: 21568 - DNA, 25 bp, Homo sapiens
ggaggacctttttatagccagaatc

SEQ ID NO: 21569 - DNA, 25 bp, Homo sapiens
ctccaccgccacctgtggaagaacc

SEQ ID NO: 21570 - DNA, 25 bp, Homo sapiens
gaaccagtctttgatgagtctcccc

SEQ ID NO: 21571 - DNA, 25 bp, Homo sapiens
cctcctcctccagaagattacgaag

SEQ ID NO: 21572 - DNA, 25 bp, Homo sapiens
tgaagaggacccaccgtgggctcca

SEQ ID NO: 21573 - DNA, 25 bp, Homo sapiens
tgggctccacgttcttacttggaaa

SEQ ID NO: 21574 - DNA, 25 bp, Homo sapiens
ggaagatgagctgtcctttcaggaa

SEQ ID NO: 21575 - DNA, 25 bp, Homo sapiens
gagtctatcatgcattattctgagt

SEQ ID NO: 21576 - DNA, 25 bp, Homo sapiens
agccagtccagtactatttcacgct

SEQ ID NO: 21577 - DNA, 25 bp, Homo sapiens
actatttcacgctggctcagcaacc

SEQ ID NO: 21578 - DNA, 25 bp, Homo sapiens
tgggcagatcatcatcgcacagcct

SEQ ID NO: 21579 - DNA, 25 bp, Homo sapiens
gtcagcaggtgcagattgtccaggc

SEQ ID NO: 21580 - DNA, 25 bp, Homo sapiens
cccaacaggcccagagtggcactgg

SEQ ID NO: 21581 - DNA, 25 bp, Homo sapiens
gtggcactggacagaccatgcaggt

SEQ ID NO: 21582 - DNA, 25 bp, Homo sapiens
cagcagatcatcactaacacaggag

SEQ ID NO: 21583 - DNA, 25 bp, Homo sapiens
caggagagatccagcagatcccggt

SEQ ID NO: 21584 - DNA, 25 bp, Homo sapiens
gcctgtatcaggcactcaagttgtg

SEQ ID NO: 21585 - DNA, 25 bp, Homo sapiens
gcagttcagccagttcacagatgga

SEQ ID NO: 21586 - DNA, 25 bp, Homo sapiens
agctctaccagatccagcaagtcac

SEQ ID NO: 21587 - DNA, 25 bp, Homo sapiens
caagagctatctgttccagctgctc

SEQ ID NO: 21588 - DNA, 25 bp, Homo sapiens
gagaccttaaacctcagaatctgct

SEQ ID NO: 21589 - DNA, 25 bp, Homo sapiens
cagagggggccatcaagctagcaga

SEQ ID NO: 21590 - DNA, 25 bp, Homo sapiens
cctgttcgtacttacacccatgagg

SEQ ID NO: 21591 - DNA, 25 bp, Homo sapiens
tcttccggatctttcggactctggg

SEQ ID NO: 21592 - DNA, 25 bp, Homo sapiens
ggggaccccagatgaggtggtgtgg

SEQ ID NO: 21593 - DNA, 25 bp, Homo sapiens
ggagttacttctatgcctgattaca

SEQ ID NO: 21594 - DNA, 25 bp, Homo sapiens
attacaagccaagtttccccaagtg

SEQ ID NO: 21595 - DNA, 25 bp, Homo sapiens
agttgtacctcccctggatgaagat

SEQ ID NO: 21596 - DNA, 25 bp, Homo sapiens
gatggacggagcttgttatcgcaaa

SEQ ID NO: 21597 - DNA, 25 bp, Homo sapiens
atcgcaaatgctgcactacgaccct

SEQ ID NO: 21598 - DNA, 25 bp, Homo sapiens
gaaaacgggcacccagggagcccag

SEQ ID NO: 21599 - DNA, 25 bp, Homo sapiens
ggagacaggacaagcaggctcaccg

SEQ ID NO: 21600 - DNA, 25 bp, Homo sapiens
gctccaaggtgttcctggaccaaag

SEQ ID NO: 21601 - DNA, 25 bp, Homo sapiens
ctacccggagcttcaggtttggacg

SEQ ID NO: 21602 - DNA, 25 bp, Homo sapiens
ggaccaattggagttccaggcccag

SEQ ID NO: 21603 - DNA, 25 bp, Homo sapiens
gacaggaccaacgggagcagctggg

SEQ ID NO: 21604 - DNA, 25 bp, Homo sapiens
ctgggcttcctggtttacatggacc

SEQ ID NO: 21605 - DNA, 25 bp, Homo sapiens
tacatggaccacccggggacaaggg

SEQ ID NO: 21606 - DNA, 25 bp, Homo sapiens
aaggagcgcctggattagatgcccc

SEQ ID NO: 21607 - DNA, 25 bp, Homo sapiens
gaagatggcttaccagtccaaggct

SEQ ID NO: 21608 - DNA, 25 bp, Homo sapiens
gctgctggaacaagtgatgcctcta

SEQ ID NO: 21609 - DNA, 25 bp, Homo sapiens
aggcccagaagttcctgatgaccgc

SEQ ID NO: 21610 - DNA, 25 bp, Homo sapiens
gtcaatgccatcttcgagtggtcca

SEQ ID NO: 21611 - DNA, 25 bp, Homo sapiens
caaagtgccaaaggatcttccccct

SEQ ID NO: 21612 - DNA, 25 bp, Homo sapiens
ctgacacaactctgctagacctgca

SEQ ID NO: 21613 - DNA, 25 bp, Homo sapiens
tgaagaaccttcacgttgtctacct

SEQ ID NO: 21614 - DNA, 25 bp, Homo sapiens
gttggatcaagtgacttctgcccac

SEQ ID NO: 21615 - DNA, 25 bp, Homo sapiens
aaggcttcttattcgggtgtgagtc

SEQ ID NO: 21616 - DNA, 25 bp, Homo sapiens
ttgcacaagtttcctgggctggacc

SEQ ID NO: 21617 - DNA, 25 bp, Homo sapiens
agcaacccggtccagtactgggaga

SEQ ID NO: 21618 - DNA, 25 bp, Homo sapiens
cagccatccaccttcagatgtgtct

SEQ ID NO: 21619 - DNA, 25 bp, Homo sapiens
gctctgccattcaactcggaaacta

SEQ ID NO: 21620 - DNA, 25 bp, Homo sapiens
caccacccacctatgatactgtgct

SEQ ID NO: 21621 - DNA, 25 bp, Homo sapiens
aacactcagattattcccagttgct

SEQ ID NO: 21622 - DNA, 25 bp, Homo sapiens
aagctatgttcttcatcatgaccca

SEQ ID NO: 21623 - DNA, 25 bp, Homo sapiens
ggacagagcctgagaagttcctccc

SEQ ID NO: 21624 - DNA, 25 bp, Homo sapiens
atccttacatatacacaccctttgg

SEQ ID NO: 21625 - DNA, 25 bp, Homo sapiens
ggcatgaggtttgctctcgtgaaca

SEQ ID NO: 21626 - DNA, 25 bp, Homo sapiens
agtcagagtccttcagaacttctcc

SEQ ID NO: 21627 - DNA, 25 bp, Homo sapiens
acagatccccctgaaattacgcttt

SEQ ID NO: 21628 - DNA, 25 bp, Homo sapiens
tacgctttggaggacttcttctaac

SEQ ID NO: 21629 - DNA, 25 bp, Homo sapiens
gtagatatggagcccattcacatgg

SEQ ID NO: 21630 - DNA, 25 bp, Homo sapiens
tgggaactactttgtcctaccatca

SEQ ID NO: 21631 - DNA, 25 bp, Homo sapiens
tcccacccaggctgatcattcagat

SEQ ID NO: 21632 - DNA, 25 bp, Homo sapiens
ttctctggatgactacttgggtttc

SEQ ID NO: 21633 - DNA, 25 bp, Homo sapiens
gtttcctagaacttgacttgcgtca

SEQ ID NO: 21634 - DNA, 25 bp, Homo sapiens
ttgcgtcacacgatcattcctgcaa

SEQ ID NO: 21635 - DNA, 25 bp, Homo sapiens
tgaacccccttaaagccaagacagc

SEQ ID NO: 21636 - DNA, 25 bp, Homo sapiens
aaggaggccgacgagaggccagccg

SEQ ID NO: 21637 - DNA, 25 bp, Homo sapiens
gaaccccaagctggacttaccaaat

SEQ ID NO: 21638 - DNA, 25 bp, Homo sapiens
taccaaatcgaccagaaacctcctt

SEQ ID NO: 21639 - DNA, 25 bp, Homo sapiens
ccatgaagttcatcgtgtggcgccg

SEQ ID NO: 21640 - DNA, 25 bp, Homo sapiens
tggcgccgctttaagtgggtcatca

SEQ ID NO: 21641 - DNA, 25 bp, Homo sapiens
ctctactctttgccgaactatttgt

SEQ ID NO: 21642 - DNA, 25 bp, Homo sapiens
gatgttctcaaagggtcccgggtct

SEQ ID NO: 21643 - DNA, 25 bp, Homo sapiens
aaaccgcgttagcactctacgagtt

SEQ ID NO: 21644 - DNA, 25 bp, Homo sapiens
tgctttctgctctggatcatgggat

SEQ ID NO: 21645 - DNA, 25 bp, Homo sapiens
ggatcataccctcagagtctgggcc

SEQ ID NO: 21646 - DNA, 25 bp, Homo sapiens
catgcagatcctgacagcgagcggc

SEQ ID NO: 21647 - DNA, 25 bp, Homo sapiens
gagcgggcagctgctgcagagcttc

SEQ ID NO: 21648 - DNA, 25 bp, Homo sapiens
aacaccttcgtgtctgggggatgtg

SEQ ID NO: 21649 - DNA, 25 bp, Homo sapiens
gccagtgcgtgcaggcctttgaaac

SEQ ID NO: 21650 - DNA, 25 bp, Homo sapiens
gtactaccccagtggagatgccttt

SEQ ID NO: 21651 - DNA, 25 bp, Homo sapiens
gatgcctttgcttcagggtcagatg

SEQ ID NO: 21652 - DNA, 25 bp, Homo sapiens
tggagcatccagcgtggacttctcc

SEQ ID NO: 21653 - DNA, 25 bp, Homo sapiens
ggcatctctcacagccaaagactgc

SEQ ID NO: 21654 - DNA, 25 bp, Homo sapiens
gagaaccaagtcagcgtctctgtca

SEQ ID NO: 21655 - DNA, 25 bp, Homo sapiens
tcagtcacaaatctatgggcgctcc

SEQ ID NO: 21656 - DNA, 25 bp, Homo sapiens
gctcccagactgtagccatgcaggg

SEQ ID NO: 21657 - DNA, 25 bp, Homo sapiens
tgagtgtgaacctgatgccagcgcc

SEQ ID NO: 21658 - DNA, 25 bp, Homo sapiens
gccagcctacaatgtcaactctgtg

SEQ ID NO: 21659 - DNA, 25 bp, Homo sapiens
gaacactctcaacgccatgaatggg

SEQ ID NO: 21660 - DNA, 25 bp, Homo sapiens
tacagcatgtcccagccaatgatga

SEQ ID NO: 21661 - DNA, 25 bp, Homo sapiens
gcatgatgggcacccagccatatgc

SEQ ID NO: 21662 - DNA, 25 bp, Homo sapiens
cggtaacatgatgtacacggccccc

SEQ ID NO: 21663 - DNA, 25 bp, Homo sapiens
ggcatgtccaaacagtctctcaatg

SEQ ID NO: 21664 - DNA, 25 bp, Homo sapiens
cacacctgtgcttgatagcgtgctg

SEQ ID NO: 21665 - DNA, 25 bp, Homo sapiens
tgagagcctcaggcttacagctgcc

SEQ ID NO: 21666 - DNA, 25 bp, Homo sapiens
gagacccagaaatctacacagaccc

SEQ ID NO: 21667 - DNA, 25 bp, Homo sapiens
gattcctgaaccctgacggatcaga

SEQ ID NO: 21668 - DNA, 25 bp, Homo sapiens
aagaattacaacatgccctgggggg

SEQ ID NO: 21669 - DNA, 25 bp, Homo sapiens
aatttgtgttccttgtgctggtgca

SEQ ID NO: 21670 - DNA, 25 bp, Homo sapiens
gtgctggtgcacttggacttggagc

SEQ ID NO: 21671 - DNA, 25 bp, Homo sapiens
atgtggagatccctgagtttgacct

SEQ ID NO: 21672 - DNA, 25 bp, Homo sapiens
gtttgacctcagcaggtacggcttc

SEQ ID NO: 21673 - DNA, 25 bp, Homo sapiens
gcttcggtctgatgcagccggaaca

SEQ ID NO: 21674 - DNA, 25 bp, Homo sapiens
agagctcgagagtatcctttggcaa

SEQ ID NO: 21675 - DNA, 25 bp, Homo sapiens
tcctccttcccttacggaattacat

SEQ ID NO: 21676 - DNA, 25 bp, Homo sapiens
ccttacggaattacatcttgatggc

SEQ ID NO: 21677 - DNA, 25 bp, Homo sapiens
cagcagagttgatgcagctagcctg

SEQ ID NO: 21678 - DNA, 25 bp, Homo sapiens
gatgcagctagcctgaaaggactga

SEQ ID NO: 21679 - DNA, 25 bp, Homo sapiens
tctgctgttgacaatggctctctgg

SEQ ID NO: 21680 - DNA, 25 bp, Homo sapiens
gccaacacgcctcatctgagggagc

SEQ ID NO: 21681 - DNA, 25 bp, Homo sapiens
ctgagggagcttcacttggacaaca

SEQ ID NO: 21682 - DNA, 25 bp, Homo sapiens
acaacaacaagcttaccagagtacc

SEQ ID NO: 21683 - DNA, 25 bp, Homo sapiens
cagagtacctggtgggctggcagag

SEQ ID NO: 21684 - DNA, 25 bp, Homo sapiens
ggctggcagagcataagtacatcca

SEQ ID NO: 21685 - DNA, 25 bp, Homo sapiens
gtacatccaggttgtctaccttcat

SEQ ID NO: 21686 - DNA, 25 bp, Homo sapiens
ctggcttcgactacaagttcctgga

SEQ ID NO: 21687 - DNA, 25 bp, Homo sapiens
agcttcctctggactatgccaagat

SEQ ID NO: 21688 - DNA, 25 bp, Homo sapiens
gccactacgtcatctacagggccac

SEQ ID NO: 21689 - DNA, 25 bp, Homo sapiens
atacctgcagcttcaatgtcattcc

SEQ ID NO: 21690 - DNA, 25 bp, Homo sapiens
tggagaagcccaagcgacggctgct

SEQ ID NO: 21691 - DNA, 25 bp, Homo sapiens
tgcacacttgcagcatgactgcccc

SEQ ID NO: 21692 - DNA, 25 bp, Homo sapiens
gcgcctcaagtgcgagttttgtggc

SEQ ID NO: 21693 - DNA, 25 bp, Homo sapiens
gttttgtggctgtgacttcagtggg

SEQ ID NO: 21694 - DNA, 25 bp, Homo sapiens
agagttctctgggctttggttatcc

SEQ ID NO: 21695 - DNA, 25 bp, Homo sapiens
ctcccaccaggacattcgaaagcga

SEQ ID NO: 21696 - DNA, 25 bp, Homo sapiens
atgatgcagtcttcatccgtgctgc

SEQ ID NO: 21697 - DNA, 25 bp, Homo sapiens
gaatcgtttctctgtgaacttccag

SEQ ID NO: 21698 - DNA, 25 bp, Homo sapiens
gtctcaagatctcagactcacagct

SEQ ID NO: 21699 - DNA, 25 bp, Homo sapiens
gatgccgcgatgtatttctgtgctt

SEQ ID NO: 21700 - DNA, 25 bp, Homo sapiens
ggggaccaaactctcggtcatacca

SEQ ID NO: 21701 - DNA, 25 bp, Homo sapiens
tgacaagtctgtctgcctattcacc

SEQ ID NO: 21702 - DNA, 25 bp, Homo sapiens
gagcaacagtgctgtggcctggagc

SEQ ID NO: 21703 - DNA, 25 bp, Homo sapiens
gcatgtgcaaacgccttcaacaaca

SEQ ID NO: 21704 - DNA, 25 bp, Homo sapiens
tccccagcccagaaagttcctgtga

SEQ ID NO: 21705 - DNA, 25 bp, Homo sapiens
cagtgattgggttccgaatcctcct

SEQ ID NO: 21706 - DNA, 25 bp, Homo sapiens
aagtggccgggtttaatctgctcat

SEQ ID NO: 21707 - DNA, 25 bp, Homo sapiens
gctcatgacgctgcggttgtggtcc

SEQ ID NO: 21708 - DNA, 25 bp, Homo sapiens
ggcattgaggccagtcctgacaaaa

SEQ ID NO: 21709 - DNA, 25 bp, Homo sapiens
cgcctgggacccaattatcttcata

SEQ ID NO: 21710 - DNA, 25 bp, Homo sapiens
tcatatacctgtgaactgtccctac

SEQ ID NO: 21711 - DNA, 25 bp, Homo sapiens
ggcccgatgtgcatgcaggacaatc

SEQ ID NO: 21712 - DNA, 25 bp, Homo sapiens
gctttggtgctccggaacaacagcc

SEQ ID NO: 21713 - DNA, 25 bp, Homo sapiens
gtgcggagattcaacactgccaatg

SEQ ID NO: 21714 - DNA, 25 bp, Homo sapiens
taacgttactcaggtgcgggcattc

SEQ ID NO: 21715 - DNA, 25 bp, Homo sapiens
tcaagaacttcactgaggtccaccc

SEQ ID NO: 21716 - DNA, 25 bp, Homo sapiens
tgactacgggagccacatccaggct

SEQ ID NO: 21717 - DNA, 25 bp, Homo sapiens
aagaatgcgattcacacctttgtgc

SEQ ID NO: 21718 - DNA, 25 bp, Homo sapiens
ggttgaacagatagccttcgaccca

SEQ ID NO: 21719 - DNA, 25 bp, Homo sapiens
aatcaccaatgaccagaatcgcctg

SEQ ID NO: 21720 - DNA, 25 bp, Homo sapiens
gaatcgcctgacacctgaagaaatc

SEQ ID NO: 21721 - DNA, 25 bp, Homo sapiens
gttggaaagctatgcctattctcta

SEQ ID NO: 21722 - DNA, 25 bp, Homo sapiens
gctgggaggtaaactttcctctgaa

SEQ ID NO: 21723 - DNA, 25 bp, Homo sapiens
ggaaagccaccaagatgctgacatt

SEQ ID NO: 21724 - DNA, 25 bp, Homo sapiens
ttcaaccaattatcagcaaactcta

SEQ ID NO: 21725 - DNA, 25 bp, Homo sapiens
aactctatggaagtgcaggccctcc

SEQ ID NO: 21726 - DNA, 25 bp, Homo sapiens
ctcccccaactggtgaagaggatac

SEQ ID NO: 21727 - DNA, 25 bp, Homo sapiens
gatgagttgtagacactgatctgct

SEQ ID NO: 21728 - DNA, 25 bp, Homo sapiens
gatctgctagtgctgtaatattgta

SEQ ID NO: 21729 - DNA, 25 bp, Homo sapiens
tactggactcaggaacttttgttag

SEQ ID NO: 21730 - DNA, 25 bp, Homo sapiens
cagcccctaaaggtaatgccagccc

SEQ ID NO: 21731 - DNA, 25 bp, Homo sapiens
agcagtcccctacaagtggtggggg

SEQ ID NO: 21732 - DNA, 25 bp, Homo sapiens
ggtgggggaaaagtagctccagctc

SEQ ID NO: 21733 - DNA, 25 bp, Homo sapiens
gctccagctcaaccatctgaggaag

SEQ ID NO: 21734 - DNA, 25 bp, Homo sapiens
gaactctagccgtggtccaggagac

SEQ ID NO: 21735 - DNA, 25 bp, Homo sapiens
cagatctgcacctgagccaaagaaa

SEQ ID NO: 21736 - DNA, 25 bp, Homo sapiens
aaatccagcttctaagttcagttct

SEQ ID NO: 21737 - DNA, 25 bp, Homo sapiens
gcaagcaagtatgctgctctctctg

SEQ ID NO: 21738 - DNA, 25 bp, Homo sapiens
ctgctctctctgttgatggtgaaga

SEQ ID NO: 21739 - DNA, 25 bp, Homo sapiens
ccgaatagacctctacatcctgtgc

SEQ ID NO: 21740 - DNA, 25 bp, Homo sapiens
tctctccaccctggaacattcgaga

SEQ ID NO: 21741 - DNA, 25 bp, Homo sapiens
acactgcagctcttttcagtttttg

SEQ ID NO: 21742 - DNA, 25 bp, Homo sapiens
acacaattcattctttgcagctaat

SEQ ID NO: 21743 - DNA, 25 bp, Homo sapiens
ttaagccgaagaagcctgggaatca

SEQ ID NO: 21744 - DNA, 25 bp, Homo sapiens
acagtgatccactttaacaacccta

SEQ ID NO: 21745 - DNA, 25 bp, Homo sapiens
acaaccctaaagttcaggcatctct

SEQ ID NO: 21746 - DNA, 25 bp, Homo sapiens
ttcaggcatctctggcagcgaacac

SEQ ID NO: 21747 - DNA, 25 bp, Homo sapiens
gcgaacactttcaccattacaggcc

SEQ ID NO: 21748 - DNA, 25 bp, Homo sapiens
gctacccagcatcttaaaccagctt

SEQ ID NO: 21749 - DNA, 25 bp, Homo sapiens
agcttggtgcggatagtctgactag

SEQ ID NO: 21750 - DNA, 25 bp, Homo sapiens
gtttaaggagactggccgaagctct

SEQ ID NO: 21751 - DNA, 25 bp, Homo sapiens
agaagttactgggagctgctatttt

SEQ ID NO: 21752 - DNA, 25 bp, Homo sapiens
tcgccgagctccagccgaaggagaa

SEQ ID NO: 21753 - DNA, 25 bp, Homo sapiens
taaggaggtctctgtaccatggctc

SEQ ID NO: 21754 - DNA, 25 bp, Homo sapiens
caaagcagactgcccgcaaatcgac

SEQ ID NO: 21755 - DNA, 25 bp, Homo sapiens
gcaactggctacaaaagccgctcgc

SEQ ID NO: 21756 - DNA, 25 bp, Homo sapiens
agagtgcgccctctactggaggggt

SEQ ID NO: 21757 - DNA, 25 bp, Homo sapiens
aaacctcatcgttacaggcctggta

SEQ ID NO: 21758 - DNA, 25 bp, Homo sapiens
tactgtggcgctccgtgaaattaga

SEQ ID NO: 21759 - DNA, 25 bp, Homo sapiens
gaacttctgattcgcaaacttccct

SEQ ID NO: 21760 - DNA, 25 bp, Homo sapiens
aaaacagatctgcgcttccagagcg

SEQ ID NO: 21761 - DNA, 25 bp, Homo sapiens
cgcagctatcggtgctttgcaggag

SEQ ID NO: 21762 - DNA, 25 bp, Homo sapiens
agacaccaacctgtgtgctatccat

SEQ ID NO: 21763 - DNA, 25 bp, Homo sapiens
cctgtgtgccattttaagagttact

SEQ ID NO: 21764 - DNA, 25 bp, Homo sapiens
gtttggtaacttttatgccttcact

SEQ ID NO: 21765 - DNA, 25 bp, Homo sapiens
acttttatgccttcactttacaaat

SEQ ID NO: 21766 - DNA, 25 bp, Homo sapiens
agcactatttacatacaggccatac

SEQ ID NO: 21767 - DNA, 25 bp, Homo sapiens
gaatggggaccttttgagttgaatt

SEQ ID NO: 21768 - DNA, 25 bp, Homo sapiens
tcacctcttctaatcttttaatgta

SEQ ID NO: 21769 - DNA, 25 bp, Homo sapiens
tcacctacgcgagtcttactttgag

SEQ ID NO: 21770 - DNA, 25 bp, Homo sapiens
gaccactgtatgtttacttctcacc

SEQ ID NO: 21771 - DNA, 25 bp, Homo sapiens
acttctcaccatttgagttgcccat

SEQ ID NO: 21772 - DNA, 25 bp, Homo sapiens
cccatcttgtttcacactagtcaca

SEQ ID NO: 21773 - DNA, 25 bp, Homo sapiens
tcacactagtcacattcttgtttta

SEQ ID NO: 21774 - DNA, 25 bp, Homo sapiens
ttctaagccagctggtaccaccaag

SEQ ID NO: 21775 - DNA, 25 bp, Homo sapiens
tcaaataagccagctgtcaccacca

SEQ ID NO: 21776 - DNA, 25 bp, Homo sapiens
accaccaagtcacctgcagtgaagc

SEQ ID NO: 21777 - DNA, 25 bp, Homo sapiens
acctgtgggcggtggccagaagctt

SEQ ID NO: 21778 - DNA, 25 bp, Homo sapiens
gaagatggtggccaccactaagccc

SEQ ID NO: 21779 - DNA, 25 bp, Homo sapiens
caagcaggctcctcagggtagtagg

SEQ ID NO: 21780 - DNA, 25 bp, Homo sapiens
agggtagtagggacagcagctctga

SEQ ID NO: 21781 - DNA, 25 bp, Homo sapiens
gctctgattcagacagctccagcag

SEQ ID NO: 21782 - DNA, 25 bp, Homo sapiens
gcaacagttcttcttctgatgactc

SEQ ID NO: 21783 - DNA, 25 bp, Homo sapiens
agaagctcaagggcaagggctctcc

SEQ ID NO: 21784 - DNA, 25 bp, Homo sapiens
aagggctctccaagaccacaagccc

SEQ ID NO: 21785 - DNA, 25 bp, Homo sapiens
cctcgtcgatctcatttacaacatg

SEQ ID NO: 21786 - DNA, 25 bp, Homo sapiens
cccatctacgaagctgccgacaaag

SEQ ID NO: 21787 - DNA, 25 bp, Homo sapiens
accttctcagagttcctcgatgtgg

SEQ ID NO: 21788 - DNA, 25 bp, Homo sapiens
atcaccgatccagagagcttcctga

SEQ ID NO: 21789 - DNA, 25 bp, Homo sapiens
tccgcgggatgctgcattgttaccc

SEQ ID NO: 21790 - DNA, 25 bp, Homo sapiens
ttttaggcttcctgttttatctcgt

SEQ ID NO: 21791 - DNA, 25 bp, Homo sapiens
tatctcgtgtgtgtggtgcaccagc

SEQ ID NO: 21792 - DNA, 25 bp, Homo sapiens
gtgcaccagctatgaggttgtctgt

SEQ ID NO: 21793 - DNA, 25 bp, Homo sapiens
gttgtctgtaacccaagccatcaaa

SEQ ID NO: 21794 - DNA, 25 bp, Homo sapiens
agggcctgtacatacctaggagcca

SEQ ID NO: 21795 - DNA, 25 bp, Homo sapiens
ctaggagccatgagttgtcccggcc

SEQ ID NO: 21796 - DNA, 25 bp, Homo sapiens
gagccacaagcaggaagagcagcgc

SEQ ID NO: 21797 - DNA, 25 bp, Homo sapiens
tttccatggatttctaccagaccac

SEQ ID NO: 21798 - DNA, 25 bp, Homo sapiens
taccagaccactgaaggagttcctg

SEQ ID NO: 21799 - DNA, 25 bp, Homo sapiens
gccctgcggtagctagcactgaaga

SEQ ID NO: 21800 - DNA, 25 bp, Homo sapiens
tactcagcgtagatgtgtgttcaca

SEQ ID NO: 21801 - DNA, 25 bp, Homo sapiens
gtgttcacacaaattgctctgcatt

SEQ ID NO: 21802 - DNA, 25 bp, Homo sapiens
cctcctacccagcaaaccagtagac

SEQ ID NO: 21803 - DNA, 25 bp, Homo sapiens
tttgatgtcactttggttctttttc

SEQ ID NO: 21804 - DNA, 25 bp, Homo sapiens
agtgactcagtcgggaagctttcca

SEQ ID NO: 21805 - DNA, 25 bp, Homo sapiens
gtgaagtgtcattggcatgtctggc

SEQ ID NO: 21806 - DNA, 25 bp, Homo sapiens
atgtctggcagtagtctctcattca

SEQ ID NO: 21807 - DNA, 25 bp, Homo sapiens
gctttaatggtttttgctctagaat

SEQ ID NO: 21808 - DNA, 25 bp, Homo sapiens
atggtttttgctctagaataccgta

SEQ ID NO: 21809 - DNA, 25 bp, Homo sapiens
ttaaacttcatataactttcagaaa

SEQ ID NO: 21810 - DNA, 25 bp, Homo sapiens
atatattattcttcaacgacatttt

SEQ ID NO: 21811 - DNA, 25 bp, Homo sapiens
ccccctttgtgttggactgcaaatt

SEQ ID NO: 21812 - DNA, 25 bp, Homo sapiens
ggactgcaaattgagtttctttctc

SEQ ID NO: 21813 - DNA, 25 bp, Homo sapiens
tttctctttaggcctttcacaacta

SEQ ID NO: 21814 - DNA, 25 bp, Homo sapiens
tctttaggcctttcacaactaggac

SEQ ID NO: 21815 - DNA, 25 bp, Homo sapiens
ggcctttcacaactaggactgagaa

SEQ ID NO: 21816 - DNA, 25 bp, Homo sapiens
caactaggactgagaatgtatgtaa

SEQ ID NO: 21817 - DNA, 25 bp, Homo sapiens
gtatgtaaaagttctgtgacagtac

SEQ ID NO: 21818 - DNA, 25 bp, Homo sapiens
cactttccaatgccacagacaactc

SEQ ID NO: 21819 - DNA, 25 bp, Homo sapiens
agacaactcacattgttcaactccc

SEQ ID NO: 21820 - DNA, 25 bp, Homo sapiens
gggacagacgagacaacagcacaca

SEQ ID NO: 21821 - DNA, 25 bp, Homo sapiens
ccatgttctcccaaataccgttgat

SEQ ID NO: 21822 - DNA, 25 bp, Homo sapiens
cactgataatcacactgcggtaggt

SEQ ID NO: 21823 - DNA, 25 bp, Homo sapiens
tgcggtaggtcattcttttgccaca

SEQ ID NO: 21824 - DNA, 25 bp, Homo sapiens
tgccacatccctatagaccactggg

SEQ ID NO: 21825 - DNA, 25 bp, Homo sapiens
gaccactgggtttggcaaaactcag

SEQ ID NO: 21826 - DNA, 25 bp, Homo sapiens
cttgctacttgaaggtacaccccat

SEQ ID NO: 21827 - DNA, 25 bp, Homo sapiens
gaaggtacaccccatagggtcggag

SEQ ID NO: 21828 - DNA, 25 bp, Homo sapiens
ccatagggtcggaggtgctgtcccc

SEQ ID NO: 21829 - DNA, 25 bp, Homo sapiens
tggtgatgtctgctactatgccagc

SEQ ID NO: 21830 - DNA, 25 bp, Homo sapiens
ccagccggaacgacaagtcctactg

SEQ ID NO: 21831 - DNA, 25 bp, Homo sapiens
gaggacgagatcaagccctacatca

SEQ ID NO: 21832 - DNA, 25 bp, Homo sapiens
ccatcgcggtccacagtcaggatgt

SEQ ID NO: 21833 - DNA, 25 bp, Homo sapiens
tgcccagctgggtggcggagtttgt

SEQ ID NO: 21834 - DNA, 25 bp, Homo sapiens
tgtggatcggatattccttcctcat

SEQ ID NO: 21835 - DNA, 25 bp, Homo sapiens
gaaggcggtggccaatcactggtgt

SEQ ID NO: 21836 - DNA, 25 bp, Homo sapiens
caatcactggtgtcaccgggcagct

SEQ ID NO: 21837 - DNA, 25 bp, Homo sapiens
actacgccaacaagtacagcttctg

SEQ ID NO: 21838 - DNA, 25 bp, Homo sapiens
gaagggccattttggtgcttattct

SEQ ID NO: 21839 - DNA, 25 bp, Homo sapiens
tattacctcaggtgccaacccaaaa

SEQ ID NO: 21840 - DNA, 25 bp, Homo sapiens
tttccttcaacttgtggatgcaggc

SEQ ID NO: 21841 - DNA, 25 bp, Homo sapiens
aggtggatgatgccagagctctcct

SEQ ID NO: 21842 - DNA, 25 bp, Homo sapiens
aattgctgaacaaaccccgattttg

SEQ ID NO: 21843 - DNA, 25 bp, Homo sapiens
gttgttgttcctccttaggaattct

SEQ ID NO: 21844 - DNA, 25 bp, Homo sapiens
gaagaagcatacaattccctcatga

SEQ ID NO: 21845 - DNA, 25 bp, Homo sapiens
agatgtcacatctgctaaagcactg

SEQ ID NO: 21846 - DNA, 25 bp, Homo sapiens
ggatgatctgtttctaaagcgttac

SEQ ID NO: 21847 - DNA, 25 bp, Homo sapiens
aagcgttacgcatctttgctgaagt

SEQ ID NO: 21848 - DNA, 25 bp, Homo sapiens
cattgaaccccctgaaagctttgaa

SEQ ID NO: 21849 - DNA, 25 bp, Homo sapiens
taaccaggcgatactttgttttgta

SEQ ID NO: 21850 - DNA, 25 bp, Homo sapiens
gtgattctgtgtctacatgttattt

SEQ ID NO: 21851 - DNA, 25 bp, Homo sapiens
ccattgccccatgtgaagtcactgt

SEQ ID NO: 21852 - DNA, 25 bp, Homo sapiens
agcccagaacactggtctcgggccc

SEQ ID NO: 21853 - DNA, 25 bp, Homo sapiens
tttccaggctttaggtatcaccact

SEQ ID NO: 21854 - DNA, 25 bp, Homo sapiens
caccactaaaatctccaggggcacc

SEQ ID NO: 21855 - DNA, 25 bp, Homo sapiens
acgctgctgaacatgctcaacatct

SEQ ID NO: 21856 - DNA, 25 bp, Homo sapiens
gacaatggcagcatctacaaccctg

SEQ ID NO: 21857 - DNA, 25 bp, Homo sapiens
gtgtctgtctgcagattggctaccc

SEQ ID NO: 21858 - DNA, 25 bp, Homo sapiens
tcaacgggtacaaacgagtcctggc

SEQ ID NO: 21859 - DNA, 25 bp, Homo sapiens
tgtggagacggattacaccttccca

SEQ ID NO: 21860 - DNA, 25 bp, Homo sapiens
tacaccttcccacttgctgaaaagg

SEQ ID NO: 21861 - DNA, 25 bp, Homo sapiens
aaggtcaaggccttcttggctgatc

SEQ ID NO: 21862 - DNA, 25 bp, Homo sapiens
gagagagtatgctctgtgtcgtccc

SEQ ID NO: 21863 - DNA, 25 bp, Homo sapiens
tcgtcccagacatttctgcattccg

SEQ ID NO: 21864 - DNA, 25 bp, Homo sapiens
accagtccaggttccagtaactttg

SEQ ID NO: 21865 - DNA, 25 bp, Homo sapiens
cctttacctacacaccagaaccagg

SEQ ID NO: 21866 - DNA, 25 bp, Homo sapiens
aatccttcgagccaattcaagccag

SEQ ID NO: 21867 - DNA, 25 bp, Homo sapiens
gtgccccctaacgaatcaaacacaa

SEQ ID NO: 21868 - DNA, 25 bp, Homo sapiens
gagggaagttacacaaacgccagca

SEQ ID NO: 21869 - DNA, 25 bp, Homo sapiens
aaacgccagcacaaattcaaccagt

SEQ ID NO: 21870 - DNA, 25 bp, Homo sapiens
aaccagtgtcacatcatctacagcc

SEQ ID NO: 21871 - DNA, 25 bp, Homo sapiens
tatcctaactaccgtctttttgcta

SEQ ID NO: 21872 - DNA, 25 bp, Homo sapiens
ttgtctccctgcaagtgctgatttg

SEQ ID NO: 21873 - DNA, 25 bp, Homo sapiens
aagacagcaggctttcacagaatta

SEQ ID NO: 21874 - DNA, 25 bp, Homo sapiens
tcagggtggtgacttcacacgccat

SEQ ID NO: 21875 - DNA, 25 bp, Homo sapiens
ggcactggtggcaagtccatctatg

SEQ ID NO: 21876 - DNA, 25 bp, Homo sapiens
taaagcatacgggtcctggcatctt

SEQ ID NO: 21877 - DNA, 25 bp, Homo sapiens
cctggcatcttgtccatggcaaatg

SEQ ID NO: 21878 - DNA, 25 bp, Homo sapiens
ggacccaacacaaatggttcccagt

SEQ ID NO: 21879 - DNA, 25 bp, Homo sapiens
gtttttcatctgcactgccaagact

SEQ ID NO: 21880 - DNA, 25 bp, Homo sapiens
ggagcgctttgggtccaggaatggc

SEQ ID NO: 21881 - DNA, 25 bp, Homo sapiens
agatcaccattgctgactgtggaca

SEQ ID NO: 21882 - DNA, 25 bp, Homo sapiens
tcttaaccaccagatcattccttct

SEQ ID NO: 21883 - DNA, 25 bp, Homo sapiens
atcctagaatctttgtgctctcgct

SEQ ID NO: 21884 - DNA, 25 bp, Homo sapiens
gaaagactgtgctgtcctttaacat

SEQ ID NO: 21885 - DNA, 25 bp, Homo sapiens
acatccgttttcattgttcacttct

SEQ ID NO: 21886 - DNA, 25 bp, Homo sapiens
agcaacaaccttaaaggccgtcatt

SEQ ID NO: 21887 - DNA, 25 bp, Homo sapiens
ggccgtcatttcattagtattcctc

SEQ ID NO: 21888 - DNA, 25 bp, Homo sapiens
cattagtattcctcattctgcatcc

SEQ ID NO: 21889 - DNA, 25 bp, Homo sapiens
ctcattctgcatcctggcttgaaaa

SEQ ID NO: 21890 - DNA, 25 bp, Homo sapiens
gtatcagtattttcacacgtaagca

SEQ ID NO: 21891 - DNA, 25 bp, Homo sapiens
acacgtaagcacattcgggccattt

SEQ ID NO: 21892 - DNA, 25 bp, Homo sapiens
gtggtttctcatgagctgtgttcac

SEQ ID NO: 21893 - DNA, 25 bp, Homo sapiens
tcgcatggaccgcaggagggcagat

SEQ ID NO: 21894 - DNA, 25 bp, Homo sapiens
cgcaggagggcagattcggaccact

SEQ ID NO: 21895 - DNA, 25 bp, Homo sapiens
tcggctactcttttgtgatgcacac

SEQ ID NO: 21896 - DNA, 25 bp, Homo sapiens
cagcgctggtgcagaaggctctggc

SEQ ID NO: 21897 - DNA, 25 bp, Homo sapiens
aagtgcgccattcatcgagtgtcac

SEQ ID NO: 21898 - DNA, 25 bp, Homo sapiens
ccgtgggacctgcaattactacgca

SEQ ID NO: 21899 - DNA, 25 bp, Homo sapiens
gcaaacgcttacagcttttggctcg

SEQ ID NO: 21900 - DNA, 25 bp, Homo sapiens
ttttggctcgccaccatagagagga

SEQ ID NO: 21901 - DNA, 25 bp, Homo sapiens
agatgttcaagaagcctacgccgtc

SEQ ID NO: 21902 - DNA, 25 bp, Homo sapiens
gccgtccaccttgaaggcaggggag

SEQ ID NO: 21903 - DNA, 25 bp, Homo sapiens
tcagccgctgccaagtctgtatgag

SEQ ID NO: 21904 - DNA, 25 bp, Homo sapiens
aatatatcctgtgtacctcactgtc

SEQ ID NO: 21905 - DNA, 25 bp, Homo sapiens
aatttgcgtaactaacacaccctgc

SEQ ID NO: 21906 - DNA, 25 bp, Homo sapiens
gcgctactacagactctgcaacgac

SEQ ID NO: 21907 - DNA, 25 bp, Homo sapiens
cccctggcactgtgaagctctaggc

SEQ ID NO: 21908 - DNA, 25 bp, Homo sapiens
caccacagatgtctcccagatgggc

SEQ ID NO: 21909 - DNA, 25 bp, Homo sapiens
ccagcagagctggcttctgggtcca

SEQ ID NO: 21910 - DNA, 25 bp, Homo sapiens
ctcccagggcgttggagcaggcgga

SEQ ID NO: 21911 - DNA, 25 bp, Homo sapiens
gcacgtggctcatggggcagaattg

SEQ ID NO: 21912 - DNA, 25 bp, Homo sapiens
tgccaaggacagctcacgacagtgc

SEQ ID NO: 21913 - DNA, 25 bp, Homo sapiens
ttctcaccattccagccaaggagag

SEQ ID NO: 21914 - DNA, 25 bp, Homo sapiens
gatgtgacgttggaactgctctggc

SEQ ID NO: 21915 - DNA, 25 bp, Homo sapiens
aattgccttgagatctctgctcttt

SEQ ID NO: 21916 - DNA, 25 bp, Homo sapiens
gactcacgtttttgttgttttctca

SEQ ID NO: 21917 - DNA, 25 bp, Homo sapiens
tgaacggctgtgcagtaggcccagc

SEQ ID NO: 21918 - DNA, 25 bp, Homo sapiens
cagaggaatagcttaccacgaaccc

SEQ ID NO: 21919 - DNA, 25 bp, Homo sapiens
gaacccctcagcatactgggaatct

SEQ ID NO: 21920 - DNA, 25 bp, Homo sapiens
ggaatctcttcctgaacaacgaatg

SEQ ID NO: 21921 - DNA, 25 bp, Homo sapiens
aatttggtcaagtctactcttccgt

SEQ ID NO: 21922 - DNA, 25 bp, Homo sapiens
ctactcttccgttcattcaattatt

SEQ ID NO: 21923 - DNA, 25 bp, Homo sapiens
aatatatttctcctttggcagtgac

SEQ ID NO: 21924 - DNA, 25 bp, Homo sapiens
taatgtgtcttaatctatccctcca

SEQ ID NO: 21925 - DNA, 25 bp, Homo sapiens
cctccagctggcagttactgttttt

SEQ ID NO: 21926 - DNA, 25 bp, Homo sapiens
ttaatcccctgaagttgtcctgtag

SEQ ID NO: 21927 - DNA, 25 bp, Homo sapiens
ttgctgtctgtatcccttggagtaa

SEQ ID NO: 21928 - DNA, 25 bp, Homo sapiens
gaggcaaatggatctcgatatttca

SEQ ID NO: 21929 - DNA, 25 bp, Homo sapiens
ggatctcgatatttcagatgggctt

SEQ ID NO: 21930 - DNA, 25 bp, Homo sapiens
agatgggcttttgatgcactgttgc

SEQ ID NO: 21931 - DNA, 25 bp, Homo sapiens
gggcttttgatgcactgttgccaag

SEQ ID NO: 21932 - DNA, 25 bp, Homo sapiens
gatgcactgttgccaaggaaggctt

SEQ ID NO: 21933 - DNA, 25 bp, Homo sapiens
ctgttgccaaggaaggctttttctg

SEQ ID NO: 21934 - DNA, 25 bp, Homo sapiens
gaatttttgcacactttcattggtg

SEQ ID NO: 21935 - DNA, 25 bp, Homo sapiens
gcacactttcattggtgtctttcgg

SEQ ID NO: 21936 - DNA, 25 bp, Homo sapiens
cattggtgtctttcggcaacttaca

SEQ ID NO: 21937 - DNA, 25 bp, Homo sapiens
gtctttcggcaacttacacacattg

SEQ ID NO: 21938 - DNA, 25 bp, Homo sapiens
tcggcaacttacacacattgaaaat

SEQ ID NO: 21939 - DNA, 25 bp, Homo sapiens
gagagctcctgtttactaagcaagc

SEQ ID NO: 21940 - DNA, 25 bp, Homo sapiens
agcttttgtgtttattatcctcatt

SEQ ID NO: 21941 - DNA, 25 bp, Homo sapiens
tggggtgatgggttgcagacggagg

SEQ ID NO: 21942 - DNA, 25 bp, Homo sapiens
cagacggaggtcaggtcttcctctt

SEQ ID NO: 21943 - DNA, 25 bp, Homo sapiens
tcttcctctttcctgagactggatc

SEQ ID NO: 21944 - DNA, 25 bp, Homo sapiens
tctgttcaaacagcaaacgcccaca

SEQ ID NO: 21945 - DNA, 25 bp, Homo sapiens
cgcccacagatggcccagaggtggt

SEQ ID NO: 21946 - DNA, 25 bp, Homo sapiens
gaggtggtggtagtcagggtgtgtg

SEQ ID NO: 21947 - DNA, 25 bp, Homo sapiens
tggtcccagccagtttggtgctgac

SEQ ID NO: 21948 - DNA, 25 bp, Homo sapiens
acatgaggggcttccattttctgtg

SEQ ID NO: 21949 - DNA, 25 bp, Homo sapiens
gccgccatgttcctgatattagttc

SEQ ID NO: 21950 - DNA, 25 bp, Homo sapiens
gaggaacaggcccgcaaaaggcagg

SEQ ID NO: 21951 - DNA, 25 bp, Homo sapiens
agaaggaggccgcagagcaagctga

SEQ ID NO: 21952 - DNA, 25 bp, Homo sapiens
gcagtcagagcagcatcgttcctga

SEQ ID NO: 21953 - DNA, 25 bp, Homo sapiens
gacgacgagaacattccgatggaga

SEQ ID NO: 21954 - DNA, 25 bp, Homo sapiens
tgaagaaggcacgtctactcctgag

SEQ ID NO: 21955 - DNA, 25 bp, Homo sapiens
gatagtaacactggctcggagagca

SEQ ID NO: 21956 - DNA, 25 bp, Homo sapiens
ggctcggagagcaacagtgcaacag

SEQ ID NO: 21957 - DNA, 25 bp, Homo sapiens
agtggaggagccaccaacagatccc

SEQ ID NO: 21958 - DNA, 25 bp, Homo sapiens
aacagatcccataccagaagatgag

SEQ ID NO: 21959 - DNA, 25 bp, Homo sapiens
taagtgttgccttgttttgtgtgtt

SEQ ID NO: 21960 - DNA, 25 bp, Homo sapiens
aaaaggttgtgcggtctgaaagtag

SEQ ID NO: 21961 - DNA, 25 bp, Homo sapiens
gaggacttaggagagatctgaactc

SEQ ID NO: 21962 - DNA, 25 bp, Homo sapiens
cacttcatgtgaaaactactccagt

SEQ ID NO: 21963 - DNA, 25 bp, Homo sapiens
aaactactccagtggctgactgaat

SEQ ID NO: 21964 - DNA, 25 bp, Homo sapiens
tgactgaattgctgacccttcaagc

SEQ ID NO: 21965 - DNA, 25 bp, Homo sapiens
tgtccttatccattacctcaaagca

SEQ ID NO: 21966 - DNA, 25 bp, Homo sapiens
ccattacctcaaagcagtcattcct

SEQ ID NO: 21967 - DNA, 25 bp, Homo sapiens
gcagtcattccttagtaaagtttcc

SEQ ID NO: 21968 - DNA, 25 bp, Homo sapiens
taatgacactttggtagcactaata

SEQ ID NO: 21969 - DNA, 25 bp, Homo sapiens
ggagattatcctttcattgagcctt

SEQ ID NO: 21970 - DNA, 25 bp, Homo sapiens
tcattgagccttttatcctctgttc

SEQ ID NO: 21971 - DNA, 25 bp, Homo sapiens
tgttctcctttgaagaacccctcac

SEQ ID NO: 21972 - DNA, 25 bp, Homo sapiens
caccgtcctcatcataaagtctctg

SEQ ID NO: 21973 - DNA, 25 bp, Homo sapiens
cgtcctcatcataaagtctctgcgt

SEQ ID NO: 21974 - DNA, 25 bp, Homo sapiens
tcctcatcataaagtctctgcgttc

SEQ ID NO: 21975 - DNA, 25 bp, Homo sapiens
ctcatcataaagtctctgcgttctg

SEQ ID NO: 21976 - DNA, 25 bp, Homo sapiens
gcactgggaggcccaagagccaatc

SEQ ID NO: 21977 - DNA, 25 bp, Homo sapiens
tgggaggcccaagagccaatccaga

SEQ ID NO: 21978 - DNA, 25 bp, Homo sapiens
ggaggcccaagagccaatccagatg

SEQ ID NO: 21979 - DNA, 25 bp, Homo sapiens
ggcccaagagccaatccagatgcct

SEQ ID NO: 21980 - DNA, 25 bp, Homo sapiens
ccagatgcctgagacaacggagact

SEQ ID NO: 21981 - DNA, 25 bp, Homo sapiens
gatgcctgagacaacggagactgtg

SEQ ID NO: 21982 - DNA, 25 bp, Homo sapiens
gacaacggagactgtgctctgtgcc

SEQ ID NO: 21983 - DNA, 25 bp, Homo sapiens
agcagctagtccatagcacagcctt

SEQ ID NO: 21984 - DNA, 25 bp, Homo sapiens
caggcattgcccatgagcagagctg

SEQ ID NO: 21985 - DNA, 25 bp, Homo sapiens
tgctatctttatagttccactgccc

SEQ ID NO: 21986 - DNA, 25 bp, Homo sapiens
gccctaaccaagtgtccacattcta

SEQ ID NO: 21987 - DNA, 25 bp, Homo sapiens
aatgtgtagtgtccatcccttatgt

SEQ ID NO: 21988 - DNA, 25 bp, Homo sapiens
tatgtaatagtggtttcccgcccaa

SEQ ID NO: 21989 - DNA, 25 bp, Homo sapiens
ggaacgccagaagtgctgattgccc

SEQ ID NO: 21990 - DNA, 25 bp, Homo sapiens
gtaaaggctggctggtgggtgtctg

SEQ ID NO: 21991 - DNA, 25 bp, Homo sapiens
acctccctctggccaaagatgggct

SEQ ID NO: 21992 - DNA, 25 bp, Homo sapiens
aaagatgggctttgcccgctgtgtg

SEQ ID NO: 21993 - DNA, 25 bp, Homo sapiens
atgccctgggcttcccaaatggaga

SEQ ID NO: 21994 - DNA, 25 bp, Homo sapiens
ttcccatgagccactactctgatgt

SEQ ID NO: 21995 - DNA, 25 bp, Homo sapiens
tcccatgagccactactctgatgtc

SEQ ID NO: 21996 - DNA, 25 bp, Homo sapiens
ccatgagccactactctgatgtcag

SEQ ID NO: 21997 - DNA, 25 bp, Homo sapiens
gtcagcctataaccaaaggagctgg

SEQ ID NO: 21998 - DNA, 25 bp, Homo sapiens
gcctataaccaaaggagctgggggg

SEQ ID NO: 21999 - DNA, 25 bp, Homo sapiens
tttctcagcccactcaatcagggtg

SEQ ID NO: 22000 - DNA, 25 bp, Homo sapiens
ctcagcccactcaatcagggtgctc

SEQ ID NO: 22001 - DNA, 25 bp, Homo sapiens
agcctccctggtaagcagagactca

SEQ ID NO: 22002 - DNA, 25 bp, Homo sapiens
cctccctggtaagcagagactcaag

SEQ ID NO: 22003 - DNA, 25 bp, Homo sapiens
gagactcaagaaacctctggggtcc

SEQ ID NO: 22004 - DNA, 25 bp, Homo sapiens
gactcaagaaacctctggggtcctg

SEQ ID NO: 22005 - DNA, 25 bp, Homo sapiens
acaacttggtttaacatgtttactg

SEQ ID NO: 22006 - DNA, 25 bp, Homo sapiens
aaagcagcaggatccagagctatag

SEQ ID NO: 22007 - DNA, 25 bp, Homo sapiens
gatccagagctataggtacagtgtg

SEQ ID NO: 22008 - DNA, 25 bp, Homo sapiens
tacagtgtgatctcagctttgcaaa

SEQ ID NO: 22009 - DNA, 25 bp, Homo sapiens
gatctcagctttgcaaacacatttt

SEQ ID NO: 22010 - DNA, 25 bp, Homo sapiens
tagtggtatttttggcacccttata

SEQ ID NO: 22011 - DNA, 25 bp, Homo sapiens
tttggcacccttatatatgttttcc

SEQ ID NO: 22012 - DNA, 25 bp, Homo sapiens
aatctccagcaagcatctcatttaa

SEQ ID NO: 22013 - DNA, 25 bp, Homo sapiens
gctgtcaaataggtgtgaccctact

SEQ ID NO: 22014 - DNA, 25 bp, Homo sapiens
tcgagtacctcaagtcagtttgcct

SEQ ID NO: 22015 - DNA, 25 bp, Homo sapiens
tgcttcgtaattttggagtaggagg

SEQ ID NO: 22016 - DNA, 25 bp, Homo sapiens
atgtctctttattcctgcttagtgg

SEQ ID NO: 22017 - DNA, 25 bp, Homo sapiens
aaataactctctgctaggtccttgc

SEQ ID NO: 22018 - DNA, 25 bp, Homo sapiens
aggtccttgcttatatggcaaccac

SEQ ID NO: 22019 - DNA, 25 bp, Homo sapiens
tggcaaccactgctagaaccctaaa

SEQ ID NO: 22020 - DNA, 25 bp, Homo sapiens
gcctccatcagcttcttatttagta

SEQ ID NO: 22021 - DNA, 25 bp, Homo sapiens
gtatttcatatgcccattagcccta

SEQ ID NO: 22022 - DNA, 25 bp, Homo sapiens
tagccctatgcttcagatgacacgt

SEQ ID NO: 22023 - DNA, 25 bp, Homo sapiens
gacacgttttgtttagagctacttt

SEQ ID NO: 22024 - DNA, 25 bp, Homo sapiens
ctttgctccaagactcttaagccca

SEQ ID NO: 22025 - DNA, 25 bp, Homo sapiens
gtcagagcattttaactagccactc

SEQ ID NO: 22026 - DNA, 25 bp, Homo sapiens
ttctctttttactcatcagctgcaa

SEQ ID NO: 22027 - DNA, 25 bp, Homo sapiens
tcatgaaccctttcaacatgcctaa

SEQ ID NO: 22028 - DNA, 25 bp, Homo sapiens
gagagtgatcccaggacaaggacac

SEQ ID NO: 22029 - DNA, 25 bp, Homo sapiens
aggacactactcagtgatcctacct

SEQ ID NO: 22030 - DNA, 25 bp, Homo sapiens
tgatcctacctaccgggagctgata

SEQ ID NO: 22031 - DNA, 25 bp, Homo sapiens
agctacgaaacaagccttctgacct

SEQ ID NO: 22032 - DNA, 25 bp, Homo sapiens
tctgacctgggcacgaaactacaag

SEQ ID NO: 22033 - DNA, 25 bp, Homo sapiens
caagatccccggatcatgaccactc

SEQ ID NO: 22034 - DNA, 25 bp, Homo sapiens
ggggtcgatctgggcagtatggatg

SEQ ID NO: 22035 - DNA, 25 bp, Homo sapiens
gagctggggaacgatgcctacaaga

SEQ ID NO: 22036 - DNA, 25 bp, Homo sapiens
gaccccactaacatgacttacatta

SEQ ID NO: 22037 - DNA, 25 bp, Homo sapiens
aataagtgccgggagctttgtgaga

SEQ ID NO: 22038 - DNA, 25 bp, Homo sapiens
gacccagtttccagagagcaggcgg

SEQ ID NO: 22039 - DNA, 25 bp, Homo sapiens
cagtgggtcaggcacagggagcccc

SEQ ID NO: 22040 - DNA, 25 bp, Homo sapiens
ttcagggaaggggcgggcgtgtcgc

SEQ ID NO: 22041 - DNA, 25 bp, Homo sapiens
ttcacctgcagtcgcctagaaaact

SEQ ID NO: 22042 - DNA, 25 bp, Homo sapiens
aaacttgctctcaaacttcagggtt

SEQ ID NO: 22043 - DNA, 25 bp, Homo sapiens
aagtctcatttctgtgttttgcctg

SEQ ID NO: 22044 - DNA, 25 bp, Homo sapiens
cctctgatgctgggacccggaaggc

SEQ ID NO: 22045 - DNA, 25 bp, Homo sapiens
atacctgttgtgagacccgaggggc

SEQ ID NO: 22046 - DNA, 25 bp, Homo sapiens
cggcgcggttttttatggtgacaca

SEQ ID NO: 22047 - DNA, 25 bp, Homo sapiens
tccaggctcagtattgtgaccgcgg

SEQ ID NO: 22048 - DNA, 25 bp, Homo sapiens
tgccttacccgatggcttgtgacgc

SEQ ID NO: 22049 - DNA, 25 bp, Homo sapiens
ggatgagcggcgtctgtgtagggac

SEQ ID NO: 22050 - DNA, 25 bp, Homo sapiens
tgcagaagggtggtgtgctcccagg

SEQ ID NO: 22051 - DNA, 25 bp, Homo sapiens
ggactggcatgacaggtgtctcctc

SEQ ID NO: 22052 - DNA, 25 bp, Homo sapiens
tccctgtgcagaccagtgggcaagg

SEQ ID NO: 22053 - DNA, 25 bp, Homo sapiens
tgtgctcctagcagggttgctgtgc

SEQ ID NO: 22054 - DNA, 25 bp, Homo sapiens
cacacggagaggccctagagagcct

SEQ ID NO: 22055 - DNA, 25 bp, Homo sapiens
gagagcctcatggattgtaactaaa

SEQ ID NO: 22056 - DNA, 25 bp, Homo sapiens
ccagtgttaaaggcatccctcacct

SEQ ID NO: 22057 - DNA, 25 bp, Homo sapiens
ctcacctctgcattgaacttacgta

SEQ ID NO: 22058 - DNA, 25 bp, Homo sapiens
gaacttacgtatccatgccaaggaa

SEQ ID NO: 22059 - DNA, 25 bp, Homo sapiens
gagccagttcagttaggtgtcaatt

SEQ ID NO: 22060 - DNA, 25 bp, Homo sapiens
tatatccagcacatgcggtccaagg

SEQ ID NO: 22061 - DNA, 25 bp, Homo sapiens
agggcaatgagcagcacgcctttac

SEQ ID NO: 22062 - DNA, 25 bp, Homo sapiens
caaggccctggcctaagacaggctg

SEQ ID NO: 22063 - DNA, 25 bp, Homo sapiens
acagccccaggcttggtgaggaaga

SEQ ID NO: 22064 - DNA, 25 bp, Homo sapiens
ctcatccactgtctgctagcaaaga

SEQ ID NO: 22065 - DNA, 25 bp, Homo sapiens
tactcaggtgacaccacctgctcca

SEQ ID NO: 22066 - DNA, 25 bp, Homo sapiens
cagtagcctcaagcagcaccaatgg

SEQ ID NO: 22067 - DNA, 25 bp, Homo sapiens
ggggtctgggaaatccaactctctc

SEQ ID NO: 22068 - DNA, 25 bp, Homo sapiens
aactctctccacagtgtgagtgcac

SEQ ID NO: 22069 - DNA, 25 bp, Homo sapiens
gtagtagtaggcggccgctctagag

SEQ ID NO: 22070 - DNA, 25 bp, Homo sapiens
gatccaagcttacgtacgcgtgcat

SEQ ID NO: 22071 - DNA, 25 bp, Homo sapiens
gcaagaggaaggcggtccagggcgc

SEQ ID NO: 22072 - DNA, 25 bp, Homo sapiens
ctctgcacccggtgcatccagatca

SEQ ID NO: 22073 - DNA, 25 bp, Homo sapiens
tcatcctcaaggttccctttgagag

SEQ ID NO: 22074 - DNA, 25 bp, Homo sapiens
tcaaggttccctttgagagtgagga

SEQ ID NO: 22075 - DNA, 25 bp, Homo sapiens
gtgaggacaaccagggcatcgtgta

SEQ ID NO: 22076 - DNA, 25 bp, Homo sapiens
ggcatcgtgtatgcctgggtgggcc

SEQ ID NO: 22077 - DNA, 25 bp, Homo sapiens
atcagaccctgacgaagccaagttg

SEQ ID NO: 22078 - DNA, 25 bp, Homo sapiens
agccaagttggcagaagacatcctg

SEQ ID NO: 22079 - DNA, 25 bp, Homo sapiens
agacatcctgaacaccatgtttgac

SEQ ID NO: 22080 - DNA, 25 bp, Homo sapiens
cctgaacaccatgtttgacacctcc

SEQ ID NO: 22081 - DNA, 25 bp, Homo sapiens
gacacctcctacagcaagcaggtta

SEQ ID NO: 22082 - DNA, 25 bp, Homo sapiens
ccacgtctacgtgaaccagggggag

SEQ ID NO: 22083 - DNA, 25 bp, Homo sapiens
agatcctgaggaccgagcagtggcc

SEQ ID NO: 22084 - DNA, 25 bp, Homo sapiens
gaagctgtacatgcagctcatcccg

SEQ ID NO: 22085 - DNA, 25 bp, Homo sapiens
gacactgaagagcctgtgccggatc

SEQ ID NO: 22086 - DNA, 25 bp, Homo sapiens
tcatggacaatggcttcgccggctg

SEQ ID NO: 22087 - DNA, 25 bp, Homo sapiens
agcatcgtgtgagatccgcgtgctt

SEQ ID NO: 22088 - DNA, 25 bp, Homo sapiens
cttatgctcctgtactcttcagaga

SEQ ID NO: 22089 - DNA, 25 bp, Homo sapiens
aagaaaatcttcattggcctcatcc

SEQ ID NO: 22090 - DNA, 25 bp, Homo sapiens
cagggcaactttgtcaacggcatcc

SEQ ID NO: 22091 - DNA, 25 bp, Homo sapiens
caggtcctgcagcggaacctggagc

SEQ ID NO: 22092 - DNA, 25 bp, Homo sapiens
ctggggacttcaactgcccagcaac

SEQ ID NO: 22093 - DNA, 25 bp, Homo sapiens
gtgtcgcaacatcgtgtggatcgct

SEQ ID NO: 22094 - DNA, 25 bp, Homo sapiens
gtggatcgctgaatgtatcgcccag

SEQ ID NO: 22095 - DNA, 25 bp, Homo sapiens
caccgcgccaaaatcgacaactaca

SEQ ID NO: 22096 - DNA, 25 bp, Homo sapiens
aaatcgacaactacatccctatctt

SEQ ID NO: 22097 - DNA, 25 bp, Homo sapiens
ggctctcaattgcactctttgtgtg

SEQ ID NO: 22098 - DNA, 25 bp, Homo sapiens
gtgtatgtggtctgtgacaagcctg

SEQ ID NO: 22099 - DNA, 25 bp, Homo sapiens
ctgtgacaagcctgtggctcacctg

SEQ ID NO: 22100 - DNA, 25 bp, Homo sapiens
caccaaggatggacgaagaccccct

SEQ ID NO: 22101 - DNA, 25 bp, Homo sapiens
tcagccctgtggttacagccgctga

SEQ ID NO: 22102 - DNA, 25 bp, Homo sapiens
acagccgctgatgtatctaagaagc

SEQ ID NO: 22103 - DNA, 25 bp, Homo sapiens
ccctgcccctctgagacaataaaac

SEQ ID NO: 22104 - DNA, 25 bp, Homo sapiens
tgtcaaactgccagtaagccagccc

SEQ ID NO: 22105 - DNA, 25 bp, Homo sapiens
cctcaccctctgatagatattcctt

SEQ ID NO: 22106 - DNA, 25 bp, Homo sapiens
agatattcctttaatgcaccagact

SEQ ID NO: 22107 - DNA, 25 bp, Homo sapiens
aatgcaccagacttcatgtttgata

SEQ ID NO: 22108 - DNA, 25 bp, Homo sapiens
ggttgaaattgtttctcttcttttg

SEQ ID NO: 22109 - DNA, 25 bp, Homo sapiens
gtgttttcccagttaatagatggtc

SEQ ID NO: 22110 - DNA, 25 bp, Homo sapiens
taatagatggtcactgtttccacaa

SEQ ID NO: 22111 - DNA, 25 bp, Homo sapiens
tatactttcagctttttgtaactta

SEQ ID NO: 22112 - DNA, 25 bp, Homo sapiens
taaagcttgttgtggtctaatgaga

SEQ ID NO: 22113 - DNA, 25 bp, Homo sapiens
gtgcataatgtttttctgagcttct

SEQ ID NO: 22114 - DNA, 25 bp, Homo sapiens
gtaaatgccatcccaatgtggtttg

SEQ ID NO: 22115 - DNA, 25 bp, Homo sapiens
gctgaatttcacaccagatcctacc

SEQ ID NO: 22116 - DNA, 25 bp, Homo sapiens
gagccacatgtttcacacaagtgta

SEQ ID NO: 22117 - DNA, 25 bp, Homo sapiens
aaaatgccagggatccaccacaaga

SEQ ID NO: 22118 - DNA, 25 bp, Homo sapiens
tcagcacaaaccgattctgttcctc

SEQ ID NO: 22119 - DNA, 25 bp, Homo sapiens
gccacttagcaatctctatattctt

SEQ ID NO: 22120 - DNA, 25 bp, Homo sapiens
agctgttgactttcttactacttgc

SEQ ID NO: 22121 - DNA, 25 bp, Homo sapiens
ttactacttgcagtagcctgtcccc

SEQ ID NO: 22122 - DNA, 25 bp, Homo sapiens
aactctgccttgacctgaggaagac

SEQ ID NO: 22123 - DNA, 25 bp, Homo sapiens
gtatgtaccctgtgcttaattctat

SEQ ID NO: 22124 - DNA, 25 bp, Homo sapiens
aacagtaaaccccatacgcaggtgg

SEQ ID NO: 22125 - DNA, 25 bp, Homo sapiens
tgggagggaggaacaccggtgcctc

SEQ ID NO: 22126 - DNA, 25 bp, Homo sapiens
attgtaaatcttttgtgtctcctga

SEQ ID NO: 22127 - DNA, 25 bp, Homo sapiens
tgtctcctgaagacttcccttaaaa

SEQ ID NO: 22128 - DNA, 25 bp, Homo sapiens
cttcccttaaaattagctctgagtg

SEQ ID NO: 22129 - DNA, 25 bp, Homo sapiens
aaaagacatcttcgaatccatattt

SEQ ID NO: 22130 - DNA, 25 bp, Homo sapiens
gaatccatatttcaagcctggtaga

SEQ ID NO: 22131 - DNA, 25 bp, Homo sapiens
gaattggcttttctagcagaacctt

SEQ ID NO: 22132 - DNA, 25 bp, Homo sapiens
gattttgtagccaacattcattcaa

SEQ ID NO: 22133 - DNA, 25 bp, Homo sapiens
atggtccattcacctttatgttata

SEQ ID NO: 22134 - DNA, 25 bp, Homo sapiens
aatagcccattgttcattcttgtgc

SEQ ID NO: 22135 - DNA, 25 bp, Homo sapiens
cccattgttcattcttgtgctgtac

SEQ ID NO: 22136 - DNA, 25 bp, Homo sapiens
tactttgacttttcagagcacaccc

SEQ ID NO: 22137 - DNA, 25 bp, Homo sapiens
ccacccggactaccgtcaggatgag

SEQ ID NO: 22138 - DNA, 25 bp, Homo sapiens
attttgagggggacatcgccctgct

SEQ ID NO: 22139 - DNA, 25 bp, Homo sapiens
tccctgacaacgataccttctacga

SEQ ID NO: 22140 - DNA, 25 bp, Homo sapiens
ccttctacgacctgggcttgatggg

SEQ ID NO: 22141 - DNA, 25 bp, Homo sapiens
tcagtggcttcggggtcatggagga

SEQ ID NO: 22142 - DNA, 25 bp, Homo sapiens
cacaggcctgtgagaactggctccg

SEQ ID NO: 22143 - DNA, 25 bp, Homo sapiens
acccatctctaaagcaggacgcctg

SEQ ID NO: 22144 - DNA, 25 bp, Homo sapiens
ggacccgaacactgatcgctgggtg

SEQ ID NO: 22145 - DNA, 25 bp, Homo sapiens
gtgcagcaggggctatggcttctac

SEQ ID NO: 22146 - DNA, 25 bp, Homo sapiens
ggcttctacaccaaagtgctcaact

SEQ ID NO: 22147 - DNA, 25 bp, Homo sapiens
tgagcccagaattcactaggttcga

SEQ ID NO: 22148 - DNA, 25 bp, Homo sapiens
aaaccatttgtatctggcatcactt

SEQ ID NO: 22149 - DNA, 25 bp, Homo sapiens
tctggcatcacttactaacacacga

SEQ ID NO: 22150 - DNA, 25 bp, Homo sapiens
taacacacgacatgcggcttttctg

SEQ ID NO: 22151 - DNA, 25 bp, Homo sapiens
acatgcggcttttctgcatcaactg

SEQ ID NO: 22152 - DNA, 25 bp, Homo sapiens
tctaatggttacttgctcgtgcgtt

SEQ ID NO: 22153 - DNA, 25 bp, Homo sapiens
taatttgcttcatttccttgctatt

SEQ ID NO: 22154 - DNA, 25 bp, Homo sapiens
tgcatttctctgtcactgtaactat

SEQ ID NO: 22155 - DNA, 25 bp, Homo sapiens
aattttcatcttactgcacaatcaa

SEQ ID NO: 22156 - DNA, 25 bp, Homo sapiens
taggaatgaactccagaggctgggc

SEQ ID NO: 22157 - DNA, 25 bp, Homo sapiens
gaggctgggcctgaacagggaggtg

SEQ ID NO: 22158 - DNA, 25 bp, Homo sapiens
gtgctcagtcgtacgacctgtacct

SEQ ID NO: 22159 - DNA, 25 bp, Homo sapiens
aagtcctcatatctgcagagaaccc

SEQ ID NO: 22160 - DNA, 25 bp, Homo sapiens
cagagaacccattgatcaccttgtg

SEQ ID NO: 22161 - DNA, 25 bp, Homo sapiens
cacagtctgaccactcacgataaag

SEQ ID NO: 22162 - DNA, 25 bp, Homo sapiens
gaagcccattcctatggaagtctag

SEQ ID NO: 22163 - DNA, 25 bp, Homo sapiens
gcaaagcaatacgactcagcccagc

SEQ ID NO: 22164 - DNA, 25 bp, Homo sapiens
aagaactttgtctggtggctttgct

SEQ ID NO: 22165 - DNA, 25 bp, Homo sapiens
ttgtcactgttttcactgtcatgca

SEQ ID NO: 22166 - DNA, 25 bp, Homo sapiens
atggcagagacttccttgtcatcat

SEQ ID NO: 22167 - DNA, 25 bp, Homo sapiens
aacaagatgcagtggccctaggggt

SEQ ID NO: 22168 - DNA, 25 bp, Homo sapiens
ccctaggggttccactagtgtctgc

SEQ ID NO: 22169 - DNA, 25 bp, Homo sapiens
tagtgtctgctttcctttattattg

SEQ ID NO: 22170 - DNA, 25 bp, Homo sapiens
tccccgctagcttggggcgagcaga

SEQ ID NO: 22171 - DNA, 25 bp, Homo sapiens
gagcagagctgcatccagtggaact

SEQ ID NO: 22172 - DNA, 25 bp, Homo sapiens
aactaaagccgttccaggattatca

SEQ ID NO: 22173 - DNA, 25 bp, Homo sapiens
caaccttgggggacctggatcatca

SEQ ID NO: 22174 - DNA, 25 bp, Homo sapiens
caactggaaggtccttctctggcct

SEQ ID NO: 22175 - DNA, 25 bp, Homo sapiens
acgccttccacctacagtggagtct

SEQ ID NO: 22176 - DNA, 25 bp, Homo sapiens
tgcgctggatacctaagccttggga

SEQ ID NO: 22177 - DNA, 25 bp, Homo sapiens
aagccttgggagcggacagggccgc

SEQ ID NO: 22178 - DNA, 25 bp, Homo sapiens
tcccgacgggcagaggagcctgggt

SEQ ID NO: 22179 - DNA, 25 bp, Homo sapiens
gagcctgggtcccgaggggacaagg

SEQ ID NO: 22180 - DNA, 25 bp, Homo sapiens
tacccccggggcttgtatatagatt

SEQ ID NO: 22181 - DNA, 25 bp, Homo sapiens
gagatgaatgtgaaggtgctggact

SEQ ID NO: 22182 - DNA, 25 bp, Homo sapiens
tgctggactttgagcactttctgcc

SEQ ID NO: 22183 - DNA, 25 bp, Homo sapiens
gggcacctatgaggattatgtcgaa

SEQ ID NO: 22184 - DNA, 25 bp, Homo sapiens
gaaggacttcgggtgtttgacaagg

SEQ ID NO: 22185 - DNA, 25 bp, Homo sapiens
ggaaggaaatggcaccgtcatgggt

SEQ ID NO: 22186 - DNA, 25 bp, Homo sapiens
atggcaccgtcatgggtgctgaaat

SEQ ID NO: 22187 - DNA, 25 bp, Homo sapiens
agggcatgaggacagcaatggttgt

SEQ ID NO: 22188 - DNA, 25 bp, Homo sapiens
ccgcatggtgctgaatggctgagga

SEQ ID NO: 22189 - DNA, 25 bp, Homo sapiens
gtgtgaattttgtatctagcctaaa

SEQ ID NO: 22190 - DNA, 25 bp, Homo sapiens
ttgtatctagcctaaagtttcccta

SEQ ID NO: 22191 - DNA, 25 bp, Homo sapiens
ccatcttgtctctcttggatgatgt

SEQ ID NO: 22192 - DNA, 25 bp, Homo sapiens
gcctacttcggcgtgtacgatacgg

SEQ ID NO: 22193 - DNA, 25 bp, Homo sapiens
tacgatacggccaagggcatgctcc

SEQ ID NO: 22194 - DNA, 25 bp, Homo sapiens
gaccccaagaacacgcacatcgtgg

SEQ ID NO: 22195 - DNA, 25 bp, Homo sapiens
cacgcacatcgtggtgagctggatg

SEQ ID NO: 22196 - DNA, 25 bp, Homo sapiens
tgagctggatgatcgcgcagaccgt

SEQ ID NO: 22197 - DNA, 25 bp, Homo sapiens
gcagtccgggcgcaaaggagctgac

SEQ ID NO: 22198 - DNA, 25 bp, Homo sapiens
tgacatcatgtacacgggcaccgtc

SEQ ID NO: 22199 - DNA, 25 bp, Homo sapiens
gcaccgtcgactgttggaggaagat

SEQ ID NO: 22200 - DNA, 25 bp, Homo sapiens
gatcttcagagatgaggggggcaag

SEQ ID NO: 22201 - DNA, 25 bp, Homo sapiens
aaggccttcttcaagggtgcgtggt

SEQ ID NO: 22202 - DNA, 25 bp, Homo sapiens
tcttcaagggtgcgtggtccaacgt

SEQ ID NO: 22203 - DNA, 25 bp, Homo sapiens
gagagtcgcttctaagatgctccga

SEQ ID NO: 22204 - DNA, 25 bp, Homo sapiens
aagatgctccgagggaagccggcag

SEQ ID NO: 22205 - DNA, 25 bp, Homo sapiens
agaccgccctgtcgagtaaggacgg

SEQ ID NO: 22206 - DNA, 25 bp, Homo sapiens
taccggctcttccggtagaaccgct

SEQ ID NO: 22207 - DNA, 25 bp, Homo sapiens
gcctgacagacccagggagctgcag

SEQ ID NO: 22208 - DNA, 25 bp, Homo sapiens
gttcccgtgcgtgttagtttggaca

SEQ ID NO: 22209 - DNA, 25 bp, Homo sapiens
acggtgcaaacaatgtcgccacagc

SEQ ID NO: 22210 - DNA, 25 bp, Homo sapiens
ggaactcaatgtgccgatcagtgga

SEQ ID NO: 22211 - DNA, 25 bp, Homo sapiens
gagtcagtatcgagcctgaccaccg

SEQ ID NO: 22212 - DNA, 25 bp, Homo sapiens
aggaagcaggtgaagtgcccagcgc

SEQ ID NO: 22213 - DNA, 25 bp, Homo sapiens
aggactcacctctgacaagcaggag

SEQ ID NO: 22214 - DNA, 25 bp, Homo sapiens
ctgctcttctcagatggcaactcgc

SEQ ID NO: 22215 - DNA, 25 bp, Homo sapiens
ggcaggcatcgagatcttcgtggtg

SEQ ID NO: 22216 - DNA, 25 bp, Homo sapiens
gtcgtgggccgccaggtgaatgagc

SEQ ID NO: 22217 - DNA, 25 bp, Homo sapiens
tcctggtcaccggcaagacggccga

SEQ ID NO: 22218 - DNA, 25 bp, Homo sapiens
gacggccgagtacgacgtggcctac

SEQ ID NO: 22219 - DNA, 25 bp, Homo sapiens
acgtggcctacggcgagagccacct

SEQ ID NO: 22220 - DNA, 25 bp, Homo sapiens
tccaccagacagtctccaggaaggt

SEQ ID NO: 22221 - DNA, 25 bp, Homo sapiens
tcacagcgggcaggacggaccccgc

SEQ ID NO: 22222 - DNA, 25 bp, Homo sapiens
cagttcctgcagaactacacggccc

SEQ ID NO: 22223 - DNA, 25 bp, Homo sapiens
tgccatggactttatcaacgacgcc

SEQ ID NO: 22224 - DNA, 25 bp, Homo sapiens
acgatgccctgggctatgtgacccg

SEQ ID NO: 22225 - DNA, 25 bp, Homo sapiens
gaatttcacctgtaaacctgagtcg

SEQ ID NO: 22226 - DNA, 25 bp, Homo sapiens
cagaaagctgcctggtatatccaaa

SEQ ID NO: 22227 - DNA, 25 bp, Homo sapiens
tattcctcctgctcatattgtgatt

SEQ ID NO: 22228 - DNA, 25 bp, Homo sapiens
gtcttcctgacactttaattaccaa

SEQ ID NO: 22229 - DNA, 25 bp, Homo sapiens
taccaacctgttacctactttgact

SEQ ID NO: 22230 - DNA, 25 bp, Homo sapiens
gttacctactttgactttttgcatt

SEQ ID NO: 22231 - DNA, 25 bp, Homo sapiens
atgtgctatactgcatactttttaa

SEQ ID NO: 22232 - DNA, 25 bp, Homo sapiens
aactgtgtattccaagacatgtctg

SEQ ID NO: 22233 - DNA, 25 bp, Homo sapiens
catagatgcttagtccctcatgcaa

SEQ ID NO: 22234 - DNA, 25 bp, Homo sapiens
aattttttatcatgcatgtcctgta

SEQ ID NO: 22235 - DNA, 25 bp, Homo sapiens
taaaggttacaagcctgcacaataa

SEQ ID NO: 22236 - DNA, 25 bp, Homo sapiens
tatggtgcagtccgagcggtacctc

SEQ ID NO: 22237 - DNA, 25 bp, Homo sapiens
acagatatgcacagcctgctactgc

SEQ ID NO: 22238 - DNA, 25 bp, Homo sapiens
ctgcagccgcttacagtgacggtta

SEQ ID NO: 22239 - DNA, 25 bp, Homo sapiens
atggcagggtgtacacagccgaccc

SEQ ID NO: 22240 - DNA, 25 bp, Homo sapiens
gccgctagctatggagttggcgctg

SEQ ID NO: 22241 - DNA, 25 bp, Homo sapiens
gcgctgtggcgagtttataccgagg

SEQ ID NO: 22242 - DNA, 25 bp, Homo sapiens
cgaggtggctacagccgatttgccc

SEQ ID NO: 22243 - DNA, 25 bp, Homo sapiens
tgccccctactgaagtgacgtgaga

SEQ ID NO: 22244 - DNA, 25 bp, Homo sapiens
acgtgagacccctgcaaatgggaca

SEQ ID NO: 22245 - DNA, 25 bp, Homo sapiens
atgaggcctggctattgcaatattt

SEQ ID NO: 22246 - DNA, 25 bp, Homo sapiens
gggggtatcaacacttacattcctt

SEQ ID NO: 22247 - DNA, 25 bp, Homo sapiens
gtgagggttggtttggagacggaat

SEQ ID NO: 22248 - DNA, 25 bp, Homo sapiens
ggaataggtgtagctgcctttcctt

SEQ ID NO: 22249 - DNA, 25 bp, Homo sapiens
gaggcgggaggatcagtatatcggt

SEQ ID NO: 22250 - DNA, 25 bp, Homo sapiens
tatatcggtacgtctgagcccaaga

SEQ ID NO: 22251 - DNA, 25 bp, Homo sapiens
gttggggtggcacagtggcccaaag

SEQ ID NO: 22252 - DNA, 25 bp, Homo sapiens
gtggcccaaagagcagcttcagaga

SEQ ID NO: 22253 - DNA, 25 bp, Homo sapiens
agcttcagagataattccttggttc

SEQ ID NO: 22254 - DNA, 25 bp, Homo sapiens
attccttggttctatgatccctgtt

SEQ ID NO: 22255 - DNA, 25 bp, Homo sapiens
gatccctgtttaactccaaattaca

SEQ ID NO: 22256 - DNA, 25 bp, Homo sapiens
tacagtcggacttggatacatcatt

SEQ ID NO: 22257 - DNA, 25 bp, Homo sapiens
taaagtgaccatgcttttgttctgt

SEQ ID NO: 22258 - DNA, 25 bp, Homo sapiens
cccttgcagtccgctaggtgagagg

SEQ ID NO: 22259 - DNA, 25 bp, Homo sapiens
tctttccctctgcgaggcagtgggg

SEQ ID NO: 22260 - DNA, 25 bp, Homo sapiens
ggggtgggattcagagtgcttagtc

SEQ ID NO: 22261 - DNA, 25 bp, Homo sapiens
gtgcttagtctgctcactgggagaa

SEQ ID NO: 22262 - DNA, 25 bp, Homo sapiens
gtcctgtatgtctgtacgttgggga

SEQ ID NO: 22263 - DNA, 25 bp, Homo sapiens
acgttggggactgcctgtatttgga

SEQ ID NO: 22264 - DNA, 25 bp, Homo sapiens
taaaaacctagcatcctgttctcac

SEQ ID NO: 22265 - DNA, 25 bp, Homo sapiens
ttctcaccctctaagctgcattgag

SEQ ID NO: 22266 - DNA, 25 bp, Homo sapiens
gaaatgactcgtctctgtatttgta

SEQ ID NO: 22267 - DNA, 25 bp, Homo sapiens
gcattcggtgccaacattttttaga

SEQ ID NO: 22268 - DNA, 25 bp, Homo sapiens
aagcctgtactcacatcacaatgtc

SEQ ID NO: 22269 - DNA, 25 bp, Homo sapiens
gattctgggcagtgtctttgtggta

SEQ ID NO: 22270 - DNA, 25 bp, Homo sapiens
gaaagaatattgggctcttacctcc

SEQ ID NO: 22271 - DNA, 25 bp, Homo sapiens
cgctccagcgggtggggattttctt

SEQ ID NO: 22272 - DNA, 25 bp, Homo sapiens
ggactatgatgctggtgaggtctcc

SEQ ID NO: 22273 - DNA, 25 bp, Homo sapiens
gggctgttggctgtaatcctacgcc

SEQ ID NO: 22274 - DNA, 25 bp, Homo sapiens
atcctacgccaggcacaaggcatct

SEQ ID NO: 22275 - DNA, 25 bp, Homo sapiens
caaggcatcttgttgccttgccacg

SEQ ID NO: 22276 - DNA, 25 bp, Homo sapiens
ctgtcacagctgggtatccttacca

SEQ ID NO: 22277 - DNA, 25 bp, Homo sapiens
ttccacgcccttgcagtgggagaca

SEQ ID NO: 22278 - DNA, 25 bp, Homo sapiens
ggagacaggatgtccatgttctcta

SEQ ID NO: 22279 - DNA, 25 bp, Homo sapiens
ttttccttcccatgcagattgtgaa

SEQ ID NO: 22280 - DNA, 25 bp, Homo sapiens
aggtacaatctctcaggggtttcat

SEQ ID NO: 22281 - DNA, 25 bp, Homo sapiens
gagctgtaaatggaactgcttggct

SEQ ID NO: 22282 - DNA, 25 bp, Homo sapiens
actgcttggctttgaccatacacat

SEQ ID NO: 22283 - DNA, 25 bp, Homo sapiens
cccagcccttacagaatctgcacaa

SEQ ID NO: 22284 - DNA, 25 bp, Homo sapiens
tccctttgctccagttaattgttct

SEQ ID NO: 22285 - DNA, 25 bp, Homo sapiens
gttcttgtatgtaagttgctttcta

SEQ ID NO: 22286 - DNA, 25 bp, Homo sapiens
gttgctttctattccagtatatcca

SEQ ID NO: 22287 - DNA, 25 bp, Homo sapiens
taacaaggccagccacgtagccaaa

SEQ ID NO: 22288 - DNA, 25 bp, Homo sapiens
gtagccaaaggtcgctccaagcgta

SEQ ID NO: 22289 - DNA, 25 bp, Homo sapiens
aagcgtacaggagatgggccatacc

SEQ ID NO: 22290 - DNA, 25 bp, Homo sapiens
gagatgggccatacctgaggagaga

SEQ ID NO: 22291 - DNA, 25 bp, Homo sapiens
ttccgtctgggaacagtacctctgc

SEQ ID NO: 22292 - DNA, 25 bp, Homo sapiens
ccctgattcccaatgtgccatagtt

SEQ ID NO: 22293 - DNA, 25 bp, Homo sapiens
tgttctaatcaatgtctctgccttt

SEQ ID NO: 22294 - DNA, 25 bp, Homo sapiens
gtatcttttctgagggctttgtctg

SEQ ID NO: 22295 - DNA, 25 bp, Homo sapiens
ttgtctgttctcttcattctaatga

SEQ ID NO: 22296 - DNA, 25 bp, Homo sapiens
aggataatattctgcccaactccat

SEQ ID NO: 22297 - DNA, 25 bp, Homo sapiens
ttactagatcccttaccagtcacat

SEQ ID NO: 22298 - DNA, 25 bp, Homo sapiens
cagtcgtataccatccctggaagga

SEQ ID NO: 22299 - DNA, 25 bp, Homo sapiens
gtgcatcctatcaaggggcagctcc

SEQ ID NO: 22300 - DNA, 25 bp, Homo sapiens
cgtccccatggccattggatcatga

SEQ ID NO: 22301 - DNA, 25 bp, Homo sapiens
caagcaagcccccatgatggttctc

SEQ ID NO: 22302 - DNA, 25 bp, Homo sapiens
aagacctagaatccaagcgtgttac

SEQ ID NO: 22303 - DNA, 25 bp, Homo sapiens
tgtaacagagcagctgcttccacct

SEQ ID NO: 22304 - DNA, 25 bp, Homo sapiens
gctgcttccacctttcagatataga

SEQ ID NO: 22305 - DNA, 25 bp, Homo sapiens
gagcgacaacttatatacacaccta

SEQ ID NO: 22306 - DNA, 25 bp, Homo sapiens
ccttttctccagccatattacatca

SEQ ID NO: 22307 - DNA, 25 bp, Homo sapiens
ggtccctaagtgaaaggctctgctt

SEQ ID NO: 22308 - DNA, 25 bp, Homo sapiens
tgtagatttagtttgacgctcccca

SEQ ID NO: 22309 - DNA, 25 bp, Homo sapiens
tgacgctccccaaagtgcatgagac

SEQ ID NO: 22310 - DNA, 25 bp, Homo sapiens
gatagactcaatttagctctctgaa

SEQ ID NO: 22311 - DNA, 25 bp, Homo sapiens
aattcccactttggctgtgtacatc

SEQ ID NO: 22312 - DNA, 25 bp, Homo sapiens
gagaagtgtgtatgctgaccaaacc

SEQ ID NO: 22313 - DNA, 25 bp, Homo sapiens
gaggtgaaccatcttaattactagt

SEQ ID NO: 22314 - DNA, 25 bp, Homo sapiens
agttctattacctaattcagcttcc

SEQ ID NO: 22315 - DNA, 25 bp, Homo sapiens
attcagcttccttgtttggtctgct

SEQ ID NO: 22316 - DNA, 25 bp, Homo sapiens
tctgctgtggatctgccttattgca

SEQ ID NO: 22317 - DNA, 25 bp, Homo sapiens
agcctttcctacatttaaacttgct

SEQ ID NO: 22318 - DNA, 25 bp, Homo sapiens
gagcttatagctatgtctactgcac

SEQ ID NO: 22319 - DNA, 25 bp, Homo sapiens
aatctaggatgtactgtcttgttgt

SEQ ID NO: 22320 - DNA, 25 bp, Homo sapiens
atataagcatcaccttcccattgaa

SEQ ID NO: 22321 - DNA, 25 bp, Homo sapiens
gatgactggccaggaactttctctc

SEQ ID NO: 22322 - DNA, 25 bp, Homo sapiens
tttctctctgaatcggacatttgga

SEQ ID NO: 22323 - DNA, 25 bp, Homo sapiens
agtatcatggccttatgtatgctca

SEQ ID NO: 22324 - DNA, 25 bp, Homo sapiens
ctgtctcataccagtttccctggag

SEQ ID NO: 22325 - DNA, 25 bp, Homo sapiens
tgtgggcatatgtaggtctcctgtc

SEQ ID NO: 22326 - DNA, 25 bp, Homo sapiens
caacccgcaagctcatgtatcagga

SEQ ID NO: 22327 - DNA, 25 bp, Homo sapiens
ttcctataccagtgccagtctatac

SEQ ID NO: 22328 - DNA, 25 bp, Homo sapiens
gccagtctatacaggattctcagca

SEQ ID NO: 22329 - DNA, 25 bp, Homo sapiens
gtggacattacccagaagccacagc

SEQ ID NO: 22330 - DNA, 25 bp, Homo sapiens
ctggaaatggccattcgacttcttt

SEQ ID NO: 22331 - DNA, 25 bp, Homo sapiens
acttctttcccttcaaagtggcatt

SEQ ID NO: 22332 - DNA, 25 bp, Homo sapiens
tcctgtgcctcttactacttggagt

SEQ ID NO: 22333 - DNA, 25 bp, Homo sapiens
gaaactctgaggcagccacttatct

SEQ ID NO: 22334 - DNA, 25 bp, Homo sapiens
cctcacctgctcatgaccagagagc

SEQ ID NO: 22335 - DNA, 25 bp, Homo sapiens
ggatgcagtagatgccctgatgcag

SEQ ID NO: 22336 - DNA, 25 bp, Homo sapiens
ctcgtgcacatgggtctgctcaaga

SEQ ID NO: 22337 - DNA, 25 bp, Homo sapiens
ggtcaaggccattgccaacctgtac

SEQ ID NO: 22338 - DNA, 25 bp, Homo sapiens
ccctgatggcgctgaaccacatggt

SEQ ID NO: 22339 - DNA, 25 bp, Homo sapiens
atggtgcagcaggactatttcccca

SEQ ID NO: 22340 - DNA, 25 bp, Homo sapiens
ccgccacagtctgctgcagacgctg

SEQ ID NO: 22341 - DNA, 25 bp, Homo sapiens
tgaactgaggcgcagcctacgccat

SEQ ID NO: 22342 - DNA, 25 bp, Homo sapiens
tacgccattgccttggacaggactc

SEQ ID NO: 22343 - DNA, 25 bp, Homo sapiens
gccacaggcagggcgggtctgtgtc

SEQ ID NO: 22344 - DNA, 25 bp, Homo sapiens
gtcagtcccctgagtatgtgtgtgg

SEQ ID NO: 22345 - DNA, 25 bp, Homo sapiens
gatttgggttttaacgtcttctgct

SEQ ID NO: 22346 - DNA, 25 bp, Homo sapiens
tcccctctgtgttgtgattgggttg

SEQ ID NO: 22347 - DNA, 25 bp, Homo sapiens
gctgaccgctcagcctgaagagcag

SEQ ID NO: 22348 - DNA, 25 bp, Homo sapiens
gagaatgccatgggtgggactgtgg

SEQ ID NO: 22349 - DNA, 25 bp, Homo sapiens
ggttgttggcagagggcaaccctgg

SEQ ID NO: 22350 - DNA, 25 bp, Homo sapiens
cttctcctggctgctgagatgtcgt

SEQ ID NO: 22351 - DNA, 25 bp, Homo sapiens
ctgagatgtcgtctgtgactggcct

SEQ ID NO: 22352 - DNA, 25 bp, Homo sapiens
ggcctggctggagggggagtgttga

SEQ ID NO: 22353 - DNA, 25 bp, Homo sapiens
gggggagtgttgacaacccaaagct

SEQ ID NO: 22354 - DNA, 25 bp, Homo sapiens
aatgtccgagctgcatctggacgct

SEQ ID NO: 22355 - DNA, 25 bp, Homo sapiens
tggacgctgctcttaaaggacctcc

SEQ ID NO: 22356 - DNA, 25 bp, Homo sapiens
ggcaggggagcggtagggtctggac

SEQ ID NO: 22357 - DNA, 25 bp, Homo sapiens
ttcactttctagacgattacaaaca

SEQ ID NO: 22358 - DNA, 25 bp, Homo sapiens
ggcagaagcaccagctgtactacta

SEQ ID NO: 22359 - DNA, 25 bp, Homo sapiens
ggtgtctccaacctgactaggtgga

SEQ ID NO: 22360 - DNA, 25 bp, Homo sapiens
gccctcttaccgctagcgaggtgat

SEQ ID NO: 22361 - DNA, 25 bp, Homo sapiens
gtgataggacatctggcttgccaca

SEQ ID NO: 22362 - DNA, 25 bp, Homo sapiens
gcttgccacaaaggtctgttcgacc

SEQ ID NO: 22363 - DNA, 25 bp, Homo sapiens
gttcgaccagacatatcctagctaa

SEQ ID NO: 22364 - DNA, 25 bp, Homo sapiens
gaatgtgaggccaaccttctatcag

SEQ ID NO: 22365 - DNA, 25 bp, Homo sapiens
cagctgcccaatgccatgtgaagta

SEQ ID NO: 22366 - DNA, 25 bp, Homo sapiens
cagagttccctaccctaagagaatg

SEQ ID NO: 22367 - DNA, 25 bp, Homo sapiens
gttaccacctgaacagtcctcggtg

SEQ ID NO: 22368 - DNA, 25 bp, Homo sapiens
tcagccctgatgcacaggctgccag

SEQ ID NO: 22369 - DNA, 25 bp, Homo sapiens
actggtgccttgcttagagccagaa

SEQ ID NO: 22370 - DNA, 25 bp, Homo sapiens
gccagaagggatgaagccgggggat

SEQ ID NO: 22371 - DNA, 25 bp, Homo sapiens
gaagccgggggatctatggaacaga

SEQ ID NO: 22372 - DNA, 25 bp, Homo sapiens
gaggaggagcgatgcagttgggaga

SEQ ID NO: 22373 - DNA, 25 bp, Homo sapiens
ggaagctagaagggttatggttgga

SEQ ID NO: 22374 - DNA, 25 bp, Homo sapiens
cagaggggaagggccctgtggtgcc

SEQ ID NO: 22375 - DNA, 25 bp, Homo sapiens
ttccttcagcctccgaagggtgatg

SEQ ID NO: 22376 - DNA, 25 bp, Homo sapiens
gcattgagcccttggttgcctgggc

SEQ ID NO: 22377 - DNA, 25 bp, Homo sapiens
gggggttttcagtatttgtaagcat

SEQ ID NO: 22378 - DNA, 25 bp, Homo sapiens
gtatttgtaagcatttcagcagaac

SEQ ID NO: 22379 - DNA, 25 bp, Homo sapiens
gtggaaaagcctctaaatgcatccc

SEQ ID NO: 22380 - DNA, 25 bp, Homo sapiens
tgcttcctttgccttacaattgaag

SEQ ID NO: 22381 - DNA, 25 bp, Homo sapiens
caattgaagcagcccgtggtaccat

SEQ ID NO: 22382 - DNA, 25 bp, Homo sapiens
cagtatgcagagacttcctcacctt

SEQ ID NO: 22383 - DNA, 25 bp, Homo sapiens
cacctttcatatctagggaccaccc

SEQ ID NO: 22384 - DNA, 25 bp, Homo sapiens
accacccccgatgcattggtgaggg

SEQ ID NO: 22385 - DNA, 25 bp, Homo sapiens
ggtgggcacttataaatgcctgcta

SEQ ID NO: 22386 - DNA, 25 bp, Homo sapiens
gcctgctattgttaagccattccag

SEQ ID NO: 22387 - DNA, 25 bp, Homo sapiens
cagcctcttcctctgaatagaccag

SEQ ID NO: 22388 - DNA, 25 bp, Homo sapiens
tctgaatagaccagacgccctttca

SEQ ID NO: 22389 - DNA, 25 bp, Homo sapiens
cgccctttcacttagttcagtgcca

SEQ ID NO: 22390 - DNA, 25 bp, Homo sapiens
tcttccccttgagcttcagagagga

SEQ ID NO: 22391 - DNA, 25 bp, Homo sapiens
gagaggagagttggcatggttaaat

SEQ ID NO: 22392 - DNA, 25 bp, Homo sapiens
atggttaaatctgaatggttacctc

SEQ ID NO: 22393 - DNA, 25 bp, Homo sapiens
tgaaaacccagaggggcgtggcaca

SEQ ID NO: 22394 - DNA, 25 bp, Homo sapiens
gttccctttgctcttgattaggaga

SEQ ID NO: 22395 - DNA, 25 bp, Homo sapiens
gagctcccataactgaattggcctt

SEQ ID NO: 22396 - DNA, 25 bp, Homo sapiens
ttggcctttggttcatgttttctcc

SEQ ID NO: 22397 - DNA, 25 bp, Homo sapiens
tatgtgccaacaaatctatctacgt

SEQ ID NO: 22398 - DNA, 25 bp, Homo sapiens
aaatctatctacgttgttcttttca

SEQ ID NO: 22399 - DNA, 25 bp, Homo sapiens
ttgttcttttcaaattagcacgcag

SEQ ID NO: 22400 - DNA, 25 bp, Homo sapiens
taggaattttgagtttcttcttctt

SEQ ID NO: 22401 - DNA, 25 bp, Homo sapiens
ttctacctgaacacttgtactcttg

SEQ ID NO: 22402 - DNA, 25 bp, Homo sapiens
atgagcttttcacatcacctttatg

SEQ ID NO: 22403 - DNA, 25 bp, Homo sapiens
cacctttatggtttcaatccctagc

SEQ ID NO: 22404 - DNA, 25 bp, Homo sapiens
aatccctagctcaaagcttcctgga

SEQ ID NO: 22405 - DNA, 25 bp, Homo sapiens
ttacttctttcctttggcattttca

SEQ ID NO: 22406 - DNA, 25 bp, Homo sapiens
gaaatgctttcctttggttgttggt

SEQ ID NO: 22407 - DNA, 25 bp, Homo sapiens
taaacctgcaaagctctgctctgtt

SEQ ID NO: 22408 - DNA, 25 bp, Homo sapiens
tctgtcccttttgattccaactgaa

SEQ ID NO: 22409 - DNA, 25 bp, Homo sapiens
tccaactgaacttttgtgttctcta

SEQ ID NO: 22410 - DNA, 25 bp, Homo sapiens
cacggtgtaggttttacagtctcct

SEQ ID NO: 22411 - DNA, 25 bp, Homo sapiens
tacagtctcctaatttgtactggta

SEQ ID NO: 22412 - DNA, 25 bp, Homo sapiens
atcattctctttttgctgtatagaa

SEQ ID NO: 22413 - DNA, 25 bp, Homo sapiens
attgcttatatcactctttctttca

SEQ ID NO: 22414 - DNA, 25 bp, Homo sapiens
cctcctgtacttgtgttgtctgtga

SEQ ID NO: 22415 - DNA, 25 bp, Homo sapiens
gtgttgtctgtgaccgcttatagag

SEQ ID NO: 22416 - DNA, 25 bp, Homo sapiens
gttattggtgtttacctgaatacct

SEQ ID NO: 22417 - DNA, 25 bp, Homo sapiens
cctgaatacctatgcgtacacacac

SEQ ID NO: 22418 - DNA, 25 bp, Homo sapiens
ttccttaatacttctgaactcatta

SEQ ID NO: 22419 - DNA, 25 bp, Homo sapiens
aatactactacactttaccagcaat

SEQ ID NO: 22420 - DNA, 25 bp, Homo sapiens
tttaccagcaattaacttctcccta

SEQ ID NO: 22421 - DNA, 25 bp, Homo sapiens
ggaactaatttgtcttattcgtgct

SEQ ID NO: 22422 - DNA, 25 bp, Homo sapiens
gtcttattcgtgcttatatctgtat

SEQ ID NO: 22423 - DNA, 25 bp, Homo sapiens
aaaaacaatcatcatccacttggat

SEQ ID NO: 22424 - DNA, 25 bp, Homo sapiens
atatatattcatttgcacttacgtg

SEQ ID NO: 22425 - DNA, 25 bp, Homo sapiens
gtgaaacacaaactttgctctacaa

SEQ ID NO: 22426 - DNA, 25 bp, Homo sapiens
tgctctacaaaatttcgtgtttctt

SEQ ID NO: 22427 - DNA, 25 bp, Homo sapiens
aatgtttatcacacctttatcttgg

SEQ ID NO: 22428 - DNA, 25 bp, Homo sapiens
acagtaggcttctatatatcctgga

SEQ ID NO: 22429 - DNA, 25 bp, Homo sapiens
atatcctggatttctgaactggtct

SEQ ID NO: 22430 - DNA, 25 bp, Homo sapiens
aaatggatcttttcactggctgact

SEQ ID NO: 22431 - DNA, 25 bp, Homo sapiens
ctgactctcccatatctgcaagaga

SEQ ID NO: 22432 - DNA, 25 bp, Homo sapiens
ggaactgggtgtgcacacggtgttg

SEQ ID NO: 22433 - DNA, 25 bp, Homo sapiens
acacggtgttgtagccagttcaggt

SEQ ID NO: 22434 - DNA, 25 bp, Homo sapiens
gaattcacatgaggccagtcctaca

SEQ ID NO: 22435 - DNA, 25 bp, Homo sapiens
agcaagatgcaccccaggatttctt

SEQ ID NO: 22436 - DNA, 25 bp, Homo sapiens
agatgtgggagtgctccattttccc

SEQ ID NO: 22437 - DNA, 25 bp, Homo sapiens
gatactagaccctgggtttgcccac

SEQ ID NO: 22438 - DNA, 25 bp, Homo sapiens
cctccctctggcatggaattgacgc

SEQ ID NO: 22439 - DNA, 25 bp, Homo sapiens
attgacgcccgtgcagtacatttgc

SEQ ID NO: 22440 - DNA, 25 bp, Homo sapiens
ttgccaagtggcaccttctttcaat

SEQ ID NO: 22441 - DNA, 25 bp, Homo sapiens
ctttatttgctggttgtcttttctc

SEQ ID NO: 22442 - DNA, 25 bp, Homo sapiens
aatactcaacgattctttcagcttt

SEQ ID NO: 22443 - DNA, 25 bp, Homo sapiens
tccattgtttcttgcgacttgtgtc

SEQ ID NO: 22444 - DNA, 25 bp, Homo sapiens
cttgtgtctcgttctttgtagtatt

SEQ ID NO: 22445 - DNA, 25 bp, Homo sapiens
agaagtcctagcagctgtcattgct

SEQ ID NO: 22446 - DNA, 25 bp, Homo sapiens
gctggtggagttattggctttctct

SEQ ID NO: 22447 - DNA, 25 bp, Homo sapiens
aacgcaaaccatccagtgctgctta

SEQ ID NO: 22448 - DNA, 25 bp, Homo sapiens
tgctgcttatcagaaggcacctact

SEQ ID NO: 22449 - DNA, 25 bp, Homo sapiens
aaaactccaacttagtgtctctatt

SEQ ID NO: 22450 - DNA, 25 bp, Homo sapiens
ctgcgtctggctcgggagctgatga

SEQ ID NO: 22451 - DNA, 25 bp, Homo sapiens
ccagagctgacaacatctcgaccac

SEQ ID NO: 22452 - DNA, 25 bp, Homo sapiens
tctcgaccacttccaaagatactgt

SEQ ID NO: 22453 - DNA, 25 bp, Homo sapiens
gatactgttgactagtgctgctcca

SEQ ID NO: 22454 - DNA, 25 bp, Homo sapiens
atacctgctcagacaaagtcacctg

SEQ ID NO: 22455 - DNA, 25 bp, Homo sapiens
agagaaagttcacctctctgactca

SEQ ID NO: 22456 - DNA, 25 bp, Homo sapiens
cggggtttttgcagactcgaagtct

SEQ ID NO: 22457 - DNA, 25 bp, Homo sapiens
gaagtctcactgcaccagtgtcttt

SEQ ID NO: 22458 - DNA, 25 bp, Homo sapiens
tggtggtgagggtgggtgatggtgc

SEQ ID NO: 22459 - DNA, 25 bp, Homo sapiens
gtgcccagcaccaacagttttagtg

SEQ ID NO: 22460 - DNA, 25 bp, Homo sapiens
gtggtcctttgtaaactatggctcc

SEQ ID NO: 22461 - DNA, 25 bp, Homo sapiens
gctgtgtgacagatcaacgtgctga

SEQ ID NO: 22462 - DNA, 25 bp, Homo sapiens
aagagacagtgagtgccattggccc

SEQ ID NO: 22463 - DNA, 25 bp, Homo sapiens
cattggccccattcgcagatgtggg

SEQ ID NO: 22464 - DNA, 25 bp, Homo sapiens
agcccttcaccagagttcggaggag

SEQ ID NO: 22465 - DNA, 25 bp, Homo sapiens
tacccacacagaagcagtgctgccc

SEQ ID NO: 22466 - DNA, 25 bp, Homo sapiens
ccacctccctggatagcaggaactt

SEQ ID NO: 22467 - DNA, 25 bp, Homo sapiens
ggctgccaggggatttcgaagtttg

SEQ ID NO: 22468 - DNA, 25 bp, Homo sapiens
aagacagacgcctgcttttgcaaat

SEQ ID NO: 22469 - DNA, 25 bp, Homo sapiens
aagatctgaatggggctttcctgat

SEQ ID NO: 22470 - DNA, 25 bp, Homo sapiens
gggctttcctgatgttggtatctaa

SEQ ID NO: 22471 - DNA, 25 bp, Homo sapiens
ggaattgtgctccaaatgtctactg

SEQ ID NO: 22472 - DNA, 25 bp, Homo sapiens
aatgtctactgaagcttaaccgaag

SEQ ID NO: 22473 - DNA, 25 bp, Homo sapiens
ggactacagtagctcacgttacagg

SEQ ID NO: 22474 - DNA, 25 bp, Homo sapiens
atgagggtctcactgctttaggatt

SEQ ID NO: 22475 - DNA, 25 bp, Homo sapiens
gggtactgtggctggtactttctgt

SEQ ID NO: 22476 - DNA, 25 bp, Homo sapiens
aactgtgagccgtccaagtcagaag

SEQ ID NO: 22477 - DNA, 25 bp, Homo sapiens
aaagcaacttttccaacatacaatt

SEQ ID NO: 22478 - DNA, 25 bp, Homo sapiens
tgagtctcgggatgaagccacagct

SEQ ID NO: 22479 - DNA, 25 bp, Homo sapiens
aacttgtattagggtagccattcac

SEQ ID NO: 22480 - DNA, 25 bp, Homo sapiens
agccattcacatcattttttatagg

SEQ ID NO: 22481 - DNA, 25 bp, Homo sapiens
tagggtagatcttcatattgctgtg

SEQ ID NO: 22482 - DNA, 25 bp, Homo sapiens
tccagattgttttcctagtatttcc

SEQ ID NO: 22483 - DNA, 25 bp, Homo sapiens
gaacctgtggattgtttcaattgca

SEQ ID NO: 22484 - DNA, 25 bp, Homo sapiens
aattgcatatagcttggtttccata

SEQ ID NO: 22485 - DNA, 25 bp, Homo sapiens
gtttacagaagactcactcaccagg

SEQ ID NO: 22486 - DNA, 25 bp, Homo sapiens
actcattgagggtgctcttgccagc

SEQ ID NO: 22487 - DNA, 25 bp, Homo sapiens
gaagttggctactctcagaatttgg

SEQ ID NO: 22488 - DNA, 25 bp, Homo sapiens
gctggacagatttgctttgttatag

SEQ ID NO: 22489 - DNA, 25 bp, Homo sapiens
tgcccagccacttagttttttctta

SEQ ID NO: 22490 - DNA, 25 bp, Homo sapiens
tcccacctttctatcccatagaaca

SEQ ID NO: 22491 - DNA, 25 bp, Homo sapiens
tagaacactcttttttatcttccct

SEQ ID NO: 22492 - DNA, 25 bp, Homo sapiens
tcaacagagtatttcccttggccga

SEQ ID NO: 22493 - DNA, 25 bp, Homo sapiens
aacaaggtgacatttttctgctgcc

SEQ ID NO: 22494 - DNA, 25 bp, Homo sapiens
tgcccatttgtgtcctggagacggt

SEQ ID NO: 22495 - DNA, 25 bp, Homo sapiens
tggagacggtggtaccctgaaggca

SEQ ID NO: 22496 - DNA, 25 bp, Homo sapiens
agacagcaatgacagtccacctgcc

SEQ ID NO: 22497 - DNA, 25 bp, Homo sapiens
aataaccacatggctaccttctatc

SEQ ID NO: 22498 - DNA, 25 bp, Homo sapiens
ggtggcacttatcctgaagtcgtca

SEQ ID NO: 22499 - DNA, 25 bp, Homo sapiens
aaaatgctgtgcactcattccatgg

SEQ ID NO: 22500 - DNA, 25 bp, Homo sapiens
actgtcttgtacataggcatcttat

SEQ ID NO: 22501 - DNA, 25 bp, Homo sapiens
cataggcatcttattcactgcaccc

SEQ ID NO: 22502 - DNA, 25 bp, Homo sapiens
ccgccccgcacattatttgaaagac

SEQ ID NO: 22503 - DNA, 25 bp, Homo sapiens
tctacttctttttccagggacgact

SEQ ID NO: 22504 - DNA, 25 bp, Homo sapiens
tgacatgagcacctttagatccctt

SEQ ID NO: 22505 - DNA, 25 bp, Homo sapiens
gtggaggtattgtgggttcatttga

SEQ ID NO: 22506 - DNA, 25 bp, Homo sapiens
gggttcatttgagtaagccctccaa

SEQ ID NO: 22507 - DNA, 25 bp, Homo sapiens
taagccctccaaagataccattcaa

SEQ ID NO: 22508 - DNA, 25 bp, Homo sapiens
tttacatatgttgccctaattacca

SEQ ID NO: 22509 - DNA, 25 bp, Homo sapiens
gttgccctaattaccatttgatgat

SEQ ID NO: 22510 - DNA, 25 bp, Homo sapiens
gtgaatgacattggacttttagtaa

SEQ ID NO: 22511 - DNA, 25 bp, Homo sapiens
cgatgcaagtgtttctgttctggga

SEQ ID NO: 22512 - DNA, 25 bp, Homo sapiens
ggatggctggaacactgtactgagg

SEQ ID NO: 22513 - DNA, 25 bp, Homo sapiens
taaactactgaactgttacctaggt

SEQ ID NO: 22514 - DNA, 25 bp, Homo sapiens
aacaaccctgttgagtatttgctgt

SEQ ID NO: 22515 - DNA, 25 bp, Homo sapiens
gagtatttgctgtttgtccagttca

SEQ ID NO: 22516 - DNA, 25 bp, Homo sapiens
gttttgtctatatgtgcggcttttc

SEQ ID NO: 22517 - DNA, 25 bp, Homo sapiens
tccccctccaaagtcttgatagcaa

SEQ ID NO: 22518 - DNA, 25 bp, Homo sapiens
aaacggtgaaatctctagcctcttt

SEQ ID NO: 22519 - DNA, 25 bp, Homo sapiens
ttaaaaaactcctgtcttgctagac

SEQ ID NO: 22520 - DNA, 25 bp, Homo sapiens
tgttgtgcagtgtgcctgtcactac

SEQ ID NO: 22521 - DNA, 25 bp, Homo sapiens
actggtctgtactccttggatttgc

SEQ ID NO: 22522 - DNA, 25 bp, Homo sapiens
ccacttccacaaggactggcagcgg

SEQ ID NO: 22523 - DNA, 25 bp, Homo sapiens
aagatccgcagacgtaaggcccggc

SEQ ID NO: 22524 - DNA, 25 bp, Homo sapiens
tcagggtggccggcattcacaagaa

SEQ ID NO: 22525 - DNA, 25 bp, Homo sapiens
tcacaagaaggtggcccggaccatc

SEQ ID NO: 22526 - DNA, 25 bp, Homo sapiens
gaccatcggcatttctgtggatccg

SEQ ID NO: 22527 - DNA, 25 bp, Homo sapiens
ggaggcggaacaagtccacggagtc

SEQ ID NO: 22528 - DNA, 25 bp, Homo sapiens
aggccaacgtgcagcggctgaagga

SEQ ID NO: 22529 - DNA, 25 bp, Homo sapiens
tgaaggagtaccgctccaaactcat

SEQ ID NO: 22530 - DNA, 25 bp, Homo sapiens
gctgaagaactgaaactggccaccc

SEQ ID NO: 22531 - DNA, 25 bp, Homo sapiens
agctgaccggaccggtcatgcccgt

SEQ ID NO: 22532 - DNA, 25 bp, Homo sapiens
aatggcatggtcttgaagccccact

SEQ ID NO: 22533 - DNA, 25 bp, Homo sapiens
caactgtttttgcgactttataggc

SEQ ID NO: 22534 - DNA, 25 bp, Homo sapiens
tgacaattcatttatgaccactcaa

SEQ ID NO: 22535 - DNA, 25 bp, Homo sapiens
gaccactcaaacagcgttagtaacc

SEQ ID NO: 22536 - DNA, 25 bp, Homo sapiens
caggcatctgaaaaccttatctgct

SEQ ID NO: 22537 - DNA, 25 bp, Homo sapiens
gaaaaccttatctgctagacaatgt

SEQ ID NO: 22538 - DNA, 25 bp, Homo sapiens
gattcacacagagttatctgggatt

SEQ ID NO: 22539 - DNA, 25 bp, Homo sapiens
agatgcagtcaaagtcttttcagac

SEQ ID NO: 22540 - DNA, 25 bp, Homo sapiens
gacatgcccaaactttgagaatttc

SEQ ID NO: 22541 - DNA, 25 bp, Homo sapiens
gaatttcttcaaccatctaatgcta

SEQ ID NO: 22542 - DNA, 25 bp, Homo sapiens
ttcttcctgttcacaaccagttgta

SEQ ID NO: 22543 - DNA, 25 bp, Homo sapiens
gaaatactagctactgttttccttc

SEQ ID NO: 22544 - DNA, 25 bp, Homo sapiens
atggaatgcgtgaggctggcttctg

SEQ ID NO: 22545 - DNA, 25 bp, Homo sapiens
gacttcctgttgtcttcatcaaagc

SEQ ID NO: 22546 - DNA, 25 bp, Homo sapiens
ggagggcatctgtgttagtcctttc

SEQ ID NO: 22547 - DNA, 25 bp, Homo sapiens
gcagcctgttgataagctaccctgt

SEQ ID NO: 22548 - DNA, 25 bp, Homo sapiens
agccagcacgcctcaaggtagatgg

SEQ ID NO: 22549 - DNA, 25 bp, Homo sapiens
tagatggaatccccactggtcagag

SEQ ID NO: 22550 - DNA, 25 bp, Homo sapiens
aaagctatgcggacactccagcttg

SEQ ID NO: 22551 - DNA, 25 bp, Homo sapiens
aggagaaagtgcactgccttccagc

SEQ ID NO: 22552 - DNA, 25 bp, Homo sapiens
actgatgcagcttagaaccacaccc

SEQ ID NO: 22553 - DNA, 25 bp, Homo sapiens
gaaccacacccctgagagtcgtggc

SEQ ID NO: 22554 - DNA, 25 bp, Homo sapiens
gagtcgtggcaaacctttcacaacc

SEQ ID NO: 22555 - DNA, 25 bp, Homo sapiens
atgaatcacactgtccaaaccttct

SEQ ID NO: 22556 - DNA, 25 bp, Homo sapiens
ttctctcctgtcaacagtggccagc

SEQ ID NO: 22557 - DNA, 25 bp, Homo sapiens
agccccccaactatgagatgctcaa

SEQ ID NO: 22558 - DNA, 25 bp, Homo sapiens
tgttcaacaccctcttcatgaaccc

SEQ ID NO: 22559 - DNA, 25 bp, Homo sapiens
attcgcctactccgtgaagtctagg

SEQ ID NO: 22560 - DNA, 25 bp, Homo sapiens
gccaagtgcctgaacatctgggccc

SEQ ID NO: 22561 - DNA, 25 bp, Homo sapiens
atctgggccctgattctgggcatcc

SEQ ID NO: 22562 - DNA, 25 bp, Homo sapiens
catgaccattctgctcatcgtcatc

SEQ ID NO: 22563 - DNA, 25 bp, Homo sapiens
gcatcactgaggccaggagctctgc

SEQ ID NO: 22564 - DNA, 25 bp, Homo sapiens
tcctcacacgcttttctacaatggc

SEQ ID NO: 22565 - DNA, 25 bp, Homo sapiens
ggtcttcgctggacaccatgaatca

SEQ ID NO: 22566 - DNA, 25 bp, Homo sapiens
gcttaactcttttgacatctgctat

SEQ ID NO: 22567 - DNA, 25 bp, Homo sapiens
tattgtgacacatcccattgctggc

SEQ ID NO: 22568 - DNA, 25 bp, Homo sapiens
ggtgcacactccgaaacttttaact

SEQ ID NO: 22569 - DNA, 25 bp, Homo sapiens
actactgttttgtaagcctccaagg

SEQ ID NO: 22570 - DNA, 25 bp, Homo sapiens
gcctccaagggtggcattgcagggt

SEQ ID NO: 22571 - DNA, 25 bp, Homo sapiens
gagaggtgctccaagtgctgtgatt

SEQ ID NO: 22572 - DNA, 25 bp, Homo sapiens
gagcaccgtgctagaggaactgtaa

SEQ ID NO: 22573 - DNA, 25 bp, Homo sapiens
atgaagtagcgtggaggccctggac

SEQ ID NO: 22574 - DNA, 25 bp, Homo sapiens
actgctgctcgttctttaggatgga

SEQ ID NO: 22575 - DNA, 25 bp, Homo sapiens
ggactgttctggtatctggtattgg

SEQ ID NO: 22576 - DNA, 25 bp, Homo sapiens
gaagcactctatttctgttttaatg

SEQ ID NO: 22577 - DNA, 25 bp, Homo sapiens
ccctcctttcaggaactggtctcga

SEQ ID NO: 22578 - DNA, 25 bp, Homo sapiens
ggtcaactccctaaatggcagctga

SEQ ID NO: 22579 - DNA, 25 bp, Homo sapiens
aaatggcagctgagacagtcctccc

SEQ ID NO: 22580 - DNA, 25 bp, Homo sapiens
aactctgcagttgtacagccactgt

SEQ ID NO: 22581 - DNA, 25 bp, Homo sapiens
cagccactgtacagctaacatctca

SEQ ID NO: 22582 - DNA, 25 bp, Homo sapiens
ttcttccagtttggctcagattctt

SEQ ID NO: 22583 - DNA, 25 bp, Homo sapiens
aaacagctctctatactcaatcctt

SEQ ID NO: 22584 - DNA, 25 bp, Homo sapiens
tgagaagatacaggcctgcccactc

SEQ ID NO: 22585 - DNA, 25 bp, Homo sapiens
ggacctttaggagctaacctccaca

SEQ ID NO: 22586 - DNA, 25 bp, Homo sapiens
gttctttggcaatagcccagtctgg

SEQ ID NO: 22587 - DNA, 25 bp, Homo sapiens
cccagtctggacttactatgtactt

SEQ ID NO: 22588 - DNA, 25 bp, Homo sapiens
gtaggtgttaggcatgtcccaccca

SEQ ID NO: 22589 - DNA, 25 bp, Homo sapiens
acaccagagctgccgacttggagac

SEQ ID NO: 22590 - DNA, 25 bp, Homo sapiens
caccagagctgccgacttggagact

SEQ ID NO: 22591 - DNA, 25 bp, Homo sapiens
ttggtctttctgtgcttggatttgc

SEQ ID NO: 22592 - DNA, 25 bp, Homo sapiens
ggtctttctgtgcttggatttgcat

SEQ ID NO: 22593 - DNA, 25 bp, Homo sapiens
ttctgtgcttggatttgcatattta

SEQ ID NO: 22594 - DNA, 25 bp, Homo sapiens
gtgcttggatttgcatatttattgc

SEQ ID NO: 22595 - DNA, 25 bp, Homo sapiens
ttattgcattgctggtagagacccc

SEQ ID NO: 22596 - DNA, 25 bp, Homo sapiens
attgcattgctggtagagaccccca

SEQ ID NO: 22597 - DNA, 25 bp, Homo sapiens
gcattgctggtagagacccccaggc

SEQ ID NO: 22598 - DNA, 25 bp, Homo sapiens
ccgggcaccaactccatgtttggtg

SEQ ID NO: 22599 - DNA, 25 bp, Homo sapiens
tgatcatgatggccttctacacggg

SEQ ID NO: 22600 - DNA, 25 bp, Homo sapiens
ctgtctcgcgtatcagaccacaagc

SEQ ID NO: 22601 - DNA, 25 bp, Homo sapiens
gcaccatcccagtgatgttctggca

SEQ ID NO: 22602 - DNA, 25 bp, Homo sapiens
ggcaggatttgctcaaggagccctg

SEQ ID NO: 22603 - DNA, 25 bp, Homo sapiens
ctgctgcatagttttcttcgtgtct

SEQ ID NO: 22604 - DNA, 25 bp, Homo sapiens
tcttcgtgtctgacctcttcaagac

SEQ ID NO: 22605 - DNA, 25 bp, Homo sapiens
ttcaagactaagacgacgctctccc

SEQ ID NO: 22606 - DNA, 25 bp, Homo sapiens
tgcccctgctatccggaaggaaatc

SEQ ID NO: 22607 - DNA, 25 bp, Homo sapiens
gaaatcctttcacctgtggacatta

SEQ ID NO: 22608 - DNA, 25 bp, Homo sapiens
acaacatgatgtaggtgccacccac

SEQ ID NO: 22609 - DNA, 25 bp, Homo sapiens
tgctctccaatctcatcagacagta

SEQ ID NO: 22610 - DNA, 25 bp, Homo sapiens
agcaataccgtcatgtttcagccaa

SEQ ID NO: 22611 - DNA, 25 bp, Homo sapiens
caagcccagagccctaagattacaa

SEQ ID NO: 22612 - DNA, 25 bp, Homo sapiens
cagagttccctaccctaagagaatg

SEQ ID NO: 22613 - DNA, 25 bp, Homo sapiens
gttaccacctgaacagtcctcggtg

SEQ ID NO: 22614 - DNA, 25 bp, Homo sapiens
ggcagaagcaccagctgtactacta

SEQ ID NO: 22615 - DNA, 25 bp, Homo sapiens
ggtgtctccaacctgactaggtgga

SEQ ID NO: 22616 - DNA, 25 bp, Homo sapiens
gtgataggacatctggcttgccaca

SEQ ID NO: 22617 - DNA, 25 bp, Homo sapiens
gcttgccacaaaggtctgttcgacc

SEQ ID NO: 22618 - DNA, 25 bp, Homo sapiens
gttcgaccagacatatcctagctaa

SEQ ID NO: 22619 - DNA, 25 bp, Homo sapiens
gaatgtgaggccaaccttctatcag

SEQ ID NO: 22620 - DNA, 25 bp, Homo sapiens
cagctgcccaatgccatgtgaagta

SEQ ID NO: 22621 - DNA, 25 bp, Homo sapiens
caaggtcccactctaggtgatagac

SEQ ID NO: 22622 - DNA, 25 bp, Homo sapiens
gatagacagggaccccttctactga

SEQ ID NO: 22623 - DNA, 25 bp, Homo sapiens
ccttctactgaacctttgaggaaag

SEQ ID NO: 22624 - DNA, 25 bp, Homo sapiens
agatcttggatgcagacctttcaaa

SEQ ID NO: 22625 - DNA, 25 bp, Homo sapiens
accatatggatcaaccacatgcaca

SEQ ID NO: 22626 - DNA, 25 bp, Homo sapiens
catgcacatccttactacagaatcc

SEQ ID NO: 22627 - DNA, 25 bp, Homo sapiens
tactacagaatccgtcctttcattt

SEQ ID NO: 22628 - DNA, 25 bp, Homo sapiens
acaatttagctatatccactatgat

SEQ ID NO: 22629 - DNA, 25 bp, Homo sapiens
gattataaactgtgtctcgacctgt

SEQ ID NO: 22630 - DNA, 25 bp, Homo sapiens
gtgtctcgacctgtgttatttacat

SEQ ID NO: 22631 - DNA, 25 bp, Homo sapiens
gtgaaaacttgtatctgcgaaacta

SEQ ID NO: 22632 - DNA, 25 bp, Homo sapiens
atcctggccacagacagtttcaagt

SEQ ID NO: 22633 - DNA, 25 bp, Homo sapiens
ttgcttgggcggctgttggtagagt

SEQ ID NO: 22634 - DNA, 25 bp, Homo sapiens
tggtagagtgggcagtgcccgcgcc

SEQ ID NO: 22635 - DNA, 25 bp, Homo sapiens
gatggggggcacaggagctgggagc

SEQ ID NO: 22636 - DNA, 25 bp, Homo sapiens
agatgcaccgaggctgtagctgggc

SEQ ID NO: 22637 - DNA, 25 bp, Homo sapiens
gtagctgggctacttgatcttgctg

SEQ ID NO: 22638 - DNA, 25 bp, Homo sapiens
aaaaacgtatcatgcaccaactgtg

SEQ ID NO: 22639 - DNA, 25 bp, Homo sapiens
caccaactgtgaatagctgccgctt

SEQ ID NO: 22640 - DNA, 25 bp, Homo sapiens
gactgttccagagagcgggcagacc

SEQ ID NO: 22641 - DNA, 25 bp, Homo sapiens
tgtggccgatgggccatgcgggccc

SEQ ID NO: 22642 - DNA, 25 bp, Homo sapiens
gactggctcagagcccatgggggct

SEQ ID NO: 22643 - DNA, 25 bp, Homo sapiens
tgcagtcccagctcagcatgaaagc

SEQ ID NO: 22644 - DNA, 25 bp, Homo sapiens
aaagcatccctggagggcaacctgg

SEQ ID NO: 22645 - DNA, 25 bp, Homo sapiens
gacagagaaccgctactgcgtgcag

SEQ ID NO: 22646 - DNA, 25 bp, Homo sapiens
gtcccagatccaggggctgattggc

SEQ ID NO: 22647 - DNA, 25 bp, Homo sapiens
gcccagcttcgctgcgagatggagc

SEQ ID NO: 22648 - DNA, 25 bp, Homo sapiens
atcctgctggatgtgaagacgcggc

SEQ ID NO: 22649 - DNA, 25 bp, Homo sapiens
ctggagcaggagattgccacctacc

SEQ ID NO: 22650 - DNA, 25 bp, Homo sapiens
tggagggagaggatgcccacctgac

SEQ ID NO: 22651 - DNA, 25 bp, Homo sapiens
cccgtcaggtgcgtaccattgtgga

SEQ ID NO: 22652 - DNA, 25 bp, Homo sapiens
ccaggatggcaaggtcatctcctcc

SEQ ID NO: 22653 - DNA, 25 bp, Homo sapiens
gaccacccgctgaggactcagctac

SEQ ID NO: 22654 - DNA, 25 bp, Homo sapiens
gactatccaacttaacatgaaactt

SEQ ID NO: 22655 - DNA, 25 bp, Homo sapiens
gaaacttgtcaccatgagatagcat

SEQ ID NO: 22656 - DNA, 25 bp, Homo sapiens
gagatagcattagctgcccaggatg

SEQ ID NO: 22657 - DNA, 25 bp, Homo sapiens
ctgcccaggatgctgctatatatat

SEQ ID NO: 22658 - DNA, 25 bp, Homo sapiens
aaaaactcatttatacctgtgtatt

SEQ ID NO: 22659 - DNA, 25 bp, Homo sapiens
aaagctacaatctgttcaatgtttt

SEQ ID NO: 22660 - DNA, 25 bp, Homo sapiens
agttggtcttttgacgagagggagg

SEQ ID NO: 22661 - DNA, 25 bp, Homo sapiens
gagagggaggatgtcacggtcagtt

SEQ ID NO: 22662 - DNA, 25 bp, Homo sapiens
cacggtcagttgtaactttgccttc

SEQ ID NO: 22663 - DNA, 25 bp, Homo sapiens
gtgcctccttgacatttcgttcaag

SEQ ID NO: 22664 - DNA, 25 bp, Homo sapiens
aatggagctatgtcttgttttaagt

SEQ ID NO: 22665 - DNA, 25 bp, Homo sapiens
ggcctgagaaggtttggtccagcct

SEQ ID NO: 22666 - DNA, 25 bp, Homo sapiens
ggtccagcctggtttagcctggatg

SEQ ID NO: 22667 - DNA, 25 bp, Homo sapiens
tagcctggatgttgctgtgcacggt

SEQ ID NO: 22668 - DNA, 25 bp, Homo sapiens
gacccagacacatcgcactgtggat

SEQ ID NO: 22669 - DNA, 25 bp, Homo sapiens
gtagcagaaaggcacgtccactcac

SEQ ID NO: 22670 - DNA, 25 bp, Homo sapiens
tccactcacaagggacgctttggga

SEQ ID NO: 22671 - DNA, 25 bp, Homo sapiens
atcaataccaaatagcttctgtttt

SEQ ID NO: 22672 - DNA, 25 bp, Homo sapiens
ggctaaattcacagcgctatgcaat

SEQ ID NO: 22673 - DNA, 25 bp, Homo sapiens
gtaccttcagaataagcttccccac

SEQ ID NO: 22674 - DNA, 25 bp, Homo sapiens
gcttgaaaatattgttgtcccggat

SEQ ID NO: 22675 - DNA, 25 bp, Homo sapiens
tgttgtcccggatttttgttaatat

SEQ ID NO: 22676 - DNA, 25 bp, Homo sapiens
gcagctgctctccatagaagaatcc

SEQ ID NO: 22677 - DNA, 25 bp, Homo sapiens
gaatccttggcacttcagaaacagc

SEQ ID NO: 22678 - DNA, 25 bp, Homo sapiens
gatgcaagcaaagctcgcagcgcaa

SEQ ID NO: 22679 - DNA, 25 bp, Homo sapiens
gacgattggtcctctgatgaattct

SEQ ID NO: 22680 - DNA, 25 bp, Homo sapiens
ataatctcctaaatcactgacgttg

SEQ ID NO: 22681 - DNA, 25 bp, Homo sapiens
aagcccagtttgtctttcagaaggt

SEQ ID NO: 22682 - DNA, 25 bp, Homo sapiens
tgattcatctagtcattgccagaag

SEQ ID NO: 22683 - DNA, 25 bp, Homo sapiens
cagaagagtgggtctcctatttcct

SEQ ID NO: 22684 - DNA, 25 bp, Homo sapiens
cctatttcctcagaagagcggcggc

SEQ ID NO: 22685 - DNA, 25 bp, Homo sapiens
ggcgcagggataagcagcatcttga

SEQ ID NO: 22686 - DNA, 25 bp, Homo sapiens
tgatgacatcacagcagctcggctt

SEQ ID NO: 22687 - DNA, 25 bp, Homo sapiens
cccggcagcatgggcctggataaga

SEQ ID NO: 22688 - DNA, 25 bp, Homo sapiens
gggcctggataagaacacagtgcac

SEQ ID NO: 22689 - DNA, 25 bp, Homo sapiens
cacagtgcacgaccaagagcatatc

SEQ ID NO: 22690 - DNA, 25 bp, Homo sapiens
ggagcatctagaaggtgtcatcaac

SEQ ID NO: 22691 - DNA, 25 bp, Homo sapiens
tgtcgccacaagaattgcagctcca

SEQ ID NO: 22692 - DNA, 25 bp, Homo sapiens
tgcttgatggcttagaactctccac

SEQ ID NO: 22693 - DNA, 25 bp, Homo sapiens
ccatcactcatgtccataaggagga

SEQ ID NO: 22694 - DNA, 25 bp, Homo sapiens
atttggccatctcctggttatatac

SEQ ID NO: 22695 - DNA, 25 bp, Homo sapiens
gtgacccgtgataatgtgattgaac

SEQ ID NO: 22696 - DNA, 25 bp, Homo sapiens
aaataactcatttccaactactgct

SEQ ID NO: 22697 - DNA, 25 bp, Homo sapiens
gtagcgattcgttacactggggtga

SEQ ID NO: 22698 - DNA, 25 bp, Homo sapiens
ttggtgtaagcaacctgtggcctgc

SEQ ID NO: 22699 - DNA, 25 bp, Homo sapiens
ctgcacttgtggcctcgaaggaagc

SEQ ID NO: 22700 - DNA, 25 bp, Homo sapiens
ctcgaaggaagcacaaaccctccat

SEQ ID NO: 22701 - DNA, 25 bp, Homo sapiens
cccagaaagccttattgagcccctt

SEQ ID NO: 22702 - DNA, 25 bp, Homo sapiens
ttcctgagaggcaggtcttccgtcc

SEQ ID NO: 22703 - DNA, 25 bp, Homo sapiens
ggagcttcacgttgccgagtggaag

SEQ ID NO: 22704 - DNA, 25 bp, Homo sapiens
gtggaagaaccatgacctccacttg

SEQ ID NO: 22705 - DNA, 25 bp, Homo sapiens
ctccacttgcttccaaggtgctagg

SEQ ID NO: 22706 - DNA, 25 bp, Homo sapiens
gctagggaagtttcagggtacgctg

SEQ ID NO: 22707 - DNA, 25 bp, Homo sapiens
cagctggaggccgagtttctgggga

SEQ ID NO: 22708 - DNA, 25 bp, Homo sapiens
tcgattcaatgcccgatgcttctgt

SEQ ID NO: 22709 - DNA, 25 bp, Homo sapiens
agcagcagagtgctcagactttccc

SEQ ID NO: 22710 - DNA, 25 bp, Homo sapiens
gcaagcttcgacttccaggatattt

SEQ ID NO: 22711 - DNA, 25 bp, Homo sapiens
cagggaaaggcttccactctgggga

SEQ ID NO: 22712 - DNA, 25 bp, Homo sapiens
taacaactgcagctgccagagtccg

SEQ ID NO: 22713 - DNA, 25 bp, Homo sapiens
ctgattccaagaagactcccagccg

SEQ ID NO: 22714 - DNA, 25 bp, Homo sapiens
agcagccgccgaggcagtgatgcat

SEQ ID NO: 22715 - DNA, 25 bp, Homo sapiens
tttcagaaatccagtccgtgtgctc

SEQ ID NO: 22716 - DNA, 25 bp, Homo sapiens
tcagatgtggaaactgtcccccaga

SEQ ID NO: 22717 - DNA, 25 bp, Homo sapiens
gcgaagccttcaaaaatccccacgc

SEQ ID NO: 22718 - DNA, 25 bp, Homo sapiens
ccccagaggaaatcacctgccagca

SEQ ID NO: 22719 - DNA, 25 bp, Homo sapiens
taccaaggcccttccttgagcattt

SEQ ID NO: 22720 - DNA, 25 bp, Homo sapiens
ttctgcactgtaacgtgccgggcac

SEQ ID NO: 22721 - DNA, 25 bp, Homo sapiens
ccgggcacacactaaactcagttac

SEQ ID NO: 22722 - DNA, 25 bp, Homo sapiens
caggtaagtctacatcctctctgac

SEQ ID NO: 22723 - DNA, 25 bp, Homo sapiens
cactacatcaatccctgacgttagg

SEQ ID NO: 22724 - DNA, 25 bp, Homo sapiens
gggatacctcatgacattttcctgt

SEQ ID NO: 22725 - DNA, 25 bp, Homo sapiens
cccacacgcagtctttgcagtatct

SEQ ID NO: 22726 - DNA, 25 bp, Homo sapiens
gcacttgccagtactatgatattca

SEQ ID NO: 22727 - DNA, 25 bp, Homo sapiens
taccttgcagcatttctctgccatt

SEQ ID NO: 22728 - DNA, 25 bp, Homo sapiens
ggcatcctggatattagacctatta

SEQ ID NO: 22729 - DNA, 25 bp, Homo sapiens
ggttttcttttgcttgagtggacag

SEQ ID NO: 22730 - DNA, 25 bp, Homo sapiens
gcacctgtatcattgaactcatttt

SEQ ID NO: 22731 - DNA, 25 bp, Homo sapiens
gagaactttttaactattcattgac

SEQ ID NO: 22732 - DNA, 25 bp, Homo sapiens
aagactttaacctgctggcagtccc

SEQ ID NO: 22733 - DNA, 25 bp, Homo sapiens
ctgctggcagtcccaaatgaaatta

SEQ ID NO: 22734 - DNA, 25 bp, Homo sapiens
gcaactttgatatcatattccttga

SEQ ID NO: 22735 - DNA, 25 bp, Homo sapiens
gtacaaatacactatctatcttaga

SEQ ID NO: 22736 - DNA, 25 bp, Homo sapiens
ctatttatggtggtggggctttctt

SEQ ID NO: 22737 - DNA, 25 bp, Homo sapiens
gggctttcttactaatacacaaata

SEQ ID NO: 22738 - DNA, 25 bp, Homo sapiens
cagctcagataccatgtgctatcat

SEQ ID NO: 22739 - DNA, 25 bp, Homo sapiens
ggatgtgaccactgtcagatcactg

SEQ ID NO: 22740 - DNA, 25 bp, Homo sapiens
ccactgtcagatcactgttcttttc

SEQ ID NO: 22741 - DNA, 25 bp, Homo sapiens
gaaaagcctatactacaatttgaag

SEQ ID NO: 22742 - DNA, 25 bp, Homo sapiens
acattgctagctgctttacctttgc

SEQ ID NO: 22743 - DNA, 25 bp, Homo sapiens
ttacctttgcttcaggtgctcggta

SEQ ID NO: 22744 - DNA, 25 bp, Homo sapiens
ggtaatgctggagctatccttagac

SEQ ID NO: 22745 - DNA, 25 bp, Homo sapiens
cattcatcagtatcattcgtgtttg

SEQ ID NO: 22746 - DNA, 25 bp, Homo sapiens
ctgatttcttcgtcatgcattcggc

SEQ ID NO: 22747 - DNA, 25 bp, Homo sapiens
gttcaggctgttaacaattccatgc

SEQ ID NO: 22748 - DNA, 25 bp, Homo sapiens
tactttggcagagtttataccctcc

SEQ ID NO: 22749 - DNA, 25 bp, Homo sapiens
gtgctgctgttagtgcaactgctgt

SEQ ID NO: 22750 - DNA, 25 bp, Homo sapiens
atgttgagccactgttgtcatgcca

SEQ ID NO: 22751 - DNA, 25 bp, Homo sapiens
tgaggacattctagacaacagctta

SEQ ID NO: 22752 - DNA, 25 bp, Homo sapiens
gcttagttcctttttcaggctcatt

SEQ ID NO: 22753 - DNA, 25 bp, Homo sapiens
gagctcatgacgtgaagcactgttc

SEQ ID NO: 22754 - DNA, 25 bp, Homo sapiens
actgttctgtcctcaagtactcaaa

SEQ ID NO: 22755 - DNA, 25 bp, Homo sapiens
gatactgctgagtcagactgtcaga

SEQ ID NO: 22756 - DNA, 25 bp, Homo sapiens
agcactaactcgtgtttggagctct

SEQ ID NO: 22757 - DNA, 25 bp, Homo sapiens
ggagctctatccatattttactgat

SEQ ID NO: 22758 - DNA, 25 bp, Homo sapiens
ttaagtatttgttcctgccactgtg

SEQ ID NO: 22759 - DNA, 25 bp, Homo sapiens
gtggagttgactcggtgttctgtcc

SEQ ID NO: 22760 - DNA, 25 bp, Homo sapiens
gttcaataattactgtaccctcgca

SEQ ID NO: 22761 - DNA, 25 bp, Homo sapiens
taccctcgcatgactgttacagctt

SEQ ID NO: 22762 - DNA, 25 bp, Homo sapiens
aagtgccacatgcctacgattgaaa

SEQ ID NO: 22763 - DNA, 25 bp, Homo sapiens
tattgttacctctgagttgtgttcc

SEQ ID NO: 22764 - DNA, 25 bp, Homo sapiens
gtcaacgagaggggcacggtgctgc

SEQ ID NO: 22765 - DNA, 25 bp, Homo sapiens
ggaaaccgaccagctgatgtgtatt

SEQ ID NO: 22766 - DNA, 25 bp, Homo sapiens
aagaccaacatctcttcgtatgtga

SEQ ID NO: 22767 - DNA, 25 bp, Homo sapiens
tgtgaagtagtcgaccacgttttcc

SEQ ID NO: 22768 - DNA, 25 bp, Homo sapiens
agaagccattcttcagactttccct

SEQ ID NO: 22769 - DNA, 25 bp, Homo sapiens
tttccctgttcggataccttcagta

SEQ ID NO: 22770 - DNA, 25 bp, Homo sapiens
ccttcagtaacttcaccttttggag

SEQ ID NO: 22771 - DNA, 25 bp, Homo sapiens
ccactgccaccttttgaaaaccagg

SEQ ID NO: 22772 - DNA, 25 bp, Homo sapiens
aaaccaggacattcattctgcctca

SEQ ID NO: 22773 - DNA, 25 bp, Homo sapiens
tctgcctcagcgtaaaatgtcccaa

SEQ ID NO: 22774 - DNA, 25 bp, Homo sapiens
agcagtgcagagcctggttgtcacc

SEQ ID NO: 22775 - DNA, 25 bp, Homo sapiens
ttacactggctcgtggacagaacaa

SEQ ID NO: 22776 - DNA, 25 bp, Homo sapiens
gagtgttttactccaacgattgaaa

SEQ ID NO: 22777 - DNA, 25 bp, Homo sapiens
aatccacagagttgttgcctccgtt

SEQ ID NO: 22778 - DNA, 25 bp, Homo sapiens
gttgcctccgttgtagttggtgggc

SEQ ID NO: 22779 - DNA, 25 bp, Homo sapiens
ttgtagttggtgggccccgttagca

SEQ ID NO: 22780 - DNA, 25 bp, Homo sapiens
ccccgttagcattggatgcctttgc

SEQ ID NO: 22781 - DNA, 25 bp, Homo sapiens
ggatgcctttgccaaatggttcatg

SEQ ID NO: 22782 - DNA, 25 bp, Homo sapiens
gcaaacagatctgccatcgatcgca

SEQ ID NO: 22783 - DNA, 25 bp, Homo sapiens
tgccatcgatcgcagatttctgtag

SEQ ID NO: 22784 - DNA, 25 bp, Homo sapiens
tgtgcatgtgcagattcccttttgc

SEQ ID NO: 22785 - DNA, 25 bp, Homo sapiens
atagtcctgcctgaggttgcagtga

SEQ ID NO: 22786 - DNA, 25 bp, Homo sapiens
tgtaccttaaacttccacatcactg

SEQ ID NO: 22787 - DNA, 25 bp, Homo sapiens
acatcactgcaccctgaaacagagc

SEQ ID NO: 22788 - DNA, 25 bp, Homo sapiens
gtcacactctcagatctgtgtcaag

SEQ ID NO: 22789 - DNA, 25 bp, Homo sapiens
gtcaagttcaatgtgagccctggca

SEQ ID NO: 22790 - DNA, 25 bp, Homo sapiens
gcaaggctggcatattaacacctgc

SEQ ID NO: 22791 - DNA, 25 bp, Homo sapiens
ctgccttctggcttctgaaagtgag

SEQ ID NO: 22792 - DNA, 25 bp, Homo sapiens
tttgtatatgggctgcactcacgca

SEQ ID NO: 22793 - DNA, 25 bp, Homo sapiens
gctgaggtcatgtgctggaatgctg

SEQ ID NO: 22794 - DNA, 25 bp, Homo sapiens
ttggaccacacatttcaaagttgcc

SEQ ID NO: 22795 - DNA, 25 bp, Homo sapiens
gagaattccctttgcaattttatgt

SEQ ID NO: 22796 - DNA, 25 bp, Homo sapiens
ggatcaccactgtaagcacacttta

SEQ ID NO: 22797 - DNA, 25 bp, Homo sapiens
ttcacacccgcatggggacagctgt

SEQ ID NO: 22798 - DNA, 25 bp, Homo sapiens
tggggacagctgtctgtgggctgca

SEQ ID NO: 22799 - DNA, 25 bp, Homo sapiens
caagatgcctgatgcgctatgtcct

SEQ ID NO: 22800 - DNA, 25 bp, Homo sapiens
ctgttccttctagattcttctgatg

SEQ ID NO: 22801 - DNA, 25 bp, Homo sapiens
gcgactggaaagattcttcgactca

SEQ ID NO: 22802 - DNA, 25 bp, Homo sapiens
gaagactttgaaatcctgtcccttt

SEQ ID NO: 22803 - DNA, 25 bp, Homo sapiens
tcctgtccctttgaaaatcctgggg

SEQ ID NO: 22804 - DNA, 25 bp, Homo sapiens
acctgtgagagcctggggctcctgg

SEQ ID NO: 22805 - DNA, 25 bp, Homo sapiens
ttactgcttggtgtcagactgccca

SEQ ID NO: 22806 - DNA, 25 bp, Homo sapiens
agccgtctgttaggagcttccagag

SEQ ID NO: 22807 - DNA, 25 bp, Homo sapiens
gccggttctgtggttggtttggaat

SEQ ID NO: 22808 - DNA, 25 bp, Homo sapiens
tcagcccaacaatgactttcagtca

SEQ ID NO: 22809 - DNA, 25 bp, Homo sapiens
taaatcttagtcttccacatttcta

SEQ ID NO: 22810 - DNA, 25 bp, Homo sapiens
cctgacacaagtccctgtatctgaa

SEQ ID NO: 22811 - DNA, 25 bp, Homo sapiens
gtccctgtatctgaagtctagcatc

SEQ ID NO: 22812 - DNA, 25 bp, Homo sapiens
gtctagcatctcaaggctgatctgg

SEQ ID NO: 22813 - DNA, 25 bp, Homo sapiens
gaagtgtgctagtatgctccctagt

SEQ ID NO: 22814 - DNA, 25 bp, Homo sapiens
tttaatacagttccgtcattcccat

SEQ ID NO: 22815 - DNA, 25 bp, Homo sapiens
gtcattcccatcttgttttcagaag

SEQ ID NO: 22816 - DNA, 25 bp, Homo sapiens
cccattttgctcacaagccatattg

SEQ ID NO: 22817 - DNA, 25 bp, Homo sapiens
gcccgattagtggtactgtctgact

SEQ ID NO: 22818 - DNA, 25 bp, Homo sapiens
actgtctgactcacgtgtgtgatcc

SEQ ID NO: 22819 - DNA, 25 bp, Homo sapiens
cgtccgcctttggtgaatctggcag

SEQ ID NO: 22820 - DNA, 25 bp, Homo sapiens
ggaactgagcggggaccaggaggcc

SEQ ID NO: 22821 - DNA, 25 bp, Homo sapiens
ggctcgagcccttggagggcagcag

SEQ ID NO: 22822 - DNA, 25 bp, Homo sapiens
ggctgctgctctgatgggaagacgc

SEQ ID NO: 22823 - DNA, 25 bp, Homo sapiens
ccctcgctggacgcagagggctcca

SEQ ID NO: 22824 - DNA, 25 bp, Homo sapiens
tggagctggagggcgtcgagggcca

SEQ ID NO: 22825 - DNA, 25 bp, Homo sapiens
gttctacacgcccgagatggctgac

SEQ ID NO: 22826 - DNA, 25 bp, Homo sapiens
gagatggctgaccccaagtcagaac

SEQ ID NO: 22827 - DNA, 25 bp, Homo sapiens
acctcttccggaattcagacgtcaa

SEQ ID NO: 22828 - DNA, 25 bp, Homo sapiens
tccgcgccattgtggatgtgcactt

SEQ ID NO: 22829 - DNA, 25 bp, Homo sapiens
tgtggatgtgcactttgaccccacc

SEQ ID NO: 22830 - DNA, 25 bp, Homo sapiens
gaaggttgtcatgggctgttccttg

SEQ ID NO: 22831 - DNA, 25 bp, Homo sapiens
accgtggagataagcctgcggcttg

SEQ ID NO: 22832 - DNA, 25 bp, Homo sapiens
ctgcggcttgtctaaccagcgcagc

SEQ ID NO: 22833 - DNA, 25 bp, Homo sapiens
agcgcagcgcaaaggtctcaatgcc

SEQ ID NO: 22834 - DNA, 25 bp, Homo sapiens
gccttttggtaacatccgtcattgc

SEQ ID NO: 22835 - DNA, 25 bp, Homo sapiens
tttcatgtttcttattggctctgcc

SEQ ID NO: 22836 - DNA, 25 bp, Homo sapiens
cctcctgtgcttatatcatccaaaa

SEQ ID NO: 22837 - DNA, 25 bp, Homo sapiens
gagcacctttaaaacgttcgtatgt

SEQ ID NO: 22838 - DNA, 25 bp, Homo sapiens
cattttgctgtgtgaggccgatcgc

SEQ ID NO: 22839 - DNA, 25 bp, Homo sapiens
cgatcgccactgtaaaggtcctaga

SEQ ID NO: 22840 - DNA, 25 bp, Homo sapiens
gagttgcctgtttgtctctggagat

SEQ ID NO: 22841 - DNA, 25 bp, Homo sapiens
tgaggattgcttctgccatggagct

SEQ ID NO: 22842 - DNA, 25 bp, Homo sapiens
gtgaaagtgagtgccgggggtgggt

SEQ ID NO: 22843 - DNA, 25 bp, Homo sapiens
tggtcttgttcataggggagccttt

SEQ ID NO: 22844 - DNA, 25 bp, Homo sapiens
agcctttccctagcagtggaacgct

SEQ ID NO: 22845 - DNA, 25 bp, Homo sapiens
tggaacgctgtggtcattttctcta

SEQ ID NO: 22846 - DNA, 25 bp, Homo sapiens
ttttctctagcatattcccttggga

SEQ ID NO: 22847 - DNA, 25 bp, Homo sapiens
tagagacagtttgcactttcccata

SEQ ID NO: 22848 - DNA, 25 bp, Homo sapiens
atattgtgcctgggacagccatatg

SEQ ID NO: 22849 - DNA, 25 bp, Homo sapiens
tataacctgagttactcctctgctc

SEQ ID NO: 22850 - DNA, 25 bp, Homo sapiens
tactcctctgctctaacattgttgc

SEQ ID NO: 22851 - DNA, 25 bp, Homo sapiens
gagtggagtggtttggcatttctgt

SEQ ID NO: 22852 - DNA, 25 bp, Homo sapiens
tctcttgggctttatccatgtcttt

SEQ ID NO: 22853 - DNA, 25 bp, Homo sapiens
cactctgcacgcattcagtattacc

SEQ ID NO: 22854 - DNA, 25 bp, Homo sapiens
ccctggggcaatagcagcagcacca

SEQ ID NO: 22855 - DNA, 25 bp, Homo sapiens
ttggcccacccattgaacattcggc

SEQ ID NO: 22856 - DNA, 25 bp, Homo sapiens
tgaacattcggcacgtgaccttgtg

SEQ ID NO: 22857 - DNA, 25 bp, Homo sapiens
gaccttgtggggggagcggggattg

SEQ ID NO: 22858 - DNA, 25 bp, Homo sapiens
gggggggtctaatttgagagcgaga

SEQ ID NO: 22859 - DNA, 25 bp, Homo sapiens
aatgcagtactctttgtatcagtct

SEQ ID NO: 22860 - DNA, 25 bp, Homo sapiens
gtatcagtctgtcatgggtctatag

SEQ ID NO: 22861 - DNA, 25 bp, Homo sapiens
gtcatgggtctatagctgtttcaga

SEQ ID NO: 22862 - DNA, 25 bp, Homo sapiens
tttttcagctgtacttgagcatctg

SEQ ID NO: 22863 - DNA, 25 bp, Homo sapiens
gtcttccctacctcaggcaggaagg

SEQ ID NO: 22864 - DNA, 25 bp, Homo sapiens
gcctgctgcatggggtggggtaggg

SEQ ID NO: 22865 - DNA, 25 bp, Homo sapiens
ggggtagggctgactagaagggcca

SEQ ID NO: 22866 - DNA, 25 bp, Homo sapiens
tagaagggccagtcctgcctggcca

SEQ ID NO: 22867 - DNA, 25 bp, Homo sapiens
ctctgctgtacatatttgagactag

SEQ ID NO: 22868 - DNA, 25 bp, Homo sapiens
actatttttgttaagcgtgtctgta

SEQ ID NO: 22869 - DNA, 25 bp, Homo sapiens
gcagtgcgcgtgcacgtggagagct

SEQ ID NO: 22870 - DNA, 25 bp, Homo sapiens
agctggtgcccggagattggacggc

SEQ ID NO: 22871 - DNA, 25 bp, Homo sapiens
gcccggagattggacggcctgatgc

SEQ ID NO: 22872 - DNA, 25 bp, Homo sapiens
ccctggtccagggaagctggccgag

SEQ ID NO: 22873 - DNA, 25 bp, Homo sapiens
tccagctctttgaaatagtctgtgt

SEQ ID NO: 22874 - DNA, 25 bp, Homo sapiens
tattttggtacctgtgcttgccaca

SEQ ID NO: 22875 - DNA, 25 bp, Homo sapiens
ttgatagatttctctttgacttcca

SEQ ID NO: 22876 - DNA, 25 bp, Homo sapiens
ttgacttccaagacctagcagttat

SEQ ID NO: 22877 - DNA, 25 bp, Homo sapiens
gtcctagtgcttccgaatcatttaa

SEQ ID NO: 22878 - DNA, 25 bp, Homo sapiens
aatggcattgtcggatatcttttac

SEQ ID NO: 22879 - DNA, 25 bp, Homo sapiens
atcttttacatttcaattgcaatcc

SEQ ID NO: 22880 - DNA, 25 bp, Homo sapiens
agtacttaactgtagtcttctccat

SEQ ID NO: 22881 - DNA, 25 bp, Homo sapiens
gtagtcttctccatgaattacacgt

SEQ ID NO: 22882 - DNA, 25 bp, Homo sapiens
gcctctagcttatagtttcatccct

SEQ ID NO: 22883 - DNA, 25 bp, Homo sapiens
gcctgcgtgagtctgtacagggata

SEQ ID NO: 22884 - DNA, 25 bp, Homo sapiens
ggtccaaactactctttgcactact

SEQ ID NO: 22885 - DNA, 25 bp, Homo sapiens
ctgtgaaaacttactttgcccctag

SEQ ID NO: 22886 - DNA, 25 bp, Homo sapiens
tagtctggctgctgctaggacttct

SEQ ID NO: 22887 - DNA, 25 bp, Homo sapiens
ggatagccaagccctgggtgagcga

SEQ ID NO: 22888 - DNA, 25 bp, Homo sapiens
gccctgggtgagcgagaggctggag

SEQ ID NO: 22889 - DNA, 25 bp, Homo sapiens
gaggctggagaacacaggagctcac

SEQ ID NO: 22890 - DNA, 25 bp, Homo sapiens
cccaaccatgggccactgtgaacag

SEQ ID NO: 22891 - DNA, 25 bp, Homo sapiens
cagacttcagtcctctgtttttgtt

SEQ ID NO: 22892 - DNA, 25 bp, Homo sapiens
aagccgttgagacatctgatggact

SEQ ID NO: 22893 - DNA, 25 bp, Homo sapiens
tgctgggacatcccacgtgtgatcc

SEQ ID NO: 22894 - DNA, 25 bp, Homo sapiens
ttcactccatcaggacaccaggact

SEQ ID NO: 22895 - DNA, 25 bp, Homo sapiens
gcagcaggagtcatattttctgtgt

SEQ ID NO: 22896 - DNA, 25 bp, Homo sapiens
ctaagcctccagaaacgtcttctta

SEQ ID NO: 22897 - DNA, 25 bp, Homo sapiens
tccagaaacgtcttcttaatcccca

SEQ ID NO: 22898 - DNA, 25 bp, Homo sapiens
gttttgttctatcctacatttgaga

SEQ ID NO: 22899 - DNA, 25 bp, Homo sapiens
tgttctatcctacatttgagatttc

SEQ ID NO: 22900 - DNA, 25 bp, Homo sapiens
tccaggctattaaagtcactaaatt

SEQ ID NO: 22901 - DNA, 25 bp, Homo sapiens
tctaagtatgtccatttcccatctc

SEQ ID NO: 22902 - DNA, 25 bp, Homo sapiens
cttcaagggaggtgtcagcagtatt

SEQ ID NO: 22903 - DNA, 25 bp, Homo sapiens
gtcagcagtattatctccactttca

SEQ ID NO: 22904 - DNA, 25 bp, Homo sapiens
cagtattatctccactttcaatctc

SEQ ID NO: 22905 - DNA, 25 bp, Homo sapiens
gctcctttcccctgatcagagaaag

SEQ ID NO: 22906 - DNA, 25 bp, Homo sapiens
aaagagaccagccttggtccctaag

SEQ ID NO: 22907 - DNA, 25 bp, Homo sapiens
tagggggaaacctgtgctccattac

SEQ ID NO: 22908 - DNA, 25 bp, Homo sapiens
gtgctccattaccacatgggtgcaa

SEQ ID NO: 22909 - DNA, 25 bp, Homo sapiens
gcaacaaccaagaacaaagccccgg

SEQ ID NO: 22910 - DNA, 25 bp, Homo sapiens
agccacaggcaggcatcgtagctcc

SEQ ID NO: 22911 - DNA, 25 bp, Homo sapiens
tccacagcccgaggggacacaggat

SEQ ID NO: 22912 - DNA, 25 bp, Homo sapiens
aagctgcgttggtaagtttttcatg

SEQ ID NO: 22913 - DNA, 25 bp, Homo sapiens
aggcatctcttatccttggttttaa

SEQ ID NO: 22914 - DNA, 25 bp, Homo sapiens
ggagcaaggcctggtatgagcgccc

SEQ ID NO: 22915 - DNA, 25 bp, Homo sapiens
tatgagcgccctgggtcttgttttt

SEQ ID NO: 22916 - DNA, 25 bp, Homo sapiens
ttttggtgtttcgcttttctgtaag

SEQ ID NO: 22917 - DNA, 25 bp, Homo sapiens
aaggggcctcactttagaatgaatg

SEQ ID NO: 22918 - DNA, 25 bp, Homo sapiens
cctggcaactgcttaacaaaatccc

SEQ ID NO: 22919 - DNA, 25 bp, Homo sapiens
aaatcccaagctcaggggcttctca

SEQ ID NO: 22920 - DNA, 25 bp, Homo sapiens
gcttctcagcatttacctaatttct

SEQ ID NO: 22921 - DNA, 25 bp, Homo sapiens
aaggctcttctgaaaggtggtatct

SEQ ID NO: 22922 - DNA, 25 bp, Homo sapiens
ggtggtatctgttctttcgtagcac

SEQ ID NO: 22923 - DNA, 25 bp, Homo sapiens
gggttgtaatgatcctgaatagctc

SEQ ID NO: 22924 - DNA, 25 bp, Homo sapiens
agcatggtcaaacaggcttatggtt

SEQ ID NO: 22925 - DNA, 25 bp, Homo sapiens
aatgtgttattctcttctttgggaa

SEQ ID NO: 22926 - DNA, 25 bp, Homo sapiens
tgagacacacggtcttctaagactg

SEQ ID NO: 22927 - DNA, 25 bp, Homo sapiens
aacatcacagcaagctctatctctg

SEQ ID NO: 22928 - DNA, 25 bp, Homo sapiens
acatttgtgttacttacctttggag

SEQ ID NO: 22929 - DNA, 25 bp, Homo sapiens
ctttctaaacagccccaagcaaaca

SEQ ID NO: 22930 - DNA, 25 bp, Homo sapiens
tcaagtttgtacactcttttctctc

SEQ ID NO: 22931 - DNA, 25 bp, Homo sapiens
tctctccctgttttgcagcaacaaa

SEQ ID NO: 22932 - DNA, 25 bp, Homo sapiens
aaagcttattgccatgctggtgcgg

SEQ ID NO: 22933 - DNA, 25 bp, Homo sapiens
tgctggtgcggctatggagactgtc

SEQ ID NO: 22934 - DNA, 25 bp, Homo sapiens
ggagactgtctggaaggcttggaat

SEQ ID NO: 22935 - DNA, 25 bp, Homo sapiens
gatttcttacaggcagcgtttggaa

SEQ ID NO: 22936 - DNA, 25 bp, Homo sapiens
aagcatcttcctgtaatctattata

SEQ ID NO: 22937 - DNA, 25 bp, Homo sapiens
taaaacacctcctgttgtggatggt

SEQ ID NO: 22938 - DNA, 25 bp, Homo sapiens
tgccgcttatttgccgtgagtttgg

SEQ ID NO: 22939 - DNA, 25 bp, Homo sapiens
ggagtttgttcagtggtacggtgtc

SEQ ID NO: 22940 - DNA, 25 bp, Homo sapiens
gatagcacattcagtagccttattt

SEQ ID NO: 22941 - DNA, 25 bp, Homo sapiens
tactgtatcatatgctcaactctga

SEQ ID NO: 22942 - DNA, 25 bp, Homo sapiens
aaccttgaacacggccaaaatccat

SEQ ID NO: 22943 - DNA, 25 bp, Homo sapiens
caattcaaactgacctgcatccatc

SEQ ID NO: 22944 - DNA, 25 bp, Homo sapiens
ctgcatccatccaaaacaaattcct

SEQ ID NO: 22945 - DNA, 25 bp, Homo sapiens
gagttaataccactggctcagcaaa

SEQ ID NO: 22946 - DNA, 25 bp, Homo sapiens
aggaggccctttattattgctgcag

SEQ ID NO: 22947 - DNA, 25 bp, Homo sapiens
gcctggctgagttgatgttttacat

SEQ ID NO: 22948 - DNA, 25 bp, Homo sapiens
tctcccttactgaaatctacatgac

SEQ ID NO: 22949 - DNA, 25 bp, Homo sapiens
gatgcttcttgctgggtttttgtac

SEQ ID NO: 22950 - DNA, 25 bp, Homo sapiens
atggctggaggtgtgctttgtgtga

SEQ ID NO: 22951 - DNA, 25 bp, Homo sapiens
gatagccatggaagttttaccttat

SEQ ID NO: 22952 - DNA, 25 bp, Homo sapiens
ggaagttttaccttattctgtgaga

SEQ ID NO: 22953 - DNA, 25 bp, Homo sapiens
taaaggaaagttgtcccaggattca

SEQ ID NO: 22954 - DNA, 25 bp, Homo sapiens
gatgggtagagttgggttcttgagt

SEQ ID NO: 22955 - DNA, 25 bp, Homo sapiens
ttcttgagttttaccaccacttagt

SEQ ID NO: 22956 - DNA, 25 bp, Homo sapiens
ttcccactgaattttgtaacttcct

SEQ ID NO: 22957 - DNA, 25 bp, Homo sapiens
ttgtaacttcctgtgtttgcatcct

SEQ ID NO: 22958 - DNA, 25 bp, Homo sapiens
tgctctgtgtcatctcagtcatttg

SEQ ID NO: 22959 - DNA, 25 bp, Homo sapiens
tgacttagaaagtgcccttcaaaag

SEQ ID NO: 22960 - DNA, 25 bp, Homo sapiens
gcccttcaaaaggaccctgttcact

SEQ ID NO: 22961 - DNA, 25 bp, Homo sapiens
ctgttcactgctgcacttttcaatg

SEQ ID NO: 22962 - DNA, 25 bp, Homo sapiens
cttctgtccagctttaagcactttg

SEQ ID NO: 22963 - DNA, 25 bp, Homo sapiens
gaattgcagatagtcatgttgggct

SEQ ID NO: 22964 - DNA, 25 bp, Homo sapiens
gatatattcctttacctcacatgac

SEQ ID NO: 22965 - DNA, 25 bp, Homo sapiens
atatgggtatcggctttctttttca

SEQ ID NO: 22966 - DNA, 25 bp, Homo sapiens
ttctttttcactttgactcttaaca

SEQ ID NO: 22967 - DNA, 25 bp, Homo sapiens
ttatcagtcaacttccacattaatg

SEQ ID NO: 22968 - DNA, 25 bp, Homo sapiens
accacgcttggctaagaacacctaa

SEQ ID NO: 22969 - DNA, 25 bp, Homo sapiens
ggctcaaaaaccagttccatttcta

SEQ ID NO: 22970 - DNA, 25 bp, Homo sapiens
tccatttctaatgttgtcctcacaa

SEQ ID NO: 22971 - DNA, 25 bp, Homo sapiens
ggaggaagagctgtggtttgtaact

SEQ ID NO: 22972 - DNA, 25 bp, Homo sapiens
gtttgtaacttgttcaactcaggca

SEQ ID NO: 22973 - DNA, 25 bp, Homo sapiens
ggaaaacacctcatttgaccttgcc

SEQ ID NO: 22974 - DNA, 25 bp, Homo sapiens
cctgcatttgaaccgaccaacatta

SEQ ID NO: 22975 - DNA, 25 bp, Homo sapiens
aaccgatttcagtggcgatggcatg

SEQ ID NO: 22976 - DNA, 25 bp, Homo sapiens
tgacagagctagagctcgggcccag

SEQ ID NO: 22977 - DNA, 25 bp, Homo sapiens
cccattcgcaggcacccgaaagaac

SEQ ID NO: 22978 - DNA, 25 bp, Homo sapiens
agaacttccccagtatggtggtcct

SEQ ID NO: 22979 - DNA, 25 bp, Homo sapiens
atatcttcctgtgcattccgatgga

SEQ ID NO: 22980 - DNA, 25 bp, Homo sapiens
gttcatcagatgttcaccatggcca

SEQ ID NO: 22981 - DNA, 25 bp, Homo sapiens
gccaccgcagaacaccgaagtaatt

SEQ ID NO: 22982 - DNA, 25 bp, Homo sapiens
gtcacagcacctagaaggcagcgcc

SEQ ID NO: 22983 - DNA, 25 bp, Homo sapiens
tagatgaaactgttaccttacccta

SEQ ID NO: 22984 - DNA, 25 bp, Homo sapiens
cagctgtcggtgcagagcgtggagc

SEQ ID NO: 22985 - DNA, 25 bp, Homo sapiens
agcgtggagcgcgtgcgcacagata

SEQ ID NO: 22986 - DNA, 25 bp, Homo sapiens
cacagatagcacgggctctgctgtc

SEQ ID NO: 22987 - DNA, 25 bp, Homo sapiens
tctccacggacgactcagagcaaga

SEQ ID NO: 22988 - DNA, 25 bp, Homo sapiens
ggccctggtgagctggacagtgttg

SEQ ID NO: 22989 - DNA, 25 bp, Homo sapiens
tgttggcagcagcagtgacgcggac

SEQ ID NO: 22990 - DNA, 25 bp, Homo sapiens
cactacagcctgcagagtggcaccg

SEQ ID NO: 22991 - DNA, 25 bp, Homo sapiens
gctgtgccattctggaagctccagc

SEQ ID NO: 22992 - DNA, 25 bp, Homo sapiens
ctgccccttccagctgggcagagtc

SEQ ID NO: 22993 - DNA, 25 bp, Homo sapiens
ctgcaaggaggcagggcccagcttc

SEQ ID NO: 22994 - DNA, 25 bp, Homo sapiens
ccacggtctgttctcagattcctaa

SEQ ID NO: 22995 - DNA, 25 bp, Homo sapiens
gtgtgcacacggagactcatcgtta

SEQ ID NO: 22996 - DNA, 25 bp, Homo sapiens
ggatatttgggttggcttggttttg

SEQ ID NO: 22997 - DNA, 25 bp, Homo sapiens
atggtgcctttctgagtgtctaaaa

SEQ ID NO: 22998 - DNA, 25 bp, Homo sapiens
cttgacacccctggtaaatctttca

SEQ ID NO: 22999 - DNA, 25 bp, Homo sapiens
gtaaatctttcaacacacttccact

SEQ ID NO: 23000 - DNA, 25 bp, Homo sapiens
ttccactgcctgcgtaatgaagttt

SEQ ID NO: 23001 - DNA, 25 bp, Homo sapiens
accactggaatttttcaatgccgtc

SEQ ID NO: 23002 - DNA, 25 bp, Homo sapiens
tttttacaggcttatcagtctcact

SEQ ID NO: 23003 - DNA, 25 bp, Homo sapiens
atcagtctcactgttggctgtcatt

SEQ ID NO: 23004 - DNA, 25 bp, Homo sapiens
ggacgacacacagtatggatcacat

SEQ ID NO: 23005 - DNA, 25 bp, Homo sapiens
tgttgcatgtgttttacctcgactt

SEQ ID NO: 23006 - DNA, 25 bp, Homo sapiens
caagtccccaggaaacccaatcatg

SEQ ID NO: 23007 - DNA, 25 bp, Homo sapiens
catgaggtccttgtgcctggtatgg

SEQ ID NO: 23008 - DNA, 25 bp, Homo sapiens
agtcaggatatgcattccaggctcc

SEQ ID NO: 23009 - DNA, 25 bp, Homo sapiens
gccctattcacaggcaccaggaaac

SEQ ID NO: 23010 - DNA, 25 bp, Homo sapiens
cacacaggaattcccatccctggaa

SEQ ID NO: 23011 - DNA, 25 bp, Homo sapiens
ttcaatgccccgagtccatgggttt

SEQ ID NO: 23012 - DNA, 25 bp, Homo sapiens
gccccaaggccctgaggggatctca

SEQ ID NO: 23013 - DNA, 25 bp, Homo sapiens
aatcctggaaccccgatttcaatct

SEQ ID NO: 23014 - DNA, 25 bp, Homo sapiens
tcaatctacgttctagtcactggcc

SEQ ID NO: 23015 - DNA, 25 bp, Homo sapiens
gccagaccaacagctcgagggagaa

SEQ ID NO: 23016 - DNA, 25 bp, Homo sapiens
catgtccccaaactcagcatgactc

SEQ ID NO: 23017 - DNA, 25 bp, Homo sapiens
taccaaccctgtgcatgactgatgt

SEQ ID NO: 23018 - DNA, 25 bp, Homo sapiens
ttcccaactcactttgtgttatgtg

SEQ ID NO: 23019 - DNA, 25 bp, Homo sapiens
tgaggctctgtaaccttatctaaga

SEQ ID NO: 23020 - DNA, 25 bp, Homo sapiens
cttggaagccgtcagccaagtcgcc

SEQ ID NO: 23021 - DNA, 25 bp, Homo sapiens
agtcgccacatttctctgcaaaatg

SEQ ID NO: 23022 - DNA, 25 bp, Homo sapiens
tcggttgtaagtagccagatccctc

SEQ ID NO: 23023 - DNA, 25 bp, Homo sapiens
agatccctctccagtgacattggaa

SEQ ID NO: 23024 - DNA, 25 bp, Homo sapiens
gtgacattggaacatgctacttttt

SEQ ID NO: 23025 - DNA, 25 bp, Homo sapiens
gctactttttaattggccctgtaca

SEQ ID NO: 23026 - DNA, 25 bp, Homo sapiens
ggccctgtacagtttgcttatttat

SEQ ID NO: 23027 - DNA, 25 bp, Homo sapiens
gcagacagctatttcgcactgtatt

SEQ ID NO: 23028 - DNA, 25 bp, Homo sapiens
ttacccatcaccagcatttgtacag

SEQ ID NO: 23029 - DNA, 25 bp, Homo sapiens
ggactcgatatccatggcttctttc

SEQ ID NO: 23030 - DNA, 25 bp, Homo sapiens
gcttctttccatcacaaaacgggta

SEQ ID NO: 23031 - DNA, 25 bp, Homo sapiens
gaaacacattcactgcttcagggtt

SEQ ID NO: 23032 - DNA, 25 bp, Homo sapiens
cagggttctaatctgtgtgtctcct

SEQ ID NO: 23033 - DNA, 25 bp, Homo sapiens
tgactccatttctgtaagctactct

SEQ ID NO: 23034 - DNA, 25 bp, Homo sapiens
gcaagctagccatacaaccattgta

SEQ ID NO: 23035 - DNA, 25 bp, Homo sapiens
atctctttctcttcagtatggttta

SEQ ID NO: 23036 - DNA, 25 bp, Homo sapiens
ggtttagagcccagatcagttagta

SEQ ID NO: 23037 - DNA, 25 bp, Homo sapiens
agttagtaggctttcgttgtcttct

SEQ ID NO: 23038 - DNA, 25 bp, Homo sapiens
aggaatcttcacttttgctaccttg

SEQ ID NO: 23039 - DNA, 25 bp, Homo sapiens
caaagagcagccaacagtggcctcc

SEQ ID NO: 23040 - DNA, 25 bp, Homo sapiens
ccctaccctgcaatgggattcgctt

SEQ ID NO: 23041 - DNA, 25 bp, Homo sapiens
aacttctgggactgatgcccaactc

SEQ ID NO: 23042 - DNA, 25 bp, Homo sapiens
ctcagtgcactcaagacgcatctcc

SEQ ID NO: 23043 - DNA, 25 bp, Homo sapiens
ggcgtgaggcccagaggaccacgca

SEQ ID NO: 23044 - DNA, 25 bp, Homo sapiens
gtacgatgaggcctgggctcagtga

SEQ ID NO: 23045 - DNA, 25 bp, Homo sapiens
aggacgaatgtgacagacacccctt

SEQ ID NO: 23046 - DNA, 25 bp, Homo sapiens
ccacagtcagccctttgacgaaggt

SEQ ID NO: 23047 - DNA, 25 bp, Homo sapiens
ggtgggctggtgattctggaagtat

SEQ ID NO: 23048 - DNA, 25 bp, Homo sapiens
cttccttgtggacttacgacagcag

SEQ ID NO: 23049 - DNA, 25 bp, Homo sapiens
gaagcagagaaccacctgtgctgtt

SEQ ID NO: 23050 - DNA, 25 bp, Homo sapiens
agagttctccatagacatagtctgt

SEQ ID NO: 23051 - DNA, 25 bp, Homo sapiens
ttcatgagaattctttctggcccct

SEQ ID NO: 23052 - DNA, 25 bp, Homo sapiens
agggttcaaatgcccatgagcaagc

SEQ ID NO: 23053 - DNA, 25 bp, Homo sapiens
aagccctggaaaccggagtcacagt

SEQ ID NO: 23054 - DNA, 25 bp, Homo sapiens
agttactgggtgcactgtacacttt

SEQ ID NO: 23055 - DNA, 25 bp, Homo sapiens
tttgcaagaagctgttcccgtgaag

SEQ ID NO: 23056 - DNA, 25 bp, Homo sapiens
gaagaggggtgatactgtcgcaact

SEQ ID NO: 23057 - DNA, 25 bp, Homo sapiens
atactgtcgcaactctttctgaaag

SEQ ID NO: 23058 - DNA, 25 bp, Homo sapiens
cataaaatatttcctgcagcccttc

SEQ ID NO: 23059 - DNA, 25 bp, Homo sapiens
ctgtttgcatggtggttttttatca

SEQ ID NO: 23060 - DNA, 25 bp, Homo sapiens
tttttatcatggacttggcccaaaa

SEQ ID NO: 23061 - DNA, 25 bp, Homo sapiens
gaagtgagtcttgctgatttgcaga

SEQ ID NO: 23062 - DNA, 25 bp, Homo sapiens
aaaactgcctgactaacttccatgg

SEQ ID NO: 23063 - DNA, 25 bp, Homo sapiens
tggcatggatcttacccgtgacaaa

SEQ ID NO: 23064 - DNA, 25 bp, Homo sapiens
gctcacgttgatgtcaagactaccg

SEQ ID NO: 23065 - DNA, 25 bp, Homo sapiens
accgatggttacttgcttcgtctgt

SEQ ID NO: 23066 - DNA, 25 bp, Homo sapiens
tcgtctgttctgtgttggttttact

SEQ ID NO: 23067 - DNA, 25 bp, Homo sapiens
acctcttatgctcagcaccaacagg

SEQ ID NO: 23068 - DNA, 25 bp, Homo sapiens
ccaacaggtccgccaaatccggaag

SEQ ID NO: 23069 - DNA, 25 bp, Homo sapiens
gatggaaatcatgacccgagaggtg

SEQ ID NO: 23070 - DNA, 25 bp, Homo sapiens
aggcttgccaatctatttatcctct

SEQ ID NO: 23071 - DNA, 25 bp, Homo sapiens
tcctctccatgatgtcttcgttaga

SEQ ID NO: 23072 - DNA, 25 bp, Homo sapiens
ggtctggagtccacttgtttggttg

SEQ ID NO: 23073 - DNA, 25 bp, Homo sapiens
tggttgtggcctatggtttggacat

SEQ ID NO: 23074 - DNA, 25 bp, Homo sapiens
atttaccaaactcgagtctacccat

SEQ ID NO: 23075 - DNA, 25 bp, Homo sapiens
gtctacccatccaagcagtttgacg

SEQ ID NO: 23076 - DNA, 25 bp, Homo sapiens
acgtgttaatcagcagcgtcctctt

SEQ ID NO: 23077 - DNA, 25 bp, Homo sapiens
gtttttgccaccatgatcactaaga

SEQ ID NO: 23078 - DNA, 25 bp, Homo sapiens
agagactggcacaggtgaagctcct

SEQ ID NO: 23079 - DNA, 25 bp, Homo sapiens
gtgtgtgtcagtgctcagctaagaa

SEQ ID NO: 23080 - DNA, 25 bp, Homo sapiens
atggatgaccttcacgcagaactcc

SEQ ID NO: 23081 - DNA, 25 bp, Homo sapiens
ctctctcagctgacactctcagaga

SEQ ID NO: 23082 - DNA, 25 bp, Homo sapiens
aagtccaaaggcgtctgcattgttt

SEQ ID NO: 23083 - DNA, 25 bp, Homo sapiens
aaaggaagctgaccgcacagtgtcc

SEQ ID NO: 23084 - DNA, 25 bp, Homo sapiens
cacagtgtccagacgaattggcccc

SEQ ID NO: 23085 - DNA, 25 bp, Homo sapiens
gacctcacccagcctaggagggagg

SEQ ID NO: 23086 - DNA, 25 bp, Homo sapiens
ggtgcattcagggtagatttgcctc

SEQ ID NO: 23087 - DNA, 25 bp, Homo sapiens
gatttgcctctcattcaaagttctg

SEQ ID NO: 23088 - DNA, 25 bp, Homo sapiens
tctggggctttgggcggaaaacagc

SEQ ID NO: 23089 - DNA, 25 bp, Homo sapiens
aacagccagctttggcgctgttggg

SEQ ID NO: 23090 - DNA, 25 bp, Homo sapiens
cgctgttggggagactcctccagac

SEQ ID NO: 23091 - DNA, 25 bp, Homo sapiens
ggccctgggccagggtgattggact

SEQ ID NO: 23092 - DNA, 25 bp, Homo sapiens
gctcctggacttcaaattctatata

SEQ ID NO: 23093 - DNA, 25 bp, Homo sapiens
ggagttggtctatgcaatgtcagtt

SEQ ID NO: 23094 - DNA, 25 bp, Homo sapiens
ggagtgcctcaagccaagatagtga

SEQ ID NO: 23095 - DNA, 25 bp, Homo sapiens
ataattgagctttctcatctgtcaa

SEQ ID NO: 23096 - DNA, 25 bp, Homo sapiens
tctgtcaaatgctatggttttctta

SEQ ID NO: 23097 - DNA, 25 bp, Homo sapiens
ctagatctatccaccttgttttttt

SEQ ID NO: 23098 - DNA, 25 bp, Homo sapiens
agagtcagtcattggctttgtcatt

SEQ ID NO: 23099 - DNA, 25 bp, Homo sapiens
ggctttgtcatttaccctttgagag

SEQ ID NO: 23100 - DNA, 25 bp, Homo sapiens
accctttgagagttccacaagtggt

SEQ ID NO: 23101 - DNA, 25 bp, Homo sapiens
tagagtggtttaacgtctttcctct

SEQ ID NO: 23102 - DNA, 25 bp, Homo sapiens
gtctttcctctagtactaccagtat

SEQ ID NO: 23103 - DNA, 25 bp, Homo sapiens
aatgtataccccttactgtaatttg

SEQ ID NO: 23104 - DNA, 25 bp, Homo sapiens
gttcctcttagaagtcagatcatct

SEQ ID NO: 23105 - DNA, 25 bp, Homo sapiens
caggctctactttgatcttctacaa

SEQ ID NO: 23106 - DNA, 25 bp, Homo sapiens
agatgtagccttagtcctgactgtc

SEQ ID NO: 23107 - DNA, 25 bp, Homo sapiens
caagttcaccaattctaacacaccc

SEQ ID NO: 23108 - DNA, 25 bp, Homo sapiens
acacccaactcctacaatcatatgg

SEQ ID NO: 23109 - DNA, 25 bp, Homo sapiens
aatggcctctggagccgtatttctc

SEQ ID NO: 23110 - DNA, 25 bp, Homo sapiens
ttctcacttagttctgcctgtgcaa

SEQ ID NO: 23111 - DNA, 25 bp, Homo sapiens
gcctgtgcaacctgaaaatgccctg

SEQ ID NO: 23112 - DNA, 25 bp, Homo sapiens
gaaaaatcatgtcccaagttctgag

SEQ ID NO: 23113 - DNA, 25 bp, Homo sapiens
agttctgagaattgttcacactttc

SEQ ID NO: 23114 - DNA, 25 bp, Homo sapiens
ttcacactttctaaccagagacaga

SEQ ID NO: 23115 - DNA, 25 bp, Homo sapiens
gagacagaattcagagctctttttg

SEQ ID NO: 23116 - DNA, 25 bp, Homo sapiens
tgcctacttcacgctgtgcaatgtg

SEQ ID NO: 23117 - DNA, 25 bp, Homo sapiens
gtcatgcggcatgacatcccagacc

SEQ ID NO: 23118 - DNA, 25 bp, Homo sapiens
acatcccagacctgggcaccatgtc

SEQ ID NO: 23119 - DNA, 25 bp, Homo sapiens
ttcccgtgcccaaagatgacagcca

SEQ ID NO: 23120 - DNA, 25 bp, Homo sapiens
caccttcgcaaaccaggacgactac

SEQ ID NO: 23121 - DNA, 25 bp, Homo sapiens
ggacgactacatatcattccggcac

SEQ ID NO: 23122 - DNA, 25 bp, Homo sapiens
gacagaccaccgcaacgtggagctc

SEQ ID NO: 23123 - DNA, 25 bp, Homo sapiens
gaagctgtacatgatccgtctgggc

SEQ ID NO: 23124 - DNA, 25 bp, Homo sapiens
ttacaccaataccgcacgcaagaga

SEQ ID NO: 23125 - DNA, 25 bp, Homo sapiens
atagacagacccaccagtaggaact

SEQ ID NO: 23126 - DNA, 25 bp, Homo sapiens
ctgtcacagaatggcctgctgaact

SEQ ID NO: 23127 - DNA, 25 bp, Homo sapiens
ccgtgtttatttcctattaattcag

SEQ ID NO: 23128 - DNA, 25 bp, Homo sapiens
atgtaccattttcaagcagtactac

SEQ ID NO: 23129 - DNA, 25 bp, Homo sapiens
gcagtactacattaggagccctttt

SEQ ID NO: 23130 - DNA, 25 bp, Homo sapiens
cccccgttccagtgtgaatctagta

SEQ ID NO: 23131 - DNA, 25 bp, Homo sapiens
tgtgtggcatttggagtttgtcatc

SEQ ID NO: 23132 - DNA, 25 bp, Homo sapiens
tggagtttgtcatccccattgaagg

SEQ ID NO: 23133 - DNA, 25 bp, Homo sapiens
gggagagccttctcagacatgaagc

SEQ ID NO: 23134 - DNA, 25 bp, Homo sapiens
acaaatttgatctggcttccatttg

SEQ ID NO: 23135 - DNA, 25 bp, Homo sapiens
ggattctcaatgtataagttgcctt

SEQ ID NO: 23136 - DNA, 25 bp, Homo sapiens
aagttgccttatctgttaatgtcta

SEQ ID NO: 23137 - DNA, 25 bp, Homo sapiens
ttaatgtctatcttctgtctcttta

SEQ ID NO: 23138 - DNA, 25 bp, Homo sapiens
tggtgggagggctctcaatcagcag

SEQ ID NO: 23139 - DNA, 25 bp, Homo sapiens
agccctccagcatctaatagacttg

SEQ ID NO: 23140 - DNA, 25 bp, Homo sapiens
gaatatttaatccaacctcactaca

SEQ ID NO: 23141 - DNA, 25 bp, Homo sapiens
gtagctcagtccaacgactaaccct

SEQ ID NO: 23142 - DNA, 25 bp, Homo sapiens
tgttccagccttcagcgagatggcc

SEQ ID NO: 23143 - DNA, 25 bp, Homo sapiens
tgtccatacgtgtgagtccagctaa

SEQ ID NO: 23144 - DNA, 25 bp, Homo sapiens
gcccagctcggaaggtgcgtggaga

SEQ ID NO: 23145 - DNA, 25 bp, Homo sapiens
tgcgtggagaaggctccgacgtctc

SEQ ID NO: 23146 - DNA, 25 bp, Homo sapiens
agcccttgggatggcattccgttgt

SEQ ID NO: 23147 - DNA, 25 bp, Homo sapiens
cgttgtgtgccttattcctggagaa

SEQ ID NO: 23148 - DNA, 25 bp, Homo sapiens
atctgtatacggctcgcctatagaa

SEQ ID NO: 23149 - DNA, 25 bp, Homo sapiens
caccccaaagtgaccttgccagtga

SEQ ID NO: 23150 - DNA, 25 bp, Homo sapiens
tgagctgttcagcaggtagccactg

SEQ ID NO: 23151 - DNA, 25 bp, Homo sapiens
actggggaactctcttgtggtcagc

SEQ ID NO: 23152 - DNA, 25 bp, Homo sapiens
aactctcttgtggtcagcaaagccc

SEQ ID NO: 23153 - DNA, 25 bp, Homo sapiens
gcaggccaggtgccattgagaatta

SEQ ID NO: 23154 - DNA, 25 bp, Homo sapiens
gaattaagtgctcagagggccagga

SEQ ID NO: 23155 - DNA, 25 bp, Homo sapiens
gggacaatcgcttgcagttggtaga

SEQ ID NO: 23156 - DNA, 25 bp, Homo sapiens
ggtgtttaccccatatgaagtattc

SEQ ID NO: 23157 - DNA, 25 bp, Homo sapiens
atacttgacacagaattcctttttt

SEQ ID NO: 23158 - DNA, 25 bp, Homo sapiens
gcatggttaccagtttttctcacaa

SEQ ID NO: 23159 - DNA, 25 bp, Homo sapiens
cactgaatttggtagcttttcccga

SEQ ID NO: 23160 - DNA, 25 bp, Homo sapiens
gccggggtggcagagtgagttgtct

SEQ ID NO: 23161 - DNA, 25 bp, Homo sapiens
cagagtgagttgtctcaggaccccg

SEQ ID NO: 23162 - DNA, 25 bp, Homo sapiens
ccaactccccaaacactgtggaagg

SEQ ID NO: 23163 - DNA, 25 bp, Homo sapiens
ggaagtgatccacagcattcaggcc

SEQ ID NO: 23164 - DNA, 25 bp, Homo sapiens
agtgatccacagcattcaggccact

SEQ ID NO: 23165 - DNA, 25 bp, Homo sapiens
ttcaggccacttggggtctagacca

SEQ ID NO: 23166 - DNA, 25 bp, Homo sapiens
gtctagaccatggtggtgccagcct

SEQ ID NO: 23167 - DNA, 25 bp, Homo sapiens
ctctgcccgctggagcggttgagtg

SEQ ID NO: 23168 - DNA, 25 bp, Homo sapiens
gctggagcggttgagtgcagaaggg

SEQ ID NO: 23169 - DNA, 25 bp, Homo sapiens
tgaggtgagaggtatcctggccgag

SEQ ID NO: 23170 - DNA, 25 bp, Homo sapiens
gaataaaggtagctaatctcatcat

SEQ ID NO: 23171 - DNA, 25 bp, Homo sapiens
ctcaagttgaaccctgtcggagcca

SEQ ID NO: 23172 - DNA, 25 bp, Homo sapiens
ggagccaagttcgacccttatgaac

SEQ ID NO: 23173 - DNA, 25 bp, Homo sapiens
gaacatgaggccttgttccacacac

SEQ ID NO: 23174 - DNA, 25 bp, Homo sapiens
ttgttccacacaccggttgagggga

SEQ ID NO: 23175 - DNA, 25 bp, Homo sapiens
tggggtacaagctgcatgggcgcac

SEQ ID NO: 23176 - DNA, 25 bp, Homo sapiens
gatgtaactctcaaggctggttcat

SEQ ID NO: 23177 - DNA, 25 bp, Homo sapiens
tatgagtacgtgtgaccttttccca

SEQ ID NO: 23178 - DNA, 25 bp, Homo sapiens
gccggttgcccaactgcattaatga

SEQ ID NO: 23179 - DNA, 25 bp, Homo sapiens
tcccttttagtgccacgcgttgaat

SEQ ID NO: 23180 - DNA, 25 bp, Homo sapiens
ctggtctcccgagcatcatgagtaa

SEQ ID NO: 23181 - DNA, 25 bp, Homo sapiens
gtgtctgctcagactctgctgacac

SEQ ID NO: 23182 - DNA, 25 bp, Homo sapiens
gtccctgcggcgcatgagtgactgg

SEQ ID NO: 23183 - DNA, 25 bp, Homo sapiens
tgactggcgtatttagcccgtcaca

SEQ ID NO: 23184 - DNA, 25 bp, Homo sapiens
ccgtcacatttcattcgctgaagga

SEQ ID NO: 23185 - DNA, 25 bp, Homo sapiens
gtgagttcgtttgtcttcagtcaac

SEQ ID NO: 23186 - DNA, 25 bp, Homo sapiens
acagcggctgaaactgaccactgag

SEQ ID NO: 23187 - DNA, 25 bp, Homo sapiens
atgggtgtgggcactgacagttctc

SEQ ID NO: 23188 - DNA, 25 bp, Homo sapiens
ttctcccccattatttggccaggaa

SEQ ID NO: 23189 - DNA, 25 bp, Homo sapiens
tgagcttggcttggcaaagttcctt

SEQ ID NO: 23190 - DNA, 25 bp, Homo sapiens
taccctgttctgttcatctaaatgc

SEQ ID NO: 23191 - DNA, 25 bp, Homo sapiens
tgacctcaagttgtattccctggca

SEQ ID NO: 23192 - DNA, 25 bp, Homo sapiens
gcacgcttggtgtactttaaatgtt

SEQ ID NO: 23193 - DNA, 25 bp, Homo sapiens
ttagattactcatctgtccaccaag

SEQ ID NO: 23194 - DNA, 25 bp, Homo sapiens
gtgggacatttgcatggactggggg

SEQ ID NO: 23195 - DNA, 25 bp, Homo sapiens
tggactgggggcttaaaggacttag

SEQ ID NO: 23196 - DNA, 25 bp, Homo sapiens
tgaaaatgagccaatccccacttga

SEQ ID NO: 23197 - DNA, 25 bp, Homo sapiens
gccaatccccacttgaatggttact

SEQ ID NO: 23198 - DNA, 25 bp, Homo sapiens
cacccgaggccgataaaccaacttg

SEQ ID NO: 23199 - DNA, 25 bp, Homo sapiens
accaacttggctctggttcattttt

SEQ ID NO: 23200 - DNA, 25 bp, Homo sapiens
cttttcttcatttgtgatgctcaga

SEQ ID NO: 23201 - DNA, 25 bp, Homo sapiens
gtgtgttctacactgttacaggctt

SEQ ID NO: 23202 - DNA, 25 bp, Homo sapiens
acactgttacaggcttctcttttgt

SEQ ID NO: 23203 - DNA, 25 bp, Homo sapiens
agattttagtcctacttttgtatgg

SEQ ID NO: 23204 - DNA, 25 bp, Homo sapiens
aaagaacggcagattactgaggaag

SEQ ID NO: 23205 - DNA, 25 bp, Homo sapiens
ggaagacttagagggcaaaacagag

SEQ ID NO: 23206 - DNA, 25 bp, Homo sapiens
ggtaagaaggtggatggctctgtaa

SEQ ID NO: 23207 - DNA, 25 bp, Homo sapiens
ggtggatggctctgtaaatgcctat

SEQ ID NO: 23208 - DNA, 25 bp, Homo sapiens
gcctatgccataaatgtctctcaga

SEQ ID NO: 23209 - DNA, 25 bp, Homo sapiens
gtacaggcagtacatgaatcgaaaa

SEQ ID NO: 23210 - DNA, 25 bp, Homo sapiens
aaacaggatctcagttctcctttct

SEQ ID NO: 23211 - DNA, 25 bp, Homo sapiens
ttaacttaccttgcctcaacagaag

SEQ ID NO: 23212 - DNA, 25 bp, Homo sapiens
ttgtccttattcctgtggaagcagt

SEQ ID NO: 23213 - DNA, 25 bp, Homo sapiens
tttcttcctgaatgctcattaggac

SEQ ID NO: 23214 - DNA, 25 bp, Homo sapiens
gaatgctcattaggacttcttaaaa

SEQ ID NO: 23215 - DNA, 25 bp, Homo sapiens
gaaggctgtgctactcatggacgcc

SEQ ID NO: 23216 - DNA, 25 bp, Homo sapiens
aagcgtatccggttactgcagtttg

SEQ ID NO: 23217 - DNA, 25 bp, Homo sapiens
gtcacagggacatcgcgagtaccta

SEQ ID NO: 23218 - DNA, 25 bp, Homo sapiens
ctttatggttccaatggtcctcagc

SEQ ID NO: 23219 - DNA, 25 bp, Homo sapiens
agtcctgagaaactgcccagagctc

SEQ ID NO: 23220 - DNA, 25 bp, Homo sapiens
gctcacacatgctttaatcgccttg

SEQ ID NO: 23221 - DNA, 25 bp, Homo sapiens
gccttgacttacctccatatgaaac

SEQ ID NO: 23222 - DNA, 25 bp, Homo sapiens
tcgggggtggttgttcttcaagcaa

SEQ ID NO: 23223 - DNA, 25 bp, Homo sapiens
ctgcttgcacttttgcatttgccta

SEQ ID NO: 23224 - DNA, 25 bp, Homo sapiens
cactcgtccaagttcggatgcggga

SEQ ID NO: 23225 - DNA, 25 bp, Homo sapiens
gttgtgcctctgcaggcaaagccct

SEQ ID NO: 23226 - DNA, 25 bp, Homo sapiens
gtattagtttttgatgcagacataa

SEQ ID NO: 23227 - DNA, 25 bp, Homo sapiens
aaggctagtcagaaccctataccat

SEQ ID NO: 23228 - DNA, 25 bp, Homo sapiens
gtcagaaccctataccataaagtgt

SEQ ID NO: 23229 - DNA, 25 bp, Homo sapiens
atgtatgcttgatatttctcaactg

SEQ ID NO: 23230 - DNA, 25 bp, Homo sapiens
gctgtattccagctgaccaaaacaa

SEQ ID NO: 23231 - DNA, 25 bp, Homo sapiens
gaatgcatctttataaatgggtgct

SEQ ID NO: 23232 - DNA, 25 bp, Homo sapiens
gaagccatatgtttatgtctggatt

SEQ ID NO: 23233 - DNA, 25 bp, Homo sapiens
tactatgtcatttttctttaccttg

SEQ ID NO: 23234 - DNA, 25 bp, Homo sapiens
atttcacttctacaaatcagcaaga

SEQ ID NO: 23235 - DNA, 25 bp, Homo sapiens
aatattgtgctgtaacatgggaaag

SEQ ID NO: 23236 - DNA, 25 bp, Homo sapiens
ttttcatggtttctatcaatgtgaa

SEQ ID NO: 23237 - DNA, 25 bp, Homo sapiens
gagaaccaagtcagcgtctctgtca

SEQ ID NO: 23238 - DNA, 25 bp, Homo sapiens
gccacccatcagtcacaaatctatg

SEQ ID NO: 23239 - DNA, 25 bp, Homo sapiens
gctcccagactgtagccatgcaggg

SEQ ID NO: 23240 - DNA, 25 bp, Homo sapiens
tgagtgtgaacctgatgccagcgcc

SEQ ID NO: 23241 - DNA, 25 bp, Homo sapiens
gccagcctacaatgtcaactctgtg

SEQ ID NO: 23242 - DNA, 25 bp, Homo sapiens
gaacactctcaacgccatgaatggg

SEQ ID NO: 23243 - DNA, 25 bp, Homo sapiens
tacagcatgtcccagccaatgatga

SEQ ID NO: 23244 - DNA, 25 bp, Homo sapiens
gcatgatgggcacccagccatatgc

SEQ ID NO: 23245 - DNA, 25 bp, Homo sapiens
ccatatgcccagcagccaatgcaga

SEQ ID NO: 23246 - DNA, 25 bp, Homo sapiens
ggcatgtccaaacagtctctcaatg

SEQ ID NO: 23247 - DNA, 25 bp, Homo sapiens
aaacctacggggcatcactattgga

SEQ ID NO: 23248 - DNA, 25 bp, Homo sapiens
cctcatacctacacccaaggttgtc

SEQ ID NO: 23249 - DNA, 25 bp, Homo sapiens
atacctacacccaaggttgtcagct

SEQ ID NO: 23250 - DNA, 25 bp, Homo sapiens
cctacacccaaggttgtcagctttg

SEQ ID NO: 23251 - DNA, 25 bp, Homo sapiens
tacacccaaggttgtcagctttgga

SEQ ID NO: 23252 - DNA, 25 bp, Homo sapiens
gtcagctttggattgctggggccag

SEQ ID NO: 23253 - DNA, 25 bp, Homo sapiens
cagctttggattgctggggccaggc

SEQ ID NO: 23254 - DNA, 25 bp, Homo sapiens
gccaggccccatggagggtatactg

SEQ ID NO: 23255 - DNA, 25 bp, Homo sapiens
atggagggtatactgaggggtctat

SEQ ID NO: 23256 - DNA, 25 bp, Homo sapiens
ctgaggggtctataggtttgtgatt

SEQ ID NO: 23257 - DNA, 25 bp, Homo sapiens
ataaaagctaggcgtgtttgatgcg

SEQ ID NO: 23258 - DNA, 25 bp, Homo sapiens
gctaggcgtgtttgatgcgctttta

SEQ ID NO: 23259 - DNA, 25 bp, Homo sapiens
ttccctctatccttttatttaatgc

SEQ ID NO: 23260 - DNA, 25 bp, Homo sapiens
atattacaaaatccgttctaccata

SEQ ID NO: 23261 - DNA, 25 bp, Homo sapiens
aatccgttctaccataacaatacag

SEQ ID NO: 23262 - DNA, 25 bp, Homo sapiens
gtgttactgcaccagtgttataggt

SEQ ID NO: 23263 - DNA, 25 bp, Homo sapiens
agaatgtttacttcctgcaaactgg

SEQ ID NO: 23264 - DNA, 25 bp, Homo sapiens
aagcaatccagatgtggtttactct

SEQ ID NO: 23265 - DNA, 25 bp, Homo sapiens
ggtttactctgccacagtctaatgt

SEQ ID NO: 23266 - DNA, 25 bp, Homo sapiens
gccacagtctaatgtcattcacttc

SEQ ID NO: 23267 - DNA, 25 bp, Homo sapiens
gtcattcacttcatttgatggggtc

SEQ ID NO: 23268 - DNA, 25 bp, Homo sapiens
tgatggggtcacttgttagctgtca

SEQ ID NO: 23269 - DNA, 25 bp, Homo sapiens
gatgtatctaaatgtcccgagaggg

SEQ ID NO: 23270 - DNA, 25 bp, Homo sapiens
gaagttccttttgttattgccatct

SEQ ID NO: 23271 - DNA, 25 bp, Homo sapiens
tgccatcttcgctttgctggaaatg

SEQ ID NO: 23272 - DNA, 25 bp, Homo sapiens
ggccaagcacattgcggaagaggct

SEQ ID NO: 23273 - DNA, 25 bp, Homo sapiens
gaggctgaccgcaaatacgaggagg

SEQ ID NO: 23274 - DNA, 25 bp, Homo sapiens
tagctcgtaagctggtcatcctgga

SEQ ID NO: 23275 - DNA, 25 bp, Homo sapiens
agcgtgcggaggtgtctgaactaaa

SEQ ID NO: 23276 - DNA, 25 bp, Homo sapiens
ctgaaatctctggaggctgcatctg

SEQ ID NO: 23277 - DNA, 25 bp, Homo sapiens
ctgaaagaggctgagacccgtgctg

SEQ ID NO: 23278 - DNA, 25 bp, Homo sapiens
tggaagagaaacttgcccaggccaa

SEQ ID NO: 23279 - DNA, 25 bp, Homo sapiens
gaacgtgggcttacatcagacactg

SEQ ID NO: 23280 - DNA, 25 bp, Homo sapiens
acagaaactctggagctccgtgggt

SEQ ID NO: 23281 - DNA, 25 bp, Homo sapiens
ggccaggcatgtattcctcagaggc

SEQ ID NO: 23282 - DNA, 25 bp, Homo sapiens
atgtattcctcagaggcgaaactgc

SEQ ID NO: 23283 - DNA, 25 bp, Homo sapiens
tggggcgggcatctagggtacagcc

SEQ ID NO: 23284 - DNA, 25 bp, Homo sapiens
cttggcgtctctgggattgggatga

SEQ ID NO: 23285 - DNA, 25 bp, Homo sapiens
attgggatgagtgcctggctcccat

SEQ ID NO: 23286 - DNA, 25 bp, Homo sapiens
ctcaccttttgttgctatcggcagc

SEQ ID NO: 23287 - DNA, 25 bp, Homo sapiens
tcctctgccctggaagggctccagg

SEQ ID NO: 23288 - DNA, 25 bp, Homo sapiens
tgccctggaagggctccaggacccg

SEQ ID NO: 23289 - DNA, 25 bp, Homo sapiens
ccaaggccccgtgctggatatttaa

SEQ ID NO: 23290 - DNA, 25 bp, Homo sapiens
gctggatatttaaatttaggggccg

SEQ ID NO: 23291 - DNA, 25 bp, Homo sapiens
gcatgcacccatgcaaaaggctcag

SEQ ID NO: 23292 - DNA, 25 bp, Homo sapiens
gaaaggcgatctcttcactgtgaaa

SEQ ID NO: 23293 - DNA, 25 bp, Homo sapiens
accaccagaatgcagttccagctta

SEQ ID NO: 23294 - DNA, 25 bp, Homo sapiens
aacaccgccagcgtggattttccaa

SEQ ID NO: 23295 - DNA, 25 bp, Homo sapiens
tggaaagtaagtctcgctcttgcca

SEQ ID NO: 23296 - DNA, 25 bp, Homo sapiens
gagagtctctggagcccaggatgcc

SEQ ID NO: 23297 - DNA, 25 bp, Homo sapiens
ggatgccagcatgtgccaatgactg

SEQ ID NO: 23298 - DNA, 25 bp, Homo sapiens
tgccaatgactgtcaccttcatctc

SEQ ID NO: 23299 - DNA, 25 bp, Homo sapiens
aaaagccatagccgaggactgtccc

SEQ ID NO: 23300 - DNA, 25 bp, Homo sapiens
ccgtggactgcgtctaggtcatgtg

SEQ ID NO: 23301 - DNA, 25 bp, Homo sapiens
ctctgtggtcccttcaaagttgtta

SEQ ID NO: 23302 - DNA, 25 bp, Homo sapiens
cagaccactctagccacagtatatt

SEQ ID NO: 23303 - DNA, 25 bp, Homo sapiens
ccacagtctgttgccaaggactcta

SEQ ID NO: 23304 - DNA, 25 bp, Homo sapiens
gttgccaaggactctaagatcaatg

SEQ ID NO: 23305 - DNA, 25 bp, Homo sapiens
aagatcaatgcacgtcactttcctt

SEQ ID NO: 23306 - DNA, 25 bp, Homo sapiens
gggctgttatgaggactgggttgtg

SEQ ID NO: 23307 - DNA, 25 bp, Homo sapiens
ctgggttgtgcctacttgatttgaa

SEQ ID NO: 23308 - DNA, 25 bp, Homo sapiens
gcctacttgatttgaaaacacacac

SEQ ID NO: 23309 - DNA, 25 bp, Homo sapiens
attgaaaagcaggtaccagtgcccc

SEQ ID NO: 23310 - DNA, 25 bp, Homo sapiens
tgccccttttcagacagtttttgat

SEQ ID NO: 23311 - DNA, 25 bp, Homo sapiens
agacagtttttgattcgctctagac

SEQ ID NO: 23312 - DNA, 25 bp, Homo sapiens
tttctacatgcacttaagactaaaa

SEQ ID NO: 23313 - DNA, 25 bp, Homo sapiens
gatgggagaatgtccagggcaggga

SEQ ID NO: 23314 - DNA, 25 bp, Homo sapiens
gagaatgtgtgtcacctctttgcag

SEQ ID NO: 23315 - DNA, 25 bp, Homo sapiens
gtcacctctttgcagagcttgaccc

SEQ ID NO: 23316 - DNA, 25 bp, Homo sapiens
cattgtcaccttcatcaccaaagtt

SEQ ID NO: 23317 - DNA, 25 bp, Homo sapiens
caccaaagttctactgggccagaga

SEQ ID NO: 23318 - DNA, 25 bp, Homo sapiens
aaagcaccctcccttaggaatgagg

SEQ ID NO: 23319 - DNA, 25 bp, Homo sapiens
gcccccagcctgctaagttaagtgg

SEQ ID NO: 23320 - DNA, 25 bp, Homo sapiens
ggacaggcccacaagatgaccttgc

SEQ ID NO: 23321 - DNA, 25 bp, Homo sapiens
aggaggcatcagcagttgagccccg

SEQ ID NO: 23322 - DNA, 25 bp, Homo sapiens
gagccccgaaggagatcaggcagcc

SEQ ID NO: 23323 - DNA, 25 bp, Homo sapiens
caggtgccagcacggcagggatggg

SEQ ID NO: 23324 - DNA, 25 bp, Homo sapiens
agaggggtggggagcgagtcactgc

SEQ ID NO: 23325 - DNA, 25 bp, Homo sapiens
ttccagagctacccagaccatatgg

SEQ ID NO: 23326 - DNA, 25 bp, Homo sapiens
gctacccagaccatatggtgcaccc

SEQ ID NO: 23327 - DNA, 25 bp, Homo sapiens
agaccatatggtgcacccacagatc

SEQ ID NO: 23328 - DNA, 25 bp, Homo sapiens
cccacagatccagctgcagctggtc

SEQ ID NO: 23329 - DNA, 25 bp, Homo sapiens
ccagctgcagctggtcctttaggtc

SEQ ID NO: 23330 - DNA, 25 bp, Homo sapiens
ggtcctttaggtccatggggatcca

SEQ ID NO: 23331 - DNA, 25 bp, Homo sapiens
catggggatccatgtcttctggacc

SEQ ID NO: 23332 - DNA, 25 bp, Homo sapiens
cttctggaccttgggcgccaggaat

SEQ ID NO: 23333 - DNA, 25 bp, Homo sapiens
gaccttgggcgccaggaatgggagg

SEQ ID NO: 23334 - DNA, 25 bp, Homo sapiens
gaatgggagggcagtatcctacccc

SEQ ID NO: 23335 - DNA, 25 bp, Homo sapiens
ggcagtatcctacccctaatatgcc

SEQ ID NO: 23336 - DNA, 25 bp, Homo sapiens
ttctgcatcctgtcaactctgatta

SEQ ID NO: 23337 - DNA, 25 bp, Homo sapiens
gacacttagtaccaccagtttcagc

SEQ ID NO: 23338 - DNA, 25 bp, Homo sapiens
aaatgtttgtcttgtgaccttgtgc

SEQ ID NO: 23339 - DNA, 25 bp, Homo sapiens
atttaatcctgcttgacactttacc

SEQ ID NO: 23340 - DNA, 25 bp, Homo sapiens
gacactttacccaagggagatggtc

SEQ ID NO: 23341 - DNA, 25 bp, Homo sapiens
ggagatggtcccttttatcagttga

SEQ ID NO: 23342 - DNA, 25 bp, Homo sapiens
gagaaactcatgtactcaaccagcc

SEQ ID NO: 23343 - DNA, 25 bp, Homo sapiens
tactcaaccagccacagtttcaaac

SEQ ID NO: 23344 - DNA, 25 bp, Homo sapiens
gcaaccttcttgtatgttaaaccac

SEQ ID NO: 23345 - DNA, 25 bp, Homo sapiens
tgttaaaccaccagtacgctttgta

SEQ ID NO: 23346 - DNA, 25 bp, Homo sapiens
gtacatctgtgataacgcctgtttt

SEQ ID NO: 23347 - DNA, 25 bp, Homo sapiens
attctgtggtcattcgcactgggtt

SEQ ID NO: 23348 - DNA, 25 bp, Homo sapiens
cgcactgggttgcattgattccccc

SEQ ID NO: 23349 - DNA, 25 bp, Homo sapiens
cggaactcacatcggtgatcgtccc

SEQ ID NO: 23350 - DNA, 25 bp, Homo sapiens
tgccagagctccggctgaagcaaga

SEQ ID NO: 23351 - DNA, 25 bp, Homo sapiens
gctcacctgtgcacttctaaattga

SEQ ID NO: 23352 - DNA, 25 bp, Homo sapiens
gcccacggtgtccaaccaagaagga

SEQ ID NO: 23353 - DNA, 25 bp, Homo sapiens
ggagcatctgcactccgagaaagat

SEQ ID NO: 23354 - DNA, 25 bp, Homo sapiens
tgttctgtaactgccccagtgtgac

SEQ ID NO: 23355 - DNA, 25 bp, Homo sapiens
gtggctctcggtgctagatatgcat

SEQ ID NO: 23356 - DNA, 25 bp, Homo sapiens
ttatgttgtgggcagcgtctttctc

SEQ ID NO: 23357 - DNA, 25 bp, Homo sapiens
tctttctctgcctttgctatatgca

SEQ ID NO: 23358 - DNA, 25 bp, Homo sapiens
gcctcatccctgtgaatttcttatt

SEQ ID NO: 23359 - DNA, 25 bp, Homo sapiens
acaagttctttcactatctgtgtgc

SEQ ID NO: 23360 - DNA, 25 bp, Homo sapiens
tctgtgtgcagtgctctgaggggac

SEQ ID NO: 23361 - DNA, 25 bp, Homo sapiens
gaggggacagacaaggcttgggtgt

SEQ ID NO: 23362 - DNA, 25 bp, Homo sapiens
gtgtatatgccaaccagatctcatt

SEQ ID NO: 23363 - DNA, 25 bp, Homo sapiens
gatctcattgaagtatcagcttgtt

SEQ ID NO: 23364 - DNA, 25 bp, Homo sapiens
ggtgcaagtgtagcatgtcacatgt

SEQ ID NO: 23365 - DNA, 25 bp, Homo sapiens
gtgaccatgttggatcattgacaat

SEQ ID NO: 23366 - DNA, 25 bp, Homo sapiens
gtttgcaatgaccatcttgaaccac

SEQ ID NO: 23367 - DNA, 25 bp, Homo sapiens
ccatcttgaaccacagatttctgct

SEQ ID NO: 23368 - DNA, 25 bp, Homo sapiens
gatttctgctatgtgtcatcaaaac

SEQ ID NO: 23369 - DNA, 25 bp, Homo sapiens
gatcagtctcaaatgggtttcttgg

SEQ ID NO: 23370 - DNA, 25 bp, Homo sapiens
ttgcagttcttaggtttgttggtta

SEQ ID NO: 23371 - DNA, 25 bp, Homo sapiens
cagcatcaacccctatggcatgcat

SEQ ID NO: 23372 - DNA, 25 bp, Homo sapiens
ggcctggaacctttggttcagggct

SEQ ID NO: 23373 - DNA, 25 bp, Homo sapiens
cacagtcattgccttcaacacagag

SEQ ID NO: 23374 - DNA, 25 bp, Homo sapiens
gactccctcctagtagagctatcta

SEQ ID NO: 23375 - DNA, 25 bp, Homo sapiens
gagctatctaggtttgtctggaaag

SEQ ID NO: 23376 - DNA, 25 bp, Homo sapiens
gtctggaaagtttccgaccctggct

SEQ ID NO: 23377 - DNA, 25 bp, Homo sapiens
atgtactcctcatggcttggatctc

SEQ ID NO: 23378 - DNA, 25 bp, Homo sapiens
gcttggatctctgtattcagccttt

SEQ ID NO: 23379 - DNA, 25 bp, Homo sapiens
tttcttgacctatgccttttcttag

SEQ ID NO: 23380 - DNA, 25 bp, Homo sapiens
aatgcccttgtaattaccactctga

SEQ ID NO: 23381 - DNA, 25 bp, Homo sapiens
aagtctgctgactgtgtctcttgaa

SEQ ID NO: 23382 - DNA, 25 bp, Homo sapiens
gaagtttctgctctactaactgtag

SEQ ID NO: 23383 - DNA, 25 bp, Homo sapiens
aaccacctgtggtccattgttcatt

SEQ ID NO: 23384 - DNA, 25 bp, Homo sapiens
gggagacacctagattagcagctca

SEQ ID NO: 23385 - DNA, 25 bp, Homo sapiens
ttgtactacttcagccaatctgtga

SEQ ID NO: 23386 - DNA, 25 bp, Homo sapiens
tacactgttgccttgctaggatcca

SEQ ID NO: 23387 - DNA, 25 bp, Homo sapiens
gaaatccaccctaggagacggagtc

SEQ ID NO: 23388 - DNA, 25 bp, Homo sapiens
cccatggcatccacaccaagagggt

SEQ ID NO: 23389 - DNA, 25 bp, Homo sapiens
gaggtgccggtgtgcaaagggaact

SEQ ID NO: 23390 - DNA, 25 bp, Homo sapiens
tggttcttatctgctagccttttac

SEQ ID NO: 23391 - DNA, 25 bp, Homo sapiens
gtggaattcctcacagattaaccag

SEQ ID NO: 23392 - DNA, 25 bp, Homo sapiens
attttatggcatgtcttctatttaa

SEQ ID NO: 23393 - DNA, 25 bp, Homo sapiens
attcttgcatctggccttagaaatg

SEQ ID NO: 23394 - DNA, 25 bp, Homo sapiens
gaagttatattctcaagtttatttt

SEQ ID NO: 23395 - DNA, 25 bp, Homo sapiens
gatagtacatgtgttgttcaaacct

SEQ ID NO: 23396 - DNA, 25 bp, Homo sapiens
ttggcatttagtaaccttaattctt

SEQ ID NO: 23397 - DNA, 25 bp, Homo sapiens
taaagtattgtcccctctttttgca

SEQ ID NO: 23398 - DNA, 25 bp, Homo sapiens
tcccctctttttgcactaattgtgg

SEQ ID NO: 23399 - DNA, 25 bp, Homo sapiens
aattgtggatttttttagatgcttc

SEQ ID NO: 23400 - DNA, 25 bp, Homo sapiens
tttagatgcttctcaaaattttcag

SEQ ID NO: 23401 - DNA, 25 bp, Homo sapiens
ggaatggtctctttgatttaaaatg

SEQ ID NO: 23402 - DNA, 25 bp, Homo sapiens
gttcttcttcggcagtggtggtatc

SEQ ID NO: 23403 - DNA, 25 bp, Homo sapiens
gcctccagactctgtggttgatgtg

SEQ ID NO: 23404 - DNA, 25 bp, Homo sapiens
aaatctttctggagtacctctcctc

SEQ ID NO: 23405 - DNA, 25 bp, Homo sapiens
cctgttccgaggtgaggcctacaac

SEQ ID NO: 23406 - DNA, 25 bp, Homo sapiens
ggcctacaacctctttgaacacaat

SEQ ID NO: 23407 - DNA, 25 bp, Homo sapiens
gaacacaattgtaacaccttcagca

SEQ ID NO: 23408 - DNA, 25 bp, Homo sapiens
aacgaagtggcacagttcctgactg

SEQ ID NO: 23409 - DNA, 25 bp, Homo sapiens
agattccttcttacatcacagacct

SEQ ID NO: 23410 - DNA, 25 bp, Homo sapiens
cctcctggactccattcagatccag

SEQ ID NO: 23411 - DNA, 25 bp, Homo sapiens
cggccagagctaacaggactgcctg

SEQ ID NO: 23412 - DNA, 25 bp, Homo sapiens
accgtcaggccgcatgtagacaatg

SEQ ID NO: 23413 - DNA, 25 bp, Homo sapiens
gtacagtttccaacagctgtccttc

SEQ ID NO: 23414 - DNA, 25 bp, Homo sapiens
tgtccttcctcagtactctaatggc

SEQ ID NO: 23415 - DNA, 25 bp, Homo sapiens
ggccactccaccgcgagtggaagtc

SEQ ID NO: 23416 - DNA, 25 bp, Homo sapiens
gtgtgtacacaggtggtcccaatca

SEQ ID NO: 23417 - DNA, 25 bp, Homo sapiens
aaactccatcttttgagcccaatta

SEQ ID NO: 23418 - DNA, 25 bp, Homo sapiens
gagcccaattatgtccattttgtta

SEQ ID NO: 23419 - DNA, 25 bp, Homo sapiens
atttctgtattaaccatcatgcgca

SEQ ID NO: 23420 - DNA, 25 bp, Homo sapiens
gaaaactcctggcattggatcttaa

SEQ ID NO: 23421 - DNA, 25 bp, Homo sapiens
aagacactgctttgctatatttaaa

SEQ ID NO: 23422 - DNA, 25 bp, Homo sapiens
agaagctgtacacggtttgatcatg

SEQ ID NO: 23423 - DNA, 25 bp, Homo sapiens
aaaccgtttggcggcacaagctgga

SEQ ID NO: 23424 - DNA, 25 bp, Homo sapiens
gttggccttgattgtggctcagcat

SEQ ID NO: 23425 - DNA, 25 bp, Homo sapiens
ctcagcatcgtgatcgttccaatgt

SEQ ID NO: 23426 - DNA, 25 bp, Homo sapiens
gttccaatgtcctgtctggcattaa

SEQ ID NO: 23427 - DNA, 25 bp, Homo sapiens
gcaagtgttcatcttccacgtattg

SEQ ID NO: 23428 - DNA, 25 bp, Homo sapiens
ggtatggtactgagcgacttattcg

SEQ ID NO: 23429 - DNA, 25 bp, Homo sapiens
agaggcatcccaacttacatatatt

SEQ ID NO: 23430 - DNA, 25 bp, Homo sapiens
gaagcaagtctgctgtccttcattc

SEQ ID NO: 23431 - DNA, 25 bp, Homo sapiens
gtgccttaagaattggcccagcctc

SEQ ID NO: 23432 - DNA, 25 bp, Homo sapiens
tggtgggcctcagaaattgtctctt

SEQ ID NO: 23433 - DNA, 25 bp, Homo sapiens
gagtttcagtttggttctcctggat

SEQ ID NO: 23434 - DNA, 25 bp, Homo sapiens
ttgaccccagcttgctagttgcata

SEQ ID NO: 23435 - DNA, 25 bp, Homo sapiens
ctggctcactttgcagttggcactg

SEQ ID NO: 23436 - DNA, 25 bp, Homo sapiens
tgcttgtccagttgtgagctgtcct

SEQ ID NO: 23437 - DNA, 25 bp, Homo sapiens
ggtgttaccgaggctgtgcctagag

SEQ ID NO: 23438 - DNA, 25 bp, Homo sapiens
tgatgaaaggtgtgctcgctctctg

SEQ ID NO: 23439 - DNA, 25 bp, Homo sapiens
cctccttgttcctgcaaaccacaag

SEQ ID NO: 23440 - DNA, 25 bp, Homo sapiens
taaaggtagtggtgtgtctcgaccc

SEQ ID NO: 23441 - DNA, 25 bp, Homo sapiens
acacacacaagtcctcaaaagtttc

SEQ ID NO: 23442 - DNA, 25 bp, Homo sapiens
gtttcagctccgtgtgtgagatgtg

SEQ ID NO: 23443 - DNA, 25 bp, Homo sapiens
ttggggcctcaaatttgactctgcc

SEQ ID NO: 23444 - DNA, 25 bp, Homo sapiens
tatatcctatgcagagttacagtca

SEQ ID NO: 23445 - DNA, 25 bp, Homo sapiens
atgttacaataaagccttcctctga

SEQ ID NO: 23446 - DNA, 25 bp, Homo sapiens
agagggccacgtaactgagagctta

SEQ ID NO: 23447 - DNA, 25 bp, Homo sapiens
gagagcttacagtgccaatgccgtt

SEQ ID NO: 23448 - DNA, 25 bp, Homo sapiens
atgccgtttgtgttctggccagagt

SEQ ID NO: 23449 - DNA, 25 bp, Homo sapiens
gactcccaggcgctgagattgttgc

SEQ ID NO: 23450 - DNA, 25 bp, Homo sapiens
gctgagattgttgcctggttaccca

SEQ ID NO: 23451 - DNA, 25 bp, Homo sapiens
tggttacccaggaagctgctgttcc

SEQ ID NO: 23452 - DNA, 25 bp, Homo sapiens
agccagcggatgcacagtccgtggc

SEQ ID NO: 23453 - DNA, 25 bp, Homo sapiens
gacatcaaaattctctcttgtgcat

SEQ ID NO: 23454 - DNA, 25 bp, Homo sapiens
gcattgggccctgggtcattcaaac

SEQ ID NO: 23455 - DNA, 25 bp, Homo sapiens
gctgaacctaggccagcttgcttag

SEQ ID NO: 23456 - DNA, 25 bp, Homo sapiens
cttagcgggtcaccctgctgtgaag

SEQ ID NO: 23457 - DNA, 25 bp, Homo sapiens
aactcggcctggtgtttgacaatgt

SEQ ID NO: 23458 - DNA, 25 bp, Homo sapiens
gaagtgatcaactcccaggacattc

SEQ ID NO: 23459 - DNA, 25 bp, Homo sapiens
ggttgccacatatacctcagtgaag

SEQ ID NO: 23460 - DNA, 25 bp, Homo sapiens
agatcgtgagcgccaagtcatctga

SEQ ID NO: 23461 - DNA, 25 bp, Homo sapiens
atgaacatacttatccctcaggatg

SEQ ID NO: 23462 - DNA, 25 bp, Homo sapiens
ttatggcctaacttcctgagagacc

SEQ ID NO: 23463 - DNA, 25 bp, Homo sapiens
tgaatccccctctatcaaacaaaca

SEQ ID NO: 23464 - DNA, 25 bp, Homo sapiens
gcctccaacgattctgtgctataga

SEQ ID NO: 23465 - DNA, 25 bp, Homo sapiens
agatacagcactgtttctggcacgc

SEQ ID NO: 23466 - DNA, 25 bp, Homo sapiens
gcacgcctcgtgggcattttgaaat

SEQ ID NO: 23467 - DNA, 25 bp, Homo sapiens
taacgtttcctcatgatttgccttt

SEQ ID NO: 23468 - DNA, 25 bp, Homo sapiens
cagggcaactcccagggatgtggtg

SEQ ID NO: 23469 - DNA, 25 bp, Homo sapiens
gacatgcagggttcaagtgttcttg

SEQ ID NO: 23470 - DNA, 25 bp, Homo sapiens
cccggctcacggggagctcagaggt

SEQ ID NO: 23471 - DNA, 25 bp, Homo sapiens
cccatgcgttttgtgatcccaagtg

SEQ ID NO: 23472 - DNA, 25 bp, Homo sapiens
gaggcgtcgggagggtatacaggga

SEQ ID NO: 23473 - DNA, 25 bp, Homo sapiens
cacagccgcttgcacgtatagatac

SEQ ID NO: 23474 - DNA, 25 bp, Homo sapiens
acgtatagatactgtggtccccttt

SEQ ID NO: 23475 - DNA, 25 bp, Homo sapiens
gtaggtcccgtatttaatgcctctg

SEQ ID NO: 23476 - DNA, 25 bp, Homo sapiens
tttaatgcctctgactgcctttgaa

SEQ ID NO: 23477 - DNA, 25 bp, Homo sapiens
ctgagcctggctgttgtgtggtatt

SEQ ID NO: 23478 - DNA, 25 bp, Homo sapiens
tggtatttatgctctctttgtctgc

SEQ ID NO: 23479 - DNA, 25 bp, Homo sapiens
aatcaagctcagttattattttcca

SEQ ID NO: 23480 - DNA, 25 bp, Homo sapiens
ttatgtctttaacgttttcttatag

SEQ ID NO: 23481 - DNA, 25 bp, Homo sapiens
ttcttatagactaatttcctctttt

SEQ ID NO: 23482 - DNA, 25 bp, Homo sapiens
cttgctgctcctattttgtagtctt

SEQ ID NO: 23483 - DNA, 25 bp, Homo sapiens
gatgcttcttcagcgtaagagtagc

SEQ ID NO: 23484 - DNA, 25 bp, Homo sapiens
gagtagctatgatattcctttttat

SEQ ID NO: 23485 - DNA, 25 bp, Homo sapiens
aaatctgcaacttcttggatcatat

SEQ ID NO: 23486 - DNA, 25 bp, Homo sapiens
gtataatgcttgcaggcccagtaca

SEQ ID NO: 23487 - DNA, 25 bp, Homo sapiens
atatattgtgcctcttacagccttt

SEQ ID NO: 23488 - DNA, 25 bp, Homo sapiens
gtgcctcttacagcctttggaatac

SEQ ID NO: 23489 - DNA, 25 bp, Homo sapiens
aatgctcatgtaccaaggttttgct

SEQ ID NO: 23490 - DNA, 25 bp, Homo sapiens
tcttgatatgtcacttctgttcctc

SEQ ID NO: 23491 - DNA, 25 bp, Homo sapiens
gagaatttatcaatcatctttccga

SEQ ID NO: 23492 - DNA, 25 bp, Homo sapiens
tcatctttccgaaatgaccacattg

SEQ ID NO: 23493 - DNA, 25 bp, Homo sapiens
gaccacattgtgcttttagtttgta

SEQ ID NO: 23494 - DNA, 25 bp, Homo sapiens
gtttaagtggtcaagcaaggctcta

SEQ ID NO: 23495 - DNA, 25 bp, Homo sapiens
ggaggtagtcactgagctggacctt

SEQ ID NO: 23496 - DNA, 25 bp, Homo sapiens
gagctggaccttaaacacatctgca

SEQ ID NO: 23497 - DNA, 25 bp, Homo sapiens
ggcagggcaagaggagacagcacct

SEQ ID NO: 23498 - DNA, 25 bp, Homo sapiens
gacagcaccttgttgccagagattc

SEQ ID NO: 23499 - DNA, 25 bp, Homo sapiens
gtgatggacactgatgctctattaa

SEQ ID NO: 23500 - DNA, 25 bp, Homo sapiens
attgtcactgatcgtatttctactt

SEQ ID NO: 23501 - DNA, 25 bp, Homo sapiens
taattttagattcgccttacaatgt

SEQ ID NO: 23502 - DNA, 25 bp, Homo sapiens
taatattggttggaccttgcccatc

SEQ ID NO: 23503 - DNA, 25 bp, Homo sapiens
cttcactctagccttcgtatttgtg

SEQ ID NO: 23504 - DNA, 25 bp, Homo sapiens
cccatgcttctcaccaaatttttgt

SEQ ID NO: 23505 - DNA, 25 bp, Homo sapiens
ttgtcattgagggcacttggataac

SEQ ID NO: 23506 - DNA, 25 bp, Homo sapiens
gtgtcacagaactatgctgcctaaa

SEQ ID NO: 23507 - DNA, 25 bp, Homo sapiens
tgcctaaagtgatcttggctcctta

SEQ ID NO: 23508 - DNA, 25 bp, Homo sapiens
ttggctccttaatggtccttttggc

SEQ ID NO: 23509 - DNA, 25 bp, Homo sapiens
ttggccccttggatagttaacagct

SEQ ID NO: 23510 - DNA, 25 bp, Homo sapiens
acagctgagtaattctaatctcttc

SEQ ID NO: 23511 - DNA, 25 bp, Homo sapiens
tccttgccttaaccacaaattgtgg

SEQ ID NO: 23512 - DNA, 25 bp, Homo sapiens
gccacatgctggaagcctgaggcct

SEQ ID NO: 23513 - DNA, 25 bp, Homo sapiens
tgccccgtcgcattaatgaggccct

SEQ ID NO: 23514 - DNA, 25 bp, Homo sapiens
gcccttccacatcatttttaaacta

SEQ ID NO: 23515 - DNA, 25 bp, Homo sapiens
atttggctttcataggccacacaca

SEQ ID NO: 23516 - DNA, 25 bp, Homo sapiens
aagcaagcaccgatgagtcagtccc

SEQ ID NO: 23517 - DNA, 25 bp, Homo sapiens
tcagtcccacgtattttcttttttg

SEQ ID NO: 23518 - DNA, 25 bp, Homo sapiens
gagacatgccgggatgtgtcatcgt

SEQ ID NO: 23519 - DNA, 25 bp, Homo sapiens
ggatgtgtcatcgtgccaaatacca

SEQ ID NO: 23520 - DNA, 25 bp, Homo sapiens
ataccacatttcctgttggcacagt

SEQ ID NO: 23521 - DNA, 25 bp, Homo sapiens
tatttaacccgccattgtgtgtttt

SEQ ID NO: 23522 - DNA, 25 bp, Homo sapiens
gcttgtcacaatctaactggctatg

SEQ ID NO: 23523 - DNA, 25 bp, Homo sapiens
acacccaggtgctgattcaccagct

SEQ ID NO: 23524 - DNA, 25 bp, Homo sapiens
cagccacggacaggtgcagcgagtg

SEQ ID NO: 23525 - DNA, 25 bp, Homo sapiens
gaagctgatgcccaactgcaagtgg

SEQ ID NO: 23526 - DNA, 25 bp, Homo sapiens
ggtgcaccctgcaggtgacaacgtc

SEQ ID NO: 23527 - DNA, 25 bp, Homo sapiens
gacaacgtcatctgtgggagctacg

SEQ ID NO: 23528 - DNA, 25 bp, Homo sapiens
tggtttgacctggatctttccacca

SEQ ID NO: 23529 - DNA, 25 bp, Homo sapiens
gagacaccacaagaaggctctgcgg

SEQ ID NO: 23530 - DNA, 25 bp, Homo sapiens
tctttgcgtcaggctcggacgacgg

SEQ ID NO: 23531 - DNA, 25 bp, Homo sapiens
gacggcagtgtcatcgtctgccatg

SEQ ID NO: 23532 - DNA, 25 bp, Homo sapiens
ggcatggtgtacaatgaccttctgc

SEQ ID NO: 23533 - DNA, 25 bp, Homo sapiens
tgaagggacacgtgctgacccgaga

SEQ ID NO: 23534 - DNA, 25 bp, Homo sapiens
acaggagcagcagctatctgtcttt

SEQ ID NO: 23535 - DNA, 25 bp, Homo sapiens
ctgtcttttgctgatctacaaataa

SEQ ID NO: 23536 - DNA, 25 bp, Homo sapiens
ttagtccatagaggtccctggctac

SEQ ID NO: 23537 - DNA, 25 bp, Homo sapiens
gctaccaaacacattctcctttgaa

SEQ ID NO: 23538 - DNA, 25 bp, Homo sapiens
ataactgttttgctacaacccatga

SEQ ID NO: 23539 - DNA, 25 bp, Homo sapiens
aacccatgattattttcctgttgtg

SEQ ID NO: 23540 - DNA, 25 bp, Homo sapiens
ttactttctctttagaagtgcactt

SEQ ID NO: 23541 - DNA, 25 bp, Homo sapiens
gagacacttgggactactagagata

SEQ ID NO: 23542 - DNA, 25 bp, Homo sapiens
atgtgaggggatattgctgctttaa

SEQ ID NO: 23543 - DNA, 25 bp, Homo sapiens
atgaggctactgagtttggtgttca

SEQ ID NO: 23544 - DNA, 25 bp, Homo sapiens
aaatgttttggtggcatgaggacaa

SEQ ID NO: 23545 - DNA, 25 bp, Homo sapiens
ctcgatttgcttatggctcagccat

SEQ ID NO: 23546 - DNA, 25 bp, Homo sapiens
ttatggctcagccattacctgtgtc

SEQ ID NO: 23547 - DNA, 25 bp, Homo sapiens
agccattacctgtgtcagtccatga

SEQ ID NO: 23548 - DNA, 25 bp, Homo sapiens
tacctgtgtcagtccatgattctgt

SEQ ID NO: 23549 - DNA, 25 bp, Homo sapiens
gtcagtccatgattctgttgtaaca

SEQ ID NO: 23550 - DNA, 25 bp, Homo sapiens
ctttcactcctttggccaaaggttg

SEQ ID NO: 23551 - DNA, 25 bp, Homo sapiens
aggtagacaacaggagtggtcagag

SEQ ID NO: 23552 - DNA, 25 bp, Homo sapiens
tccactccagagcacctgagaaggc

SEQ ID NO: 23553 - DNA, 25 bp, Homo sapiens
cagagcacctgagaaggccgggacc

SEQ ID NO: 23554 - DNA, 25 bp, Homo sapiens
cacctgagaaggccgggaccagagg

SEQ ID NO: 23555 - DNA, 25 bp, Homo sapiens
gtacttctcgatttgcttatggctc

SEQ ID NO: 23556 - DNA, 25 bp, Homo sapiens
ccaagcacacaccaggaaactgcag

SEQ ID NO: 23557 - DNA, 25 bp, Homo sapiens
ccaggaaactgcaggggctcacgga

SEQ ID NO: 23558 - DNA, 25 bp, Homo sapiens
gctcacggaggaagtgctgcctggg

SEQ ID NO: 23559 - DNA, 25 bp, Homo sapiens
gctttcctccgtagagaccatgtgc

SEQ ID NO: 23560 - DNA, 25 bp, Homo sapiens
gagggagccagtgttttgtcagcag

SEQ ID NO: 23561 - DNA, 25 bp, Homo sapiens
aagggcctgctgggatgaaagtggg

SEQ ID NO: 23562 - DNA, 25 bp, Homo sapiens
tcaggagacacctcaggggcaacag

SEQ ID NO: 23563 - DNA, 25 bp, Homo sapiens
acagcacaggcccagagtacctgct

SEQ ID NO: 23564 - DNA, 25 bp, Homo sapiens
aggttgacgacaggttccaggtcct

SEQ ID NO: 23565 - DNA, 25 bp, Homo sapiens
ccctgtgtgatgtgtactccgcagc

SEQ ID NO: 23566 - DNA, 25 bp, Homo sapiens
tggggtgggacatttctgtacttct

SEQ ID NO: 23567 - DNA, 25 bp, Homo sapiens
attgcaacattgtctagttctagta

SEQ ID NO: 23568 - DNA, 25 bp, Homo sapiens
ttttgttttgagttccctcattctt

SEQ ID NO: 23569 - DNA, 25 bp, Homo sapiens
agttccctcattcttattaccagaa

SEQ ID NO: 23570 - DNA, 25 bp, Homo sapiens
atagttttactttcttggcactgga

SEQ ID NO: 23571 - DNA, 25 bp, Homo sapiens
aagctactttgttgagagtctcatt

SEQ ID NO: 23572 - DNA, 25 bp, Homo sapiens
agtctcattcttccctggagttaat

SEQ ID NO: 23573 - DNA, 25 bp, Homo sapiens
tctttggggttttctcctcatcaaa

SEQ ID NO: 23574 - DNA, 25 bp, Homo sapiens
agcatttcttaagtgcctatctaaa

SEQ ID NO: 23575 - DNA, 25 bp, Homo sapiens
ctgtgtctgccctttagaagctaag

SEQ ID NO: 23576 - DNA, 25 bp, Homo sapiens
tatatttcccatatttcaggtgaat

SEQ ID NO: 23577 - DNA, 25 bp, Homo sapiens
gacaaaaccctatctagtcaactgg

SEQ ID NO: 23578 - DNA, 25 bp, Homo sapiens
taaagatcttgctgtggctctgtta

SEQ ID NO: 23579 - DNA, 25 bp, Homo sapiens
ggctctgttatgttctgaggccttg

SEQ ID NO: 23580 - DNA, 25 bp, Homo sapiens
tgaggccttgggattagcctcttcc

SEQ ID NO: 23581 - DNA, 25 bp, Homo sapiens
tctagtctgtggatcagctatgcct

SEQ ID NO: 23582 - DNA, 25 bp, Homo sapiens
tcagctatgcctttggacacttctc

SEQ ID NO: 23583 - DNA, 25 bp, Homo sapiens
tcttttccattgtgccttttgaatg

SEQ ID NO: 23584 - DNA, 25 bp, Homo sapiens
ttgaatgttgtcttctcactcagca

SEQ ID NO: 23585 - DNA, 25 bp, Homo sapiens
actcagcatcagcacttcgatctaa

SEQ ID NO: 23586 - DNA, 25 bp, Homo sapiens
agtgaaccatccttcatttattcag

SEQ ID NO: 23587 - DNA, 25 bp, Homo sapiens
gtcattcgttcatctgtcaaacacg

SEQ ID NO: 23588 - DNA, 25 bp, Homo sapiens
gggaagcctttacagagggtgtgac

SEQ ID NO: 23589 - DNA, 25 bp, Homo sapiens
caaggtcatccctgagctgaacggg

SEQ ID NO: 23590 - DNA, 25 bp, Homo sapiens
gtccccactgccaacgtgtcagtgg

SEQ ID NO: 23591 - DNA, 25 bp, Homo sapiens
gtgtcagtggtggacctgacctgcc

SEQ ID NO: 23592 - DNA, 25 bp, Homo sapiens
gacctgccgtctagaaaaacctgcc

SEQ ID NO: 23593 - DNA, 25 bp, Homo sapiens
acactgagcaccaggtggtctcctc

SEQ ID NO: 23594 - DNA, 25 bp, Homo sapiens
tctcctctgacttcaacagcgacac

SEQ ID NO: 23595 - DNA, 25 bp, Homo sapiens
tttgacgctggggctggcattgccc

SEQ ID NO: 23596 - DNA, 25 bp, Homo sapiens
cgaccactttgtcaagctcatttcc

SEQ ID NO: 23597 - DNA, 25 bp, Homo sapiens
gcaacagggtggtggacctcatggc

SEQ ID NO: 23598 - DNA, 25 bp, Homo sapiens
tcctcacagttgccatgtagacccc

SEQ ID NO: 23599 - DNA, 25 bp, Homo sapiens
cgcaccttgtcatgtaccatcaata

SEQ ID NO: 23600 - DNA, 25 bp, Homo sapiens
gatgtgtttgcaaggatacggctgc

SEQ ID NO: 23601 - DNA, 25 bp, Homo sapiens
aaggatacggctgcagtattactaa

SEQ ID NO: 23602 - DNA, 25 bp, Homo sapiens
gaactctgaatatgccttctttttt

SEQ ID NO: 23603 - DNA, 25 bp, Homo sapiens
atatcttcgagacttgggtgtttgt

SEQ ID NO: 23604 - DNA, 25 bp, Homo sapiens
aagcagccctttttacagtctagtt

SEQ ID NO: 23605 - DNA, 25 bp, Homo sapiens
aaaaaggtttctgcacattgttgtg

SEQ ID NO: 23606 - DNA, 25 bp, Homo sapiens
gataggttcctcaggtgaccaaaac

SEQ ID NO: 23607 - DNA, 25 bp, Homo sapiens
tttcctgagggatttctaaccatgt

SEQ ID NO: 23608 - DNA, 25 bp, Homo sapiens
tctaaccatgtatctaatcctccca

SEQ ID NO: 23609 - DNA, 25 bp, Homo sapiens
ctaatcctcccatttgggcagtata

SEQ ID NO: 23610 - DNA, 25 bp, Homo sapiens
gggcagtataggtgtttgctttttt

SEQ ID NO: 23611 - DNA, 25 bp, Homo sapiens
aagtgaaccatctcagacctttact

SEQ ID NO: 23612 - DNA, 25 bp, Homo sapiens
gacctttactgatactacaactttt

SEQ ID NO: 23613 - DNA, 25 bp, Homo sapiens
agaatcccttcagttttagctacca

SEQ ID NO: 23614 - DNA, 25 bp, Homo sapiens
gctaccaacggccaggaaaagccct

SEQ ID NO: 23615 - DNA, 25 bp, Homo sapiens
tctctcctcagtttacatcttgttg

SEQ ID NO: 23616 - DNA, 25 bp, Homo sapiens
atcttgttggtacctttctagcctt

SEQ ID NO: 23617 - DNA, 25 bp, Homo sapiens
aatgatcaccatgttagccttagac

SEQ ID NO: 23618 - DNA, 25 bp, Homo sapiens
ctggctagtcctttctgtgaagcta

SEQ ID NO: 23619 - DNA, 25 bp, Homo sapiens
tatacacagacatgctcttttttta

SEQ ID NO: 23620 - DNA, 25 bp, Homo sapiens
gaatcatactgcctactgttactct

SEQ ID NO: 23621 - DNA, 25 bp, Homo sapiens
aatgtgaatttttgcctatctttaa

SEQ ID NO: 23622 - DNA, 25 bp, Homo sapiens
gcttcttaaagctgactgttcttgc

SEQ ID NO: 23623 - DNA, 25 bp, Homo sapiens
ccacttgcttctcctagagtacaaa

SEQ ID NO: 23624 - DNA, 25 bp, Homo sapiens
gccttccttactaactgcagggtct

SEQ ID NO: 23625 - DNA, 25 bp, Homo sapiens
aactgcagggtctctctattacacc

SEQ ID NO: 23626 - DNA, 25 bp, Homo sapiens
acctcaacatacacactttgctgct

SEQ ID NO: 23627 - DNA, 25 bp, Homo sapiens
gctgctactgtttgtactgtctaca

SEQ ID NO: 23628 - DNA, 25 bp, Homo sapiens
ccttatcttgctcctggtagtgcat

SEQ ID NO: 23629 - DNA, 25 bp, Homo sapiens
gtaattgaattacctccctgtagct

SEQ ID NO: 23630 - DNA, 25 bp, Homo sapiens
tgaccttgctagttctttcattaga

SEQ ID NO: 23631 - DNA, 25 bp, Homo sapiens
ggtcatactaaacctgtctatttcc

SEQ ID NO: 23632 - DNA, 25 bp, Homo sapiens
atgattttccttcgtacagacagct

SEQ ID NO: 23633 - DNA, 25 bp, Homo sapiens
atcatatgtataacctagcatacga

SEQ ID NO: 23634 - DNA, 25 bp, Homo sapiens
aacctagcatacgaatgagcagatt

SEQ ID NO: 23635 - DNA, 25 bp, Homo sapiens
gagcagatttaaacacataacttca

SEQ ID NO: 23636 - DNA, 25 bp, Homo sapiens
acacataacttcaagccatttctga

SEQ ID NO: 23637 - DNA, 25 bp, Homo sapiens
aaaacatacaccaggagctctgctc

SEQ ID NO: 23638 - DNA, 25 bp, Homo sapiens
gtgtcaccctgggaaggtcgtggtg

SEQ ID NO: 23639 - DNA, 25 bp, Homo sapiens
tgggaaggtcgtggtgcgttgtggc

SEQ ID NO: 23640 - DNA, 25 bp, Homo sapiens
ggtcgtggtgcgttgtggcatatta

SEQ ID NO: 23641 - DNA, 25 bp, Homo sapiens
gtggcatattaagtctaaaccagat

SEQ ID NO: 23642 - DNA, 25 bp, Homo sapiens
tctgttccatccaggtcagcaatca

SEQ ID NO: 23643 - DNA, 25 bp, Homo sapiens
gttccatccaggtcagcaatcagat

SEQ ID NO: 23644 - DNA, 25 bp, Homo sapiens
gttttcatcctaagcctcaaatcat

SEQ ID NO: 23645 - DNA, 25 bp, Homo sapiens
aatttgcctgtttatttatgaccta

SEQ ID NO: 23646 - DNA, 25 bp, Homo sapiens
ggatccctgattaagctgatgacta

SEQ ID NO: 23647 - DNA, 25 bp, Homo sapiens
acaattaattttcctgcagtatatg

SEQ ID NO: 23648 - DNA, 25 bp, Homo sapiens
ggaatacgttttaggatgtcatcat

SEQ ID NO: 23649 - DNA, 25 bp, Homo sapiens
aagagattcacttaattgccttttt

SEQ ID NO: 23650 - DNA, 25 bp, Homo sapiens
tttgcccacgtatattatgtagtct

SEQ ID NO: 23651 - DNA, 25 bp, Homo sapiens
gtagtctatttgcaactgttcttaa

SEQ ID NO: 23652 - DNA, 25 bp, Homo sapiens
gtggatgttaattgtctccccacct

SEQ ID NO: 23653 - DNA, 25 bp, Homo sapiens
gtctccccacctatatttatgggtg

SEQ ID NO: 23654 - DNA, 25 bp, Homo sapiens
gggtgttagcgcaactgctttgcta

SEQ ID NO: 23655 - DNA, 25 bp, Homo sapiens
gctcctgtagctgcattatttcttg

SEQ ID NO: 23656 - DNA, 25 bp, Homo sapiens
caccgctcagctgtcttgtaaaaca

SEQ ID NO: 23657 - DNA, 25 bp, Homo sapiens
tttctggttctagtaatcctgggtg

SEQ ID NO: 23658 - DNA, 25 bp, Homo sapiens
atcctgggtgtttatcacgttcaga

SEQ ID NO: 23659 - DNA, 25 bp, Homo sapiens
gctattgcatgattagccccctatc

SEQ ID NO: 23660 - DNA, 25 bp, Homo sapiens
cctgggtagtctgtgcttgtaatcc

SEQ ID NO: 23661 - DNA, 25 bp, Homo sapiens
gtaagcctgttgtgactttgctttt

SEQ ID NO: 23662 - DNA, 25 bp, Homo sapiens
ggggtctatgtcattggtttctgat

SEQ ID NO: 23663 - DNA, 25 bp, Homo sapiens
gcacctctggctgttacattaccat

SEQ ID NO: 23664 - DNA, 25 bp, Homo sapiens
aaaccatatcacatgcctacatttt

SEQ ID NO: 23665 - DNA, 25 bp, Homo sapiens
ctaacatagtactttctttccagca

SEQ ID NO: 23666 - DNA, 25 bp, Homo sapiens
ggatgacagagacagcgccaatggc

SEQ ID NO: 23667 - DNA, 25 bp, Homo sapiens
atcttatcccattatttctttacct

SEQ ID NO: 23668 - DNA, 25 bp, Homo sapiens
ttctttacctaggcgcttgtctaag

SEQ ID NO: 23669 - DNA, 25 bp, Homo sapiens
tcaaatttttcaccagatcctctcc

SEQ ID NO: 23670 - DNA, 25 bp, Homo sapiens
tcttcagcacatgctcactgttctc

SEQ ID NO: 23671 - DNA, 25 bp, Homo sapiens
ttgtccttcccatgttcattaattc

SEQ ID NO: 23672 - DNA, 25 bp, Homo sapiens
tcctttgacgctcctagtagttttg

SEQ ID NO: 23673 - DNA, 25 bp, Homo sapiens
gattctctcctggaaaacctggaaa

SEQ ID NO: 23674 - DNA, 25 bp, Homo sapiens
gagcagagcagcagctccgtgaaga

SEQ ID NO: 23675 - DNA, 25 bp, Homo sapiens
gactctgctgaggagggggacctac

SEQ ID NO: 23676 - DNA, 25 bp, Homo sapiens
gatcggggggatgaccagctggagt

SEQ ID NO: 23677 - DNA, 25 bp, Homo sapiens
aaatgtgaccctcgccatggtaaat

SEQ ID NO: 23678 - DNA, 25 bp, Homo sapiens
ccgtggtgacgtggttcccaaagat

SEQ ID NO: 23679 - DNA, 25 bp, Homo sapiens
atgtcaatgctgccattgccaccat

SEQ ID NO: 23680 - DNA, 25 bp, Homo sapiens
agtttgtggattggtgccccactgg

SEQ ID NO: 23681 - DNA, 25 bp, Homo sapiens
ctcccactgtggtgcctggtggaga

SEQ ID NO: 23682 - DNA, 25 bp, Homo sapiens
gagagctgtgtgcatgctgagcaac

SEQ ID NO: 23683 - DNA, 25 bp, Homo sapiens
gcctttgttcactggtacgtgggtg

SEQ ID NO: 23684 - DNA, 25 bp, Homo sapiens
ggcccgtgaagatatggctgccctt

SEQ ID NO: 23685 - DNA, 25 bp, Homo sapiens
ctaattatccattccttttggccct

SEQ ID NO: 23686 - DNA, 25 bp, Homo sapiens
gatcaccaatgcttgctttgagcca

SEQ ID NO: 23687 - DNA, 25 bp, Homo sapiens
gctttgagccagccaaccagatggt

SEQ ID NO: 23688 - DNA, 25 bp, Homo sapiens
attacttgcagttctgagtttcaga

SEQ ID NO: 23689 - DNA, 25 bp, Homo sapiens
atacatactgctcctttgaaatttg

SEQ ID NO: 23690 - DNA, 25 bp, Homo sapiens
gagtccagagactacgcttaacttt

SEQ ID NO: 23691 - DNA, 25 bp, Homo sapiens
acgcttaactttctatgcatgcatt

SEQ ID NO: 23692 - DNA, 25 bp, Homo sapiens
gaaagctgtttttacctgataatgt

SEQ ID NO: 23693 - DNA, 25 bp, Homo sapiens
aatactgatctgtgttgcatttcaa

SEQ ID NO: 23694 - DNA, 25 bp, Homo sapiens
gtaccaaccattatccagaggcacc

SEQ ID NO: 23695 - DNA, 25 bp, Homo sapiens
agaggcaccatggagagttagtcat

SEQ ID NO: 23696 - DNA, 25 bp, Homo sapiens
ggaataaagcactgtccttgcagat

SEQ ID NO: 23697 - DNA, 25 bp, Homo sapiens
gtctccagagcagacttctgacagg

SEQ ID NO: 23698 - DNA, 25 bp, Homo sapiens
gaagagatcgtgccctcatttttca

SEQ ID NO: 23699 - DNA, 25 bp, Homo sapiens
aaaactggctgcaagctgctccagc

SEQ ID NO: 23700 - DNA, 25 bp, Homo sapiens
ctccagccccagaggaactggccaa

SEQ ID NO: 23701 - DNA, 25 bp, Homo sapiens
aactggccaagctccagagggcctc

SEQ ID NO: 23702 - DNA, 25 bp, Homo sapiens
gcctccttggagggcctcagaggga

SEQ ID NO: 23703 - DNA, 25 bp, Homo sapiens
ttgtccctcagttccaggaggcagc

SEQ ID NO: 23704 - DNA, 25 bp, Homo sapiens
tgtccacatgcgtgtcagcacatac

SEQ ID NO: 23705 - DNA, 25 bp, Homo sapiens
aagccgcctggaatgtcttcacggc

SEQ ID NO: 23706 - DNA, 25 bp, Homo sapiens
tgctcacacagcagcttttgcacgc

SEQ ID NO: 23707 - DNA, 25 bp, Homo sapiens
ccaacttgagctggctggtggtccc

SEQ ID NO: 23708 - DNA, 25 bp, Homo sapiens
ctttcttgcctctatttcttagttg

SEQ ID NO: 23709 - DNA, 25 bp, Homo sapiens
tccaaagcctttgtctctgagacct

SEQ ID NO: 23710 - DNA, 25 bp, Homo sapiens
tgctgttcatcccacatcgtgtggg

SEQ ID NO: 23711 - DNA, 25 bp, Homo sapiens
cctgcagctacttggtgacttaaca

SEQ ID NO: 23712 - DNA, 25 bp, Homo sapiens
taacaactccaggagccctgtcagc

SEQ ID NO: 23713 - DNA, 25 bp, Homo sapiens
gtctctgcacctacttttgcagaat

SEQ ID NO: 23714 - DNA, 25 bp, Homo sapiens
tacaaaccacattacttctgtcact

SEQ ID NO: 23715 - DNA, 25 bp, Homo sapiens
ctgtcacttcagggcatcgggactg

SEQ ID NO: 23716 - DNA, 25 bp, Homo sapiens
gcgcccttgttatgtgctattttaa

SEQ ID NO: 23717 - DNA, 25 bp, Homo sapiens
gttacccatgtatgctgtgtttatc

SEQ ID NO: 23718 - DNA, 25 bp, Homo sapiens
gtttatcatgtgtatatcgtccaga

SEQ ID NO: 23719 - DNA, 25 bp, Homo sapiens
gatgcaactggcgaaccttggagag

SEQ ID NO: 23720 - DNA, 25 bp, Homo sapiens
gctgattgtcttgaccaaacccaca

SEQ ID NO: 23721 - DNA, 25 bp, Homo sapiens
gcaagctcttcacgcagattctgcg

SEQ ID NO: 23722 - DNA, 25 bp, Homo sapiens
gattctgcgggtcaaggaccgcgac

SEQ ID NO: 23723 - DNA, 25 bp, Homo sapiens
agatctggagtcacagcgccaggtc

SEQ ID NO: 23724 - DNA, 25 bp, Homo sapiens
acgtggcctactttgaggcctcggc

SEQ ID NO: 23725 - DNA, 25 bp, Homo sapiens
gccaaactgcgtctcaacgtggacg

SEQ ID NO: 23726 - DNA, 25 bp, Homo sapiens
gacgaggcttttgagcagctggtgc

SEQ ID NO: 23727 - DNA, 25 bp, Homo sapiens
ctggtgcgggctgtccggaaatacc

SEQ ID NO: 23728 - DNA, 25 bp, Homo sapiens
aataccaggaacaagagctcccacc

SEQ ID NO: 23729 - DNA, 25 bp, Homo sapiens
agagaagcaaccaccacaagctctc

SEQ ID NO: 23730 - DNA, 25 bp, Homo sapiens
atctgggtctcccaggacacatcac

SEQ ID NO: 23731 - DNA, 25 bp, Homo sapiens
ctccgggtcactgctgtatataact

SEQ ID NO: 23732 - DNA, 25 bp, Homo sapiens
aaaccccaatgctgacagccatatg

SEQ ID NO: 23733 - DNA, 25 bp, Homo sapiens
gatgggcatttattactggcagtgg

SEQ ID NO: 23734 - DNA, 25 bp, Homo sapiens
gatagttacaaatgcatccatctta

SEQ ID NO: 23735 - DNA, 25 bp, Homo sapiens
aataggcttgtaaatcttatcgatg

SEQ ID NO: 23736 - DNA, 25 bp, Homo sapiens
gaattgacatgtatcccaccataaa

SEQ ID NO: 23737 - DNA, 25 bp, Homo sapiens
gaaattttacaaccaaagctcccat

SEQ ID NO: 23738 - DNA, 25 bp, Homo sapiens
aagctcccatttgattgtaatcttg

SEQ ID NO: 23739 - DNA, 25 bp, Homo sapiens
tatccactagtgttgttatcagcta

SEQ ID NO: 23740 - DNA, 25 bp, Homo sapiens
ttatcagctactgtaaccaagtggc

SEQ ID NO: 23741 - DNA, 25 bp, Homo sapiens
ggctggttcatttggttgatgctga

SEQ ID NO: 23742 - DNA, 25 bp, Homo sapiens
ttgatgctgattatggcctttaacc

SEQ ID NO: 23743 - DNA, 25 bp, Homo sapiens
gaaaatgccttcaatttgtgtttta

SEQ ID NO: 23744 - DNA, 25 bp, Homo sapiens
aagactcaacttctcagatctataa

SEQ ID NO: 23745 - DNA, 25 bp, Homo sapiens
atacattgtcatcctctagcaactc

SEQ ID NO: 23746 - DNA, 25 bp, Homo sapiens
ttctcaaataattcttaacctcagt

SEQ ID NO: 23747 - DNA, 25 bp, Homo sapiens
ctaaatttactctgcttggctctct

SEQ ID NO: 23748 - DNA, 25 bp, Homo sapiens
ttggctctctacacatggcatttca

SEQ ID NO: 23749 - DNA, 25 bp, Homo sapiens
acatatgtgttgctatcttcatcat

SEQ ID NO: 23750 - DNA, 25 bp, Homo sapiens
tcttcatcattaacatccttctttt

SEQ ID NO: 23751 - DNA, 25 bp, Homo sapiens
gcatcttcattttgctagctttgca

SEQ ID NO: 23752 - DNA, 25 bp, Homo sapiens
atgtgtactcgttatttctaatgat

SEQ ID NO: 23753 - DNA, 25 bp, Homo sapiens
aaatccctagtcctgtttagcattt

SEQ ID NO: 23754 - DNA, 25 bp, Homo sapiens
gtcctgccacatgtaacacttactc

SEQ ID NO: 23755 - DNA, 25 bp, Homo sapiens
ggagtttttctgcagtggttgcgtt

SEQ ID NO: 23756 - DNA, 25 bp, Homo sapiens
tggttgcgtttcactgtaaggataa

SEQ ID NO: 23757 - DNA, 25 bp, Homo sapiens
ggataatggagttcctctcctctgc

SEQ ID NO: 23758 - DNA, 25 bp, Homo sapiens
gaggatggtcctttaacatagccag

SEQ ID NO: 23759 - DNA, 25 bp, Homo sapiens
gtcttatcatccgagaatacaccat

SEQ ID NO: 23760 - DNA, 25 bp, Homo sapiens
tcttacatcatgcttgattcctaca

SEQ ID NO: 23761 - DNA, 25 bp, Homo sapiens
gattcctacattttgttgggtctca

SEQ ID NO: 23762 - DNA, 25 bp, Homo sapiens
ttgggtctcaacattggctcacgaa

SEQ ID NO: 23763 - DNA, 25 bp, Homo sapiens
tgccactacaagtaaatcccccatt

SEQ ID NO: 23764 - DNA, 25 bp, Homo sapiens
ttttcttctttagcatagcactgtc

SEQ ID NO: 23765 - DNA, 25 bp, Homo sapiens
atttacttttagctctggacatcat

SEQ ID NO: 23766 - DNA, 25 bp, Homo sapiens
caaacctcttcagaccgagaatgca

SEQ ID NO: 23767 - DNA, 25 bp, Homo sapiens
gtgccatctgggttctacgttggct

SEQ ID NO: 23768 - DNA, 25 bp, Homo sapiens
tacgttggctcttatgtccacggag

SEQ ID NO: 23769 - DNA, 25 bp, Homo sapiens
cctcacttcacaagctggtgctggg

SEQ ID NO: 23770 - DNA, 25 bp, Homo sapiens
ggtgctggggaagtatggggccctg

SEQ ID NO: 23771 - DNA, 25 bp, Homo sapiens
ccctggtcatctgtgagacgtctga

SEQ ID NO: 23772 - DNA, 25 bp, Homo sapiens
tctgttggctccctggacgatgagc

SEQ ID NO: 23773 - DNA, 25 bp, Homo sapiens
agagactaagatgctgtcccagccg

SEQ ID NO: 23774 - DNA, 25 bp, Homo sapiens
cctccattaccttggggcagtatgt

SEQ ID NO: 23775 - DNA, 25 bp, Homo sapiens
cagtatgtgcagcctcagggggtgt

SEQ ID NO: 23776 - DNA, 25 bp, Homo sapiens
acgccaggcccagttaatgctagtc

SEQ ID NO: 23777 - DNA, 25 bp, Homo sapiens
aatgtgaagctgccatgttgccttt

SEQ ID NO: 23778 - DNA, 25 bp, Homo sapiens
tttaagggctaatctcacacctcct

SEQ ID NO: 23779 - DNA, 25 bp, Homo sapiens
cacacctccttagctgtaagagtct

SEQ ID NO: 23780 - DNA, 25 bp, Homo sapiens
cagacctctctgtgcaataacttgt

SEQ ID NO: 23781 - DNA, 25 bp, Homo sapiens
cctgggccggcatttgtattggggt

SEQ ID NO: 23782 - DNA, 25 bp, Homo sapiens
gttgcaatgactcccaagggccaaa

SEQ ID NO: 23783 - DNA, 25 bp, Homo sapiens
actccttccaaggctgagggggtca

SEQ ID NO: 23784 - DNA, 25 bp, Homo sapiens
agtaggtgctctggagggactcggc

SEQ ID NO: 23785 - DNA, 25 bp, Homo sapiens
actcggcaccacttgatattcaaca

SEQ ID NO: 23786 - DNA, 25 bp, Homo sapiens
gtctagcattgatttggttcctgtg

SEQ ID NO: 23787 - DNA, 25 bp, Homo sapiens
aagggttcctgctttcacagaatta

SEQ ID NO: 23788 - DNA, 25 bp, Homo sapiens
tcagggtggtgacttcacacgccat

SEQ ID NO: 23789 - DNA, 25 bp, Homo sapiens
ggcactggtggcaagtccatctatg

SEQ ID NO: 23790 - DNA, 25 bp, Homo sapiens
taaagcatacgggtcctggcatctt

SEQ ID NO: 23791 - DNA, 25 bp, Homo sapiens
cctggcatcttgtccatggcaaatg

SEQ ID NO: 23792 - DNA, 25 bp, Homo sapiens
ggacccaacacaaatggttcccagt

SEQ ID NO: 23793 - DNA, 25 bp, Homo sapiens
gtttttcatctgcactgccaagact

SEQ ID NO: 23794 - DNA, 25 bp, Homo sapiens
ggagcgctttgggtccaggaatggc

SEQ ID NO: 23795 - DNA, 25 bp, Homo sapiens
agatcaccattgctgactgtggaca

SEQ ID NO: 23796 - DNA, 25 bp, Homo sapiens
tcttaaccaccagatcattccttct

SEQ ID NO: 23797 - DNA, 25 bp, Homo sapiens
atcctagaatctttgtgctctcgct

SEQ ID NO: 23798 - DNA, 25 bp, Homo sapiens
caggaggacacagcattattctagt

SEQ ID NO: 23799 - DNA, 25 bp, Homo sapiens
tattctagtgctgtactgttccgta

SEQ ID NO: 23800 - DNA, 25 bp, Homo sapiens
tgctgtactgttccgtacggcagcc

SEQ ID NO: 23801 - DNA, 25 bp, Homo sapiens
cccaatcacactagcaacatttcaa

SEQ ID NO: 23802 - DNA, 25 bp, Homo sapiens
gaagtagaatcttttcatcatcaca

SEQ ID NO: 23803 - DNA, 25 bp, Homo sapiens
ggacagtgctcttctagatcatcat

SEQ ID NO: 23804 - DNA, 25 bp, Homo sapiens
gatcatcataagactacagagcact

SEQ ID NO: 23805 - DNA, 25 bp, Homo sapiens
ttcaaagctcatgcatgttcatcat

SEQ ID NO: 23806 - DNA, 25 bp, Homo sapiens
atgttcatcatgttagtgtcgtatt

SEQ ID NO: 23807 - DNA, 25 bp, Homo sapiens
tagtgtcgtattttgagctggggtt

SEQ ID NO: 23808 - DNA, 25 bp, Homo sapiens
ttcccctctcttattttaagttatg

SEQ ID NO: 23809 - DNA, 25 bp, Homo sapiens
gggactttgaggcctacacgaagat

SEQ ID NO: 23810 - DNA, 25 bp, Homo sapiens
agatttgtgatccaggcctcacttc

SEQ ID NO: 23811 - DNA, 25 bp, Homo sapiens
ttgagcctgaggcccttggtaacct

SEQ ID NO: 23812 - DNA, 25 bp, Homo sapiens
ttactttgagaatctcctgtccaag

SEQ ID NO: 23813 - DNA, 25 bp, Homo sapiens
aagaacagcaagcctatccatacca

SEQ ID NO: 23814 - DNA, 25 bp, Homo sapiens
aaacccacacgtccacgtgattggg

SEQ ID NO: 23815 - DNA, 25 bp, Homo sapiens
ttggggaggacgcagcgtgcatcgc

SEQ ID NO: 23816 - DNA, 25 bp, Homo sapiens
ctcacccagtacatcgacgggcagg

SEQ ID NO: 23817 - DNA, 25 bp, Homo sapiens
cagaagagacccgggtctggcaccg

SEQ ID NO: 23818 - DNA, 25 bp, Homo sapiens
gtctggcaccgtcgggatggcaagt

SEQ ID NO: 23819 - DNA, 25 bp, Homo sapiens
agtggctcaatgtccactatcactg

SEQ ID NO: 23820 - DNA, 25 bp, Homo sapiens
atccagttggtacccaagcacctga

SEQ ID NO: 23821 - DNA, 25 bp, Homo sapiens
ccaagcacctgaagcctcaaagctg

SEQ ID NO: 23822 - DNA, 25 bp, Homo sapiens
tgaagcctcaaagctggattcgctc

SEQ ID NO: 23823 - DNA, 25 bp, Homo sapiens
gaaaaccaccccacactgggaatag

SEQ ID NO: 23824 - DNA, 25 bp, Homo sapiens
accccacactgggaatagccacctt

SEQ ID NO: 23825 - DNA, 25 bp, Homo sapiens
cacactgggaatagccaccttgccc

SEQ ID NO: 23826 - DNA, 25 bp, Homo sapiens
ccggcaccactagctggctgggtgc

SEQ ID NO: 23827 - DNA, 25 bp, Homo sapiens
gcaccactagctggctgggtgcacc

SEQ ID NO: 23828 - DNA, 25 bp, Homo sapiens
tcaacctggttgacctgtcatggcc

SEQ ID NO: 23829 - DNA, 25 bp, Homo sapiens
catctttttgtgtctcgctgtgata

SEQ ID NO: 23830 - DNA, 25 bp, Homo sapiens
tgtgtctcgctgtgatagatcaata

SEQ ID NO: 23831 - DNA, 25 bp, Homo sapiens
aggagtggatcctggagcagctcac

SEQ ID NO: 23832 - DNA, 25 bp, Homo sapiens
tgacgtggatgagctcctggacatg

SEQ ID NO: 23833 - DNA, 25 bp, Homo sapiens
acatggagagtgacgatgcccgggc

SEQ ID NO: 23834 - DNA, 25 bp, Homo sapiens
aaggagctgctggttgactgttaca

SEQ ID NO: 23835 - DNA, 25 bp, Homo sapiens
cagaggccttcatttctggcctgct

SEQ ID NO: 23836 - DNA, 25 bp, Homo sapiens
tggcctgctggacaagatccggggc

SEQ ID NO: 23837 - DNA, 25 bp, Homo sapiens
gatccggggcatgcagaagctgagc

SEQ ID NO: 23838 - DNA, 25 bp, Homo sapiens
gaagaagtgagggtccccgacccag

SEQ ID NO: 23839 - DNA, 25 bp, Homo sapiens
cgacccaggagaacggtggctccca

SEQ ID NO: 23840 - DNA, 25 bp, Homo sapiens
gtagcaacagcaataccgggggacc

SEQ ID NO: 23841 - DNA, 25 bp, Homo sapiens
ccaggcctggtgccatgagcagggc

SEQ ID NO: 23842 - DNA, 25 bp, Homo sapiens
tttttggccttgtggcagcacatcc

SEQ ID NO: 23843 - DNA, 25 bp, Homo sapiens
cacatcctcacacccaaagaagttt

SEQ ID NO: 23844 - DNA, 25 bp, Homo sapiens
acaacctagagaacacctgagtact

SEQ ID NO: 23845 - DNA, 25 bp, Homo sapiens
agaataatcctctctgtgaactcct

SEQ ID NO: 23846 - DNA, 25 bp, Homo sapiens
agagaatatcaagtccccaggtctg

SEQ ID NO: 23847 - DNA, 25 bp, Homo sapiens
gagtagtactattgtccaatgtcat

SEQ ID NO: 23848 - DNA, 25 bp, Homo sapiens
gtgggaaccagtgtgctttgaaacc

SEQ ID NO: 23849 - DNA, 25 bp, Homo sapiens
gttttctgggacttgatcatacatt

SEQ ID NO: 23850 - DNA, 25 bp, Homo sapiens
gatatcttgtttaaggagacctctt

SEQ ID NO: 23851 - DNA, 25 bp, Homo sapiens
tcatcagatatttgagtgcccactc

SEQ ID NO: 23852 - DNA, 25 bp, Homo sapiens
gcccactctgtgcccaaataaatat

SEQ ID NO: 23853 - DNA, 25 bp, Homo sapiens
ttatgtttactcttcctattggcag

SEQ ID NO: 23854 - DNA, 25 bp, Homo sapiens
gagggagtccctataaccaaagatg

SEQ ID NO: 23855 - DNA, 25 bp, Homo sapiens
gacagcatagccctggatagccaga

SEQ ID NO: 23856 - DNA, 25 bp, Homo sapiens
gatagccagataaaccactctttgt

SEQ ID NO: 23857 - DNA, 25 bp, Homo sapiens
gtttctttcctagtggtgaggggtg

SEQ ID NO: 23858 - DNA, 25 bp, Homo sapiens
gtcatatattatttgcgctgcttca

SEQ ID NO: 23859 - DNA, 25 bp, Homo sapiens
gcgctgcttcatttgtatcatgtgc

SEQ ID NO: 23860 - DNA, 25 bp, Homo sapiens
tcatgtgcaatctctagaccaaccc

SEQ ID NO: 23861 - DNA, 25 bp, Homo sapiens
gcatcattttgtacatattcccagc

SEQ ID NO: 23862 - DNA, 25 bp, Homo sapiens
acatattcccagctgcagaactagt

SEQ ID NO: 23863 - DNA, 25 bp, Homo sapiens
gaactagtatcacttatctcagcaa

SEQ ID NO: 23864 - DNA, 25 bp, Homo sapiens
ggaatacgggggcatcatccggcat

SEQ ID NO: 23865 - DNA, 25 bp, Homo sapiens
tcatccggcatggtgccaagcttct

SEQ ID NO: 23866 - DNA, 25 bp, Homo sapiens
agcttctctacgcatttgctgaggc

SEQ ID NO: 23867 - DNA, 25 bp, Homo sapiens
gctgaggcaactgtacccaaagtca

SEQ ID NO: 23868 - DNA, 25 bp, Homo sapiens
ccaaagtcacagtcatcaccaggaa

SEQ ID NO: 23869 - DNA, 25 bp, Homo sapiens
gtcatgagctctaagcacctttgtg

SEQ ID NO: 23870 - DNA, 25 bp, Homo sapiens
aaagggcgctgtggagatcatcttc

SEQ ID NO: 23871 - DNA, 25 bp, Homo sapiens
catcgagaagtttgccaaccctttc

SEQ ID NO: 23872 - DNA, 25 bp, Homo sapiens
cctttccctgcagcagtgcgagggt

SEQ ID NO: 23873 - DNA, 25 bp, Homo sapiens
ccgaatctgctgtgacctggatgtc

SEQ ID NO: 23874 - DNA, 25 bp, Homo sapiens
gaactgaattactgtctgcccattc

SEQ ID NO: 23875 - DNA, 25 bp, Homo sapiens
tcagccccagtcgagaggaaagaga

SEQ ID NO: 23876 - DNA, 25 bp, Homo sapiens
gagaatcgggccactgccagaaaga

SEQ ID NO: 23877 - DNA, 25 bp, Homo sapiens
gctctcttccctaaggtacaggttg

SEQ ID NO: 23878 - DNA, 25 bp, Homo sapiens
aggtacaggttggcaggaccacctc

SEQ ID NO: 23879 - DNA, 25 bp, Homo sapiens
cccagatcaacctgccagtggagtc

SEQ ID NO: 23880 - DNA, 25 bp, Homo sapiens
tggagtcaggcagtgcactcctgga

SEQ ID NO: 23881 - DNA, 25 bp, Homo sapiens
tgcactcctggagccaagagggaag

SEQ ID NO: 23882 - DNA, 25 bp, Homo sapiens
gtatgtccagtagcctggagctcca

SEQ ID NO: 23883 - DNA, 25 bp, Homo sapiens
cggaacagtgcctcaaatcctgacc

SEQ ID NO: 23884 - DNA, 25 bp, Homo sapiens
ctgacccaagggccagcatggggaa

SEQ ID NO: 23885 - DNA, 25 bp, Homo sapiens
aaggtgtgtttctcccacaatttgt

SEQ ID NO: 23886 - DNA, 25 bp, Homo sapiens
agagctcaagccaaacgcttctgtc

SEQ ID NO: 23887 - DNA, 25 bp, Homo sapiens
tccttctgcattaaccctttgctga

SEQ ID NO: 23888 - DNA, 25 bp, Homo sapiens
acagagcctgttttcatgtactgca

SEQ ID NO: 23889 - DNA, 25 bp, Homo sapiens
gttaggtgtctcatagtcactcata

SEQ ID NO: 23890 - DNA, 25 bp, Homo sapiens
caggggtaatggcatctccccactt

SEQ ID NO: 23891 - DNA, 25 bp, Homo sapiens
cccactttaggcttctcaaacagac

SEQ ID NO: 23892 - DNA, 25 bp, Homo sapiens
gacttttgacacctctcaagttcag

SEQ ID NO: 23893 - DNA, 25 bp, Homo sapiens
aggagggggatttcgtgtgtttgca

SEQ ID NO: 23894 - DNA, 25 bp, Homo sapiens
tttgcatgagtgtgcgcttcaggcc

SEQ ID NO: 23895 - DNA, 25 bp, Homo sapiens
gtttcttgtacctgagggatcctgc

SEQ ID NO: 23896 - DNA, 25 bp, Homo sapiens
atctccatagtctccactgtgaact

SEQ ID NO: 23897 - DNA, 25 bp, Homo sapiens
gatcttaagcttttgtgtcagatta

SEQ ID NO: 23898 - DNA, 25 bp, Homo sapiens
tgatgacttcatgctttattatgcc

SEQ ID NO: 23899 - DNA, 25 bp, Homo sapiens
tatgccttattatggctgacgtatt

SEQ ID NO: 23900 - DNA, 25 bp, Homo sapiens
ggctgacgtattactgtggtgaaac

SEQ ID NO: 23901 - DNA, 25 bp, Homo sapiens
ataaagtacctttgagcatgagtgt

SEQ ID NO: 23902 - DNA, 25 bp, Homo sapiens
gcatgagtgtatcacagctttcatt

SEQ ID NO: 23903 - DNA, 25 bp, Homo sapiens
ggaaaacttttcattacatacttgt

SEQ ID NO: 23904 - DNA, 25 bp, Homo sapiens
acttgtttaaactctgtcttccagg

SEQ ID NO: 23905 - DNA, 25 bp, Homo sapiens
ttcaggtggtatttgcattcagtgc

SEQ ID NO: 23906 - DNA, 25 bp, Homo sapiens
agtgccttactggtattctcagaac

SEQ ID NO: 23907 - DNA, 25 bp, Homo sapiens
aataaaactgacatttactcttgac

SEQ ID NO: 23908 - DNA, 25 bp, Homo sapiens
cacatggttctagcctggacctggc

SEQ ID NO: 23909 - DNA, 25 bp, Homo sapiens
cctgtcccaacagctgacagccagg

SEQ ID NO: 23910 - DNA, 25 bp, Homo sapiens
gccaccctagtgtgctaagctgagc

SEQ ID NO: 23911 - DNA, 25 bp, Homo sapiens
agtgtgaacagggcccatggtgtat

SEQ ID NO: 23912 - DNA, 25 bp, Homo sapiens
ccatggtgtattctaggccacagcc

SEQ ID NO: 23913 - DNA, 25 bp, Homo sapiens
ctcccctgtggtgagtaccgtggaa

SEQ ID NO: 23914 - DNA, 25 bp, Homo sapiens
taggcatgcatatgaggtcttcccc

SEQ ID NO: 23915 - DNA, 25 bp, Homo sapiens
tccccataccctctgggtgttgaga

SEQ ID NO: 23916 - DNA, 25 bp, Homo sapiens
ggtttagccacatgagggagcagag

SEQ ID NO: 23917 - DNA, 25 bp, Homo sapiens
ggacaatctctgcagggctgggagt

SEQ ID NO: 23918 - DNA, 25 bp, Homo sapiens
gtgggtagggactgaaggtctcaat

SEQ ID NO: 23919 - DNA, 25 bp, Homo sapiens
tcagcttgatggattttcagttttt

SEQ ID NO: 23920 - DNA, 25 bp, Homo sapiens
gaagaattttctttaccattagtct

SEQ ID NO: 23921 - DNA, 25 bp, Homo sapiens
ggatactgttgtgcagtggtgtact

SEQ ID NO: 23922 - DNA, 25 bp, Homo sapiens
gtggtgtactgttatacttcagaga

SEQ ID NO: 23923 - DNA, 25 bp, Homo sapiens
gagtacatctagttcagttcctatg

SEQ ID NO: 23924 - DNA, 25 bp, Homo sapiens
gttcctatgaggtagctgtaaccct

SEQ ID NO: 23925 - DNA, 25 bp, Homo sapiens
gaaacgtcaactctagggtacattt

SEQ ID NO: 23926 - DNA, 25 bp, Homo sapiens
gcatacaaatcagcgatcagccagc

SEQ ID NO: 23927 - DNA, 25 bp, Homo sapiens
tcttttgccttcaatctgttgtctt

SEQ ID NO: 23928 - DNA, 25 bp, Homo sapiens
aattacttattctgatgatgcactt

SEQ ID NO: 23929 - DNA, 25 bp, Homo sapiens
gatgatgcacttttatgtatttttc

SEQ ID NO: 23930 - DNA, 25 bp, Homo sapiens
gcagccaaggtctgtgttcagcact

SEQ ID NO: 23931 - DNA, 25 bp, Homo sapiens
gcacttggtctctgttgttacgtaa

SEQ ID NO: 23932 - DNA, 25 bp, Homo sapiens
gatatttttgaccagttccttttag

SEQ ID NO: 23933 - DNA, 25 bp, Homo sapiens
gatctgacctgtttattgttggcgc

SEQ ID NO: 23934 - DNA, 25 bp, Homo sapiens
tgaaaacgagctttctttcccatga

SEQ ID NO: 23935 - DNA, 25 bp, Homo sapiens
tttcccatgatagtgcttcgttttt

SEQ ID NO: 23936 - DNA, 25 bp, Homo sapiens
tgaagtgttgaagctgtgctcccct

SEQ ID NO: 23937 - DNA, 25 bp, Homo sapiens
acaacactcagttctatgtcttaca

SEQ ID NO: 23938 - DNA, 25 bp, Homo sapiens
aaattcgattccagtcatttcccat

SEQ ID NO: 23939 - DNA, 25 bp, Homo sapiens
atagctggcgagtgctttctgtatt

SEQ ID NO: 23940 - DNA, 25 bp, Homo sapiens
gtttggtcaatgtttccgcagtatt

SEQ ID NO: 23941 - DNA, 25 bp, Homo sapiens
tcagtgtctgggctcatgacttgta

SEQ ID NO: 23942 - DNA, 25 bp, Homo sapiens
ttatgacccacttctatttactttg

SEQ ID NO: 23943 - DNA, 25 bp, Homo sapiens
ggactcatgagctattgttggttgc

SEQ ID NO: 23944 - DNA, 25 bp, Homo sapiens
atcacgcgggagtgagtgtgccctt

SEQ ID NO: 23945 - DNA, 25 bp, Homo sapiens
gtgcccttcacactgtgacattgtg

SEQ ID NO: 23946 - DNA, 25 bp, Homo sapiens
agctccatgtcctttaaaatcagtc

SEQ ID NO: 23947 - DNA, 25 bp, Homo sapiens
aaaatcagtcactctgcacacaaga

SEQ ID NO: 23948 - DNA, 25 bp, Homo sapiens
tcgtggttggatggggccggaacac

SEQ ID NO: 23949 - DNA, 25 bp, Homo sapiens
gccggaacacaaccagtctttttgt

SEQ ID NO: 23950 - DNA, 25 bp, Homo sapiens
agtttcctactggtggttttgatat

SEQ ID NO: 23951 - DNA, 25 bp, Homo sapiens
ctgattttgctaaactcctgttccc

SEQ ID NO: 23952 - DNA, 25 bp, Homo sapiens
gtcccagagggcccatctgtaaaga

SEQ ID NO: 23953 - DNA, 25 bp, Homo sapiens
gtctgggcacagttcacatcaggac

SEQ ID NO: 23954 - DNA, 25 bp, Homo sapiens
tcaggacagcgtccattgtgctctc

SEQ ID NO: 23955 - DNA, 25 bp, Homo sapiens
gccagcagggaaccggaagctctga

SEQ ID NO: 23956 - DNA, 25 bp, Homo sapiens
gggacccagagtagatgctgacctg

SEQ ID NO: 23957 - DNA, 25 bp, Homo sapiens
agagatgccagcaggatgccacttt

SEQ ID NO: 23958 - DNA, 25 bp, Homo sapiens
gagaggcagcgtgtgaccagattgt

SEQ ID NO: 23959 - DNA, 25 bp, Homo sapiens
gattgtgtcccgtcattgggtggca

SEQ ID NO: 23960 - DNA, 25 bp, Homo sapiens
aattcatgtacatttgcaacagcca

SEQ ID NO: 23961 - DNA, 25 bp, Homo sapiens
gtgtcgtgaccagcctaagtagtta

SEQ ID NO: 23962 - DNA, 25 bp, Homo sapiens
agatgctgatgtgcagtcacccatc

SEQ ID NO: 23963 - DNA, 25 bp, Homo sapiens
cctcatccgctacatgagctctggg

SEQ ID NO: 23964 - DNA, 25 bp, Homo sapiens
gggaagggtacaatgtcgtccgcgc

SEQ ID NO: 23965 - DNA, 25 bp, Homo sapiens
agggccatgattggacacaccgact

SEQ ID NO: 23966 - DNA, 25 bp, Homo sapiens
ataaggggtgacttcagcgtccaca

SEQ ID NO: 23967 - DNA, 25 bp, Homo sapiens
cagcgtccacatcagcaggaatgtc

SEQ ID NO: 23968 - DNA, 25 bp, Homo sapiens
aggagtttgagccaccaacttcagt

SEQ ID NO: 23969 - DNA, 25 bp, Homo sapiens
gtaccccaagccagcacaagattgg

SEQ ID NO: 23970 - DNA, 25 bp, Homo sapiens
tgcaccaaagtgccggacaaccttt

SEQ ID NO: 23971 - DNA, 25 bp, Homo sapiens
aaagtgccggacaacctttgtggtg

SEQ ID NO: 23972 - DNA, 25 bp, Homo sapiens
ggggggtcttcacattatcataacc

SEQ ID NO: 23973 - DNA, 25 bp, Homo sapiens
atcataacctctcctctaaagggga

SEQ ID NO: 23974 - DNA, 25 bp, Homo sapiens
gtaggaccaagtgatgacacccctc

SEQ ID NO: 23975 - DNA, 25 bp, Homo sapiens
tgatgacacccctcgaaggggccca

SEQ ID NO: 23976 - DNA, 25 bp, Homo sapiens
ccgtgggacatcatgacatcatcac

SEQ ID NO: 23977 - DNA, 25 bp, Homo sapiens
catcatcactgatgtcgccacattc

SEQ ID NO: 23978 - DNA, 25 bp, Homo sapiens
accacacagggcttcatcgtaactg

SEQ ID NO: 23979 - DNA, 25 bp, Homo sapiens
ggcttcatcgtaactgcttctagag

SEQ ID NO: 23980 - DNA, 25 bp, Homo sapiens
tatgtctccatattactgtttcatg

SEQ ID NO: 23981 - DNA, 25 bp, Homo sapiens
attactgtttcatgactgactgact

SEQ ID NO: 23982 - DNA, 25 bp, Homo sapiens
actgactgactaaatgacacccaaa

SEQ ID NO: 23983 - DNA, 25 bp, Homo sapiens
gactagtttacttatgcatctcttt

SEQ ID NO: 23984 - DNA, 25 bp, Homo sapiens
tctctttgcaagaatcagccagcca

SEQ ID NO: 23985 - DNA, 25 bp, Homo sapiens
atagggttttcttgggcgaggatgt

SEQ ID NO: 23986 - DNA, 25 bp, Homo sapiens
tggcacccaccacagaatacagtgt

SEQ ID NO: 23987 - DNA, 25 bp, Homo sapiens
gtgttattacgaggagccagcagtt

SEQ ID NO: 23988 - DNA, 25 bp, Homo sapiens
tctactgccccataagccaggaaaa

SEQ ID NO: 23989 - DNA, 25 bp, Homo sapiens
gaggccttatgtatgtagctgagtc

SEQ ID NO: 23990 - DNA, 25 bp, Homo sapiens
aaggtacatgatgctgtctgctttc

SEQ ID NO: 23991 - DNA, 25 bp, Homo sapiens
actgactccttccttagttcaagga

SEQ ID NO: 23992 - DNA, 25 bp, Homo sapiens
agacagacctctgctgagtagctct

SEQ ID NO: 23993 - DNA, 25 bp, Homo sapiens
gatgacaaagccttggtttaactga

SEQ ID NO: 23994 - DNA, 25 bp, Homo sapiens
tgtgaggtttattagtccccaaggc

SEQ ID NO: 23995 - DNA, 25 bp, Homo sapiens
agtccccaaggcaaacacaaatatt

SEQ ID NO: 23996 - DNA, 25 bp, Homo sapiens
accagctgctcagcgcataagacct

SEQ ID NO: 23997 - DNA, 25 bp, Homo sapiens
ccctccagcgtcagacactaatggg

SEQ ID NO: 23998 - DNA, 25 bp, Homo sapiens
taatgggagttcccgagatgctcgg

SEQ ID NO: 23999 - DNA, 25 bp, Homo sapiens
gatgctcgggtttgagcagggagca

SEQ ID NO: 24000 - DNA, 25 bp, Homo sapiens
agtctgaattgggtctgtctttgag

SEQ ID NO: 24001 - DNA, 25 bp, Homo sapiens
gaagtattgttgctcatggtgtggc

SEQ ID NO: 24002 - DNA, 25 bp, Homo sapiens
atggtgtggcaatggactgaactgt

SEQ ID NO: 24003 - DNA, 25 bp, Homo sapiens
aatctttgtctctgtattttgatac

SEQ ID NO: 24004 - DNA, 25 bp, Homo sapiens
tttgatacttgaatgactttccctt

SEQ ID NO: 24005 - DNA, 25 bp, Homo sapiens
gtaccaaacataaccaatctgtgca

SEQ ID NO: 24006 - DNA, 25 bp, Homo sapiens
gactgacctcagtacccaagagagt

SEQ ID NO: 24007 - DNA, 25 bp, Homo sapiens
tttatctgcacaaacatctccactt

SEQ ID NO: 24008 - DNA, 25 bp, Homo sapiens
aggtgggtagattccagttccctgg

SEQ ID NO: 24009 - DNA, 25 bp, Homo sapiens
gttccctggactaccttcaggaggc

SEQ ID NO: 24010 - DNA, 25 bp, Homo sapiens
ctacaggtttacttgggagccagct

SEQ ID NO: 24011 - DNA, 25 bp, Homo sapiens
gcagactcacaggtgctggtgcttg

SEQ ID NO: 24012 - DNA, 25 bp, Homo sapiens
tggtgcttggatttagccaggctcc

SEQ ID NO: 24013 - DNA, 25 bp, Homo sapiens
cgcaaatcccttcaccacagggttt

SEQ ID NO: 24014 - DNA, 25 bp, Homo sapiens
cacagggtttcgttttgctggcttg

SEQ ID NO: 24015 - DNA, 25 bp, Homo sapiens
gaattcattgagacccatagcttca

SEQ ID NO: 24016 - DNA, 25 bp, Homo sapiens
tactcctcttctggggctaatgtca

SEQ ID NO: 24017 - DNA, 25 bp, Homo sapiens
ggtagacccttcatagctttgttac

SEQ ID NO: 24018 - DNA, 25 bp, Homo sapiens
aggactcaagacatctcagtgttct

SEQ ID NO: 24019 - DNA, 25 bp, Homo sapiens
cccacacgaccacagatacggcaaa

SEQ ID NO: 24020 - DNA, 25 bp, Homo sapiens
acccatagtggttgcttcaggaatc

SEQ ID NO: 24021 - DNA, 25 bp, Homo sapiens
ttttcactggtggtggcccattaca

SEQ ID NO: 24022 - DNA, 25 bp, Homo sapiens
ggcccattacaggcaaccagttctc

SEQ ID NO: 24023 - DNA, 25 bp, Homo sapiens
gttctcctcagggcatggtgcaagc

SEQ ID NO: 24024 - DNA, 25 bp, Homo sapiens
ggtgcaagctgttgttctgccaaca

SEQ ID NO: 24025 - DNA, 25 bp, Homo sapiens
aacagttggtttggtgtctcccata

SEQ ID NO: 24026 - DNA, 25 bp, Homo sapiens
gaaacaatcaatgcttcacccatac

SEQ ID NO: 24027 - DNA, 25 bp, Homo sapiens
caaggtggccattctgttatttcag

SEQ ID NO: 24028 - DNA, 25 bp, Homo sapiens
aactacagtcttgagcagcctagcc

SEQ ID NO: 24029 - DNA, 25 bp, Homo sapiens
gatgcaattggttctcctgcattga

SEQ ID NO: 24030 - DNA, 25 bp, Homo sapiens
gttaacatttatacttgccttggac

SEQ ID NO: 24031 - DNA, 25 bp, Homo sapiens
tacttgccttggactgtagaacaga

SEQ ID NO: 24032 - DNA, 25 bp, Homo sapiens
tacaatcaagtcattttacctttac

SEQ ID NO: 24033 - DNA, 25 bp, Homo sapiens
atagcatgatgctctgcagttttat

SEQ ID NO: 24034 - DNA, 25 bp, Homo sapiens
taaccatacaactctcatttcctta

SEQ ID NO: 24035 - DNA, 25 bp, Homo sapiens
aactctcatttccttagtaagccaa

SEQ ID NO: 24036 - DNA, 25 bp, Homo sapiens
aatgtttaacattttgtgccaattt

SEQ ID NO: 24037 - DNA, 25 bp, Homo sapiens
gccaatttgttcctgtattcatgta

SEQ ID NO: 24038 - DNA, 25 bp, Homo sapiens
gttacagatctgactcttcattttt

SEQ ID NO: 24039 - DNA, 25 bp, Homo sapiens
agttccttgttacatcatggtcatt

SEQ ID NO: 24040 - DNA, 25 bp, Homo sapiens
gagttcattgctctcagtataagat

SEQ ID NO: 24041 - DNA, 25 bp, Homo sapiens
aagtctgaggattttcgtcaacctt

SEQ ID NO: 24042 - DNA, 25 bp, Homo sapiens
cgtcaaccttactgaaacacactgg

SEQ ID NO: 24043 - DNA, 25 bp, Homo sapiens
aacacactggtgctttcatcatcag

SEQ ID NO: 24044 - DNA, 25 bp, Homo sapiens
ttgtcgtggttaccagtgcagcctg

SEQ ID NO: 24045 - DNA, 25 bp, Homo sapiens
aaattctgctatttgacacagcttt

SEQ ID NO: 24046 - DNA, 25 bp, Homo sapiens
atggtttcatggacactgttgagca

SEQ ID NO: 24047 - DNA, 25 bp, Homo sapiens
agtgtatggtgtgcttacctgtcca

SEQ ID NO: 24048 - DNA, 25 bp, Homo sapiens
tacctgtccactctagagcattgct

SEQ ID NO: 24049 - DNA, 25 bp, Homo sapiens
gagcattgcttacaggttttttgtt

SEQ ID NO: 24050 - DNA, 25 bp, Homo sapiens
tgctatttcctggtacagtgtagtt

SEQ ID NO: 24051 - DNA, 25 bp, Homo sapiens
ctttgccctgaacttgtccgggtag

SEQ ID NO: 24052 - DNA, 25 bp, Homo sapiens
ggagggccggaggcatgtggcctcc

SEQ ID NO: 24053 - DNA, 25 bp, Homo sapiens
gacctcctgacctgggtggttgagg

SEQ ID NO: 24054 - DNA, 25 bp, Homo sapiens
ggttgaggctcaagacagctcaccc

SEQ ID NO: 24055 - DNA, 25 bp, Homo sapiens
ggtccagaagctccatgctggtcac

SEQ ID NO: 24056 - DNA, 25 bp, Homo sapiens
atgctggtcactagggtgctgtgct

SEQ ID NO: 24057 - DNA, 25 bp, Homo sapiens
ggcccaagcaggtgggagtggacac

SEQ ID NO: 24058 - DNA, 25 bp, Homo sapiens
cctgctcaggcctcttgagaaatgg

SEQ ID NO: 24059 - DNA, 25 bp, Homo sapiens
gtgacaacgtagagcgcgtgctgaa

SEQ ID NO: 24060 - DNA, 25 bp, Homo sapiens
tgaaggtgctcacgggcacgggtaa

SEQ ID NO: 24061 - DNA, 25 bp, Homo sapiens
tattcagcctaactatcctgcggca

SEQ ID NO: 24062 - DNA, 25 bp, Homo sapiens
ccctgctttgccttaaagcctcggg

SEQ ID NO: 24063 - DNA, 25 bp, Homo sapiens
tgctttgccttaaagcctcggggtc

SEQ ID NO: 24064 - DNA, 25 bp, Homo sapiens
ccagcttttctctcttacgatgaag

SEQ ID NO: 24065 - DNA, 25 bp, Homo sapiens
gcttttctctcttacgatgaaggct

SEQ ID NO: 24066 - DNA, 25 bp, Homo sapiens
ctctcttacgatgaaggctgatgcc

SEQ ID NO: 24067 - DNA, 25 bp, Homo sapiens
gaaggctgatgccgagagcgggctg

SEQ ID NO: 24068 - DNA, 25 bp, Homo sapiens
gagctgggtcagtcccgtatttatt

SEQ ID NO: 24069 - DNA, 25 bp, Homo sapiens
cagctggcaggtggcaggaatggag

SEQ ID NO: 24070 - DNA, 25 bp, Homo sapiens
ggcaggtggcaggaatggagaagct

SEQ ID NO: 24071 - DNA, 25 bp, Homo sapiens
cgggcctgtacatagcgcacagatg

SEQ ID NO: 24072 - DNA, 25 bp, Homo sapiens
tgtacatagcgcacagatgtttgtt

SEQ ID NO: 24073 - DNA, 25 bp, Homo sapiens
gaagatggtgggtcggaacagcgcc

SEQ ID NO: 24074 - DNA, 25 bp, Homo sapiens
gaccgcaaaagacgaagtgacccca

SEQ ID NO: 24075 - DNA, 25 bp, Homo sapiens
accccaacttcaagaacaggcttcg

SEQ ID NO: 24076 - DNA, 25 bp, Homo sapiens
ttccaagttacctgaccttaaagat

SEQ ID NO: 24077 - DNA, 25 bp, Homo sapiens
gttacctgaccttaaagatgctgaa

SEQ ID NO: 24078 - DNA, 25 bp, Homo sapiens
gctgttcagaagttcttccttgaag

SEQ ID NO: 24079 - DNA, 25 bp, Homo sapiens
aatacagcttggtgaagagttacta

SEQ ID NO: 24080 - DNA, 25 bp, Homo sapiens
gaagagttactagctcaaggtgaat

SEQ ID NO: 24081 - DNA, 25 bp, Homo sapiens
gagaagggcgtagaccatctgacaa

SEQ ID NO: 24082 - DNA, 25 bp, Homo sapiens
ggacagccacagcagttactgcagg

SEQ ID NO: 24083 - DNA, 25 bp, Homo sapiens
gtgctcagagcttggctgaagatga

SEQ ID NO: 24084 - DNA, 25 bp, Homo sapiens
gcatggaaaacgtttgctgtttttc

SEQ ID NO: 24085 - DNA, 25 bp, Homo sapiens
aaatttgatcgccttaactactgta

SEQ ID NO: 24086 - DNA, 25 bp, Homo sapiens
aaacatagcctatttttgtgcttaa

SEQ ID NO: 24087 - DNA, 25 bp, Homo sapiens
ggaaaactccattgtgtgttgctgg

SEQ ID NO: 24088 - DNA, 25 bp, Homo sapiens
attgtgtgttgctggactgttttgg

SEQ ID NO: 24089 - DNA, 25 bp, Homo sapiens
gtgtgttaatttggctgtaatggca

SEQ ID NO: 24090 - DNA, 25 bp, Homo sapiens
tggccttggagcattatctttagtt

SEQ ID NO: 24091 - DNA, 25 bp, Homo sapiens
gtcattgtgagtgattgctttttcc

SEQ ID NO: 24092 - DNA, 25 bp, Homo sapiens
agactgacatctagctttgacaatc

SEQ ID NO: 24093 - DNA, 25 bp, Homo sapiens
gttttgtactattggtgtgttggtg

SEQ ID NO: 24094 - DNA, 25 bp, Homo sapiens
aactgtgtgctaactgcaataaatt

SEQ ID NO: 24095 - DNA, 25 bp, Homo sapiens
gttcttgctcttcgagggcgagaag

SEQ ID NO: 24096 - DNA, 25 bp, Homo sapiens
aaggacaccaaggtacccaatgcct

SEQ ID NO: 24097 - DNA, 25 bp, Homo sapiens
caatgcctgtttattcaccatcaac

SEQ ID NO: 24098 - DNA, 25 bp, Homo sapiens
atcacaactcctaaaagacccgcaa

SEQ ID NO: 24099 - DNA, 25 bp, Homo sapiens
agacccgcaagtgctatttgctggc

SEQ ID NO: 24100 - DNA, 25 bp, Homo sapiens
tatttgctggctacaaagtccccca

SEQ ID NO: 24101 - DNA, 25 bp, Homo sapiens
gatcatcatccgagtgcagaccacg

SEQ ID NO: 24102 - DNA, 25 bp, Homo sapiens
caccgacctcatcagtgagctgtcc

SEQ ID NO: 24103 - DNA, 25 bp, Homo sapiens
agtaggggccagagggggctctgct

SEQ ID NO: 24104 - DNA, 25 bp, Homo sapiens
aggtaccacaccgaggagagcggcc

SEQ ID NO: 24105 - DNA, 25 bp, Homo sapiens
gacaccgacgtgtcctgtacataga

SEQ ID NO: 24106 - DNA, 25 bp, Homo sapiens
aacaggtactgctgggccggaaggt

SEQ ID NO: 24107 - DNA, 25 bp, Homo sapiens
ggtggtcgtacgctgtgaaggcatc

SEQ ID NO: 24108 - DNA, 25 bp, Homo sapiens
caagttgaagtacctggctttcctc

SEQ ID NO: 24109 - DNA, 25 bp, Homo sapiens
tccgcaagcggatgaacaccaaccc

SEQ ID NO: 24110 - DNA, 25 bp, Homo sapiens
tcttctggcggaccgtgcgaggtat

SEQ ID NO: 24111 - DNA, 25 bp, Homo sapiens
aaaagcggatggtggttcctgctgc

SEQ ID NO: 24112 - DNA, 25 bp, Homo sapiens
tcaaggtcgtgcgtctgaagcctac

SEQ ID NO: 24113 - DNA, 25 bp, Homo sapiens
agaaagtttgcctatctggggcgcc

SEQ ID NO: 24114 - DNA, 25 bp, Homo sapiens
gcctggctcacgaggttggctggaa

SEQ ID NO: 24115 - DNA, 25 bp, Homo sapiens
aagtaccaggcagtgacagccaccc

SEQ ID NO: 24116 - DNA, 25 bp, Homo sapiens
cacagaggtcctcaagacccacgga

SEQ ID NO: 24117 - DNA, 25 bp, Homo sapiens
gaaggatccttttgtagcagtgttt

SEQ ID NO: 24118 - DNA, 25 bp, Homo sapiens
gtgtttatgaatgtaacccccagca

SEQ ID NO: 24119 - DNA, 25 bp, Homo sapiens
gtaacccccagcaaaatatggctat

SEQ ID NO: 24120 - DNA, 25 bp, Homo sapiens
attaggggagccagtttggagcaga

SEQ ID NO: 24121 - DNA, 25 bp, Homo sapiens
gcagcccaagcactgtggagcatcc

SEQ ID NO: 24122 - DNA, 25 bp, Homo sapiens
tggagcatccacacctttgatggca

SEQ ID NO: 24123 - DNA, 25 bp, Homo sapiens
gcaatgcagattggtagcaggttcc

SEQ ID NO: 24124 - DNA, 25 bp, Homo sapiens
ggtagcaggttccataggcgtacaa

SEQ ID NO: 24125 - DNA, 25 bp, Homo sapiens
taaagctcagtgttttgcatattgt

SEQ ID NO: 24126 - DNA, 25 bp, Homo sapiens
atagctattgctacaacattttcga

SEQ ID NO: 24127 - DNA, 25 bp, Homo sapiens
gataagcctctaaaaatgcttggca

SEQ ID NO: 24128 - DNA, 25 bp, Homo sapiens
gctctggtgctagatgccactgtag

SEQ ID NO: 24129 - DNA, 25 bp, Homo sapiens
gatctccaacagtgccttggaccat

SEQ ID NO: 24130 - DNA, 25 bp, Homo sapiens
tggaccatggactcatactcaactg

SEQ ID NO: 24131 - DNA, 25 bp, Homo sapiens
gtggctgagctggtccttaataggt

SEQ ID NO: 24132 - DNA, 25 bp, Homo sapiens
ataggttgtttcttggtcttgcttt

SEQ ID NO: 24133 - DNA, 25 bp, Homo sapiens
gctcctgccacctttagataagttt

SEQ ID NO: 24134 - DNA, 25 bp, Homo sapiens
agtttctctagctaattttgtggcc

SEQ ID NO: 24135 - DNA, 25 bp, Homo sapiens
aattcgtcatcaacctaacaaacac

SEQ ID NO: 24136 - DNA, 25 bp, Homo sapiens
taacaaacacaaccttctcagcagc

SEQ ID NO: 24137 - DNA, 25 bp, Homo sapiens
aatggggaagggtctgttccagcct

SEQ ID NO: 24138 - DNA, 25 bp, Homo sapiens
gggaactgtgactatctatctcccc

SEQ ID NO: 24139 - DNA, 25 bp, Homo sapiens
gcagcatttacggtagtggcattct

SEQ ID NO: 24140 - DNA, 25 bp, Homo sapiens
aaggacctttgccatagttcagcta

SEQ ID NO: 24141 - DNA, 25 bp, Homo sapiens
gatcctgaacactctgaacttgacg

SEQ ID NO: 24142 - DNA, 25 bp, Homo sapiens
gaacttgacgtagtcctgcggtgat

SEQ ID NO: 24143 - DNA, 25 bp, Homo sapiens
gtcctgcggtgatattctatctgca

SEQ ID NO: 24144 - DNA, 25 bp, Homo sapiens
gtacctccagaatggcagatccctc

SEQ ID NO: 24145 - DNA, 25 bp, Homo sapiens
tattgacggttctctcagcgtatgc

SEQ ID NO: 24146 - DNA, 25 bp, Homo sapiens
gaaagcctgagttatcttgctataa

SEQ ID NO: 24147 - DNA, 25 bp, Homo sapiens
ttcatggagcacttcctttccagaa

SEQ ID NO: 24148 - DNA, 25 bp, Homo sapiens
tgtcctggcgtcggtttttagcata

SEQ ID NO: 24149 - DNA, 25 bp, Homo sapiens
tgcatttctgggtttcttgtgtgga

SEQ ID NO: 24150 - DNA, 25 bp, Homo sapiens
agcgagggggcaaggactctgcctc

SEQ ID NO: 24151 - DNA, 25 bp, Homo sapiens
tgcctccagggcatctggggttttc

SEQ ID NO: 24152 - DNA, 25 bp, Homo sapiens
gcaccagtggtgtgagcagttggac

SEQ ID NO: 24153 - DNA, 25 bp, Homo sapiens
gcagttggactcagtttggacaagg

SEQ ID NO: 24154 - DNA, 25 bp, Homo sapiens
ggaaggtccagctaaaagtggcaac

SEQ ID NO: 24155 - DNA, 25 bp, Homo sapiens
aaaagtggcaacatttgcccccaga

SEQ ID NO: 24156 - DNA, 25 bp, Homo sapiens
ttccctgccctacataggggcggtg

SEQ ID NO: 24157 - DNA, 25 bp, Homo sapiens
taggggcggtgggtgtgggatccct

SEQ ID NO: 24158 - DNA, 25 bp, Homo sapiens
gaggcctgggttggactcagggtct

SEQ ID NO: 24159 - DNA, 25 bp, Homo sapiens
ccgcagcacctatctgagcagttag

SEQ ID NO: 24160 - DNA, 25 bp, Homo sapiens
gagcagttagagcgtctttcttttc

SEQ ID NO: 24161 - DNA, 25 bp, Homo sapiens
gattttggctactaccgtccagaaa

SEQ ID NO: 24162 - DNA, 25 bp, Homo sapiens
ttccaattatcctggccatcgtggg

SEQ ID NO: 24163 - DNA, 25 bp, Homo sapiens
gattgatgctggtcacagtcgtagc

SEQ ID NO: 24164 - DNA, 25 bp, Homo sapiens
gaaggttcctggtgcatcgatactc

SEQ ID NO: 24165 - DNA, 25 bp, Homo sapiens
gtgcatcgatactctgtgctgcagc

SEQ ID NO: 24166 - DNA, 25 bp, Homo sapiens
tgtggatgctttggacacagcctcc

SEQ ID NO: 24167 - DNA, 25 bp, Homo sapiens
cacagcctcccacactaataaaagt

SEQ ID NO: 24168 - DNA, 25 bp, Homo sapiens
ggacctcttggaatagctcttcaga

SEQ ID NO: 24169 - DNA, 25 bp, Homo sapiens
agctggacccagcatggatggtgga

SEQ ID NO: 24170 - DNA, 25 bp, Homo sapiens
tggtggaaccacagtacctcttaca

SEQ ID NO: 24171 - DNA, 25 bp, Homo sapiens
tccctgtggctccaacttcaggaaa

SEQ ID NO: 24172 - DNA, 25 bp, Homo sapiens
ggatgcttagcatgcaagttccctc

SEQ ID NO: 24173 - DNA, 25 bp, Homo sapiens
ctccatcattgccaccttggtagag

SEQ ID NO: 24174 - DNA, 25 bp, Homo sapiens
tggtagagagggatggctccccacc

SEQ ID NO: 24175 - DNA, 25 bp, Homo sapiens
ccaccctcagcgttggggattcacg

SEQ ID NO: 24176 - DNA, 25 bp, Homo sapiens
cctccttcttggttgtcatagtgat

SEQ ID NO: 24177 - DNA, 25 bp, Homo sapiens
gtgatagggtagccttattgccccc

SEQ ID NO: 24178 - DNA, 25 bp, Homo sapiens
tctacactagtgccatgggaaccag

SEQ ID NO: 24179 - DNA, 25 bp, Homo sapiens
gtgactcaagactcgaggccgatac

SEQ ID NO: 24180 - DNA, 25 bp, Homo sapiens
gccgatacgaggctgtgattctgcc

SEQ ID NO: 24181 - DNA, 25 bp, Homo sapiens
gattctgcctttggatggatgttgc

SEQ ID NO: 24182 - DNA, 25 bp, Homo sapiens
tacagacttgtactaacacaccgta

SEQ ID NO: 24183 - DNA, 25 bp, Homo sapiens
gcacgagacacttttcatctggagc

SEQ ID NO: 24184 - DNA, 25 bp, Homo sapiens
ggagcaggggggtgagctcctcagc

SEQ ID NO: 24185 - DNA, 25 bp, Homo sapiens
catctaccagccttcatcaggaagg

SEQ ID NO: 24186 - DNA, 25 bp, Homo sapiens
tttggggtcaggtggcagctattcc

SEQ ID NO: 24187 - DNA, 25 bp, Homo sapiens
gctattccccaccaagagattcagg

SEQ ID NO: 24188 - DNA, 25 bp, Homo sapiens
caagagattcagggtcacaggtttt

SEQ ID NO: 24189 - DNA, 25 bp, Homo sapiens
caaacttccaaatcccacttttgtg

SEQ ID NO: 24190 - DNA, 25 bp, Homo sapiens
tgtgaagctactcatttcttaccct

SEQ ID NO: 24191 - DNA, 25 bp, Homo sapiens
atttcttacccttggaggctgtgtg

SEQ ID NO: 24192 - DNA, 25 bp, Homo sapiens
tgtgtggggaatttccagccctttt

SEQ ID NO: 24193 - DNA, 25 bp, Homo sapiens
cagccagatcctggggtggggtctt

SEQ ID NO: 24194 - DNA, 25 bp, Homo sapiens
ggggcaagtgatgtgtaactgctca

SEQ ID NO: 24195 - DNA, 25 bp, Homo sapiens
aagagatgcttaaacctccatagag

SEQ ID NO: 24196 - DNA, 25 bp, Homo sapiens
tccatagagaggagccgggcgcagg

SEQ ID NO: 24197 - DNA, 25 bp, Homo sapiens
ctccctggcatcagtggtttggttt

SEQ ID NO: 24198 - DNA, 25 bp, Homo sapiens
agtggtttggtttaagctccagagg

SEQ ID NO: 24199 - DNA, 25 bp, Homo sapiens
ggccctggagtctgtttctttaggc

SEQ ID NO: 24200 - DNA, 25 bp, Homo sapiens
gcggatgaactgacatgctcctacc

SEQ ID NO: 24201 - DNA, 25 bp, Homo sapiens
gcaaggctcctcacagtatccttga

SEQ ID NO: 24202 - DNA, 25 bp, Homo sapiens
gtatccttgagaggtgggcatggaa

SEQ ID NO: 24203 - DNA, 25 bp, Homo sapiens
ggcatggaagtgcccatttctcagg

SEQ ID NO: 24204 - DNA, 25 bp, Homo sapiens
ggataaatagcttgccctgtagaag

SEQ ID NO: 24205 - DNA, 25 bp, Homo sapiens
caggggaaccaagagaaccacgtag

SEQ ID NO: 24206 - DNA, 25 bp, Homo sapiens
agaaccacgtagaatcctcaaccgt

SEQ ID NO: 24207 - DNA, 25 bp, Homo sapiens
accacgtagaatcctcaaccgtgcg

SEQ ID NO: 24208 - DNA, 25 bp, Homo sapiens
cacgtagaatcctcaaccgtgcgga

SEQ ID NO: 24209 - DNA, 25 bp, Homo sapiens
gaaggctctagaaaaggggcgcatt

SEQ ID NO: 24210 - DNA, 25 bp, Homo sapiens
cagccgattccgtgtcttgatcacg

SEQ ID NO: 24211 - DNA, 25 bp, Homo sapiens
gattccgtgtcttgatcacggggtg

SEQ ID NO: 24212 - DNA, 25 bp, Homo sapiens
tccgtgtcttgatcacggggtggga

SEQ ID NO: 24213 - DNA, 25 bp, Homo sapiens
atgggtgagacactccagtactgag

SEQ ID NO: 24214 - DNA, 25 bp, Homo sapiens
ctggtcctgtacgacgagctcaaga

SEQ ID NO: 24215 - DNA, 25 bp, Homo sapiens
gtcctgtacgacgagctcaagaagg

SEQ ID NO: 24216 - DNA, 25 bp, Homo sapiens
cctcctccacagctaacatagacga

SEQ ID NO: 24217 - DNA, 25 bp, Homo sapiens
gcaccctgcagctttagtttactaa

SEQ ID NO: 24218 - DNA, 25 bp, Homo sapiens
gcctcagcaggcctagtgtatacaa

SEQ ID NO: 24219 - DNA, 25 bp, Homo sapiens
actggttgtatgtatcatgccgtgg

SEQ ID NO: 24220 - DNA, 25 bp, Homo sapiens
tcatgccgtggagctagggggagga

SEQ ID NO: 24221 - DNA, 25 bp, Homo sapiens
agggggaggagtcattgtggcacaa

SEQ ID NO: 24222 - DNA, 25 bp, Homo sapiens
agtatttgtacatactctgcttctc

SEQ ID NO: 24223 - DNA, 25 bp, Homo sapiens
gctgctctagaagactgtccgtgga

SEQ ID NO: 24224 - DNA, 25 bp, Homo sapiens
tctgctcagtctagttcccagatcc

SEQ ID NO: 24225 - DNA, 25 bp, Homo sapiens
aattgtcctaatctttcctagcttt

SEQ ID NO: 24226 - DNA, 25 bp, Homo sapiens
ctctgtcgccctgaagggtcactgt

SEQ ID NO: 24227 - DNA, 25 bp, Homo sapiens
gcattgtccctatgtaactatctta

SEQ ID NO: 24228 - DNA, 25 bp, Homo sapiens
tccctacacattttctacacttaca

SEQ ID NO: 24229 - DNA, 25 bp, Homo sapiens
tacacttacatcaccttattgcata

SEQ ID NO: 24230 - DNA, 25 bp, Homo sapiens
aaacaaagtcacgcgctttctgctt

SEQ ID NO: 24231 - DNA, 25 bp, Homo sapiens
cgcgctttctgcttgaacatcaaaa

SEQ ID NO: 24232 - DNA, 25 bp, Homo sapiens
gagacaacatccttgtccatatcca

SEQ ID NO: 24233 - DNA, 25 bp, Homo sapiens
ttgtccatatccaaacccagtgttt

SEQ ID NO: 24234 - DNA, 25 bp, Homo sapiens
aacccagtgtttcagtgctagcaac

SEQ ID NO: 24235 - DNA, 25 bp, Homo sapiens
gtttggtttgctttgctagttgtgt

SEQ ID NO: 24236 - DNA, 25 bp, Homo sapiens
gacaattactactgtttccacattt

SEQ ID NO: 24237 - DNA, 25 bp, Homo sapiens
tttatttctgaatggcttgtctgag

SEQ ID NO: 24238 - DNA, 25 bp, Homo sapiens
atccaagcaccctaatgactgttta

SEQ ID NO: 24239 - DNA, 25 bp, Homo sapiens
gccattccagaagtagcttatccta

SEQ ID NO: 24240 - DNA, 25 bp, Homo sapiens
ccactaacttccatgcttcagagat

SEQ ID NO: 24241 - DNA, 25 bp, Homo sapiens
gacattcaaagccagattcccaagt

SEQ ID NO: 24242 - DNA, 25 bp, Homo sapiens
cagattcccaagtgcctgatcatac

SEQ ID NO: 24243 - DNA, 25 bp, Homo sapiens
tacctcccagtctcaggaagatatt

SEQ ID NO: 24244 - DNA, 25 bp, Homo sapiens
gaagatatttgcttaccccttagac

SEQ ID NO: 24245 - DNA, 25 bp, Homo sapiens
aagaatcttaagatcttccccagct

SEQ ID NO: 24246 - DNA, 25 bp, Homo sapiens
tccccagctatgaagcctatcttgg

SEQ ID NO: 24247 - DNA, 25 bp, Homo sapiens
gggaagaaatagccttacagcccct

SEQ ID NO: 24248 - DNA, 25 bp, Homo sapiens
tacatccacagtgtctgctggtcgt

SEQ ID NO: 24249 - DNA, 25 bp, Homo sapiens
ggatgggctggaccaggtgggacag

SEQ ID NO: 24250 - DNA, 25 bp, Homo sapiens
gtgtcaccatataactgcacctcac

SEQ ID NO: 24251 - DNA, 25 bp, Homo sapiens
gcacgtgtgcatgactcgcagagaa

SEQ ID NO: 24252 - DNA, 25 bp, Homo sapiens
aatattccagcaattgtgtacccct

SEQ ID NO: 24253 - DNA, 25 bp, Homo sapiens
gtctagtaattcttgatgttcatct

SEQ ID NO: 24254 - DNA, 25 bp, Homo sapiens
gaacttcgatgcaggtccagagacc

SEQ ID NO: 24255 - DNA, 25 bp, Homo sapiens
gtccagagaccatggacactcccac

SEQ ID NO: 24256 - DNA, 25 bp, Homo sapiens
caccccctacacttcagttgaggga

SEQ ID NO: 24257 - DNA, 25 bp, Homo sapiens
ggaaaagctcaagtgccttaggccc

SEQ ID NO: 24258 - DNA, 25 bp, Homo sapiens
ggaattgtgttgtgccttacttcag

SEQ ID NO: 24259 - DNA, 25 bp, Homo sapiens
cagaggtggtctcttctttcttgta

SEQ ID NO: 24260 - DNA, 25 bp, Homo sapiens
gaatgtgagagcctgggtgtctgag

SEQ ID NO: 24261 - DNA, 25 bp, Homo sapiens
gcctgggtgtctgagaccgggaggg

SEQ ID NO: 24262 - DNA, 25 bp, Homo sapiens
ctcttctggtcaccaggctgttcag

SEQ ID NO: 24263 - DNA, 25 bp, Homo sapiens
ggctgttcagtggactcagttcttc

SEQ ID NO: 24264 - DNA, 25 bp, Homo sapiens
ggactcagttcttcatcttgtaatg

SEQ ID NO: 24265 - DNA, 25 bp, Homo sapiens
cttgtaatgtcgatggctttgccac

SEQ ID NO: 24266 - DNA, 25 bp, Homo sapiens
catgccataccttgtcaagactgtc

SEQ ID NO: 24267 - DNA, 25 bp, Homo sapiens
gaagaaacaggtcagccctcagatc

SEQ ID NO: 24268 - DNA, 25 bp, Homo sapiens
gctctgccattagctaggacctaag

SEQ ID NO: 24269 - DNA, 25 bp, Homo sapiens
ttagctaggacctaagactctgccc

SEQ ID NO: 24270 - DNA, 25 bp, Homo sapiens
taggtttgtctcagcatgcaagagt

SEQ ID NO: 24271 - DNA, 25 bp, Homo sapiens
ggtgaatgtgtattcctctgggagg

SEQ ID NO: 24272 - DNA, 25 bp, Homo sapiens
tcgaacagaaaacttcctcccttat

SEQ ID NO: 24273 - DNA, 25 bp, Homo sapiens
aatcctcatgtatttatgcctaatg

SEQ ID NO: 24274 - DNA, 25 bp, Homo sapiens
ttttgttgcatgccctgtgcaggca

SEQ ID NO: 24275 - DNA, 25 bp, Homo sapiens
ccctgtgcaggcatctgtattgtac

SEQ ID NO: 24276 - DNA, 25 bp, Homo sapiens
gtattgtacatgcatgcctttcgtc

SEQ ID NO: 24277 - DNA, 25 bp, Homo sapiens
tttcgtcctgttttcctgtataaag

SEQ ID NO: 24278 - DNA, 25 bp, Homo sapiens
ttttgcctagttcatgttgccaagc

SEQ ID NO: 24279 - DNA, 25 bp, Homo sapiens
gaagatgctgttctttgcaagtgta

SEQ ID NO: 24280 - DNA, 25 bp, Homo sapiens
gttaccagtgaaacacccttgtggt

SEQ ID NO: 24281 - DNA, 25 bp, Homo sapiens
tcatttcctcccatgtaactaagaa

SEQ ID NO: 24282 - DNA, 25 bp, Homo sapiens
gaacattttacattggtctgctcag

SEQ ID NO: 24283 - DNA, 25 bp, Homo sapiens
tggtctgctcagcacatggctggat

SEQ ID NO: 24284 - DNA, 25 bp, Homo sapiens
atggctggatgcggatatttctata

SEQ ID NO: 24285 - DNA, 25 bp, Homo sapiens
agctcctctgtatgagaccagtggg

SEQ ID NO: 24286 - DNA, 25 bp, Homo sapiens
gagaccagtgggcgccatttaaaag

SEQ ID NO: 24287 - DNA, 25 bp, Homo sapiens
agcaagattctttcattcgtctcct

SEQ ID NO: 24288 - DNA, 25 bp, Homo sapiens
ggagggattatgtggctgctaaagc

SEQ ID NO: 24289 - DNA, 25 bp, Homo sapiens
tttcccagaggctggtcccagccag

SEQ ID NO: 24290 - DNA, 25 bp, Homo sapiens
tcccagccaggcacacacaaaaggc

SEQ ID NO: 24291 - DNA, 25 bp, Homo sapiens
gcacacacaaaaggcagattctcgt

SEQ ID NO: 24292 - DNA, 25 bp, Homo sapiens
gatctggagtggagctgctctgaga

SEQ ID NO: 24293 - DNA, 25 bp, Homo sapiens
aattcaaattgcacctcttttctta

SEQ ID NO: 24294 - DNA, 25 bp, Homo sapiens
tttgcattcttctagccagtgattg

SEQ ID NO: 24295 - DNA, 25 bp, Homo sapiens
atgctttctttgccactctaagtaa

SEQ ID NO: 24296 - DNA, 25 bp, Homo sapiens
gctggctgtttataactgcatcgca

SEQ ID NO: 24297 - DNA, 25 bp, Homo sapiens
gcatcgcacttctagttgtggcttg

SEQ ID NO: 24298 - DNA, 25 bp, Homo sapiens
tgtttcatgctaggcttttcctggc

SEQ ID NO: 24299 - DNA, 25 bp, Homo sapiens
tttcctggcagcatgtccattgcag

SEQ ID NO: 24300 - DNA, 25 bp, Homo sapiens
gaaaccaccagcattgagctaaccc

SEQ ID NO: 24301 - DNA, 25 bp, Homo sapiens
gctaacccagtacatgctaggacct

SEQ ID NO: 24302 - DNA, 25 bp, Homo sapiens
tgtcctagaggggccacttttcatt

SEQ ID NO: 24303 - DNA, 25 bp, Homo sapiens
ggccacttttcattacctgagttat

SEQ ID NO: 24304 - DNA, 25 bp, Homo sapiens
ttgggtctagggtgtcctcaaacag

SEQ ID NO: 24305 - DNA, 25 bp, Homo sapiens
acaggctgaggaggttccgaggctc

SEQ ID NO: 24306 - DNA, 25 bp, Homo sapiens
gccccgaggaggctctgagttgatg

SEQ ID NO: 24307 - DNA, 25 bp, Homo sapiens
gttgatgtcacttaggtccagggca

SEQ ID NO: 24308 - DNA, 25 bp, Homo sapiens
caggatccaaaagctagccctgccc

SEQ ID NO: 24309 - DNA, 25 bp, Homo sapiens
gggtgtccagggctagggagtgccg

SEQ ID NO: 24310 - DNA, 25 bp, Homo sapiens
gagtgccggatgaaaccagctctgt

SEQ ID NO: 24311 - DNA, 25 bp, Homo sapiens
ggctcccgcctgacaaacaggcagg

SEQ ID NO: 24312 - DNA, 25 bp, Homo sapiens
tgaaagcagcacttggacagccttc

SEQ ID NO: 24313 - DNA, 25 bp, Homo sapiens
ggacagccttcaaagtccttccatc

SEQ ID NO: 24314 - DNA, 25 bp, Homo sapiens
ccctctgtccttttcagaacacatg

SEQ ID NO: 24315 - DNA, 25 bp, Homo sapiens
caccgcgcagagctcagggggtggt

SEQ ID NO: 24316 - DNA, 25 bp, Homo sapiens
gcttgttcgtctcactggtgtgagc

SEQ ID NO: 24317 - DNA, 25 bp, Homo sapiens
ctcactggtgtgagctccagcatcc

SEQ ID NO: 24318 - DNA, 25 bp, Homo sapiens
catcccctttgctcgaaatggaccc

SEQ ID NO: 24319 - DNA, 25 bp, Homo sapiens
gccggctcctgcaagtgcaaagagt

SEQ ID NO: 24320 - DNA, 25 bp, Homo sapiens
gcacctcctgcaagaagagctgctg

SEQ ID NO: 24321 - DNA, 25 bp, Homo sapiens
cccagggctgcgtctgcaaaggggc

SEQ ID NO: 24322 - DNA, 25 bp, Homo sapiens
gaagtgcagctgctgtgcctgatgt

SEQ ID NO: 24323 - DNA, 25 bp, Homo sapiens
gtgcctgatgtgggaacagctcttc

SEQ ID NO: 24324 - DNA, 25 bp, Homo sapiens
acagctcttctcccagatgtaaata

SEQ ID NO: 24325 - DNA, 25 bp, Homo sapiens
aacactgagccatttgctgcatttc

SEQ ID NO: 24326 - DNA, 25 bp, Homo sapiens
gtgtcttaatggcatgtcagataat

SEQ ID NO: 24327 - DNA, 25 bp, Homo sapiens
ttctctctcaagtcctaaaatgaac

SEQ ID NO: 24328 - DNA, 25 bp, Homo sapiens
acctcttgtttaattgatctgtcca

SEQ ID NO: 24329 - DNA, 25 bp, Homo sapiens
atctgtccaactctgagatcacttg

SEQ ID NO: 24330 - DNA, 25 bp, Homo sapiens
gagatcacttggtaactggtttcat

SEQ ID NO: 24331 - DNA, 25 bp, Homo sapiens
gtttcatgtgtatccaaaaatcagc

SEQ ID NO: 24332 - DNA, 25 bp, Homo sapiens
gcatttggatttaagctttctgaat

SEQ ID NO: 24333 - DNA, 25 bp, Homo sapiens
aaataatgattttccaccagctctg

SEQ ID NO: 24334 - DNA, 25 bp, Homo sapiens
gcctctccttatctacggggattac

SEQ ID NO: 24335 - DNA, 25 bp, Homo sapiens
acggggattactttgtacatgcaga

SEQ ID NO: 24336 - DNA, 25 bp, Homo sapiens
taagttttcgcaaacctatttccat

SEQ ID NO: 24337 - DNA, 25 bp, Homo sapiens
taatctcacggctcttgatctggaa

SEQ ID NO: 24338 - DNA, 25 bp, Homo sapiens
ggcaggacacgtatctctgtctgac

SEQ ID NO: 24339 - DNA, 25 bp, Homo sapiens
caaaccggcctagacacgaagacca

SEQ ID NO: 24340 - DNA, 25 bp, Homo sapiens
aaagcagcctgcacagggcaaggcc

SEQ ID NO: 24341 - DNA, 25 bp, Homo sapiens
gtccatgaccgtttgcattcgaaac

SEQ ID NO: 24342 - DNA, 25 bp, Homo sapiens
gaaacacaatacactgcctcgttct

SEQ ID NO: 24343 - DNA, 25 bp, Homo sapiens
cctcgttctctcagttagcagctgg

SEQ ID NO: 24344 - DNA, 25 bp, Homo sapiens
gcagcgcaccattcatcatttaggc

SEQ ID NO: 24345 - DNA, 25 bp, Homo sapiens
ggcttgtggtttgttgtttactcta

SEQ ID NO: 24346 - DNA, 25 bp, Homo sapiens
ttggcctgacgctggagtgcggtga

SEQ ID NO: 24347 - DNA, 25 bp, Homo sapiens
gattgtattcctcagtagcacttta

SEQ ID NO: 24348 - DNA, 25 bp, Homo sapiens
ggagagtatggcggctggtacaaag

SEQ ID NO: 24349 - DNA, 25 bp, Homo sapiens
aaagcctgcaaagttgatagtccaa

SEQ ID NO: 24350 - DNA, 25 bp, Homo sapiens
tagtccaactgttacaaccactcta

SEQ ID NO: 24351 - DNA, 25 bp, Homo sapiens
ccttggggcactttacagacgtcaa

SEQ ID NO: 24352 - DNA, 25 bp, Homo sapiens
ggcactttacagacgtcaaggcaaa

SEQ ID NO: 24353 - DNA, 25 bp, Homo sapiens
gtggcagaagtgctcaatgaccctg

SEQ ID NO: 24354 - DNA, 25 bp, Homo sapiens
gaccctgagaacatggagaagcgca

SEQ ID NO: 24355 - DNA, 25 bp, Homo sapiens
gccgtgagagcctcaacgtggacgt

SEQ ID NO: 24356 - DNA, 25 bp, Homo sapiens
agagcctcaacgtggacgtggtcaa

SEQ ID NO: 24357 - DNA, 25 bp, Homo sapiens
gtggtcaagtacgagagtggccctg

SEQ ID NO: 24358 - DNA, 25 bp, Homo sapiens
gagtggccctgacggaggggaggaa

SEQ ID NO: 24359 - DNA, 25 bp, Homo sapiens
gcccagcgacaatcactgaacgccg

SEQ ID NO: 24360 - DNA, 25 bp, Homo sapiens
gattcaccaagtttcacgcaaagct

SEQ ID NO: 24361 - DNA, 25 bp, Homo sapiens
ggggtcccattgccaaattggcctt

SEQ ID NO: 24362 - DNA, 25 bp, Homo sapiens
aattggccttatggtgagacttatt

SEQ ID NO: 24363 - DNA, 25 bp, Homo sapiens
agacttattgcattgcactgcccgt

SEQ ID NO: 24364 - DNA, 25 bp, Homo sapiens
gatggaggagatgggcagccggacc

SEQ ID NO: 24365 - DNA, 25 bp, Homo sapiens
gaaggagcaggtggcggaggtgcgc

SEQ ID NO: 24366 - DNA, 25 bp, Homo sapiens
gcgcgccaagctggaggagcaggcc

SEQ ID NO: 24367 - DNA, 25 bp, Homo sapiens
gcaggcccagcagatacgcctgcag

SEQ ID NO: 24368 - DNA, 25 bp, Homo sapiens
tcgagcccctggtggaagacatgca

SEQ ID NO: 24369 - DNA, 25 bp, Homo sapiens
tgggccgggctggtggagaaggtgc

SEQ ID NO: 24370 - DNA, 25 bp, Homo sapiens
acaggcacatcaggctgcagaatgc

SEQ ID NO: 24371 - DNA, 25 bp, Homo sapiens
ggcacatcaggctgcagaatgcgct

SEQ ID NO: 24372 - DNA, 25 bp, Homo sapiens
atcaggctgcagaatgcgctttaga

SEQ ID NO: 24373 - DNA, 25 bp, Homo sapiens
ggctgcagaatgcgctttagaaagc

SEQ ID NO: 24374 - DNA, 25 bp, Homo sapiens
gaaagcattgttttagtccaggcac

SEQ ID NO: 24375 - DNA, 25 bp, Homo sapiens
gcattgttttagtccaggcacagtg

SEQ ID NO: 24376 - DNA, 25 bp, Homo sapiens
tttaattgagaggggcagggctgga

SEQ ID NO: 24377 - DNA, 25 bp, Homo sapiens
gatgtgggaaggagatcaacttctc

SEQ ID NO: 24378 - DNA, 25 bp, Homo sapiens
ttctcctcactctgggacagacgat

SEQ ID NO: 24379 - DNA, 25 bp, Homo sapiens
tcctcactctgggacagacgatgta

SEQ ID NO: 24380 - DNA, 25 bp, Homo sapiens
gggacagacgatgtatggaaactaa

SEQ ID NO: 24381 - DNA, 25 bp, Homo sapiens
tcagccaagttctaggagttcaaaa

SEQ ID NO: 24382 - DNA, 25 bp, Homo sapiens
aactatgcatcaattccacagccta

SEQ ID NO: 24383 - DNA, 25 bp, Homo sapiens
aattccacagcctatgacagacctt

SEQ ID NO: 24384 - DNA, 25 bp, Homo sapiens
gaccttccagaacttgatacaccag

SEQ ID NO: 24385 - DNA, 25 bp, Homo sapiens
gatacaccagaatctgccagaataa

SEQ ID NO: 24386 - DNA, 25 bp, Homo sapiens
aatagctttcatctcttggcttaga

SEQ ID NO: 24387 - DNA, 25 bp, Homo sapiens
gagagcagagaccatttttcccaat

SEQ ID NO: 24388 - DNA, 25 bp, Homo sapiens
gcaaacttccttcaaaacatgatag

SEQ ID NO: 24389 - DNA, 25 bp, Homo sapiens
gtcacgatagtgcagaatacctgga

SEQ ID NO: 24390 - DNA, 25 bp, Homo sapiens
tggaaatgtgtaataccttcttttt

SEQ ID NO: 24391 - DNA, 25 bp, Homo sapiens
gttctcactgtgatttcaacaacct

SEQ ID NO: 24392 - DNA, 25 bp, Homo sapiens
ccccacccgctttgaatgtagagac

SEQ ID NO: 24393 - DNA, 25 bp, Homo sapiens
tgtagagacccgtgggcacttttcc

SEQ ID NO: 24394 - DNA, 25 bp, Homo sapiens
cacagccgcctggaatgcaggactg

SEQ ID NO: 24395 - DNA, 25 bp, Homo sapiens
cactgctgttcgggtgatgacctcg

SEQ ID NO: 24396 - DNA, 25 bp, Homo sapiens
gctgtgcttctgtgaggtggtttag

SEQ ID NO: 24397 - DNA, 25 bp, Homo sapiens
gctttcgaagtggccagctgcggcc

SEQ ID NO: 24398 - DNA, 25 bp, Homo sapiens
ccaggtctcagcacaagagcgcttc

SEQ ID NO: 24399 - DNA, 25 bp, Homo sapiens
agcgcttcctttgcacagaatgagc

SEQ ID NO: 24400 - DNA, 25 bp, Homo sapiens
agcttcgagctttgttcagactaaa

SEQ ID NO: 24401 - DNA, 25 bp, Homo sapiens
gtcgggggcacgagttgattccaag

SEQ ID NO: 24402 - DNA, 25 bp, Homo sapiens
gattccaagcacatgcctttgctga

SEQ ID NO: 24403 - DNA, 25 bp, Homo sapiens
gatcttttattaagcatactttcac

SEQ ID NO: 24404 - DNA, 25 bp, Homo sapiens
gcctaaaacacaaatacaactgcca

SEQ ID NO: 24405 - DNA, 25 bp, Homo sapiens
atggtacgttactgaatgtgtttca

SEQ ID NO: 24406 - DNA, 25 bp, Homo sapiens
atgtgtttcatatgcgtgaccgtta

SEQ ID NO: 24407 - DNA, 25 bp, Homo sapiens
atacatataaccaaaccggcagcgt

SEQ ID NO: 24408 - DNA, 25 bp, Homo sapiens
accggcagcgtttagagttgggata

SEQ ID NO: 24409 - DNA, 25 bp, Homo sapiens
ttcctggttaaggttcccaagagag

SEQ ID NO: 24410 - DNA, 25 bp, Homo sapiens
gtggatggagacggtttgtggaatt

SEQ ID NO: 24411 - DNA, 25 bp, Homo sapiens
ggtttgtggaattttaagtgctcat

SEQ ID NO: 24412 - DNA, 25 bp, Homo sapiens
gtgctcattgtagtaaacttttgct

SEQ ID NO: 24413 - DNA, 25 bp, Homo sapiens
gaaggtacagacttatacaggcaag

SEQ ID NO: 24414 - DNA, 25 bp, Homo sapiens
tgaggtcatagctgtgtcctgggtc

SEQ ID NO: 24415 - DNA, 25 bp, Homo sapiens
tcctgggtcactgtggctggtgagg

SEQ ID NO: 24416 - DNA, 25 bp, Homo sapiens
acctcaaggaccccatcaagtgtac

SEQ ID NO: 24417 - DNA, 25 bp, Homo sapiens
gaccccatcaagtgtacacagcagc

SEQ ID NO: 24418 - DNA, 25 bp, Homo sapiens
aaatcaagggatgaccctcctctgg

SEQ ID NO: 24419 - DNA, 25 bp, Homo sapiens
gctggcagtgtgagctgtaggcagg

SEQ ID NO: 24420 - DNA, 25 bp, Homo sapiens
gagctgtaggcagggacggggaggg

SEQ ID NO: 24421 - DNA, 25 bp, Homo sapiens
gagggactgtcgctgtgatcagagt

SEQ ID NO: 24422 - DNA, 25 bp, Homo sapiens
gtgggttaagctgaccaggaacacc

SEQ ID NO: 24423 - DNA, 25 bp, Homo sapiens
ccccatgctacgtgattctttatgt

SEQ ID NO: 24424 - DNA, 25 bp, Homo sapiens
aaggggttagtgcatctttcagggg

SEQ ID NO: 24425 - DNA, 25 bp, Homo sapiens
cccctggagacccggggctgatggg

SEQ ID NO: 24426 - DNA, 25 bp, Homo sapiens
ccggggctgatgggtgaaaggggag

SEQ ID NO: 24427 - DNA, 25 bp, Homo sapiens
ccccgctggaaatggcaccgagggc

SEQ ID NO: 24428 - DNA, 25 bp, Homo sapiens
ctggaaatggcaccgagggcttccc

SEQ ID NO: 24429 - DNA, 25 bp, Homo sapiens
ctcaagggggacgagggagaagccg

SEQ ID NO: 24430 - DNA, 25 bp, Homo sapiens
accccggagacgataacaacgacat

SEQ ID NO: 24431 - DNA, 25 bp, Homo sapiens
cgataacaacgacattgcaccccga

SEQ ID NO: 24432 - DNA, 25 bp, Homo sapiens
acattgcaccccgaggagtcaaagg

SEQ ID NO: 24433 - DNA, 25 bp, Homo sapiens
gcaccccgaggagtcaaaggagcaa

SEQ ID NO: 24434 - DNA, 25 bp, Homo sapiens
cctgggccggacgaatgcgagattt

SEQ ID NO: 24435 - DNA, 25 bp, Homo sapiens
tgggccggacgaatgcgagattttg

SEQ ID NO: 24436 - DNA, 25 bp, Homo sapiens
tactgatgcttctgatactggatgt

SEQ ID NO: 24437 - DNA, 25 bp, Homo sapiens
ggatgtttagcttcttactgcaaaa

SEQ ID NO: 24438 - DNA, 25 bp, Homo sapiens
acagtcaactttaccatttccgtat

SEQ ID NO: 24439 - DNA, 25 bp, Homo sapiens
taccatttccgtattctccatagat

SEQ ID NO: 24440 - DNA, 25 bp, Homo sapiens
tatcgcatatgaccatctttccatc

SEQ ID NO: 24441 - DNA, 25 bp, Homo sapiens
gaccatctttccatcaaatcaatgt

SEQ ID NO: 24442 - DNA, 25 bp, Homo sapiens
tagtatgctctatttcctgaatgga

SEQ ID NO: 24443 - DNA, 25 bp, Homo sapiens
aaatgaaagctagcgcacctgcact

SEQ ID NO: 24444 - DNA, 25 bp, Homo sapiens
tcataatcatggtctcatttccttt

SEQ ID NO: 24445 - DNA, 25 bp, Homo sapiens
ttctttcaacacattcctttatttt

SEQ ID NO: 24446 - DNA, 25 bp, Homo sapiens
tgtcctttttttagctattgctgct

SEQ ID NO: 24447 - DNA, 25 bp, Homo sapiens
ggcaccttcaatttgccatcgtgac

SEQ ID NO: 24448 - DNA, 25 bp, Homo sapiens
ttccactgctttggagagtcccacc

SEQ ID NO: 24449 - DNA, 25 bp, Homo sapiens
aaacaggttcctttgctcagatgaa

SEQ ID NO: 24450 - DNA, 25 bp, Homo sapiens
gtgatgcctccttaggcacacaggc

SEQ ID NO: 24451 - DNA, 25 bp, Homo sapiens
cattgctgctaattttggtcctgct

SEQ ID NO: 24452 - DNA, 25 bp, Homo sapiens
tagcgggactcgttgacattgggga

SEQ ID NO: 24453 - DNA, 25 bp, Homo sapiens
ttgcaatgccccgaagacttaactc

SEQ ID NO: 24454 - DNA, 25 bp, Homo sapiens
aaaatcaagctgcactgaccaacct

SEQ ID NO: 24455 - DNA, 25 bp, Homo sapiens
gtacctgactgtgatttcaaacccc

SEQ ID NO: 24456 - DNA, 25 bp, Homo sapiens
ggttactggagcccatacctaggaa

SEQ ID NO: 24457 - DNA, 25 bp, Homo sapiens
gtattccaggtagacatcccagagc

SEQ ID NO: 24458 - DNA, 25 bp, Homo sapiens
ttgaggcaaggtctcactctgcttc

SEQ ID NO: 24459 - DNA, 25 bp, Homo sapiens
gtggggcaatattggctcactgcaa

SEQ ID NO: 24460 - DNA, 25 bp, Homo sapiens
gcacctcctggactcaagagatcct

SEQ ID NO: 24461 - DNA, 25 bp, Homo sapiens
ctgggactacaggcgtgtcccacca

SEQ ID NO: 24462 - DNA, 25 bp, Homo sapiens
tgttgtccaggctcgtctggaactc

SEQ ID NO: 24463 - DNA, 25 bp, Homo sapiens
agcctcccaaactgctgagattaca

SEQ ID NO: 24464 - DNA, 25 bp, Homo sapiens
cagcccactgacacgttttactgat

SEQ ID NO: 24465 - DNA, 25 bp, Homo sapiens
taatacaattcaccattctcttttc

SEQ ID NO: 24466 - DNA, 25 bp, Homo sapiens
cattctcttttctcacttcaagtaa

SEQ ID NO: 24467 - DNA, 25 bp, Homo sapiens
gaagtagacctaagtattcatcttg

SEQ ID NO: 24468 - DNA, 25 bp, Homo sapiens
aaaaatcatgccacctgaattgagc

SEQ ID NO: 24469 - DNA, 25 bp, Homo sapiens
tggtaaagtgaggggcccaccagca

SEQ ID NO: 24470 - DNA, 25 bp, Homo sapiens
gaaactttgtttacttgtctgctac

SEQ ID NO: 24471 - DNA, 25 bp, Homo sapiens
ctgctaccctctgatttgtttttag

SEQ ID NO: 24472 - DNA, 25 bp, Homo sapiens
gtgagcacacatagtacctagttac

SEQ ID NO: 24473 - DNA, 25 bp, Homo sapiens
gatctgggggtttcttcatattcct

SEQ ID NO: 24474 - DNA, 25 bp, Homo sapiens
gtttcttcatattcctgctgttgga

SEQ ID NO: 24475 - DNA, 25 bp, Homo sapiens
gttgaccagaaatgcttgccagtac

SEQ ID NO: 24476 - DNA, 25 bp, Homo sapiens
gccagtactgccaaagcactgctgt

SEQ ID NO: 24477 - DNA, 25 bp, Homo sapiens
ttctctgttcctttgttattacttg

SEQ ID NO: 24478 - DNA, 25 bp, Homo sapiens
gcatggtttggcgtcagaagtcctt

SEQ ID NO: 24479 - DNA, 25 bp, Homo sapiens
gaagtccttacctctttatattgtt

SEQ ID NO: 24480 - DNA, 25 bp, Homo sapiens
gctgaggacaggcttgcctggactt

SEQ ID NO: 24481 - DNA, 25 bp, Homo sapiens
agataggattttctgtgtttcctga

SEQ ID NO: 24482 - DNA, 25 bp, Homo sapiens
attttctcactattggtgtacctta

SEQ ID NO: 24483 - DNA, 25 bp, Homo sapiens
ggaggcatagtgctgacatatattc

SEQ ID NO: 24484 - DNA, 25 bp, Homo sapiens
ggttagcgtgacttcagttttgact

SEQ ID NO: 24485 - DNA, 25 bp, Homo sapiens
gttttatatctgtgtggtgttttgt

SEQ ID NO: 24486 - DNA, 25 bp, Homo sapiens
tggtgttttgtaccggcacgggata

SEQ ID NO: 24487 - DNA, 25 bp, Homo sapiens
gtaccggcacgggatatggaacgaa

SEQ ID NO: 24488 - DNA, 25 bp, Homo sapiens
tgttctggactgcaaatctgcacac

SEQ ID NO: 24489 - DNA, 25 bp, Homo sapiens
aatctgcacacacaacgaacagttg

SEQ ID NO: 24490 - DNA, 25 bp, Homo sapiens
aacagttgcatttcagagagttctc

SEQ ID NO: 24491 - DNA, 25 bp, Homo sapiens
ggaccgcattgatgtccagcagctg

SEQ ID NO: 24492 - DNA, 25 bp, Homo sapiens
ttgcctcacatccgaaagtcagtct

SEQ ID NO: 24493 - DNA, 25 bp, Homo sapiens
cagtctctacaagtagccctgctgg

SEQ ID NO: 24494 - DNA, 25 bp, Homo sapiens
acctctggggcgtccaataacagtt

SEQ ID NO: 24495 - DNA, 25 bp, Homo sapiens
tgagactgactccaaggccacaaac

SEQ ID NO: 24496 - DNA, 25 bp, Homo sapiens
gacaaatggcgttcagcagcgggtt

SEQ ID NO: 24497 - DNA, 25 bp, Homo sapiens
gcttttttcccatccatagagcatg

SEQ ID NO: 24498 - DNA, 25 bp, Homo sapiens
gacagcatcgattctcattgaggag

SEQ ID NO: 24499 - DNA, 25 bp, Homo sapiens
agctccggccaggccttgtaggaaa

SEQ ID NO: 24500 - DNA, 25 bp, Homo sapiens
caacggccactgtgtgtggctgctc

SEQ ID NO: 24501 - DNA, 25 bp, Homo sapiens
ggtccctgatgcagtgcttcagatg

SEQ ID NO: 24502 - DNA, 25 bp, Homo sapiens
gaattcacacggtactcagaggcac

SEQ ID NO: 24503 - DNA, 25 bp, Homo sapiens
gagacctgtccataatacccaacag

SEQ ID NO: 24504 - DNA, 25 bp, Homo sapiens
tttggtataacttctttcctgctgc

SEQ ID NO: 24505 - DNA, 25 bp, Homo sapiens
tgctgcttcccggcaaacatagttt

SEQ ID NO: 24506 - DNA, 25 bp, Homo sapiens
ggcagagtgcggtatattccaggaa

SEQ ID NO: 24507 - DNA, 25 bp, Homo sapiens
tactcacttagcttacttctttgtt

SEQ ID NO: 24508 - DNA, 25 bp, Homo sapiens
gggtgacaatgcacacatgctgggc

SEQ ID NO: 24509 - DNA, 25 bp, Homo sapiens
gctgggccagcagaagctaggacat

SEQ ID NO: 24510 - DNA, 25 bp, Homo sapiens
gagttgtcattctcatctatccatg

SEQ ID NO: 24511 - DNA, 25 bp, Homo sapiens
cagtgtgcacggtcccacactgtgg

SEQ ID NO: 24512 - DNA, 25 bp, Homo sapiens
aatgtacacgctgcagccagaatgc

SEQ ID NO: 24513 - DNA, 25 bp, Homo sapiens
gcgctgcggcggaagaaggtgctga

SEQ ID NO: 24514 - DNA, 25 bp, Homo sapiens
gatggagctgtacgagctggcgcag

SEQ ID NO: 24515 - DNA, 25 bp, Homo sapiens
gacgtgttcaagatcctggtggacc

SEQ ID NO: 24516 - DNA, 25 bp, Homo sapiens
gacctgctgaagctgaacgtggccc

SEQ ID NO: 24517 - DNA, 25 bp, Homo sapiens
cagatgctcaagtccatgtgtgccg

SEQ ID NO: 24518 - DNA, 25 bp, Homo sapiens
gccgggcagaggctagcgagcgagc

SEQ ID NO: 24519 - DNA, 25 bp, Homo sapiens
gaaacaaaggcagcgctgccctcgg

SEQ ID NO: 24520 - DNA, 25 bp, Homo sapiens
gcctgggaagagccctacacggggc

SEQ ID NO: 24521 - DNA, 25 bp, Homo sapiens
gcagcacctaggatggggcagagac

SEQ ID NO: 24522 - DNA, 25 bp, Homo sapiens
cagagacttgttgcatctttgtccc

SEQ ID NO: 24523 - DNA, 25 bp, Homo sapiens
ctacatgttacctccttcaattgat

SEQ ID NO: 24524 - DNA, 25 bp, Homo sapiens
tggcgggctcagtctgaatctgccc

SEQ ID NO: 24525 - DNA, 25 bp, Homo sapiens
ggctcagtctgaatctgcccagagc

SEQ ID NO: 24526 - DNA, 25 bp, Homo sapiens
cagtctgaatctgcccagagcaaga

SEQ ID NO: 24527 - DNA, 25 bp, Homo sapiens
gaatctgcccagagcaagatgctga

SEQ ID NO: 24528 - DNA, 25 bp, Homo sapiens
tgcccagagcaagatgctgagtggc

SEQ ID NO: 24529 - DNA, 25 bp, Homo sapiens
ctgcactgactcctgagactatttt

SEQ ID NO: 24530 - DNA, 25 bp, Homo sapiens
actgactcctgagactattttaact

SEQ ID NO: 24531 - DNA, 25 bp, Homo sapiens
gtcctacagtggctgtcacgcagcc

SEQ ID NO: 24532 - DNA, 25 bp, Homo sapiens
agtggctgtcacgcagccaccaggt

SEQ ID NO: 24533 - DNA, 25 bp, Homo sapiens
tcctcagactgctcaagagaagcac

SEQ ID NO: 24534 - DNA, 25 bp, Homo sapiens
cagactgctcaagagaagcacatga

SEQ ID NO: 24535 - DNA, 25 bp, Homo sapiens
gcccccagatggctacagaccagag

SEQ ID NO: 24536 - DNA, 25 bp, Homo sapiens
tacagaccagagattccacgctctc

SEQ ID NO: 24537 - DNA, 25 bp, Homo sapiens
cgctctcaggctgactagagtccgc

SEQ ID NO: 24538 - DNA, 25 bp, Homo sapiens
atctccaaactacacttccctggag

SEQ ID NO: 24539 - DNA, 25 bp, Homo sapiens
aaacaggccacttctcaggagttga

SEQ ID NO: 24540 - DNA, 25 bp, Homo sapiens
cagcatggtggctttctgagtcctg

SEQ ID NO: 24541 - DNA, 25 bp, Homo sapiens
cactcccgggactattgccaagaag

SEQ ID NO: 24542 - DNA, 25 bp, Homo sapiens
caagaaggtgagacccttcccggtg

SEQ ID NO: 24543 - DNA, 25 bp, Homo sapiens
gtttggtactgtccatgtctgggtg

SEQ ID NO: 24544 - DNA, 25 bp, Homo sapiens
tctgggtgtgtgcctattacctcag

SEQ ID NO: 24545 - DNA, 25 bp, Homo sapiens
attacctcagcatttctcacaaagt

SEQ ID NO: 24546 - DNA, 25 bp, Homo sapiens
aaagaacaactcctcaccagttcat

SEQ ID NO: 24547 - DNA, 25 bp, Homo sapiens
ctcctcaccagttcatcctgaggct

SEQ ID NO: 24548 - DNA, 25 bp, Homo sapiens
tcaccagttcatcctgaggctggga

SEQ ID NO: 24549 - DNA, 25 bp, Homo sapiens
ctgggaggaccgggatgctggattc

SEQ ID NO: 24550 - DNA, 25 bp, Homo sapiens
aggaccgggatgctggattctgttt

SEQ ID NO: 24551 - DNA, 25 bp, Homo sapiens
ggattctgttttccgaagtcactgc

SEQ ID NO: 24552 - DNA, 25 bp, Homo sapiens
ccgaagtcactgcagcggatgatgg

SEQ ID NO: 24553 - DNA, 25 bp, Homo sapiens
gcagcggatgatggaactgaatcga

SEQ ID NO: 24554 - DNA, 25 bp, Homo sapiens
aatcgatacggtgttttctgtccct

SEQ ID NO: 24555 - DNA, 25 bp, Homo sapiens
ggactacagacaactctttctttaa

SEQ ID NO: 24556 - DNA, 25 bp, Homo sapiens
taagtctctacaataaaaacacaac

SEQ ID NO: 24557 - DNA, 25 bp, Homo sapiens
ctgaaggggcaccttctgttcactc

SEQ ID NO: 24558 - DNA, 25 bp, Homo sapiens
gttcactcccacaaagtggtgtctg

SEQ ID NO: 24559 - DNA, 25 bp, Homo sapiens
gtctggttctcactgagacgtttta

SEQ ID NO: 24560 - DNA, 25 bp, Homo sapiens
aaatctcattccagcatagttttgg

SEQ ID NO: 24561 - DNA, 25 bp, Homo sapiens
atcattggtaacttgggcctgggcc

SEQ ID NO: 24562 - DNA, 25 bp, Homo sapiens
gaatattctcatttggtcttaacta

SEQ ID NO: 24563 - DNA, 25 bp, Homo sapiens
gaactacacgtaacatcatcatttg

SEQ ID NO: 24564 - DNA, 25 bp, Homo sapiens
agaggaatcggctctgtatttgcct

SEQ ID NO: 24565 - DNA, 25 bp, Homo sapiens
ttatggattcctttttaccgtgtca

SEQ ID NO: 24566 - DNA, 25 bp, Homo sapiens
tgtcacatttactttggtcctctat

SEQ ID NO: 24567 - DNA, 25 bp, Homo sapiens
gccttagactcttgccatattttca

SEQ ID NO: 24568 - DNA, 25 bp, Homo sapiens
tgcgctcaccatcaataaaagtaat

SEQ ID NO: 24569 - DNA, 25 bp, Homo sapiens
gattgcagaaggtacagagcctccg

SEQ ID NO: 24570 - DNA, 25 bp, Homo sapiens
cagaaggtacagagcctccgaaggg

SEQ ID NO: 24571 - DNA, 25 bp, Homo sapiens
ccgaggaagatcccgggagacctgg

SEQ ID NO: 24572 - DNA, 25 bp, Homo sapiens
gacctggggctgccgaagaagctct

SEQ ID NO: 24573 - DNA, 25 bp, Homo sapiens
gaagaagctctgctccaaatggaga

SEQ ID NO: 24574 - DNA, 25 bp, Homo sapiens
gaagctctgctccaaatggagagtg

SEQ ID NO: 24575 - DNA, 25 bp, Homo sapiens
aaatggagagtgtagcctgagggct

SEQ ID NO: 24576 - DNA, 25 bp, Homo sapiens
gcactcacgccctaataaggagcga

SEQ ID NO: 24577 - DNA, 25 bp, Homo sapiens
ataaggagcgaatcctacatccacc

SEQ ID NO: 24578 - DNA, 25 bp, Homo sapiens
tctgaaagaggtgcagtcactcaca

SEQ ID NO: 24579 - DNA, 25 bp, Homo sapiens
agggcagaagagaaaccatcctctc

SEQ ID NO: 24580 - DNA, 25 bp, Homo sapiens
ccttcttacaccgtgaggccaagat

SEQ ID NO: 24581 - DNA, 25 bp, Homo sapiens
gtgtatgtgaaccacccatgtgagg

SEQ ID NO: 24582 - DNA, 25 bp, Homo sapiens
gtgactggggcaacctgcaaggagc

SEQ ID NO: 24583 - DNA, 25 bp, Homo sapiens
ccctcaagcccgaattcgtggacat

SEQ ID NO: 24584 - DNA, 25 bp, Homo sapiens
tcgtggacatcatcaatgccaaaca

SEQ ID NO: 24585 - DNA, 25 bp, Homo sapiens
ctttccctgcatatgcttctgatgg

SEQ ID NO: 24586 - DNA, 25 bp, Homo sapiens
cctgcatatgcttctgatggtgtca

SEQ ID NO: 24587 - DNA, 25 bp, Homo sapiens
ctcatccaaactgtatcttccttta

SEQ ID NO: 24588 - DNA, 25 bp, Homo sapiens
actgtatcttcctttactgtttata

SEQ ID NO: 24589 - DNA, 25 bp, Homo sapiens
tcccttctccacttactataatggt

SEQ ID NO: 24590 - DNA, 25 bp, Homo sapiens
gtcatatacctgttttcagtcctaa

SEQ ID NO: 24591 - DNA, 25 bp, Homo sapiens
aggattcttgagtcccaatcacata

SEQ ID NO: 24592 - DNA, 25 bp, Homo sapiens
acataactgtggtgttactctgtca

SEQ ID NO: 24593 - DNA, 25 bp, Homo sapiens
gttactctgtcatttatatggtgtc

SEQ ID NO: 24594 - DNA, 25 bp, Homo sapiens
gcacttgatgagtaaacccagtagc

SEQ ID NO: 24595 - DNA, 25 bp, Homo sapiens
aacccagtagcatctttttgagtgt

SEQ ID NO: 24596 - DNA, 25 bp, Homo sapiens
tgagtgtttcataatgcattttcca

SEQ ID NO: 24597 - DNA, 25 bp, Homo sapiens
tatgccatgactaaaagtgccattt

SEQ ID NO: 24598 - DNA, 25 bp, Homo sapiens
gaaagcattccagatcaggcatggt

SEQ ID NO: 24599 - DNA, 25 bp, Homo sapiens
gaaggctgaggtgtggggattgcgt

SEQ ID NO: 24600 - DNA, 25 bp, Homo sapiens
cctggttagcaaggcaagatcccca

SEQ ID NO: 24601 - DNA, 25 bp, Homo sapiens
ggagttcaacatgctgagtgccctc

SEQ ID NO: 24602 - DNA, 25 bp, Homo sapiens
gagtgccctcaatgagatctactcc

SEQ ID NO: 24603 - DNA, 25 bp, Homo sapiens
gagatctactcctatgtcagcaagt

SEQ ID NO: 24604 - DNA, 25 bp, Homo sapiens
gctcatcggggccctagagcaggat

SEQ ID NO: 24605 - DNA, 25 bp, Homo sapiens
ggagcagctcattaatgccatgtcc

SEQ ID NO: 24606 - DNA, 25 bp, Homo sapiens
ggagcctcgcattcctgggaagagg

SEQ ID NO: 24607 - DNA, 25 bp, Homo sapiens
caagctgtcacactgggagtctcag

SEQ ID NO: 24608 - DNA, 25 bp, Homo sapiens
tacgccagccaagtttcgtcatagc

SEQ ID NO: 24609 - DNA, 25 bp, Homo sapiens
tgggagagacagtgggcgtcgtcca

SEQ ID NO: 24610 - DNA, 25 bp, Homo sapiens
gtcgtccatcctcagtgagaacacc

SEQ ID NO: 24611 - DNA, 25 bp, Homo sapiens
aaggtggttcttcaagccgagaggc

SEQ ID NO: 24612 - DNA, 25 bp, Homo sapiens
ccacgcaggtgttcttcaacggtgc

SEQ ID NO: 24613 - DNA, 25 bp, Homo sapiens
aacgtccggcaggtggacgtgccca

SEQ ID NO: 24614 - DNA, 25 bp, Homo sapiens
gctggtcgtggtgcatgcagaggac

SEQ ID NO: 24615 - DNA, 25 bp, Homo sapiens
ggtgcatgcagaggacggcaccacc

SEQ ID NO: 24616 - DNA, 25 bp, Homo sapiens
accacctccaaatactttgtgagca

SEQ ID NO: 24617 - DNA, 25 bp, Homo sapiens
tttgtgagcagcggttccatcgcag

SEQ ID NO: 24618 - DNA, 25 bp, Homo sapiens
gactcttcggtgcagttgttggccg

SEQ ID NO: 24619 - DNA, 25 bp, Homo sapiens
ttgttggccgaagaggccgtgacgc

SEQ ID NO: 24620 - DNA, 25 bp, Homo sapiens
tggtggggacagctgacgaggccac

SEQ ID NO: 24621 - DNA, 25 bp, Homo sapiens
agagatccagatccgaatcgaggcc

SEQ ID NO: 24622 - DNA, 25 bp, Homo sapiens
agatccgaatcgaggccaacgaggc

SEQ ID NO: 24623 - DNA, 25 bp, Homo sapiens
aggagaaaaggctccacttcccagc

SEQ ID NO: 24624 - DNA, 25 bp, Homo sapiens
ccttctcagacaaaccactcactgg

SEQ ID NO: 24625 - DNA, 25 bp, Homo sapiens
cctgcacccaaacagacacatcaac

SEQ ID NO: 24626 - DNA, 25 bp, Homo sapiens
acccccactgtacagagaccaagaa

SEQ ID NO: 24627 - DNA, 25 bp, Homo sapiens
tattattgccaatcccctaagatat

SEQ ID NO: 24628 - DNA, 25 bp, Homo sapiens
ttgtattttacaaatctccctcttc

SEQ ID NO: 24629 - DNA, 25 bp, Homo sapiens
tgaagttagtgcgggctttgctgct

SEQ ID NO: 24630 - DNA, 25 bp, Homo sapiens
gctccctggcccaggaaagagggac

SEQ ID NO: 24631 - DNA, 25 bp, Homo sapiens
ccaagccgctgggcctttttaattg

SEQ ID NO: 24632 - DNA, 25 bp, Homo sapiens
gccgctgggcctttttaattgccaa

SEQ ID NO: 24633 - DNA, 25 bp, Homo sapiens
cttcatcagctcagcacatgcttta

SEQ ID NO: 24634 - DNA, 25 bp, Homo sapiens
ggcattgctgtcaacattaagactg

SEQ ID NO: 24635 - DNA, 25 bp, Homo sapiens
gcgcgaactttagcaggaggaccaa

SEQ ID NO: 24636 - DNA, 25 bp, Homo sapiens
agcaggaggaccaatgattagcatt

SEQ ID NO: 24637 - DNA, 25 bp, Homo sapiens
gacagaacaacttcgtataggaccg

SEQ ID NO: 24638 - DNA, 25 bp, Homo sapiens
cgtataggaccgtactcctggacac

SEQ ID NO: 24639 - DNA, 25 bp, Homo sapiens
ctggacaccatttccacatgtggat

SEQ ID NO: 24640 - DNA, 25 bp, Homo sapiens
acatgtggatttctggttgcaccaa

SEQ ID NO: 24641 - DNA, 25 bp, Homo sapiens
tctggttgcaccaagatgacaagca

SEQ ID NO: 24642 - DNA, 25 bp, Homo sapiens
agcaaatactagagaatctttccac

SEQ ID NO: 24643 - DNA, 25 bp, Homo sapiens
gccaccccactttgttgaacatatt

SEQ ID NO: 24644 - DNA, 25 bp, Homo sapiens
tgttgaacatattagatctaccttg

SEQ ID NO: 24645 - DNA, 25 bp, Homo sapiens
accaaagaaagcaccttcttggcct

SEQ ID NO: 24646 - DNA, 25 bp, Homo sapiens
ccttcttggcctgacagaccattgg

SEQ ID NO: 24647 - DNA, 25 bp, Homo sapiens
gacagaccattggtggggctggcac

SEQ ID NO: 24648 - DNA, 25 bp, Homo sapiens
cattggtggggctggcacgaatcca

SEQ ID NO: 24649 - DNA, 25 bp, Homo sapiens
gggctggcacgaatccagatctgga

SEQ ID NO: 24650 - DNA, 25 bp, Homo sapiens
gatctggatcctacatctgttgggt

SEQ ID NO: 24651 - DNA, 25 bp, Homo sapiens
ggatcctacatctgttgggtcttag

SEQ ID NO: 24652 - DNA, 25 bp, Homo sapiens
cctacatctgttgggtcttaggcct

SEQ ID NO: 24653 - DNA, 25 bp, Homo sapiens
cagtgtctttcaaatgactttcatc

SEQ ID NO: 24654 - DNA, 25 bp, Homo sapiens
ctggaaataaagccctactctacaa

SEQ ID NO: 24655 - DNA, 25 bp, Homo sapiens
gatggcttgtgggaaaagatctctt

SEQ ID NO: 24656 - DNA, 25 bp, Homo sapiens
gaagcagccaaaactgaggccctgt

SEQ ID NO: 24657 - DNA, 25 bp, Homo sapiens
ccattggcttggctgcagagtagac

SEQ ID NO: 24658 - DNA, 25 bp, Homo sapiens
agtagactgagagctggggccacgt

SEQ ID NO: 24659 - DNA, 25 bp, Homo sapiens
tgtgctcagtattaattacgccccc

SEQ ID NO: 24660 - DNA, 25 bp, Homo sapiens
ggccaacccttccatgggtgaagac

SEQ ID NO: 24661 - DNA, 25 bp, Homo sapiens
tggaggcgggtggcccagaaagcca

SEQ ID NO: 24662 - DNA, 25 bp, Homo sapiens
aagccatctacagggttccctaggc

SEQ ID NO: 24663 - DNA, 25 bp, Homo sapiens
agtattggggccagatccctaagcc

SEQ ID NO: 24664 - DNA, 25 bp, Homo sapiens
ctaagccccccagctgtaaataggc

SEQ ID NO: 24665 - DNA, 25 bp, Homo sapiens
ccagtgcctggtcatcagaagaggg

SEQ ID NO: 24666 - DNA, 25 bp, Homo sapiens
gagcccaggcgtctgtttatgtatt

SEQ ID NO: 24667 - DNA, 25 bp, Homo sapiens
gacaggagggtgtccacatatgtta

SEQ ID NO: 24668 - DNA, 25 bp, Homo sapiens
ggagggtgtccacatatgttaacat

SEQ ID NO: 24669 - DNA, 25 bp, Homo sapiens
gttaacatcagttggatctcctata

SEQ ID NO: 24670 - DNA, 25 bp, Homo sapiens
gatctcctatagaagtttctgctgc

SEQ ID NO: 24671 - DNA, 25 bp, Homo sapiens
cttctccctgagctggtaactgcaa

SEQ ID NO: 24672 - DNA, 25 bp, Homo sapiens
tccctgagctggtaactgcaatgcc

SEQ ID NO: 24673 - DNA, 25 bp, Homo sapiens
tggtaactgcaatgccaacttcctg

SEQ ID NO: 24674 - DNA, 25 bp, Homo sapiens
tgggcctttctgactagtatcacac

SEQ ID NO: 24675 - DNA, 25 bp, Homo sapiens
gcctttctgactagtatcacacttc

SEQ ID NO: 24676 - DNA, 25 bp, Homo sapiens
ttctgactagtatcacacttctaat

SEQ ID NO: 24677 - DNA, 25 bp, Homo sapiens
atcacacttctaataaaatccacaa

SEQ ID NO: 24678 - DNA, 25 bp, Homo sapiens
gctccacatgagccatgcatgctta

SEQ ID NO: 24679 - DNA, 25 bp, Homo sapiens
gcatgcttagcaatccaagtgcaga

SEQ ID NO: 24680 - DNA, 25 bp, Homo sapiens
tgcagagctctttgctccaggagtg

SEQ ID NO: 24681 - DNA, 25 bp, Homo sapiens
gaagacaaacgttagcatacccagt

SEQ ID NO: 24682 - DNA, 25 bp, Homo sapiens
ggaacccgtgaggatcactctcaaa

SEQ ID NO: 24683 - DNA, 25 bp, Homo sapiens
ggggatgagagtgaccaggttgaac

SEQ ID NO: 24684 - DNA, 25 bp, Homo sapiens
gcctgcccacgattcctaggaaggc

SEQ ID NO: 24685 - DNA, 25 bp, Homo sapiens
cctggaaccctggggagctactggc

SEQ ID NO: 24686 - DNA, 25 bp, Homo sapiens
tggggagctactggcaaactctcct

SEQ ID NO: 24687 - DNA, 25 bp, Homo sapiens
tgcagagatggcgctatctttcctc

SEQ ID NO: 24688 - DNA, 25 bp, Homo sapiens
tcccaaccatttgtactcttcatta

SEQ ID NO: 24689 - DNA, 25 bp, Homo sapiens
gggagccctgggttggaatccagcc

SEQ ID NO: 24690 - DNA, 25 bp, Homo sapiens
ccacctcttttatgccacaggtttg

SEQ ID NO: 24691 - DNA, 25 bp, Homo sapiens
tctcccgctcagggtagggctgtga

SEQ ID NO: 24692 - DNA, 25 bp, Homo sapiens
tgaactccctcttacagctaagaac

SEQ ID NO: 24693 - DNA, 25 bp, Homo sapiens
attattcctccccattacaggtgat

SEQ ID NO: 24694 - DNA, 25 bp, Homo sapiens
gagagcttaagcaacctgctcaggg

SEQ ID NO: 24695 - DNA, 25 bp, Homo sapiens
gtcacgtctccaacaggcagtagag

SEQ ID NO: 24696 - DNA, 25 bp, Homo sapiens
gtttttgtaccagagtcccagacta

SEQ ID NO: 24697 - DNA, 25 bp, Homo sapiens
ccaattgtgctgagtctcctactag

SEQ ID NO: 24698 - DNA, 25 bp, Homo sapiens
ctagactcgcttcattctagctttc

SEQ ID NO: 24699 - DNA, 25 bp, Homo sapiens
tctagctttctgcttttacctttac

SEQ ID NO: 24700 - DNA, 25 bp, Homo sapiens
gaacttggaacctcccaggaatgct

SEQ ID NO: 24701 - DNA, 25 bp, Homo sapiens
cagtcctgggttccctcaggaattc

SEQ ID NO: 24702 - DNA, 25 bp, Homo sapiens
gaagaccttggctaggtggtgagct

SEQ ID NO: 24703 - DNA, 25 bp, Homo sapiens
ttatcccatcccatttgagttcagg

SEQ ID NO: 24704 - DNA, 25 bp, Homo sapiens
ctgggcctttagttaacatccgagt

SEQ ID NO: 24705 - DNA, 25 bp, Homo sapiens
catccgagtgacgaagccgggttcc

SEQ ID NO: 24706 - DNA, 25 bp, Homo sapiens
agtacagtgtcttttgggtgcggtc

SEQ ID NO: 24707 - DNA, 25 bp, Homo sapiens
gaggagctagatgccggtggacagt

SEQ ID NO: 24708 - DNA, 25 bp, Homo sapiens
ggggaggagaggatcagcagcagca

SEQ ID NO: 24709 - DNA, 25 bp, Homo sapiens
agtgatagggggctggctgggtcag

SEQ ID NO: 24710 - DNA, 25 bp, Homo sapiens
tgaaagtagctctggagcctctccc

SEQ ID NO: 24711 - DNA, 25 bp, Homo sapiens
gaactatactgctttgagatctcat

SEQ ID NO: 24712 - DNA, 25 bp, Homo sapiens
tgaacagtcttcagccacagttgtg

SEQ ID NO: 24713 - DNA, 25 bp, Homo sapiens
agccacagttgtgatggttgttaaa

SEQ ID NO: 24714 - DNA, 25 bp, Homo sapiens
gctcacaattgtgcattcttagggt

SEQ ID NO: 24715 - DNA, 25 bp, Homo sapiens
gttggcttcttgtctgcaagccagc

SEQ ID NO: 24716 - DNA, 25 bp, Homo sapiens
gcaagccagctgatatggtagcaac

SEQ ID NO: 24717 - DNA, 25 bp, Homo sapiens
ggtagcaaccaaagattccagtgtt

SEQ ID NO: 24718 - DNA, 25 bp, Homo sapiens
tgagcatatgaaagactctgcctgc

SEQ ID NO: 24719 - DNA, 25 bp, Homo sapiens
gactctgcctgcttaattgtgctag

SEQ ID NO: 24720 - DNA, 25 bp, Homo sapiens
ttatccttaggactctgcattaact

SEQ ID NO: 24721 - DNA, 25 bp, Homo sapiens
taggactctgcattaactctataat

SEQ ID NO: 24722 - DNA, 25 bp, Homo sapiens
gattaaacgactgtgtctttgtcac

SEQ ID NO: 24723 - DNA, 25 bp, Homo sapiens
gtcacctctgcttaactttaggagt

SEQ ID NO: 24724 - DNA, 25 bp, Homo sapiens
taaaaattaacctcacatcccttct

SEQ ID NO: 24725 - DNA, 25 bp, Homo sapiens
acatcccttctgttagggtctttca

SEQ ID NO: 24726 - DNA, 25 bp, Homo sapiens
ggacataccacgtttaaatcattaa

SEQ ID NO: 24727 - DNA, 25 bp, Homo sapiens
acatcatataagccccaactttgtt

SEQ ID NO: 24728 - DNA, 25 bp, Homo sapiens
gtttttccttctgtataagcaccta

SEQ ID NO: 24729 - DNA, 25 bp, Homo sapiens
gtagaggccattcaaccgtcaaaca

SEQ ID NO: 24730 - DNA, 25 bp, Homo sapiens
acaccatttggttatatcgcagagg

SEQ ID NO: 24731 - DNA, 25 bp, Homo sapiens
taacctctaatctccgtttgcatga

SEQ ID NO: 24732 - DNA, 25 bp, Homo sapiens
gtttgcatgatacgctttgttagaa

SEQ ID NO: 24733 - DNA, 25 bp, Homo sapiens
agtgttggaccagtattgcagttct

SEQ ID NO: 24734 - DNA, 25 bp, Homo sapiens
tgcagttctgtagtgtcatttctta

SEQ ID NO: 24735 - DNA, 25 bp, Homo sapiens
tttttaatacttgtttcagcctctt

SEQ ID NO: 24736 - DNA, 25 bp, Homo sapiens
ctattttcttcagacttctgcaata

SEQ ID NO: 24737 - DNA, 25 bp, Homo sapiens
ttcagacttctgcaatagttcttta

SEQ ID NO: 24738 - DNA, 25 bp, Homo sapiens
acaacagttagcaagctgacttttg

SEQ ID NO: 24739 - DNA, 25 bp, Homo sapiens
ctgacttttgtaatgtgctcaatac

SEQ ID NO: 24740 - DNA, 25 bp, Homo sapiens
gtgaacttttaatatgttgagtgct

SEQ ID NO: 24741 - DNA, 25 bp, Homo sapiens
tgttgagtgctttcattttgataac

SEQ ID NO: 24742 - DNA, 25 bp, Homo sapiens
actggatctccatttgatattttca

SEQ ID NO: 24743 - DNA, 25 bp, Homo sapiens
gccagtccctgaacatatcattgaa

SEQ ID NO: 24744 - DNA, 25 bp, Homo sapiens
aatcagcaagatatcctcctcatgg

SEQ ID NO: 24745 - DNA, 25 bp, Homo sapiens
ggtccctttagctctcaaaagcaat

SEQ ID NO: 24746 - DNA, 25 bp, Homo sapiens
tcctgttctcatttttactgctgtg

SEQ ID NO: 24747 - DNA, 25 bp, Homo sapiens
catttttactgctgtggttgtgctg

SEQ ID NO: 24748 - DNA, 25 bp, Homo sapiens
gctgctgaacaatactatcttctca

SEQ ID NO: 24749 - DNA, 25 bp, Homo sapiens
aattccatgccacaaattcagcaat

SEQ ID NO: 24750 - DNA, 25 bp, Homo sapiens
actgtaattggatgctgatgtggac

SEQ ID NO: 24751 - DNA, 25 bp, Homo sapiens
cactcccgaatgtgattgccaccag

SEQ ID NO: 24752 - DNA, 25 bp, Homo sapiens
gattgccaccagctctttatattgc

SEQ ID NO: 24753 - DNA, 25 bp, Homo sapiens
gctctttatattgctgctgtggtat

SEQ ID NO: 24754 - DNA, 25 bp, Homo sapiens
tgcagtcttgtttacagtatgtaca

SEQ ID NO: 24755 - DNA, 25 bp, Homo sapiens
atattcctacatcaagttactactg

SEQ ID NO: 24756 - DNA, 25 bp, Homo sapiens
tgagttttatcccgtaagttctgtt

SEQ ID NO: 24757 - DNA, 25 bp, Homo sapiens
aatttgtcttttgctatattctcca

SEQ ID NO: 24758 - DNA, 25 bp, Homo sapiens
ttatctcttaagaccatatgccccc

SEQ ID NO: 24759 - DNA, 25 bp, Homo sapiens
catatgccccctgttttaatgtttc

SEQ ID NO: 24760 - DNA, 25 bp, Homo sapiens
atcttgtttttactcatttctgact

SEQ ID NO: 24761 - DNA, 25 bp, Homo sapiens
tatgtaagaatcctcctgtggcctc

SEQ ID NO: 24762 - DNA, 25 bp, Homo sapiens
gaaacaacacttggttagtctcttt

SEQ ID NO: 24763 - DNA, 25 bp, Homo sapiens
agccaattgatgtttcttattcttt

SEQ ID NO: 24764 - DNA, 25 bp, Homo sapiens
gataccttatttccctagctatcat

SEQ ID NO: 24765 - DNA, 25 bp, Homo sapiens
ctagctatcatctcctgacttaatg

SEQ ID NO: 24766 - DNA, 25 bp, Homo sapiens
tccttgcacttagccttggcagacc

SEQ ID NO: 24767 - DNA, 25 bp, Homo sapiens
gacccttgactccaggggagatgac

SEQ ID NO: 24768 - DNA, 25 bp, Homo sapiens
ctttaggcctgtttggctccgaagc

SEQ ID NO: 24769 - DNA, 25 bp, Homo sapiens
cgaagcctatatgtgcctggatcct

SEQ ID NO: 24770 - DNA, 25 bp, Homo sapiens
gaggttgtcatggcctcagctatgc

SEQ ID NO: 24771 - DNA, 25 bp, Homo sapiens
gcagccttggctagagaactcacag

SEQ ID NO: 24772 - DNA, 25 bp, Homo sapiens
tctcagcccagccactgatgctgga

SEQ ID NO: 24773 - DNA, 25 bp, Homo sapiens
tggtctcagaatcacttttcccatc

SEQ ID NO: 24774 - DNA, 25 bp, Homo sapiens
ggtgttgaaagttcttcctggagca

SEQ ID NO: 24775 - DNA, 25 bp, Homo sapiens
aatagtgacagagtcaggccacccc

SEQ ID NO: 24776 - DNA, 25 bp, Homo sapiens
agctgacctgcttgaccgaaggatt

SEQ ID NO: 24777 - DNA, 25 bp, Homo sapiens
gttcttcaccctttcagatgtgacc

SEQ ID NO: 24778 - DNA, 25 bp, Homo sapiens
tgtgacctcttttggactaagcagc

SEQ ID NO: 24779 - DNA, 25 bp, Homo sapiens
agcagcaatctgttctcttgctcaa

SEQ ID NO: 24780 - DNA, 25 bp, Homo sapiens
aaacgatgtcaaatatacacttctt

SEQ ID NO: 24781 - DNA, 25 bp, Homo sapiens
ttctgtttgcggggatcttactatt

SEQ ID NO: 24782 - DNA, 25 bp, Homo sapiens
tactatttgatgggtcactgtcccc

SEQ ID NO: 24783 - DNA, 25 bp, Homo sapiens
tgtccccattcttactgatactttt

SEQ ID NO: 24784 - DNA, 25 bp, Homo sapiens
ttttgtcagatatcaccctgtcctt

SEQ ID NO: 24785 - DNA, 25 bp, Homo sapiens
accctgtccttaaatcatgatcact

SEQ ID NO: 24786 - DNA, 25 bp, Homo sapiens
aactctgctgttgacatgcaaaagc

SEQ ID NO: 24787 - DNA, 25 bp, Homo sapiens
gctgtagcttgccaatcagtgactt

SEQ ID NO: 24788 - DNA, 25 bp, Homo sapiens
ttttgttgcttgtacagtgtcagat

SEQ ID NO: 24789 - DNA, 25 bp, Homo sapiens
agtgtcagatgaggaacaccactat

SEQ ID NO: 24790 - DNA, 25 bp, Homo sapiens
ttttgcgatacactgcatttgctgg

SEQ ID NO: 24791 - DNA, 25 bp, Homo sapiens
acagtgaagcaacagctttgcagca

SEQ ID NO: 24792 - DNA, 25 bp, Homo sapiens
gcaagccagcagagttgtcttaaat

SEQ ID NO: 24793 - DNA, 25 bp, Homo sapiens
aaaactactgttaacactgctaatg

SEQ ID NO: 24794 - DNA, 25 bp, Homo sapiens
aatgccctttaactttctaatgatt

SEQ ID NO: 24795 - DNA, 25 bp, Homo sapiens
atgcgtctttttcacaatatcctat

SEQ ID NO: 24796 - DNA, 25 bp, Homo sapiens
gactaggctctagtgttcagaattc

SEQ ID NO: 24797 - DNA, 25 bp, Homo sapiens
aacattgttattcttaagccttata

SEQ ID NO: 24798 - DNA, 25 bp, Homo sapiens
gtaacttgcatgtatccatacctgg

SEQ ID NO: 24799 - DNA, 25 bp, Homo sapiens
ctctgctctcggtgcgtaaattcac

SEQ ID NO: 24800 - DNA, 25 bp, Homo sapiens
gaacagtgggaatcagcaattttgc

SEQ ID NO: 24801 - DNA, 25 bp, Homo sapiens
gcaattttgcacaggaagcgttggg

SEQ ID NO: 24802 - DNA, 25 bp, Homo sapiens
gaagcgttgggagatgttgtttatt

SEQ ID NO: 24803 - DNA, 25 bp, Homo sapiens
tgtagtctccctgaagttgggacaa

SEQ ID NO: 24804 - DNA, 25 bp, Homo sapiens
aacaagatgagtttggtgctttgga

SEQ ID NO: 24805 - DNA, 25 bp, Homo sapiens
agctgctagtgaactctattctcct

SEQ ID NO: 24806 - DNA, 25 bp, Homo sapiens
tgaactctattctcctttatcagga

SEQ ID NO: 24807 - DNA, 25 bp, Homo sapiens
gaaaatccaggacttgtaaacaaat

SEQ ID NO: 24808 - DNA, 25 bp, Homo sapiens
ggttggctgatcaagatgacactga

SEQ ID NO: 24809 - DNA, 25 bp, Homo sapiens
gacactgagtaacccttcagaacta

SEQ ID NO: 24810 - DNA, 25 bp, Homo sapiens
aaataaaccatatcgcccaattcca

SEQ ID NO: 24811 - DNA, 25 bp, Homo sapiens
attccagtgacatgggtacctcctc

SEQ ID NO: 24812 - DNA, 25 bp, Homo sapiens
tacctcctcctggaatgcattgtga

SEQ ID NO: 24813 - DNA, 25 bp, Homo sapiens
gaccggaatcactggattaatcctc

SEQ ID NO: 24814 - DNA, 25 bp, Homo sapiens
ttaatcctcacatgttagcacctca

SEQ ID NO: 24815 - DNA, 25 bp, Homo sapiens
gcacctcactaacttcgtttttgat

SEQ ID NO: 24816 - DNA, 25 bp, Homo sapiens
gattgtgttggtgtcatgttgagaa

SEQ ID NO: 24817 - DNA, 25 bp, Homo sapiens
tgggccaaaccatcaaacttatttt

SEQ ID NO: 24818 - DNA, 25 bp, Homo sapiens
tatattgtgcatcaactctgttgga

SEQ ID NO: 24819 - DNA, 25 bp, Homo sapiens
gtggacgatttgttctagcaccttt

SEQ ID NO: 24820 - DNA, 25 bp, Homo sapiens
ctagcacctttgagaatttacttta

SEQ ID NO: 24821 - DNA, 25 bp, Homo sapiens
accaagctgtaggccagcccatggt

SEQ ID NO: 24822 - DNA, 25 bp, Homo sapiens
ggccagcccatggtgttgtgtacac

SEQ ID NO: 24823 - DNA, 25 bp, Homo sapiens
gcccatggtgttgtgtacactgtgg

SEQ ID NO: 24824 - DNA, 25 bp, Homo sapiens
gtacactgtggagtcgacaggggcc

SEQ ID NO: 24825 - DNA, 25 bp, Homo sapiens
tggagtcgacaggggcctacaacag

SEQ ID NO: 24826 - DNA, 25 bp, Homo sapiens
caggcaggtactgctgccagggggc

SEQ ID NO: 24827 - DNA, 25 bp, Homo sapiens
gccagggggctctgaactagtgcct

SEQ ID NO: 24828 - DNA, 25 bp, Homo sapiens
ggcagcctggcacaagtgaagaaga

SEQ ID NO: 24829 - DNA, 25 bp, Homo sapiens
gaggacccagttgttataaggcgct

SEQ ID NO: 24830 - DNA, 25 bp, Homo sapiens
agttgttataaggcgctgggagagg

SEQ ID NO: 24831 - DNA, 25 bp, Homo sapiens
ccaggttgcccacggaaaatccaat

SEQ ID NO: 24832 - DNA, 25 bp, Homo sapiens
gtattccaagtttactccattacat

SEQ ID NO: 24833 - DNA, 25 bp, Homo sapiens
tactccattacatgtcggttgtctg

SEQ ID NO: 24834 - DNA, 25 bp, Homo sapiens
tcggttgtctggttgccattgttga

SEQ ID NO: 24835 - DNA, 25 bp, Homo sapiens
gccattgttgaactaaagccttttt

SEQ ID NO: 24836 - DNA, 25 bp, Homo sapiens
gcctttttttgattacctgtagtgc

SEQ ID NO: 24837 - DNA, 25 bp, Homo sapiens
gtttttgccaattaacagtatgtgc

SEQ ID NO: 24838 - DNA, 25 bp, Homo sapiens
cagtatgtgccttgggggaggaggg

SEQ ID NO: 24839 - DNA, 25 bp, Homo sapiens
ttagctttgaacattcctggcgcat

SEQ ID NO: 24840 - DNA, 25 bp, Homo sapiens
aaactatttcaaatgcataccacaa

SEQ ID NO: 24841 - DNA, 25 bp, Homo sapiens
tgcaataatacaataccccttccaa

SEQ ID NO: 24842 - DNA, 25 bp, Homo sapiens
gagatgttgtctatagctatgtcta

SEQ ID NO: 24843 - DNA, 25 bp, Homo sapiens
atatgcttactgtgcacctagagct

SEQ ID NO: 24844 - DNA, 25 bp, Homo sapiens
gcttactgtgcacctagagcttttt

SEQ ID NO: 24845 - DNA, 25 bp, Homo sapiens
atttagtgccctctttagccagaat

SEQ ID NO: 24846 - DNA, 25 bp, Homo sapiens
gccagaatctcattactgcttcatt

SEQ ID NO: 24847 - DNA, 25 bp, Homo sapiens
ggcaaaattgtgaagctaatgacca

SEQ ID NO: 24848 - DNA, 25 bp, Homo sapiens
taatgaccaacctgtttctacctat

SEQ ID NO: 24849 - DNA, 25 bp, Homo sapiens
gtttctacctatatgcagtctcttt

SEQ ID NO: 24850 - DNA, 25 bp, Homo sapiens
atgcagtctctttattttactagaa

SEQ ID NO: 24851 - DNA, 25 bp, Homo sapiens
gaaatgggaatcatggcctcttgaa

SEQ ID NO: 24852 - DNA, 25 bp, Homo sapiens
aaaagtcaccattctgcatttagct

SEQ ID NO: 24853 - DNA, 25 bp, Homo sapiens
attctgcatttagctgtattcatat

SEQ ID NO: 24854 - DNA, 25 bp, Homo sapiens
gaggaaatccaagtcaaggtcgcga

SEQ ID NO: 24855 - DNA, 25 bp, Homo sapiens
aatccaagtcaaggtcgcgatccaa

SEQ ID NO: 24856 - DNA, 25 bp, Homo sapiens
agtcaaggtcgcgatccaagaggcc

SEQ ID NO: 24857 - DNA, 25 bp, Homo sapiens
ctggttagctattaaggtggcctgt

SEQ ID NO: 24858 - DNA, 25 bp, Homo sapiens
gctattaaggtggcctgttgcagtg

SEQ ID NO: 24859 - DNA, 25 bp, Homo sapiens
tttcttctgattgctcctggggaaa

SEQ ID NO: 24860 - DNA, 25 bp, Homo sapiens
tcttctgattgctcctggggaaaac

SEQ ID NO: 24861 - DNA, 25 bp, Homo sapiens
ggaaaacacgccttgtcctgaagaa

SEQ ID NO: 24862 - DNA, 25 bp, Homo sapiens
agctgacgataatcacaccttttcc

SEQ ID NO: 24863 - DNA, 25 bp, Homo sapiens
tattaattttttacgctaaccattg

SEQ ID NO: 24864 - DNA, 25 bp, Homo sapiens
ttttttacgctaaccattgtttctg

SEQ ID NO: 24865 - DNA, 25 bp, Homo sapiens
aactccttagcaaaccaggtctaca

SEQ ID NO: 24866 - DNA, 25 bp, Homo sapiens
aaccaggtctacatcctgttttgtt

SEQ ID NO: 24867 - DNA, 25 bp, Homo sapiens
gtggtcaaattggtactcttggagg

SEQ ID NO: 24868 - DNA, 25 bp, Homo sapiens
aagcatttcttattcctagttgtag

SEQ ID NO: 24869 - DNA, 25 bp, Homo sapiens
ttttaccttccgttacagtgttgat

SEQ ID NO: 24870 - DNA, 25 bp, Homo sapiens
gcaatgatgtctgagtactgtattt

SEQ ID NO: 24871 - DNA, 25 bp, Homo sapiens
tattttttctgtgcattaccttagt

SEQ ID NO: 24872 - DNA, 25 bp, Homo sapiens
ttaaagtcatatgcatgttctcctg

SEQ ID NO: 24873 - DNA, 25 bp, Homo sapiens
gttctcctgccaaggaacctttaca

SEQ ID NO: 24874 - DNA, 25 bp, Homo sapiens
aatcaaatgccttcaatttctgaga

SEQ ID NO: 24875 - DNA, 25 bp, Homo sapiens
gagattttcaggacacagacatatg

SEQ ID NO: 24876 - DNA, 25 bp, Homo sapiens
tggagctgtacgagctggctcaggc

SEQ ID NO: 24877 - DNA, 25 bp, Homo sapiens
gacgtgttcaagatcctggtggacc

SEQ ID NO: 24878 - DNA, 25 bp, Homo sapiens
gacctgctgaagctgaacgtggccc

SEQ ID NO: 24879 - DNA, 25 bp, Homo sapiens
cagatgctcaagtccatgtgtgccg

SEQ ID NO: 24880 - DNA, 25 bp, Homo sapiens
gccgggcagaggctagcgagcgagc

SEQ ID NO: 24881 - DNA, 25 bp, Homo sapiens
ggaacgcagcaaccacgagggatcc

SEQ ID NO: 24882 - DNA, 25 bp, Homo sapiens
gagggatccagccagaggatgccac

SEQ ID NO: 24883 - DNA, 25 bp, Homo sapiens
tgggaagagccctacgcagggcagc

SEQ ID NO: 24884 - DNA, 25 bp, Homo sapiens
gcagggcagcacctaggatggggca

SEQ ID NO: 24885 - DNA, 25 bp, Homo sapiens
cagagacttgtcacatctttgtccc

SEQ ID NO: 24886 - DNA, 25 bp, Homo sapiens
tacatgttacctccttcagttgata

SEQ ID NO: 24887 - DNA, 25 bp, Homo sapiens
gggcttgggacccaactgtgtcagt

SEQ ID NO: 24888 - DNA, 25 bp, Homo sapiens
cccagatcacagcgctcgtgaggaa

SEQ ID NO: 24889 - DNA, 25 bp, Homo sapiens
ggaagctcatcctactgaagcgaga

SEQ ID NO: 24890 - DNA, 25 bp, Homo sapiens
gtgtggggctgaccaatgcaaactc

SEQ ID NO: 24891 - DNA, 25 bp, Homo sapiens
cttcctttactcttatgccattggt

SEQ ID NO: 24892 - DNA, 25 bp, Homo sapiens
ttatgccattggtcccatcattctt

SEQ ID NO: 24893 - DNA, 25 bp, Homo sapiens
gagagctcttgaccagtgaatcacc

SEQ ID NO: 24894 - DNA, 25 bp, Homo sapiens
gtgaatcaccagccgatacgaacgt

SEQ ID NO: 24895 - DNA, 25 bp, Homo sapiens
cgatacgaacgtcttgccaacaaaa

SEQ ID NO: 24896 - DNA, 25 bp, Homo sapiens
aaggcttctgtaaactgggaccaat

SEQ ID NO: 24897 - DNA, 25 bp, Homo sapiens
gaaagtgcctaggcagtgccagcca

SEQ ID NO: 24898 - DNA, 25 bp, Homo sapiens
gacctcctcccaaagatactggtat

SEQ ID NO: 24899 - DNA, 25 bp, Homo sapiens
gatactggtattgctcgagttccac

SEQ ID NO: 24900 - DNA, 25 bp, Homo sapiens
actggtattgctcgagttccacttg

SEQ ID NO: 24901 - DNA, 25 bp, Homo sapiens
ttgctcgagttccacttgctggagc

SEQ ID NO: 24902 - DNA, 25 bp, Homo sapiens
tgctcgagttccacttgctggagct

SEQ ID NO: 24903 - DNA, 25 bp, Homo sapiens
gggccatcccaacaggtgatgaccc

SEQ ID NO: 24904 - DNA, 25 bp, Homo sapiens
ctcctggtatgagacctcctatggg

SEQ ID NO: 24905 - DNA, 25 bp, Homo sapiens
ctggtatgagacctcctatgggtcc

SEQ ID NO: 24906 - DNA, 25 bp, Homo sapiens
ggaagagggactccaatgggcatgc

SEQ ID NO: 24907 - DNA, 25 bp, Homo sapiens
caccaaggccctagactcatcttgg

SEQ ID NO: 24908 - DNA, 25 bp, Homo sapiens
caaggccctagactcatcttggccc

SEQ ID NO: 24909 - DNA, 25 bp, Homo sapiens
gcaccgagacagctgagtaccagtc

SEQ ID NO: 24910 - DNA, 25 bp, Homo sapiens
ctgagtaccagtcattgtgccctca

SEQ ID NO: 24911 - DNA, 25 bp, Homo sapiens
tgagcctccggagagacgtggacga

SEQ ID NO: 24912 - DNA, 25 bp, Homo sapiens
gctcttccgagaccaggtgtgcaag

SEQ ID NO: 24913 - DNA, 25 bp, Homo sapiens
caggtgtgcaagagtggcgtgtgtg

SEQ ID NO: 24914 - DNA, 25 bp, Homo sapiens
tggcgtgtgtgtgaacacggccccg

SEQ ID NO: 24915 - DNA, 25 bp, Homo sapiens
ttgcagcaacggctactactaccac

SEQ ID NO: 24916 - DNA, 25 bp, Homo sapiens
tactaccacacacagcggctggagt

SEQ ID NO: 24917 - DNA, 25 bp, Homo sapiens
ggccccggatgcatgtgacaacatc

SEQ ID NO: 24918 - DNA, 25 bp, Homo sapiens
gacaacatcctggctcggaatgtga

SEQ ID NO: 24919 - DNA, 25 bp, Homo sapiens
tgctgctgtactgtgggtgagggct

SEQ ID NO: 24920 - DNA, 25 bp, Homo sapiens
aaggtcgtgggagcgggactgcaac

SEQ ID NO: 24921 - DNA, 25 bp, Homo sapiens
gcgggactgcaacaagcaatgccag

SEQ ID NO: 24922 - DNA, 25 bp, Homo sapiens
ctttgtggactatttcagacaacca

SEQ ID NO: 24923 - DNA, 25 bp, Homo sapiens
tcagacaaccaggttccgacagtcc

SEQ ID NO: 24924 - DNA, 25 bp, Homo sapiens
gggagagattaagcgctcattaagc

SEQ ID NO: 24925 - DNA, 25 bp, Homo sapiens
gcagaggagcccactttgaggagag

SEQ ID NO: 24926 - DNA, 25 bp, Homo sapiens
atcagacttgcagcctttcagctta

SEQ ID NO: 24927 - DNA, 25 bp, Homo sapiens
cctttcagcttaacagttgcccggt

SEQ ID NO: 24928 - DNA, 25 bp, Homo sapiens
atgggccatagccctaaggactcct

SEQ ID NO: 24929 - DNA, 25 bp, Homo sapiens
tgatgatagattgccttcaccctca

SEQ ID NO: 24930 - DNA, 25 bp, Homo sapiens
caccctcacagcgcacaaataaagc

SEQ ID NO: 24931 - DNA, 25 bp, Homo sapiens
atgagctcccagattcgtcagaatt

SEQ ID NO: 24932 - DNA, 25 bp, Homo sapiens
gattcgtcagaattattccaccgac

SEQ ID NO: 24933 - DNA, 25 bp, Homo sapiens
attccaccgacgtggaggcagccgt

SEQ ID NO: 24934 - DNA, 25 bp, Homo sapiens
gacgtggaggcagccgtcaacagcc

SEQ ID NO: 24935 - DNA, 25 bp, Homo sapiens
agccgtcaacagcctggtcaatttg

SEQ ID NO: 24936 - DNA, 25 bp, Homo sapiens
ctggtcaatttgtacctgcaggcct

SEQ ID NO: 24937 - DNA, 25 bp, Homo sapiens
gcttctatttcgaccgcgatgatgt

SEQ ID NO: 24938 - DNA, 25 bp, Homo sapiens
accgcgatgatgtggctctggaagg

SEQ ID NO: 24939 - DNA, 25 bp, Homo sapiens
tctggaaggcgtgagccacttcttc

SEQ ID NO: 24940 - DNA, 25 bp, Homo sapiens
cttcttccgcgaattggccgaggag

SEQ ID NO: 24941 - DNA, 25 bp, Homo sapiens
aattggccgaggagaagcgcgaggg

SEQ ID NO: 24942 - DNA, 25 bp, Homo sapiens
acagagtttcatggacttcgcttcc

SEQ ID NO: 24943 - DNA, 25 bp, Homo sapiens
cgcttccctttgtcacatttggatg

SEQ ID NO: 24944 - DNA, 25 bp, Homo sapiens
tgtcacatttggatgcactgaagca

SEQ ID NO: 24945 - DNA, 25 bp, Homo sapiens
atagtccagctatttctgtcaagga

SEQ ID NO: 24946 - DNA, 25 bp, Homo sapiens
aggaaagcctggtattatccctctg

SEQ ID NO: 24947 - DNA, 25 bp, Homo sapiens
tcaagtagtctagtgcctttgcaga

SEQ ID NO: 24948 - DNA, 25 bp, Homo sapiens
gcctttgcagaatcaaatgcctact

SEQ ID NO: 24949 - DNA, 25 bp, Homo sapiens
aaagcaaagacctgagccgaggaga

SEQ ID NO: 24950 - DNA, 25 bp, Homo sapiens
tactaacaaacatgagacctccctg

SEQ ID NO: 24951 - DNA, 25 bp, Homo sapiens
gtggtcagttggccaaatgtactaa

SEQ ID NO: 24952 - DNA, 25 bp, Homo sapiens
cagcaaattaccaagtgtctcagaa

SEQ ID NO: 24953 - DNA, 25 bp, Homo sapiens
gggggatgaattgcccgagctggac

SEQ ID NO: 24954 - DNA, 25 bp, Homo sapiens
gcccgagctggacaacatggctgac

SEQ ID NO: 24955 - DNA, 25 bp, Homo sapiens
atcgccagagccacaatgcagacct

SEQ ID NO: 24956 - DNA, 25 bp, Homo sapiens
tgatgcgatcctacagatccctgag

SEQ ID NO: 24957 - DNA, 25 bp, Homo sapiens
gccactgacatcgactatctgatca

SEQ ID NO: 24958 - DNA, 25 bp, Homo sapiens
tgatcaacgtgatggatgccctggg

SEQ ID NO: 24959 - DNA, 25 bp, Homo sapiens
tccagcacatcgtgacgctactgaa

SEQ ID NO: 24960 - DNA, 25 bp, Homo sapiens
acgctactgaagaccaggcctgagg

SEQ ID NO: 24961 - DNA, 25 bp, Homo sapiens
tgcggagtgtgaattactgacccca

SEQ ID NO: 24962 - DNA, 25 bp, Homo sapiens
gaccaccaagagagccagggctgct

SEQ ID NO: 24963 - DNA, 25 bp, Homo sapiens
aaaagacttggttcagctggtcacg

SEQ ID NO: 24964 - DNA, 25 bp, Homo sapiens
caatacacattcttcttttgccagc

SEQ ID NO: 24965 - DNA, 25 bp, Homo sapiens
gccagcgcttctgaagagctgctct

SEQ ID NO: 24966 - DNA, 25 bp, Homo sapiens
acctctctgcatcccaatagatatc

SEQ ID NO: 24967 - DNA, 25 bp, Homo sapiens
aatagatatccccctatgtgcatgc

SEQ ID NO: 24968 - DNA, 25 bp, Homo sapiens
gggggaccttagcatgcctaagtga

SEQ ID NO: 24969 - DNA, 25 bp, Homo sapiens
tgactccagatactgcctgagcagc

SEQ ID NO: 24970 - DNA, 25 bp, Homo sapiens
tccgctgtcaagtccagttctacgg

SEQ ID NO: 24971 - DNA, 25 bp, Homo sapiens
tagagcagactgtggctttacctcg

SEQ ID NO: 24972 - DNA, 25 bp, Homo sapiens
ccaccatcctctatgagatcctgct

SEQ ID NO: 24973 - DNA, 25 bp, Homo sapiens
gagatcctgctagggaaggccaccc

SEQ ID NO: 24974 - DNA, 25 bp, Homo sapiens
caccctgtatgctgtgctggtcagc

SEQ ID NO: 24975 - DNA, 25 bp, Homo sapiens
tttccagtcaacaatgcctctttga

SEQ ID NO: 24976 - DNA, 25 bp, Homo sapiens
taaagactgtttgcatgccgctgaa

SEQ ID NO: 24977 - DNA, 25 bp, Homo sapiens
agctgtttctacctctcagaggcat

SEQ ID NO: 24978 - DNA, 25 bp, Homo sapiens
attgcatgctataaactgctttgtg

SEQ ID NO: 24979 - DNA, 25 bp, Homo sapiens
gctttgtgtatctgttaccacctct

SEQ ID NO: 24980 - DNA, 25 bp, Homo sapiens
taccacctctcacttgagacatcac

SEQ ID NO: 24981 - DNA, 25 bp, Homo sapiens
gagacatcactcactggtaaaatgt

SEQ ID NO: 24982 - DNA, 25 bp, Homo sapiens
tcaggctacttctcctcaaggaaat

SEQ ID NO: 24983 - DNA, 25 bp, Homo sapiens
ctcaaggaaatcatcttgccctggg

SEQ ID NO: 24984 - DNA, 25 bp, Homo sapiens
gtgtagttgcaaaaatggctccatc

SEQ ID NO: 24985 - DNA, 25 bp, Homo sapiens
ggctccatcggtaactcaagcttca

SEQ ID NO: 24986 - DNA, 25 bp, Homo sapiens
gatgtttttgttcctatactcttgt

SEQ ID NO: 24987 - DNA, 25 bp, Homo sapiens
gtatcatccctatatgcttggcagt

SEQ ID NO: 24988 - DNA, 25 bp, Homo sapiens
ggcagttatttgcaatcgccaccag

SEQ ID NO: 24989 - DNA, 25 bp, Homo sapiens
gtcaaggcttctaatcagatcagca

SEQ ID NO: 24990 - DNA, 25 bp, Homo sapiens
gcagactacaactgattgacacgta

SEQ ID NO: 24991 - DNA, 25 bp, Homo sapiens
gacacgtaaaatcagtcaccgtttt

SEQ ID NO: 24992 - DNA, 25 bp, Homo sapiens
ttccctacgattacaaaactgccag

SEQ ID NO: 24993 - DNA, 25 bp, Homo sapiens
aactgccagtcctatatggagtctg

SEQ ID NO: 24994 - DNA, 25 bp, Homo sapiens
gatctcaggaagttgtcgtggggca

SEQ ID NO: 24995 - DNA, 25 bp, Homo sapiens
attagggagctatctttatctgaat

SEQ ID NO: 24996 - DNA, 25 bp, Homo sapiens
catatttctattctactgtgcaaca

SEQ ID NO: 24997 - DNA, 25 bp, Homo sapiens
gaatcatttagctaggccaggatct

SEQ ID NO: 24998 - DNA, 25 bp, Homo sapiens
tctgtgacttgtgaccctatttgaa

SEQ ID NO: 24999 - DNA, 25 bp, Homo sapiens
gaagtttcaggatttgggtgtcaca

SEQ ID NO: 25000 - DNA, 25 bp, Homo sapiens
gggtgtcacaaaggattgtccctaa

SEQ ID NO: 25001 - DNA, 25 bp, Homo sapiens
gggtcttccgagtgagctggtttaa

SEQ ID NO: 25002 - DNA, 25 bp, Homo sapiens
ccagagaatgaatccctgaccgcat

SEQ ID NO: 25003 - DNA, 25 bp, Homo sapiens
tgaccgcatcacctaaactgtcttc

SEQ ID NO: 25004 - DNA, 25 bp, Homo sapiens
gacaaagctgactgttcacactgat

SEQ ID NO: 25005 - DNA, 25 bp, Homo sapiens
ggttactggggaaacagctcagcag

SEQ ID NO: 25006 - DNA, 25 bp, Homo sapiens
ccttcctggctctgctaaattgaat

SEQ ID NO: 25007 - DNA, 25 bp, Homo sapiens
ttgaatgctcattgtttgttgttgt

SEQ ID NO: 25008 - DNA, 25 bp, Homo sapiens
tgttactgcggcccaaggacaggaa

SEQ ID NO: 25009 - DNA, 25 bp, Homo sapiens
aaatcccacagctagttaatgacag

SEQ ID NO: 25010 - DNA, 25 bp, Homo sapiens
tgtttacattgtgacatccagcccc

SEQ ID NO: 25011 - DNA, 25 bp, Homo sapiens
atggctgggagttgctcaggcatcc

SEQ ID NO: 25012 - DNA, 25 bp, Homo sapiens
ggaaaagtggggaatgctgccatct

SEQ ID NO: 25013 - DNA, 25 bp, Homo sapiens
gacagcatgtagatttgggcagtga

SEQ ID NO: 25014 - DNA, 25 bp, Homo sapiens
tgaacagggattgccatgccccagt

SEQ ID NO: 25015 - DNA, 25 bp, Homo sapiens
taactcacagcacaaaccctgcaaa

SEQ ID NO: 25016 - DNA, 25 bp, Homo sapiens
aaccctgcaaacccaaagagaatat

SEQ ID NO: 25017 - DNA, 25 bp, Homo sapiens
ctcctagccctagccagggcgagag

SEQ ID NO: 25018 - DNA, 25 bp, Homo sapiens
tcccttgagctactgagctgctttg

SEQ ID NO: 25019 - DNA, 25 bp, Homo sapiens
tcccccatttacaatccttcatgta

SEQ ID NO: 25020 - DNA, 25 bp, Homo sapiens
gagcagaacattttggtctagggtg

SEQ ID NO: 25021 - DNA, 25 bp, Homo sapiens
taggggacaatccggattggccctc

SEQ ID NO: 25022 - DNA, 25 bp, Homo sapiens
ctgccctgccaatcagactttgggg

SEQ ID NO: 25023 - DNA, 25 bp, Homo sapiens
gactttggggagatggcgatttgat

SEQ ID NO: 25024 - DNA, 25 bp, Homo sapiens
tgattacagacgttcgggggggtgg

SEQ ID NO: 25025 - DNA, 25 bp, Homo sapiens
ggggcttgcagtttgttttggagat

SEQ ID NO: 25026 - DNA, 25 bp, Homo sapiens
taatacagtttcctgctatctgccg

SEQ ID NO: 25027 - DNA, 25 bp, Homo sapiens
tatctgccgctcctatctagaggca

SEQ ID NO: 25028 - DNA, 25 bp, Homo sapiens
gccgctcctatctagaggcaacact

SEQ ID NO: 25029 - DNA, 25 bp, Homo sapiens
cagtaattgctgttgcttgttgtca

SEQ ID NO: 25030 - DNA, 25 bp, Homo sapiens
agcctgggggacaagagtgaatctg

SEQ ID NO: 25031 - DNA, 25 bp, Homo sapiens
gagtgaatctgtgtctcaccaaaaa

SEQ ID NO: 25032 - DNA, 25 bp, Homo sapiens
aaagatgcttaacaaaggttaccat

SEQ ID NO: 25033 - DNA, 25 bp, Homo sapiens
aggttaccataagccacaaattcat

SEQ ID NO: 25034 - DNA, 25 bp, Homo sapiens
accacttatccttccagtttcaagt

SEQ ID NO: 25035 - DNA, 25 bp, Homo sapiens
tatccttccagtttcaagtagaata

SEQ ID NO: 25036 - DNA, 25 bp, Homo sapiens
gtagaatatattcataacctcaata

SEQ ID NO: 25037 - DNA, 25 bp, Homo sapiens
taacctcaataaagttctccctgct

SEQ ID NO: 25038 - DNA, 25 bp, Homo sapiens
gcagtgagccaagacagtgccagtg

SEQ ID NO: 25039 - DNA, 25 bp, Homo sapiens
agcctcggtgacagcgcaaggctcc

SEQ ID NO: 25040 - DNA, 25 bp, Homo sapiens
tcagccttggcaacacggtgaaacc

SEQ ID NO: 25041 - DNA, 25 bp, Homo sapiens
ggaagaagacaagccccactagggc

SEQ ID NO: 25042 - DNA, 25 bp, Homo sapiens
gccccactagggccaagggcagcag

SEQ ID NO: 25043 - DNA, 25 bp, Homo sapiens
cctgccgagtgagaggctgtggggc

SEQ ID NO: 25044 - DNA, 25 bp, Homo sapiens
ggaatttaattgccatcgtctttga

SEQ ID NO: 25045 - DNA, 25 bp, Homo sapiens
ccctgtgtggtcgaacctaagaact

SEQ ID NO: 25046 - DNA, 25 bp, Homo sapiens
gtcgaacctaagaactgtggcttgg

SEQ ID NO: 25047 - DNA, 25 bp, Homo sapiens
gctttctttcctcttagtgaggagg

SEQ ID NO: 25048 - DNA, 25 bp, Homo sapiens
gaggtgattcgtagatcccaactgc

SEQ ID NO: 25049 - DNA, 25 bp, Homo sapiens
agatcccaactgcctatgtaatgta

SEQ ID NO: 25050 - DNA, 25 bp, Homo sapiens
gctatggtagcacattgtatttgtt

SEQ ID NO: 25051 - DNA, 25 bp, Homo sapiens
ttgttgcttaaatgtgtctttgcag

SEQ ID NO: 25052 - DNA, 25 bp, Homo sapiens
tatactcactcaaggcagtgcaaga

SEQ ID NO: 25053 - DNA, 25 bp, Homo sapiens
tgtgcatgtcattgacatctgcctt

SEQ ID NO: 25054 - DNA, 25 bp, Homo sapiens
gacatctgccttagaacttctggga

SEQ ID NO: 25055 - DNA, 25 bp, Homo sapiens
gaacttctgggacaatcctgattcg

SEQ ID NO: 25056 - DNA, 25 bp, Homo sapiens
tcctgattcgagagattctatccca

SEQ ID NO: 25057 - DNA, 25 bp, Homo sapiens
agagattctatcccattatttacat

SEQ ID NO: 25058 - DNA, 25 bp, Homo sapiens
ttaatgtgttggcttcccaactcct

SEQ ID NO: 25059 - DNA, 25 bp, Homo sapiens
ccaactcctgaacacgacacaattt

SEQ ID NO: 25060 - DNA, 25 bp, Homo sapiens
tgtttgagcagctcactagcccacc

SEQ ID NO: 25061 - DNA, 25 bp, Homo sapiens
aaagtattctgattctggttaaatt

SEQ ID NO: 25062 - DNA, 25 bp, Homo sapiens
taacgaatatggttccaggccctgt

SEQ ID NO: 25063 - DNA, 25 bp, Homo sapiens
tccagcggaggccacaagtcctcct

SEQ ID NO: 25064 - DNA, 25 bp, Homo sapiens
caattattgaagaggtggcgcccga

SEQ ID NO: 25065 - DNA, 25 bp, Homo sapiens
tggcgcccgacggtagagttctttc

SEQ ID NO: 25066 - DNA, 25 bp, Homo sapiens
cccgacggtagagttctttcatcta

SEQ ID NO: 25067 - DNA, 25 bp, Homo sapiens
gatgcatggaaaacaaagtctccaa

SEQ ID NO: 25068 - DNA, 25 bp, Homo sapiens
caaagtctccaagaaaacacttctg

SEQ ID NO: 25069 - DNA, 25 bp, Homo sapiens
aacacttctgtcttgatggtctatg

SEQ ID NO: 25070 - DNA, 25 bp, Homo sapiens
aataaggtgtctacaaggtgttttg

SEQ ID NO: 25071 - DNA, 25 bp, Homo sapiens
tgtctacaaggtgttttgtggtttc

SEQ ID NO: 25072 - DNA, 25 bp, Homo sapiens
aactttctgttctcatttactaatg

SEQ ID NO: 25073 - DNA, 25 bp, Homo sapiens
atttcaataaactttcttactgatg

SEQ ID NO: 25074 - DNA, 25 bp, Homo sapiens
ccaagttcgccaccggggtagagcg

SEQ ID NO: 25075 - DNA, 25 bp, Homo sapiens
cggggtagagcggcaggactggatg

SEQ ID NO: 25076 - DNA, 25 bp, Homo sapiens
ggactggatggagctgttcattgac

SEQ ID NO: 25077 - DNA, 25 bp, Homo sapiens
gctgttcattgacacctttaagctg

SEQ ID NO: 25078 - DNA, 25 bp, Homo sapiens
agctggtgcacagggacatcgtggg

SEQ ID NO: 25079 - DNA, 25 bp, Homo sapiens
ctggctctcagtggaggccagagat

SEQ ID NO: 25080 - DNA, 25 bp, Homo sapiens
gtggccgctctctttataagaaccc

SEQ ID NO: 25081 - DNA, 25 bp, Homo sapiens
tctctttataagaaccctggtcatt

SEQ ID NO: 25082 - DNA, 25 bp, Homo sapiens
tccgcacggaagaggggccggacgc

SEQ ID NO: 25083 - DNA, 25 bp, Homo sapiens
tcccctgatccaacagttgctaaac

SEQ ID NO: 25084 - DNA, 25 bp, Homo sapiens
ccaacagttgctaaacgccacggag

SEQ ID NO: 25085 - DNA, 25 bp, Homo sapiens
cagatcttctggggcttaactcaaa

SEQ ID NO: 25086 - DNA, 25 bp, Homo sapiens
ctcaaatactgttgtgtctgcacca

SEQ ID NO: 25087 - DNA, 25 bp, Homo sapiens
gtctgcaccagtcttttagtgtctc

SEQ ID NO: 25088 - DNA, 25 bp, Homo sapiens
ataagtctgtggttcttctcattct

SEQ ID NO: 25089 - DNA, 25 bp, Homo sapiens
ttctcattctcatctataatccacc

SEQ ID NO: 25090 - DNA, 25 bp, Homo sapiens
tataatccaccactaccaagagaga

SEQ ID NO: 25091 - DNA, 25 bp, Homo sapiens
acattgagagaaaactgcccccatc

SEQ ID NO: 25092 - DNA, 25 bp, Homo sapiens
gcaagaatggcgttggtttcttcca

SEQ ID NO: 25093 - DNA, 25 bp, Homo sapiens
aaactaatcagcattctccagcaat

SEQ ID NO: 25094 - DNA, 25 bp, Homo sapiens
gagactgtgcaatgtacgacttgga

SEQ ID NO: 25095 - DNA, 25 bp, Homo sapiens
gatccttgaaacatctctttcaggt

SEQ ID NO: 25096 - DNA, 25 bp, Homo sapiens
tcctctgccccttaaaagattgaag

SEQ ID NO: 25097 - DNA, 25 bp, Homo sapiens
gaaacttgtcaactcatatccacgt

SEQ ID NO: 25098 - DNA, 25 bp, Homo sapiens
aactcatatccacgttatctagcaa

SEQ ID NO: 25099 - DNA, 25 bp, Homo sapiens
tgttggtttaccagtgacaccccat

SEQ ID NO: 25100 - DNA, 25 bp, Homo sapiens
gacaccccatattcatcacaaaatt

SEQ ID NO: 25101 - DNA, 25 bp, Homo sapiens
tgaggtcaaattttatcttttcact

SEQ ID NO: 25102 - DNA, 25 bp, Homo sapiens
ttcacttacaagctctatgatctta

SEQ ID NO: 25103 - DNA, 25 bp, Homo sapiens
gactatatctaattcctctgatcac

SEQ ID NO: 25104 - DNA, 25 bp, Homo sapiens
atttcactcataacaatcttaccct

SEQ ID NO: 25105 - DNA, 25 bp, Homo sapiens
caatcttaccctttcttgcaagaga

SEQ ID NO: 25106 - DNA, 25 bp, Homo sapiens
tttcctaataccttggtttcactag

SEQ ID NO: 25107 - DNA, 25 bp, Homo sapiens
gcacatttcaattttcattcttatt

SEQ ID NO: 25108 - DNA, 25 bp, Homo sapiens
gtaaatgatgatgccaccccatgtt

SEQ ID NO: 25109 - DNA, 25 bp, Homo sapiens
atgccaccccatgttgactatggtt

SEQ ID NO: 25110 - DNA, 25 bp, Homo sapiens
gaaagcaactatgctgctaaccata

SEQ ID NO: 25111 - DNA, 25 bp, Homo sapiens
gaagggttccagaatctttagtgct

SEQ ID NO: 25112 - DNA, 25 bp, Homo sapiens
ggttttaacaaccgatgcaacatta

SEQ ID NO: 25113 - DNA, 25 bp, Homo sapiens
gtgtgctgtgcaattggttttcaat

SEQ ID NO: 25114 - DNA, 25 bp, Homo sapiens
aacttcatttcattgccttatatta

SEQ ID NO: 25115 - DNA, 25 bp, Homo sapiens
aattatcatgtgttcattcccattt

SEQ ID NO: 25116 - DNA, 25 bp, Homo sapiens
gtgttcattcccattttagagcgtg

SEQ ID NO: 25117 - DNA, 25 bp, Homo sapiens
gagcgtgaaactcctacattagaat

SEQ ID NO: 25118 - DNA, 25 bp, Homo sapiens
aaaaattccagtcctcatatctttt

SEQ ID NO: 25119 - DNA, 25 bp, Homo sapiens
ctagactttgcttccaatggtttct

SEQ ID NO: 25120 - DNA, 25 bp, Homo sapiens
ttccagaccacttttcctagatgaa

SEQ ID NO: 25121 - DNA, 25 bp, Homo sapiens
gctgcatgcagacaggactgcccgt

SEQ ID NO: 25122 - DNA, 25 bp, Homo sapiens
gactgcccgtgctttgtggggaatc

SEQ ID NO: 25123 - DNA, 25 bp, Homo sapiens
ttccgcagatctcatcactttgatt

SEQ ID NO: 25124 - DNA, 25 bp, Homo sapiens
gtttatcgttcctgtaacttgttct

SEQ ID NO: 25125 - DNA, 25 bp, Homo sapiens
aacttgttctacattccacagtctt

SEQ ID NO: 25126 - DNA, 25 bp, Homo sapiens
attccacagtctttaccgttttatg

SEQ ID NO: 25127 - DNA, 25 bp, Homo sapiens
caacaatccctgtccattgattcca

SEQ ID NO: 25128 - DNA, 25 bp, Homo sapiens
gaactctttgttcatgccaattttg

SEQ ID NO: 25129 - DNA, 25 bp, Homo sapiens
gacaccttcaatttgccatcatgac

SEQ ID NO: 25130 - DNA, 25 bp, Homo sapiens
ttccactgctttggagagtcccacc

SEQ ID NO: 25131 - DNA, 25 bp, Homo sapiens
aaacaggttcctttgctcagatgaa

SEQ ID NO: 25132 - DNA, 25 bp, Homo sapiens
gtgatgcctccttaggcacacaggc

SEQ ID NO: 25133 - DNA, 25 bp, Homo sapiens
cattgctgctaattttggtcctgct

SEQ ID NO: 25134 - DNA, 25 bp, Homo sapiens
atagcgggactcgttgacattgggg

SEQ ID NO: 25135 - DNA, 25 bp, Homo sapiens
ttgcaatgccccgaagacttaactc

SEQ ID NO: 25136 - DNA, 25 bp, Homo sapiens
atcaagctgtactgaccaacctgaa

SEQ ID NO: 25137 - DNA, 25 bp, Homo sapiens
gtacctgactgtgatttcaaacccc

SEQ ID NO: 25138 - DNA, 25 bp, Homo sapiens
ggttactggagcccatacctaggaa

SEQ ID NO: 25139 - DNA, 25 bp, Homo sapiens
gtattccaggtagacatcccagagc

SEQ ID NO: 25140 - DNA, 25 bp, Homo sapiens
gtgtatctaagctgctttacaattt

SEQ ID NO: 25141 - DNA, 25 bp, Homo sapiens
atgctgtactactgtctcaagattt

SEQ ID NO: 25142 - DNA, 25 bp, Homo sapiens
gagtactttattggtgtgaggcaca

SEQ ID NO: 25143 - DNA, 25 bp, Homo sapiens
gggaactaccttgacattgtgtatt

SEQ ID NO: 25144 - DNA, 25 bp, Homo sapiens
ttgtttaacatatacctctcaaaat

SEQ ID NO: 25145 - DNA, 25 bp, Homo sapiens
atcaccactcaatgacactgcatca

SEQ ID NO: 25146 - DNA, 25 bp, Homo sapiens
gatggaatggctttccttttcaaac

SEQ ID NO: 25147 - DNA, 25 bp, Homo sapiens
gaaatctttacctctgcatattaat

SEQ ID NO: 25148 - DNA, 25 bp, Homo sapiens
tattaatgagccttgccataattac

SEQ ID NO: 25149 - DNA, 25 bp, Homo sapiens
tactgtagagtggcttttcaaagat

SEQ ID NO: 25150 - DNA, 25 bp, Homo sapiens
aattagctggtcaatatttttgtcc

SEQ ID NO: 25151 - DNA, 25 bp, Homo sapiens
ggtgtgcttcgtgctgtagttatcg

SEQ ID NO: 25152 - DNA, 25 bp, Homo sapiens
tgtagttatcgttagttcctcttcc

SEQ ID NO: 25153 - DNA, 25 bp, Homo sapiens
accccagcgcctttgaaaagcaagg

SEQ ID NO: 25154 - DNA, 25 bp, Homo sapiens
aaagcaaggtttgtgctgcgcttcc

SEQ ID NO: 25155 - DNA, 25 bp, Homo sapiens
ctgcgcttccagttccgaaaagcag

SEQ ID NO: 25156 - DNA, 25 bp, Homo sapiens
aagcagatgtttaagcccttggact

SEQ ID NO: 25157 - DNA, 25 bp, Homo sapiens
tgggatcgcagctccgaagacggag

SEQ ID NO: 25158 - DNA, 25 bp, Homo sapiens
cccacgtgccctagattcatggcag

SEQ ID NO: 25159 - DNA, 25 bp, Homo sapiens
caccgatatattgttaccgctgaaa

SEQ ID NO: 25160 - DNA, 25 bp, Homo sapiens
gttgatctatccagtgacgtggcct

SEQ ID NO: 25161 - DNA, 25 bp, Homo sapiens
tttcttcttgtacttatgtggtttt

SEQ ID NO: 25162 - DNA, 25 bp, Homo sapiens
aacatcatctactactctctgaagg

SEQ ID NO: 25163 - DNA, 25 bp, Homo sapiens
gaaggagtccaccactagtgagcag

SEQ ID NO: 25164 - DNA, 25 bp, Homo sapiens
gcagagtgccaggatgacagccatg

SEQ ID NO: 25165 - DNA, 25 bp, Homo sapiens
tttcccttaataccgttgcaagtct

SEQ ID NO: 25166 - DNA, 25 bp, Homo sapiens
gacagccatggacaatgccagcaag

SEQ ID NO: 25167 - DNA, 25 bp, Homo sapiens
tgacattgacattcaaccgtacccg

SEQ ID NO: 25168 - DNA, 25 bp, Homo sapiens
cccgccaagctgtcatcacaaaaga

SEQ ID NO: 25169 - DNA, 25 bp, Homo sapiens
aaattatctctggtgctgcagctct

SEQ ID NO: 25170 - DNA, 25 bp, Homo sapiens
aatcaagttccatcctcagacaaga

SEQ ID NO: 25171 - DNA, 25 bp, Homo sapiens
tactgctgcctttgtccgaagaaac

SEQ ID NO: 25172 - DNA, 25 bp, Homo sapiens
gaatacaatctggccaacatcatct

SEQ ID NO: 25173 - DNA, 25 bp, Homo sapiens
gttcccagaattcagtttccaaaat

SEQ ID NO: 25174 - DNA, 25 bp, Homo sapiens
aaaagtgtatgctctttaagaagaa

SEQ ID NO: 25175 - DNA, 25 bp, Homo sapiens
tatctcaaaggacggtttcaccacc

SEQ ID NO: 25176 - DNA, 25 bp, Homo sapiens
tttcaccaccgtcctttattgaatc

SEQ ID NO: 25177 - DNA, 25 bp, Homo sapiens
ttcaccaccgtcctttattgaatca

SEQ ID NO: 25178 - DNA, 25 bp, Homo sapiens
gcaagtgtagattctgagggactcc

SEQ ID NO: 25179 - DNA, 25 bp, Homo sapiens
gtgtagattctgagggactcctatt

SEQ ID NO: 25180 - DNA, 25 bp, Homo sapiens
gattctgagggactcctatttgcca

SEQ ID NO: 25181 - DNA, 25 bp, Homo sapiens
ttctgagggactcctatttgccaaa

SEQ ID NO: 25182 - DNA, 25 bp, Homo sapiens
gagggactcctatttgccaaaaaga

SEQ ID NO: 25183 - DNA, 25 bp, Homo sapiens
ggactcctatttgccaaaaagacaa

SEQ ID NO: 25184 - DNA, 25 bp, Homo sapiens
accccagccaagatttacactctag

SEQ ID NO: 25185 - DNA, 25 bp, Homo sapiens
ttacactctagacatccacagacct

SEQ ID NO: 25186 - DNA, 25 bp, Homo sapiens
tatctccaaccgaacactgggacta

SEQ ID NO: 25187 - DNA, 25 bp, Homo sapiens
gggattgtccttgggaatttgtgga

SEQ ID NO: 25188 - DNA, 25 bp, Homo sapiens
gagcatatttacctggattttactt

SEQ ID NO: 25189 - DNA, 25 bp, Homo sapiens
gggactcttcaggatttgagatggc

SEQ ID NO: 25190 - DNA, 25 bp, Homo sapiens
ttagttgatacattcttctgcccat

SEQ ID NO: 25191 - DNA, 25 bp, Homo sapiens
tctgcccattataattctcacctga

SEQ ID NO: 25192 - DNA, 25 bp, Homo sapiens
ctcacctgaagttatggggattgca

SEQ ID NO: 25193 - DNA, 25 bp, Homo sapiens
gggattgcacgggttttggcacttt

SEQ ID NO: 25194 - DNA, 25 bp, Homo sapiens
gaaaaagcctgatgtgggtcttaca

SEQ ID NO: 25195 - DNA, 25 bp, Homo sapiens
aggtttcccactgcggaacaggagt

SEQ ID NO: 25196 - DNA, 25 bp, Homo sapiens
ggaacaggagtgactctggctgcca

SEQ ID NO: 25197 - DNA, 25 bp, Homo sapiens
ctggctgccaagataccttcatggt

SEQ ID NO: 25198 - DNA, 25 bp, Homo sapiens
gctgctcctagaggggacaagccag

SEQ ID NO: 25199 - DNA, 25 bp, Homo sapiens
gggccgggcaaacactttggccaca

SEQ ID NO: 25200 - DNA, 25 bp, Homo sapiens
cccaaacaagcgccaccgtgggaga

SEQ ID NO: 25201 - DNA, 25 bp, Homo sapiens
gctgtcactggtaccggatgcagac

SEQ ID NO: 25202 - DNA, 25 bp, Homo sapiens
gcagctttgaggctggcggggtctg

SEQ ID NO: 25203 - DNA, 25 bp, Homo sapiens
ggcacttggagcgtttttgctggct

SEQ ID NO: 25204 - DNA, 25 bp, Homo sapiens
tggcttgcactttcttattttctta

SEQ ID NO: 25205 - DNA, 25 bp, Homo sapiens
gaactgtctctttcagtctacattt

SEQ ID NO: 25206 - DNA, 25 bp, Homo sapiens
gctcctagcacgattatatttcacc

SEQ ID NO: 25207 - DNA, 25 bp, Homo sapiens
tatttcacctgggacatgctgctat

SEQ ID NO: 25208 - DNA, 25 bp, Homo sapiens
atgctgctatgctgggactcatgta

SEQ ID NO: 25209 - DNA, 25 bp, Homo sapiens
gtatgtctactggactcagctcaac

SEQ ID NO: 25210 - DNA, 25 bp, Homo sapiens
tcagctcaacatgttccagaccttg

SEQ ID NO: 25211 - DNA, 25 bp, Homo sapiens
cagtgtgacgtttctggctggcaat

SEQ ID NO: 25212 - DNA, 25 bp, Homo sapiens
tggctggcaatcggatgctggccca

SEQ ID NO: 25213 - DNA, 25 bp, Homo sapiens
tgctggcccagcaggcagtcaagag

SEQ ID NO: 25214 - DNA, 25 bp, Homo sapiens
ggtgagctcagatagtctctttctc

SEQ ID NO: 25215 - DNA, 25 bp, Homo sapiens
gtctctttctctgacactgtgtaag

SEQ ID NO: 25216 - DNA, 25 bp, Homo sapiens
gaatattcctaacttacccagatgt

SEQ ID NO: 25217 - DNA, 25 bp, Homo sapiens
gacatagcatgacagaccttcctag

SEQ ID NO: 25218 - DNA, 25 bp, Homo sapiens
agagtgtttggtcgggttcacagtg

SEQ ID NO: 25219 - DNA, 25 bp, Homo sapiens
gaccgagagtcaggtccagcacaca

SEQ ID NO: 25220 - DNA, 25 bp, Homo sapiens
ggtccagcacacacctgggaaaggg

SEQ ID NO: 25221 - DNA, 25 bp, Homo sapiens
tcgcgacaccgtaggacttgacttt

SEQ ID NO: 25222 - DNA, 25 bp, Homo sapiens
tgaagttttgcattctggcttgtgc

SEQ ID NO: 25223 - DNA, 25 bp, Homo sapiens
tcagacgtacagccagacatgttct

SEQ ID NO: 25224 - DNA, 25 bp, Homo sapiens
ggcatttttccgattctgttcagat

SEQ ID NO: 25225 - DNA, 25 bp, Homo sapiens
tcagatgacagcgaccgccttttca

SEQ ID NO: 25226 - DNA, 25 bp, Homo sapiens
tcaccctcacgctctttgaagaaaa

SEQ ID NO: 25227 - DNA, 25 bp, Homo sapiens
aaaaatcaccttgtgtgttgtagct

SEQ ID NO: 25228 - DNA, 25 bp, Homo sapiens
gacaaattacggttgagttctgtgg

SEQ ID NO: 25229 - DNA, 25 bp, Homo sapiens
ttaaagcttccactatttatgtctt

SEQ ID NO: 25230 - DNA, 25 bp, Homo sapiens
gtacctcggtattaacagacctgct

SEQ ID NO: 25231 - DNA, 25 bp, Homo sapiens
gatgcagttacactttcacgtattt

SEQ ID NO: 25232 - DNA, 25 bp, Homo sapiens
gtatgtcaagctacacgggtctaag

SEQ ID NO: 25233 - DNA, 25 bp, Homo sapiens
gggttaaggagacctcctgtacatc

SEQ ID NO: 25234 - DNA, 25 bp, Homo sapiens
cctgtacatctacagtgtttccttt

SEQ ID NO: 25235 - DNA, 25 bp, Homo sapiens
gtgtgttcttcataagcttcagtgc

SEQ ID NO: 25236 - DNA, 25 bp, Homo sapiens
gacgagctgttgtgcaatttgctgt

SEQ ID NO: 25237 - DNA, 25 bp, Homo sapiens
ggattcacttttgactttatatgac

SEQ ID NO: 25238 - DNA, 25 bp, Homo sapiens
gatcaagaacaggtactaccccttt

SEQ ID NO: 25239 - DNA, 25 bp, Homo sapiens
ctgcagcagccggaatagagcctcg

SEQ ID NO: 25240 - DNA, 25 bp, Homo sapiens
aatagagcctcgtctggcaagtcgg

SEQ ID NO: 25241 - DNA, 25 bp, Homo sapiens
tccctgggcctcaacaaggatcagg

SEQ ID NO: 25242 - DNA, 25 bp, Homo sapiens
ggatcaggctgctggaaacacagtc

SEQ ID NO: 25243 - DNA, 25 bp, Homo sapiens
caaggtggcatccgaaggtgtctct

SEQ ID NO: 25244 - DNA, 25 bp, Homo sapiens
tctggtcttccagcgaggtgggaga

SEQ ID NO: 25245 - DNA, 25 bp, Homo sapiens
ggtccctgcagaagccagaaggtgc

SEQ ID NO: 25246 - DNA, 25 bp, Homo sapiens
ggagcatcggagggagtcccagagc

SEQ ID NO: 25247 - DNA, 25 bp, Homo sapiens
ttgggcctagaccgcgtgataaaac

SEQ ID NO: 25248 - DNA, 25 bp, Homo sapiens
tcccagccgtggtcaacggagggag

SEQ ID NO: 25249 - DNA, 25 bp, Homo sapiens
acggagggagtggcacttctgcctt

SEQ ID NO: 25250 - DNA, 25 bp, Homo sapiens
tcctggaggaggacactcccatcag

SEQ ID NO: 25251 - DNA, 25 bp, Homo sapiens
actcccatcagaacttggcagcctt

SEQ ID NO: 25252 - DNA, 25 bp, Homo sapiens
ccccacctgtaccaccatgtgggac

SEQ ID NO: 25253 - DNA, 25 bp, Homo sapiens
gtaccaccatgtgggactccaggca

SEQ ID NO: 25254 - DNA, 25 bp, Homo sapiens
ctctcagccaccttgatagtcactg

SEQ ID NO: 25255 - DNA, 25 bp, Homo sapiens
agccaccttgatagtcactgggctc

SEQ ID NO: 25256 - DNA, 25 bp, Homo sapiens
tctagggctggggctacatttggct

SEQ ID NO: 25257 - DNA, 25 bp, Homo sapiens
ttggcttctgtactggctgaggaca

SEQ ID NO: 25258 - DNA, 25 bp, Homo sapiens
tttggggtggcctgtgttgccactc

SEQ ID NO: 25259 - DNA, 25 bp, Homo sapiens
ctgccaccatcacaataaagtcccc

SEQ ID NO: 25260 - DNA, 25 bp, Homo sapiens
acaataaagtccccatctgattttt

SEQ ID NO: 25261 - DNA, 25 bp, Homo sapiens
ccaagtaccacggctatccttatag

SEQ ID NO: 25262 - DNA, 25 bp, Homo sapiens
aactgttcctgactttatactattt

SEQ ID NO: 25263 - DNA, 25 bp, Homo sapiens
gatcagctagcttattcttgtgtac

SEQ ID NO: 25264 - DNA, 25 bp, Homo sapiens
ctttgctatgacttctggccagatg

SEQ ID NO: 25265 - DNA, 25 bp, Homo sapiens
atgtggaaccatatccgtggacctc

SEQ ID NO: 25266 - DNA, 25 bp, Homo sapiens
gtggacctccatatgctcataagaa

SEQ ID NO: 25267 - DNA, 25 bp, Homo sapiens
ggagcagccaggctcagtttgtggc

SEQ ID NO: 25268 - DNA, 25 bp, Homo sapiens
tctggtactgaatgccgctatcacc

SEQ ID NO: 25269 - DNA, 25 bp, Homo sapiens
cctagtgggattgggcctggtggtc

SEQ ID NO: 25270 - DNA, 25 bp, Homo sapiens
cttcttcttcagttttctactttca

SEQ ID NO: 25271 - DNA, 25 bp, Homo sapiens
ttctactttcaatatttcgttccaa

SEQ ID NO: 25272 - DNA, 25 bp, Homo sapiens
cagagagtactcgcaggggcgctgg

SEQ ID NO: 25273 - DNA, 25 bp, Homo sapiens
ctgcactcaagaccctcgagattaa

SEQ ID NO: 25274 - DNA, 25 bp, Homo sapiens
agattaacggtgctaaccccgtctg

SEQ ID NO: 25275 - DNA, 25 bp, Homo sapiens
ggcctggactggacatgagagcccc

SEQ ID NO: 25276 - DNA, 25 bp, Homo sapiens
gagggctgtgtcttactagaaacaa

SEQ ID NO: 25277 - DNA, 25 bp, Homo sapiens
ctagaaacaacgcaaacctctcctt

SEQ ID NO: 25278 - DNA, 25 bp, Homo sapiens
ccccctttctatgttcatgttagtt

SEQ ID NO: 25279 - DNA, 25 bp, Homo sapiens
ttcatgttagttttgctccttctgt

SEQ ID NO: 25280 - DNA, 25 bp, Homo sapiens
accatatccatgttgctgacttttc

SEQ ID NO: 25281 - DNA, 25 bp, Homo sapiens
gaaaccaaggtcaggaggccgttgc

SEQ ID NO: 25282 - DNA, 25 bp, Homo sapiens
cagacataaatctcggcgactcggc

SEQ ID NO: 25283 - DNA, 25 bp, Homo sapiens
ttaacacaattccgaatctccctca

SEQ ID NO: 25284 - DNA, 25 bp, Homo sapiens
ccctcatccatgatgcgtccattgg

SEQ ID NO: 25285 - DNA, 25 bp, Homo sapiens
tccattggatcactcgctggtggtc

SEQ ID NO: 25286 - DNA, 25 bp, Homo sapiens
agttactaggggaattctgcctctg

SEQ ID NO: 25287 - DNA, 25 bp, Homo sapiens
tttggtctttaaacaccctgtcgtg

SEQ ID NO: 25288 - DNA, 25 bp, Homo sapiens
acaccctgtcgtgggatgtgctcac

SEQ ID NO: 25289 - DNA, 25 bp, Homo sapiens
gatgtgctcactgatttgtggctat

SEQ ID NO: 25290 - DNA, 25 bp, Homo sapiens
gaaggtatcacttgtcttgagggtt

SEQ ID NO: 25291 - DNA, 25 bp, Homo sapiens
atcatgtccacagggggacctgcct

SEQ ID NO: 25292 - DNA, 25 bp, Homo sapiens
ccacctttccttcaaggtctgtcat

SEQ ID NO: 25293 - DNA, 25 bp, Homo sapiens
gtatgtctaagcctcatgtaccgat

SEQ ID NO: 25294 - DNA, 25 bp, Homo sapiens
ccatcacctgcattcagtcacagtg

SEQ ID NO: 25295 - DNA, 25 bp, Homo sapiens
caagatcggttagcttacctgcgct

SEQ ID NO: 25296 - DNA, 25 bp, Homo sapiens
gatgcaccaagctcgaaagcgctat

SEQ ID NO: 25297 - DNA, 25 bp, Homo sapiens
gaaagcgctatcgagatcgcctgca

SEQ ID NO: 25298 - DNA, 25 bp, Homo sapiens
atccaggcttttattcgggcaaaca

SEQ ID NO: 25299 - DNA, 25 bp, Homo sapiens
agctcgggatgactacaagactctc

SEQ ID NO: 25300 - DNA, 25 bp, Homo sapiens
atcctcctatggttgtggtccgaaa

SEQ ID NO: 25301 - DNA, 25 bp, Homo sapiens
cgctgccgtggatacttagttcgac

SEQ ID NO: 25302 - DNA, 25 bp, Homo sapiens
agaggttatcaccctcattcgttct

SEQ ID NO: 25303 - DNA, 25 bp, Homo sapiens
tcattcgttctaaccagcagctgga

SEQ ID NO: 25304 - DNA, 25 bp, Homo sapiens
tgaagaaacaaatccctgccatcac

SEQ ID NO: 25305 - DNA, 25 bp, Homo sapiens
caaggtcatccctgagctgaacggg

SEQ ID NO: 25306 - DNA, 25 bp, Homo sapiens
gtgtcagtggtggacctgacctgcc

SEQ ID NO: 25307 - DNA, 25 bp, Homo sapiens
gacctgccgtctagaaaaacctgcc

SEQ ID NO: 25308 - DNA, 25 bp, Homo sapiens
tggtgaagcaggcgtcggagggccc

SEQ ID NO: 25309 - DNA, 25 bp, Homo sapiens
acactgagcaccaggtggtctcctc

SEQ ID NO: 25310 - DNA, 25 bp, Homo sapiens
tctcctctgacttcaacagcgacac

SEQ ID NO: 25311 - DNA, 25 bp, Homo sapiens
tttgacgctggggctggcattgccc

SEQ ID NO: 25312 - DNA, 25 bp, Homo sapiens
cgaccactttgtcaagctcatttcc

SEQ ID NO: 25313 - DNA, 25 bp, Homo sapiens
gcaacagggtggtggacctcatggc

SEQ ID NO: 25314 - DNA, 25 bp, Homo sapiens
gcctccaaggagtaagacccctgga

SEQ ID NO: 25315 - DNA, 25 bp, Homo sapiens
ccctccgggaaactgtggcgtgatg

SEQ ID NO: 25316 - DNA, 25 bp, Homo sapiens
gctacagattcacactttctggcct

SEQ ID NO: 25317 - DNA, 25 bp, Homo sapiens
atgggatgaggcttttcaccccagg

SEQ ID NO: 25318 - DNA, 25 bp, Homo sapiens
gctggtggtgattttttagccccta

SEQ ID NO: 25319 - DNA, 25 bp, Homo sapiens
atttcctgtttacttcattgattgc

SEQ ID NO: 25320 - DNA, 25 bp, Homo sapiens
gcaaagcacaatcatgccagccaac

SEQ ID NO: 25321 - DNA, 25 bp, Homo sapiens
gccagccaacattccagaattctgc

SEQ ID NO: 25322 - DNA, 25 bp, Homo sapiens
gagaggttttacaagccagacaggc

SEQ ID NO: 25323 - DNA, 25 bp, Homo sapiens
acaggcctgggggactgcagtcccc

SEQ ID NO: 25324 - DNA, 25 bp, Homo sapiens
tgccacatgctggccctttgagtga

SEQ ID NO: 25325 - DNA, 25 bp, Homo sapiens
ctgcatctttctacatatcttcatg

SEQ ID NO: 25326 - DNA, 25 bp, Homo sapiens
atctgagataccagttccttttccc

SEQ ID NO: 25327 - DNA, 25 bp, Homo sapiens
gctcacccagcagatgttcgatgcc

SEQ ID NO: 25328 - DNA, 25 bp, Homo sapiens
caagaacatgatggccgcctgcgac

SEQ ID NO: 25329 - DNA, 25 bp, Homo sapiens
gtggacgagcagatgctggccatcc

SEQ ID NO: 25330 - DNA, 25 bp, Homo sapiens
gcagctacttcgtggagtggatccc

SEQ ID NO: 25331 - DNA, 25 bp, Homo sapiens
gtggatccccaacaacgtgaaggtg

SEQ ID NO: 25332 - DNA, 25 bp, Homo sapiens
gtgaaggtggccgtgtgtgacatcc

SEQ ID NO: 25333 - DNA, 25 bp, Homo sapiens
acagcacggccatccaggagctgtt

SEQ ID NO: 25334 - DNA, 25 bp, Homo sapiens
caggagctgttcaagcgcatctccg

SEQ ID NO: 25335 - DNA, 25 bp, Homo sapiens
tgcactggtacacgggcgagggcat

SEQ ID NO: 25336 - DNA, 25 bp, Homo sapiens
acgagatggagttcaccgaggccga

SEQ ID NO: 25337 - DNA, 25 bp, Homo sapiens
atgaacgacctggtgtccgagtacc

SEQ ID NO: 25338 - DNA, 25 bp, Homo sapiens
ccctcttgcatctggaacgccaggt

SEQ ID NO: 25339 - DNA, 25 bp, Homo sapiens
aggtgggtttttctggcataggagc

SEQ ID NO: 25340 - DNA, 25 bp, Homo sapiens
gggtttttctggcataggagcccac

SEQ ID NO: 25341 - DNA, 25 bp, Homo sapiens
tttctggcataggagcccacttgca

SEQ ID NO: 25342 - DNA, 25 bp, Homo sapiens
tctggcataggagcccacttgcatt

SEQ ID NO: 25343 - DNA, 25 bp, Homo sapiens
ggcataggagcccacttgcattttc

SEQ ID NO: 25344 - DNA, 25 bp, Homo sapiens
ataggagcccacttgcattttcata

SEQ ID NO: 25345 - DNA, 25 bp, Homo sapiens
gagcccacttgcattttcatagttt

SEQ ID NO: 25346 - DNA, 25 bp, Homo sapiens
ccacttgcattttcatagttttatt

SEQ ID NO: 25347 - DNA, 25 bp, Homo sapiens
gataaaattccatcttacattctgt

SEQ ID NO: 25348 - DNA, 25 bp, Homo sapiens
taaaattccatcttacattctgtgt

SEQ ID NO: 25349 - DNA, 25 bp, Homo sapiens
gtctgcttcttgtaaaaacctgaac

SEQ ID NO: 25350 - DNA, 25 bp, Homo sapiens
aacacaatccgttgcaaacccaaag

SEQ ID NO: 25351 - DNA, 25 bp, Homo sapiens
gacccaagtactttccaatctcagt

SEQ ID NO: 25352 - DNA, 25 bp, Homo sapiens
aatctcagtcactctaggactctgc

SEQ ID NO: 25353 - DNA, 25 bp, Homo sapiens
aggactctgcactgaatggctgacc

SEQ ID NO: 25354 - DNA, 25 bp, Homo sapiens
tgaatggctgacctgacctgatgtc

SEQ ID NO: 25355 - DNA, 25 bp, Homo sapiens
ctcccctctctttctaagagacctg

SEQ ID NO: 25356 - DNA, 25 bp, Homo sapiens
aactggtgtgagtcaaatgccccct

SEQ ID NO: 25357 - DNA, 25 bp, Homo sapiens
ttcaggtgccgggcgcaggaactgt

SEQ ID NO: 25358 - DNA, 25 bp, Homo sapiens
gtgtcctacacaatggtgctattct

SEQ ID NO: 25359 - DNA, 25 bp, Homo sapiens
gtgctattctgtgtcaaacacctct

SEQ ID NO: 25360 - DNA, 25 bp, Homo sapiens
ggattctggaacctcaggcctagac

SEQ ID NO: 25361 - DNA, 25 bp, Homo sapiens
gcctagactaggttgcctttgtggg

SEQ ID NO: 25362 - DNA, 25 bp, Homo sapiens
atgaagcagagtcccctggtcaagt

SEQ ID NO: 25363 - DNA, 25 bp, Homo sapiens
ggcaaacaggtcccactggggactg

SEQ ID NO: 25364 - DNA, 25 bp, Homo sapiens
tggggactgtgactcttggagatta

SEQ ID NO: 25365 - DNA, 25 bp, Homo sapiens
gacacctgtcatatttatggaccag

SEQ ID NO: 25366 - DNA, 25 bp, Homo sapiens
actggggcagcatcaggcacagtct

SEQ ID NO: 25367 - DNA, 25 bp, Homo sapiens
tctgtctgggtgcaacttcttcagc

SEQ ID NO: 25368 - DNA, 25 bp, Homo sapiens
gtctggccgcaccttaaaaactatt

SEQ ID NO: 25369 - DNA, 25 bp, Homo sapiens
agccccaggcatttcagaaggtggc

SEQ ID NO: 25370 - DNA, 25 bp, Homo sapiens
ggcactcaggtcaccctgaaaagcc

SEQ ID NO: 25371 - DNA, 25 bp, Homo sapiens
cattgttctgaatgctgcttccatt

SEQ ID NO: 25372 - DNA, 25 bp, Homo sapiens
ccatttgacaaagtgccgtgataat

SEQ ID NO: 25373 - DNA, 25 bp, Homo sapiens
agaagcaaacaatggtgtctctttt

SEQ ID NO: 25374 - DNA, 25 bp, Homo sapiens
caatggtgtctcttttatgttcagc

SEQ ID NO: 25375 - DNA, 25 bp, Homo sapiens
gtaatagattgttttgccacttaga

SEQ ID NO: 25376 - DNA, 25 bp, Homo sapiens
gccacttagaatagcatttgccact

SEQ ID NO: 25377 - DNA, 25 bp, Homo sapiens
atagcatttgccacttagtatttta

SEQ ID NO: 25378 - DNA, 25 bp, Homo sapiens
gttggagtatttattgtcagttttg

SEQ ID NO: 25379 - DNA, 25 bp, Homo sapiens
aagccttcagagggtttggaccaca

SEQ ID NO: 25380 - DNA, 25 bp, Homo sapiens
ggtttggaccacatctctttggaaa

SEQ ID NO: 25381 - DNA, 25 bp, Homo sapiens
gcacacagagatttgagaaccattg

SEQ ID NO: 25382 - DNA, 25 bp, Homo sapiens
caaagtgggattggaccttcttgta

SEQ ID NO: 25383 - DNA, 25 bp, Homo sapiens
agtgggattggaccttcttgtagaa

SEQ ID NO: 25384 - DNA, 25 bp, Homo sapiens
ctggggttccagggcatttgtgtga

SEQ ID NO: 25385 - DNA, 25 bp, Homo sapiens
gggttccagggcatttgtgtgatgg

SEQ ID NO: 25386 - DNA, 25 bp, Homo sapiens
gggcatttgtgtgatggacaatggc

SEQ ID NO: 25387 - DNA, 25 bp, Homo sapiens
atggacaatggcataaagtcactgc

SEQ ID NO: 25388 - DNA, 25 bp, Homo sapiens
taaagtcactgccaacaagatcaaa

SEQ ID NO: 25389 - DNA, 25 bp, Homo sapiens
gcatctacatcagctgacacaaatg

SEQ ID NO: 25390 - DNA, 25 bp, Homo sapiens
catcagctgacacaaatgaccctgt

SEQ ID NO: 25391 - DNA, 25 bp, Homo sapiens
gacacaaatgaccctgtgtttgttg

SEQ ID NO: 25392 - DNA, 25 bp, Homo sapiens
gtgtttgttggaggcttcccagatg

SEQ ID NO: 25393 - DNA, 25 bp, Homo sapiens
gtgctcggcctgatggagactgtgt

SEQ ID NO: 25394 - DNA, 25 bp, Homo sapiens
ctgatggagactgtgtgcagcccct

SEQ ID NO: 25395 - DNA, 25 bp, Homo sapiens
ggaactgtgggagaccagcggagtg

SEQ ID NO: 25396 - DNA, 25 bp, Homo sapiens
gacgcagtagacagagacagaccga

SEQ ID NO: 25397 - DNA, 25 bp, Homo sapiens
gcctgactccgctgggagagtgcag

SEQ ID NO: 25398 - DNA, 25 bp, Homo sapiens
gtgcaggagcacgtgctgtttttta

SEQ ID NO: 25399 - DNA, 25 bp, Homo sapiens
gaaaccgctgacatctagaactgac

SEQ ID NO: 25400 - DNA, 25 bp, Homo sapiens
ctagaactgacctaccacaagcatc

SEQ ID NO: 25401 - DNA, 25 bp, Homo sapiens
gcagcactgcattgtcatgacattt

SEQ ID NO: 25402 - DNA, 25 bp, Homo sapiens
gtgaattatctaaatgcgtctacca

SEQ ID NO: 25403 - DNA, 25 bp, Homo sapiens
gcgtctaccattttgcactagggag

SEQ ID NO: 25404 - DNA, 25 bp, Homo sapiens
ctcgagggttcatgcagtcagtgtt

SEQ ID NO: 25405 - DNA, 25 bp, Homo sapiens
gtcagtgttataccaaacccagtgt

SEQ ID NO: 25406 - DNA, 25 bp, Homo sapiens
aaaaatgcgcatctctttctttgtt

SEQ ID NO: 25407 - DNA, 25 bp, Homo sapiens
ttcaggacctcatcattatgtgggg

SEQ ID NO: 25408 - DNA, 25 bp, Homo sapiens
caggtaagagatggccttcttggct

SEQ ID NO: 25409 - DNA, 25 bp, Homo sapiens
ggctgccacaatcagaaatcacgca

SEQ ID NO: 25410 - DNA, 25 bp, Homo sapiens
gcattttgggtaggcggcctccagt

SEQ ID NO: 25411 - DNA, 25 bp, Homo sapiens
ccagttttcctttgagtcgcgaacg

SEQ ID NO: 25412 - DNA, 25 bp, Homo sapiens
gtcgcgaacgctgtgcgtttgtcag

SEQ ID NO: 25413 - DNA, 25 bp, Homo sapiens
actacgagttgatctcggccagcca

SEQ ID NO: 25414 - DNA, 25 bp, Homo sapiens
tcggccagccaaagacacacgacaa

SEQ ID NO: 25415 - DNA, 25 bp, Homo sapiens
gactcgactctacagtaagtcagtc

SEQ ID NO: 25416 - DNA, 25 bp, Homo sapiens
gggtctcataggactaaccttacca

SEQ ID NO: 25417 - DNA, 25 bp, Homo sapiens
gactaaccttaccagagccagaaat

SEQ ID NO: 25418 - DNA, 25 bp, Homo sapiens
gggaagtgtcggcacatctaaattt

SEQ ID NO: 25419 - DNA, 25 bp, Homo sapiens
agtttttcatgtatcaaccacctcc

SEQ ID NO: 25420 - DNA, 25 bp, Homo sapiens
gaggctatccatcattatgctggct

SEQ ID NO: 25421 - DNA, 25 bp, Homo sapiens
tatgctggctagatgcgcttctgaa

SEQ ID NO: 25422 - DNA, 25 bp, Homo sapiens
agccggattctgatgttcttaacca

SEQ ID NO: 25423 - DNA, 25 bp, Homo sapiens
ctggtcctctggcaggattgtggat

SEQ ID NO: 25424 - DNA, 25 bp, Homo sapiens
ttgtggatagagctcctcaccatac

SEQ ID NO: 25425 - DNA, 25 bp, Homo sapiens
ctcaccatacccaaaagactcagcc

SEQ ID NO: 25426 - DNA, 25 bp, Homo sapiens
tggttccttcagagggtgtctctgc

SEQ ID NO: 25427 - DNA, 25 bp, Homo sapiens
tcttcactgcattcagcaatgcctg

SEQ ID NO: 25428 - DNA, 25 bp, Homo sapiens
gggaactggacaggcttggacctca

SEQ ID NO: 25429 - DNA, 25 bp, Homo sapiens
gcttggacctcatgtttcatttcta

SEQ ID NO: 25430 - DNA, 25 bp, Homo sapiens
attgggcaacaatgggcatcttcca

SEQ ID NO: 25431 - DNA, 25 bp, Homo sapiens
aacaatgggcatcttccatgccacc

SEQ ID NO: 25432 - DNA, 25 bp, Homo sapiens
ccaccacccaggcataaccagttgg

SEQ ID NO: 25433 - DNA, 25 bp, Homo sapiens
aaggtttcaaatgtgtctagtgttc

SEQ ID NO: 25434 - DNA, 25 bp, Homo sapiens
atgtgtctagtgttcagtattgagg

SEQ ID NO: 25435 - DNA, 25 bp, Homo sapiens
ggcaggcccaagtattttctgtgat

SEQ ID NO: 25436 - DNA, 25 bp, Homo sapiens
gtattttctgtgatatcccaggtta

SEQ ID NO: 25437 - DNA, 25 bp, Homo sapiens
aaaatacctttctgcatgactcttt

SEQ ID NO: 25438 - DNA, 25 bp, Homo sapiens
gtgatttgctcagcattgtctgcaa

SEQ ID NO: 25439 - DNA, 25 bp, Homo sapiens
aaaaatcgtcggcacaactgccacc

SEQ ID NO: 25440 - DNA, 25 bp, Homo sapiens
tgccaccagagctcaaagcctgtca

SEQ ID NO: 25441 - DNA, 25 bp, Homo sapiens
catgactgactgcagactcacttca

SEQ ID NO: 25442 - DNA, 25 bp, Homo sapiens
ctgctgcccagtacaaattcttcat

SEQ ID NO: 25443 - DNA, 25 bp, Homo sapiens
taaggcatccactgcatttcctttc

SEQ ID NO: 25444 - DNA, 25 bp, Homo sapiens
acaattgcatccacgttttcttttc

SEQ ID NO: 25445 - DNA, 25 bp, Homo sapiens
ttcgagtgcctaggatgccagacca

SEQ ID NO: 25446 - DNA, 25 bp, Homo sapiens
atttctaaccctgcaacttttgcca

SEQ ID NO: 25447 - DNA, 25 bp, Homo sapiens
acttttgccaagctttattgccctg

SEQ ID NO: 25448 - DNA, 25 bp, Homo sapiens
tttacacatgcagacatcaagccct

SEQ ID NO: 25449 - DNA, 25 bp, Homo sapiens
caggcgaaactgtgatctgcggcgg

SEQ ID NO: 25450 - DNA, 25 bp, Homo sapiens
gcagctccagggagttaactcttct

SEQ ID NO: 25451 - DNA, 25 bp, Homo sapiens
taactcttcttctgggggactgaga

SEQ ID NO: 25452 - DNA, 25 bp, Homo sapiens
gagaactgtagaaagccacacacta

SEQ ID NO: 25453 - DNA, 25 bp, Homo sapiens
actactacatcccttcacaaagagt

SEQ ID NO: 25454 - DNA, 25 bp, Homo sapiens
gagtatatgctagtttcttgtagat

SEQ ID NO: 25455 - DNA, 25 bp, Homo sapiens
gtagatattcacagctcattttaga

SEQ ID NO: 25456 - DNA, 25 bp, Homo sapiens
cataatgttgtgggtctttgttttg

SEQ ID NO: 25457 - DNA, 25 bp, Homo sapiens
gttttgtttgctttgggatcttgtt

SEQ ID NO: 25458 - DNA, 25 bp, Homo sapiens
tgggatcttgttggatgcacttaga

SEQ ID NO: 25459 - DNA, 25 bp, Homo sapiens
agcttagtgctttattacctgagtt

SEQ ID NO: 25460 - DNA, 25 bp, Homo sapiens
acctgagtttttaatagagccaata

SEQ ID NO: 25461 - DNA, 25 bp, Homo sapiens
aatacatccgatgcgtagattcttg

SEQ ID NO: 25462 - DNA, 25 bp, Homo sapiens
tgcgtagattcttgaccatgtagta

SEQ ID NO: 25463 - DNA, 25 bp, Homo sapiens
atctataaaattgctatatcctcct

SEQ ID NO: 25464 - DNA, 25 bp, Homo sapiens
tatatcctcctgatagccatgggaa

SEQ ID NO: 25465 - DNA, 25 bp, Homo sapiens
cagacaccctgactgttgaagggag

SEQ ID NO: 25466 - DNA, 25 bp, Homo sapiens
ttctgtcccttgttctgcaggatta

SEQ ID NO: 25467 - DNA, 25 bp, Homo sapiens
gttctgcaggattagtattctgtta

SEQ ID NO: 25468 - DNA, 25 bp, Homo sapiens
attctgttacagacctctagttttt

SEQ ID NO: 25469 - DNA, 25 bp, Homo sapiens
gacctctagtttttagactcttcaa

SEQ ID NO: 25470 - DNA, 25 bp, Homo sapiens
aaagcagtccctaatcatcaaaagt

SEQ ID NO: 25471 - DNA, 25 bp, Homo sapiens
atataaccacactaagaactcttcc

SEQ ID NO: 25472 - DNA, 25 bp, Homo sapiens
taagaactcttccaggtgacttcaa

SEQ ID NO: 25473 - DNA, 25 bp, Homo sapiens
aacataggacagtacatctctagta

SEQ ID NO: 25474 - DNA, 25 bp, Homo sapiens
gggaagcaacactccagtggtcaga

SEQ ID NO: 25475 - DNA, 25 bp, Homo sapiens
gtggtcagatgctcacagtcttatg

SEQ ID NO: 25476 - DNA, 25 bp, Homo sapiens
ggtgccatgggaacacgtgacatca

SEQ ID NO: 25477 - DNA, 25 bp, Homo sapiens
cacgtgacatcactgaagactgcct

SEQ ID NO: 25478 - DNA, 25 bp, Homo sapiens
gtgtgttcatgcctatacgataaac

SEQ ID NO: 25479 - DNA, 25 bp, Homo sapiens
ggagagcctagagtagcaggatcaa

SEQ ID NO: 25480 - DNA, 25 bp, Homo sapiens
agctggacttcaaatatgccttgtt

SEQ ID NO: 25481 - DNA, 25 bp, Homo sapiens
gaccgactggaagaccacggcgtag

SEQ ID NO: 25482 - DNA, 25 bp, Homo sapiens
acggcgtagcagaagccattccgac

SEQ ID NO: 25483 - DNA, 25 bp, Homo sapiens
attcaagatcacggtccaagtccca

SEQ ID NO: 25484 - DNA, 25 bp, Homo sapiens
tccaagtcccagcccaagaaagaaa

SEQ ID NO: 25485 - DNA, 25 bp, Homo sapiens
ggctaaatcacgttctaggtctgca

SEQ ID NO: 25486 - DNA, 25 bp, Homo sapiens
taggtctgcatctcacaccaaaact

SEQ ID NO: 25487 - DNA, 25 bp, Homo sapiens
gaggcacctctaaaacagattccaa

SEQ ID NO: 25488 - DNA, 25 bp, Homo sapiens
gaaccacctagatccaaatctcagt

SEQ ID NO: 25489 - DNA, 25 bp, Homo sapiens
tagtcctaagtccagtggccactga

SEQ ID NO: 25490 - DNA, 25 bp, Homo sapiens
ggcatgtatcattcatttactcata

SEQ ID NO: 25491 - DNA, 25 bp, Homo sapiens
ttgttagttttccctgtaccaggca

SEQ ID NO: 25492 - DNA, 25 bp, Homo sapiens
agaagagggttcttatcgcgtctcc

SEQ ID NO: 25493 - DNA, 25 bp, Homo sapiens
ccctggccagctactgtgatgccat

SEQ ID NO: 25494 - DNA, 25 bp, Homo sapiens
ccagctactgtgatgccatcttctc

SEQ ID NO: 25495 - DNA, 25 bp, Homo sapiens
ccatcttcagatcattcgaatcatt

SEQ ID NO: 25496 - DNA, 25 bp, Homo sapiens
atcattcgaatcattttggggactt

SEQ ID NO: 25497 - DNA, 25 bp, Homo sapiens
tttggggacttaatcatgtacatgg

SEQ ID NO: 25498 - DNA, 25 bp, Homo sapiens
ggttgatgttctatccaatggccga

SEQ ID NO: 25499 - DNA, 25 bp, Homo sapiens
aatggccgaagatagcagcaggttt

SEQ ID NO: 25500 - DNA, 25 bp, Homo sapiens
gttgatttgtttcatttggattttt

SEQ ID NO: 25501 - DNA, 25 bp, Homo sapiens
cccatccctgtcttgagattttctg

SEQ ID NO: 25502 - DNA, 25 bp, Homo sapiens
tctggcatgtttctggaggtttcaa

SEQ ID NO: 25503 - DNA, 25 bp, Homo sapiens
gagctgaagatcatgctgtcacctg

SEQ ID NO: 25504 - DNA, 25 bp, Homo sapiens
cacagcatgggtgtcctttgatgga

SEQ ID NO: 25505 - DNA, 25 bp, Homo sapiens
gaagagacaagagatccgccatgga

SEQ ID NO: 25506 - DNA, 25 bp, Homo sapiens
atccgccatggagacagcatcagca

SEQ ID NO: 25507 - DNA, 25 bp, Homo sapiens
gcatcagcatcactacctcatgcta

SEQ ID NO: 25508 - DNA, 25 bp, Homo sapiens
agcgactggtttgagagcctcgccc

SEQ ID NO: 25509 - DNA, 25 bp, Homo sapiens
gaacgtccggaagaagcaagcccac

SEQ ID NO: 25510 - DNA, 25 bp, Homo sapiens
gcaagcccacttcgaggaggaggag

SEQ ID NO: 25511 - DNA, 25 bp, Homo sapiens
ccctctggggacagaccaatctgcg

SEQ ID NO: 25512 - DNA, 25 bp, Homo sapiens
ccaatctgcgtgtgtctgtgaccgc

SEQ ID NO: 25513 - DNA, 25 bp, Homo sapiens
ccacttcctttctgtagctgggtta

SEQ ID NO: 25514 - DNA, 25 bp, Homo sapiens
agacctggaggacgatacacatgaa

SEQ ID NO: 25515 - DNA, 25 bp, Homo sapiens
agccagagaagcctcactttgactc

SEQ ID NO: 25516 - DNA, 25 bp, Homo sapiens
actttgactctcgcagtgtgatatt

SEQ ID NO: 25517 - DNA, 25 bp, Homo sapiens
gagctggattcatgcaatggcagtg

SEQ ID NO: 25518 - DNA, 25 bp, Homo sapiens
gacactgagatctggttcctggaca

SEQ ID NO: 25519 - DNA, 25 bp, Homo sapiens
gacagagcgttatactggcattttc

SEQ ID NO: 25520 - DNA, 25 bp, Homo sapiens
tactggcattttctcacagacacct

SEQ ID NO: 25521 - DNA, 25 bp, Homo sapiens
cacagacacctttactgcctattac

SEQ ID NO: 25522 - DNA, 25 bp, Homo sapiens
gccccagtggcaatatgccttcacc

SEQ ID NO: 25523 - DNA, 25 bp, Homo sapiens
gccttcaccagctatggcattagcc

SEQ ID NO: 25524 - DNA, 25 bp, Homo sapiens
gctatggcattagcccacaggccaa

SEQ ID NO: 25525 - DNA, 25 bp, Homo sapiens
agcctgtgtcggacagccagatggt

SEQ ID NO: 25526 - DNA, 25 bp, Homo sapiens
gtgtcggacagccagatggtcatca

SEQ ID NO: 25527 - DNA, 25 bp, Homo sapiens
gtcggacagccagatggtcatcata

SEQ ID NO: 25528 - DNA, 25 bp, Homo sapiens
gatggtcatcatagtcacggtggtg

SEQ ID NO: 25529 - DNA, 25 bp, Homo sapiens
tggtcatcatagtcacggtggtgtc

SEQ ID NO: 25530 - DNA, 25 bp, Homo sapiens
atcatagtcacggtggtgtcggtgt

SEQ ID NO: 25531 - DNA, 25 bp, Homo sapiens
tagtcacggtggtgtcggtgttgct

SEQ ID NO: 25532 - DNA, 25 bp, Homo sapiens
cagcggatgggcacctacggggtgc

SEQ ID NO: 25533 - DNA, 25 bp, Homo sapiens
ggatgggcacctacggggtgcgagc

SEQ ID NO: 25534 - DNA, 25 bp, Homo sapiens
cttgggacattgccttttctagccc

SEQ ID NO: 25535 - DNA, 25 bp, Homo sapiens
ttgccttttctagcccgaatacaaa

SEQ ID NO: 25536 - DNA, 25 bp, Homo sapiens
gggagagtccatctggaagctggag

SEQ ID NO: 25537 - DNA, 25 bp, Homo sapiens
agctggagtatatcctgacccagac

SEQ ID NO: 25538 - DNA, 25 bp, Homo sapiens
cgacattgaagatttgcagccggaa

SEQ ID NO: 25539 - DNA, 25 bp, Homo sapiens
atactacaattacttctttgtgagt

SEQ ID NO: 25540 - DNA, 25 bp, Homo sapiens
gtaaggcctttcagatttgtgcaat

SEQ ID NO: 25541 - DNA, 25 bp, Homo sapiens
taatatttcctatgcagattgcctc

SEQ ID NO: 25542 - DNA, 25 bp, Homo sapiens
tatgcagattgcctcaaacagcttt

SEQ ID NO: 25543 - DNA, 25 bp, Homo sapiens
ctgagtgggcaagtagacttcctgt

SEQ ID NO: 25544 - DNA, 25 bp, Homo sapiens
ttttctttttgatgccttaatgtag

SEQ ID NO: 25545 - DNA, 25 bp, Homo sapiens
attatatctaatttgtacccttgtt

SEQ ID NO: 25546 - DNA, 25 bp, Homo sapiens
gtacccttgttgaaattgtcattta

SEQ ID NO: 25547 - DNA, 25 bp, Homo sapiens
gcaggcggcagtgaggagaccatcg

SEQ ID NO: 25548 - DNA, 25 bp, Homo sapiens
ggcttgcggcagattcagggagtca

SEQ ID NO: 25549 - DNA, 25 bp, Homo sapiens
atcgccaagcctgatgtcttcaaga

SEQ ID NO: 25550 - DNA, 25 bp, Homo sapiens
acacttatgtggtctttggcgaggc

SEQ ID NO: 25551 - DNA, 25 bp, Homo sapiens
gattgaggacctgtcccagcaagtg

SEQ ID NO: 25552 - DNA, 25 bp, Homo sapiens
gcaagtgcacaaagccgcagctgag

SEQ ID NO: 25553 - DNA, 25 bp, Homo sapiens
gccccgggtgaggctggagtgcaag

SEQ ID NO: 25554 - DNA, 25 bp, Homo sapiens
ggcgcaggccaatgtgtccagggcc

SEQ ID NO: 25555 - DNA, 25 bp, Homo sapiens
gtgcgggctctgagagacaaccaca

SEQ ID NO: 25556 - DNA, 25 bp, Homo sapiens
gacatcgtcaacgccatcatggaac

SEQ ID NO: 25557 - DNA, 25 bp, Homo sapiens
gtagccactgaccggaagctggagc

SEQ ID NO: 25558 - DNA, 25 bp, Homo sapiens
aaatgtgaccctcgccatggtaaat

SEQ ID NO: 25559 - DNA, 25 bp, Homo sapiens
aatacatggcttgctgcctgttgta

SEQ ID NO: 25560 - DNA, 25 bp, Homo sapiens
atgtcaatgctgccattgccaccat

SEQ ID NO: 25561 - DNA, 25 bp, Homo sapiens
tgccccactggcttcaaggttggca

SEQ ID NO: 25562 - DNA, 25 bp, Homo sapiens
aaggttggcatcaactaccagcctc

SEQ ID NO: 25563 - DNA, 25 bp, Homo sapiens
acaccacagccattgctgaggcctg

SEQ ID NO: 25564 - DNA, 25 bp, Homo sapiens
gcctggaccacaagtttgacctgat

SEQ ID NO: 25565 - DNA, 25 bp, Homo sapiens
gacctgatgtatgccaagcgtgcct

SEQ ID NO: 25566 - DNA, 25 bp, Homo sapiens
ggcccgtgaagatatggctgccctt

SEQ ID NO: 25567 - DNA, 25 bp, Homo sapiens
ctaattatccattccttttggccct

SEQ ID NO: 25568 - DNA, 25 bp, Homo sapiens
gtcatgctcccagaatttcagcttc

SEQ ID NO: 25569 - DNA, 25 bp, Homo sapiens
ccatgtgtaacttcctcacgttgtg

SEQ ID NO: 25570 - DNA, 25 bp, Homo sapiens
tgtaacttcctcacgttgtgtgcga

SEQ ID NO: 25571 - DNA, 25 bp, Homo sapiens
acttcctcacgttgtgtgcgataac

SEQ ID NO: 25572 - DNA, 25 bp, Homo sapiens
gtgtgcgataacgtattttattgta

SEQ ID NO: 25573 - DNA, 25 bp, Homo sapiens
cagcagcagtggcctggaagacgcc

SEQ ID NO: 25574 - DNA, 25 bp, Homo sapiens
gcagtggcctggaagacgccaccgc

SEQ ID NO: 25575 - DNA, 25 bp, Homo sapiens
ttctcctgcgtctgtgtgcatagga

SEQ ID NO: 25576 - DNA, 25 bp, Homo sapiens
cctgcgtctgtgtgcataggacatg

SEQ ID NO: 25577 - DNA, 25 bp, Homo sapiens
gtctgtgtgcataggacatgatact

SEQ ID NO: 25578 - DNA, 25 bp, Homo sapiens
gacatgatactaataaccacacggc

SEQ ID NO: 25579 - DNA, 25 bp, Homo sapiens
aataaccacacggctggcgtgacct

SEQ ID NO: 25580 - DNA, 25 bp, Homo sapiens
ggaaggctgtggtccaaggccattt

SEQ ID NO: 25581 - DNA, 25 bp, Homo sapiens
gctgtggtccaaggccatttttgct

SEQ ID NO: 25582 - DNA, 25 bp, Homo sapiens
ggtccaaggccatttttgctggcta

SEQ ID NO: 25583 - DNA, 25 bp, Homo sapiens
ttgctggctataagcggggtctccg

SEQ ID NO: 25584 - DNA, 25 bp, Homo sapiens
gctataagcggggtctccggaacca

SEQ ID NO: 25585 - DNA, 25 bp, Homo sapiens
accaaagggagcacacagctcttct

SEQ ID NO: 25586 - DNA, 25 bp, Homo sapiens
gggagcacacagctcttcttaaaat

SEQ ID NO: 25587 - DNA, 25 bp, Homo sapiens
aattgaaggtgtttacgcccgagat

SEQ ID NO: 25588 - DNA, 25 bp, Homo sapiens
gtttacgcccgagatgaaacagaat

SEQ ID NO: 25589 - DNA, 25 bp, Homo sapiens
ctatttgggcaagagatgcgcttat

SEQ ID NO: 25590 - DNA, 25 bp, Homo sapiens
ggaactatgtctggaaggctgtggt

SEQ ID NO: 25591 - DNA, 25 bp, Homo sapiens
taaagtggtgttaaatgctttgtaa

SEQ ID NO: 25592 - DNA, 25 bp, Homo sapiens
gctgagatctaaatggggacaaggc

SEQ ID NO: 25593 - DNA, 25 bp, Homo sapiens
ggaggggaggccagtgtacatgtaa

SEQ ID NO: 25594 - DNA, 25 bp, Homo sapiens
tgtacatgtaaatgcccacagccca

SEQ ID NO: 25595 - DNA, 25 bp, Homo sapiens
cccaagaccttgcctgaaaacaagc

SEQ ID NO: 25596 - DNA, 25 bp, Homo sapiens
agcagataccgattgcttcatccta

SEQ ID NO: 25597 - DNA, 25 bp, Homo sapiens
ataccgattgcttcatcctatttat

SEQ ID NO: 25598 - DNA, 25 bp, Homo sapiens
ttcatcctatttatggacatgtagg

SEQ ID NO: 25599 - DNA, 25 bp, Homo sapiens
gacatgtaggtctagttgcattttc

SEQ ID NO: 25600 - DNA, 25 bp, Homo sapiens
tggtaacttttaatgatctattcag

SEQ ID NO: 25601 - DNA, 25 bp, Homo sapiens
tgatctattcaggcagtagagctct

SEQ ID NO: 25602 - DNA, 25 bp, Homo sapiens
gagggatgagacagacattcacctg

SEQ ID NO: 25603 - DNA, 25 bp, Homo sapiens
gacattcacctgtatatttctttta

SEQ ID NO: 25604 - DNA, 25 bp, Homo sapiens
acaaaatgggcccttgcctctaaat

SEQ ID NO: 25605 - DNA, 25 bp, Homo sapiens
tttttcataattactctacttccca

SEQ ID NO: 25606 - DNA, 25 bp, Homo sapiens
tgcatcccacgttctgttaatttag

SEQ ID NO: 25607 - DNA, 25 bp, Homo sapiens
caggtttttagtttgttcttcagat

SEQ ID NO: 25608 - DNA, 25 bp, Homo sapiens
tgttaacctttctaaccttcacgat

SEQ ID NO: 25609 - DNA, 25 bp, Homo sapiens
gtacgtcatttgtgcaagaccgttt

SEQ ID NO: 25610 - DNA, 25 bp, Homo sapiens
caagaccgtttgtccacttcatttt

SEQ ID NO: 25611 - DNA, 25 bp, Homo sapiens
gtccacttcattttgtataatcaca

SEQ ID NO: 25612 - DNA, 25 bp, Homo sapiens
atcacagttgtgttcctgacactca

SEQ ID NO: 25613 - DNA, 25 bp, Homo sapiens
cctgtcccttggctatgagcaggct

SEQ ID NO: 25614 - DNA, 25 bp, Homo sapiens
cttggctatgagcaggctttggggg

SEQ ID NO: 25615 - DNA, 25 bp, Homo sapiens
gggggcttagaggctgggatggctc

SEQ ID NO: 25616 - DNA, 25 bp, Homo sapiens
gggcttagaggctgggatggctcct

SEQ ID NO: 25617 - DNA, 25 bp, Homo sapiens
cctctttggacccagatctgttcat

SEQ ID NO: 25618 - DNA, 25 bp, Homo sapiens
gacccagatctgttcatgcttttgt

SEQ ID NO: 25619 - DNA, 25 bp, Homo sapiens
agatctgttcatgcttttgtcttcg

SEQ ID NO: 25620 - DNA, 25 bp, Homo sapiens
tgtatggggtggaaaaatcaccggg

SEQ ID NO: 25621 - DNA, 25 bp, Homo sapiens
gaaaaagttccatgactcgaatatc

SEQ ID NO: 25622 - DNA, 25 bp, Homo sapiens
gttccatgactcgaatatctgaaat

SEQ ID NO: 25623 - DNA, 25 bp, Homo sapiens
tacctgtcccttggctatgagcagg

SEQ ID NO: 25624 - DNA, 25 bp, Homo sapiens
tgcactggtacacgggcgagggcat

SEQ ID NO: 25625 - DNA, 25 bp, Homo sapiens
acgagatggagttcaccgaggccga

SEQ ID NO: 25626 - DNA, 25 bp, Homo sapiens
gtaccagcagtaccaggatgccaca

SEQ ID NO: 25627 - DNA, 25 bp, Homo sapiens
gggcgagttcgaggaggaggctgag

SEQ ID NO: 25628 - DNA, 25 bp, Homo sapiens
gaggaggaggtggcctagagccttc

SEQ ID NO: 25629 - DNA, 25 bp, Homo sapiens
tgtgaactctttattcactcccagc

SEQ ID NO: 25630 - DNA, 25 bp, Homo sapiens
gtccacatccatgctgtacagacac

SEQ ID NO: 25631 - DNA, 25 bp, Homo sapiens
gtacagacaccaccattaaagcatt

SEQ ID NO: 25632 - DNA, 25 bp, Homo sapiens
ccaccttcattggcaacagcacggc

SEQ ID NO: 25633 - DNA, 25 bp, Homo sapiens
acagcacggccatccaggagctgtt

SEQ ID NO: 25634 - DNA, 25 bp, Homo sapiens
caggagctgttcaagcgcatctccg

SEQ ID NO: 25635 - DNA, 25 bp, Homo sapiens
gggactggacccatacaatgtactg

SEQ ID NO: 25636 - DNA, 25 bp, Homo sapiens
acaatgtactggccccaaagggagc

SEQ ID NO: 25637 - DNA, 25 bp, Homo sapiens
gggagcttcaggcaccagggaagac

SEQ ID NO: 25638 - DNA, 25 bp, Homo sapiens
gaatagtaggctgcatctgtgaaga

SEQ ID NO: 25639 - DNA, 25 bp, Homo sapiens
gatgcgctccatggcatctggaggt

SEQ ID NO: 25640 - DNA, 25 bp, Homo sapiens
aagaggacaataccagcgtcgtctg

SEQ ID NO: 25641 - DNA, 25 bp, Homo sapiens
tcgtctggttttggctgcacaaagg

SEQ ID NO: 25642 - DNA, 25 bp, Homo sapiens
gcacactgagcacctgcactaaatt

SEQ ID NO: 25643 - DNA, 25 bp, Homo sapiens
gagcacctgcactaaattactcaaa

SEQ ID NO: 25644 - DNA, 25 bp, Homo sapiens
ggaggtggtgttcccactgatgaag

SEQ ID NO: 25645 - DNA, 25 bp, Homo sapiens
agcaggcgactgggttggagaggga

SEQ ID NO: 25646 - DNA, 25 bp, Homo sapiens
cgccctgcaattaacgttggtctgt

SEQ ID NO: 25647 - DNA, 25 bp, Homo sapiens
tccgctgcccaaaccagggctatga

SEQ ID NO: 25648 - DNA, 25 bp, Homo sapiens
gaagctggaattggctcagtatcgt

SEQ ID NO: 25649 - DNA, 25 bp, Homo sapiens
gtatcgtgaggttgctgcttttgcc

SEQ ID NO: 25650 - DNA, 25 bp, Homo sapiens
aacttttgagtcgtggcgtgcgtct

SEQ ID NO: 25651 - DNA, 25 bp, Homo sapiens
ggcgtgcgtctaactgagttgctga

SEQ ID NO: 25652 - DNA, 25 bp, Homo sapiens
cagtattctcccatggctattgaag

SEQ ID NO: 25653 - DNA, 25 bp, Homo sapiens
aagtggctgttatctatgcgggtgt

SEQ ID NO: 25654 - DNA, 25 bp, Homo sapiens
gcaccaagccttgttgggcactatc

SEQ ID NO: 25655 - DNA, 25 bp, Homo sapiens
agcttaaactcctgtggattcacat

SEQ ID NO: 25656 - DNA, 25 bp, Homo sapiens
gttcagttttgtcattgttctagta

SEQ ID NO: 25657 - DNA, 25 bp, Homo sapiens
tcatgagttcttccacagtgaaccc

SEQ ID NO: 25658 - DNA, 25 bp, Homo sapiens
gtgaacccttggattacctggtggc

SEQ ID NO: 25659 - DNA, 25 bp, Homo sapiens
ggattacctggtggctttttctagc

SEQ ID NO: 25660 - DNA, 25 bp, Homo sapiens
ttgcattaatccttactgagattgg

SEQ ID NO: 25661 - DNA, 25 bp, Homo sapiens
ggcgccattcttcagatattaaagt

SEQ ID NO: 25662 - DNA, 25 bp, Homo sapiens
ttcagccttcagtgaatgtgctttc

SEQ ID NO: 25663 - DNA, 25 bp, Homo sapiens
gaatgtgctttctagttgtcaggaa

SEQ ID NO: 25664 - DNA, 25 bp, Homo sapiens
gaattaacactttgactcctaaatg

SEQ ID NO: 25665 - DNA, 25 bp, Homo sapiens
ttagtaatcgaaaaccatatcctgt

SEQ ID NO: 25666 - DNA, 25 bp, Homo sapiens
aatgcaatcagtgtaactaggggct

SEQ ID NO: 25667 - DNA, 25 bp, Homo sapiens
actaggggctgtgtttctgcattaa

SEQ ID NO: 25668 - DNA, 25 bp, Homo sapiens
aaaacccatttgccgtatactagag

SEQ ID NO: 25669 - DNA, 25 bp, Homo sapiens
tgggttcaggcagattcccactttc

SEQ ID NO: 25670 - DNA, 25 bp, Homo sapiens
tcccactttcacctctagagattta

SEQ ID NO: 25671 - DNA, 25 bp, Homo sapiens
gggtaggccctggagagcagtactc

SEQ ID NO: 25672 - DNA, 25 bp, Homo sapiens
agcagtactcttaacaagctcctca

SEQ ID NO: 25673 - DNA, 25 bp, Homo sapiens
ctcctcagtgcttcttaccattagg

SEQ ID NO: 25674 - DNA, 25 bp, Homo sapiens
agggaaacactgcattgggtcaaag

SEQ ID NO: 25675 - DNA, 25 bp, Homo sapiens
aaagtgctgcctttaatcgaccatt

SEQ ID NO: 25676 - DNA, 25 bp, Homo sapiens
caaggaatacaagccatctggttgg

SEQ ID NO: 25677 - DNA, 25 bp, Homo sapiens
agaaccagagctcctatcagtatat

SEQ ID NO: 25678 - DNA, 25 bp, Homo sapiens
tcaagcccgttttagaaagccaaca

SEQ ID NO: 25679 - DNA, 25 bp, Homo sapiens
cctggggctgagcaaggcctacgta

SEQ ID NO: 25680 - DNA, 25 bp, Homo sapiens
gggctgagcaaggcctacgtaggcc

SEQ ID NO: 25681 - DNA, 25 bp, Homo sapiens
gcctacgtaggccagaagagcagct

SEQ ID NO: 25682 - DNA, 25 bp, Homo sapiens
gagcagcttcacagtagactgcagc

SEQ ID NO: 25683 - DNA, 25 bp, Homo sapiens
gcttcacagtagactgcagcaaagc

SEQ ID NO: 25684 - DNA, 25 bp, Homo sapiens
aaagcaggcaacaacatgctgctgg

SEQ ID NO: 25685 - DNA, 25 bp, Homo sapiens
gcgtgtcctacctgctcaaggacaa

SEQ ID NO: 25686 - DNA, 25 bp, Homo sapiens
gtcctacctgctcaaggacaagggg

SEQ ID NO: 25687 - DNA, 25 bp, Homo sapiens
ggacaagggggagtacacactggtg

SEQ ID NO: 25688 - DNA, 25 bp, Homo sapiens
gggggagtacacactggtggtcaaa

SEQ ID NO: 25689 - DNA, 25 bp, Homo sapiens
gtacacactggtggtcaaatggggg

SEQ ID NO: 25690 - DNA, 25 bp, Homo sapiens
tggggagtggcagctggaatctctg

SEQ ID NO: 25691 - DNA, 25 bp, Homo sapiens
gcttccgtctgaacatctggacaca

SEQ ID NO: 25692 - DNA, 25 bp, Homo sapiens
ggctgtgcggtgaggggagaaccct

SEQ ID NO: 25693 - DNA, 25 bp, Homo sapiens
agaaccctgggcagtctggagactg

SEQ ID NO: 25694 - DNA, 25 bp, Homo sapiens
tggagactgaggtgccattctcggc

SEQ ID NO: 25695 - DNA, 25 bp, Homo sapiens
tgccattctcggctagagacaccac

SEQ ID NO: 25696 - DNA, 25 bp, Homo sapiens
gaaccagactgcctgtgactttatg

SEQ ID NO: 25697 - DNA, 25 bp, Homo sapiens
cattcacaaaagtatcccttctacc

SEQ ID NO: 25698 - DNA, 25 bp, Homo sapiens
ggcgcagggctgaaatgtcatcatt

SEQ ID NO: 25699 - DNA, 25 bp, Homo sapiens
ttctgtcttctggggcttacaagtt

SEQ ID NO: 25700 - DNA, 25 bp, Homo sapiens
acctgaaagcagtggtcccagctct

SEQ ID NO: 25701 - DNA, 25 bp, Homo sapiens
ttgactttcgcattgcttttcaaca

SEQ ID NO: 25702 - DNA, 25 bp, Homo sapiens
aaaggccacttcctatctgattttt

SEQ ID NO: 25703 - DNA, 25 bp, Homo sapiens
ggcaggcaattctaagatcttccac

SEQ ID NO: 25704 - DNA, 25 bp, Homo sapiens
atcttccacaaaacatctagccatc

SEQ ID NO: 25705 - DNA, 25 bp, Homo sapiens
gatgaatcattctacctatacaaac

SEQ ID NO: 25706 - DNA, 25 bp, Homo sapiens
agggtggttggggtatgctactcat

SEQ ID NO: 25707 - DNA, 25 bp, Homo sapiens
gggtgtcttccaactgaaatctcaa

SEQ ID NO: 25708 - DNA, 25 bp, Homo sapiens
tgctattcacccagtaaacccaaaa

SEQ ID NO: 25709 - DNA, 25 bp, Homo sapiens
gataatgctggccattttgcctttc

SEQ ID NO: 25710 - DNA, 25 bp, Homo sapiens
tgcctttctgacatttccttgggaa

SEQ ID NO: 25711 - DNA, 25 bp, Homo sapiens
tgggaatctgcaagaacctcccctt

SEQ ID NO: 25712 - DNA, 25 bp, Homo sapiens
cccacctggcatatactggctggcc

SEQ ID NO: 25713 - DNA, 25 bp, Homo sapiens
gtcttagtcgtgaccacatggctgt

SEQ ID NO: 25714 - DNA, 25 bp, Homo sapiens
acatggctgttgtcaggtcgtgctg

SEQ ID NO: 25715 - DNA, 25 bp, Homo sapiens
tgcagtgtgtgggttcattcacctg

SEQ ID NO: 25716 - DNA, 25 bp, Homo sapiens
ggagaccaagccttcttatctcaac

SEQ ID NO: 25717 - DNA, 25 bp, Homo sapiens
gacagccgatacatcctgggtgaca

SEQ ID NO: 25718 - DNA, 25 bp, Homo sapiens
gcatggaaaccatcacagcttgcct

SEQ ID NO: 25719 - DNA, 25 bp, Homo sapiens
ctccgcttcattctacagcttgtgg

SEQ ID NO: 25720 - DNA, 25 bp, Homo sapiens
tctatggggatgtgctctacttcct

SEQ ID NO: 25721 - DNA, 25 bp, Homo sapiens
tgacagagcaccgcgacggattcca

SEQ ID NO: 25722 - DNA, 25 bp, Homo sapiens
tttgtcttcatgaatgccctgtggc

SEQ ID NO: 25723 - DNA, 25 bp, Homo sapiens
ttattgtcatgtgttgcttgccttg

SEQ ID NO: 25724 - DNA, 25 bp, Homo sapiens
gcttgccttgtatagttgacttcat

SEQ ID NO: 25725 - DNA, 25 bp, Homo sapiens
tttcaggttctgtgctctttttgga

SEQ ID NO: 25726 - DNA, 25 bp, Homo sapiens
gtgctctttttggagtctttaagct

SEQ ID NO: 25727 - DNA, 25 bp, Homo sapiens
ctattgcagctatctcgttttcatg

SEQ ID NO: 25728 - DNA, 25 bp, Homo sapiens
gtttttgttatcttgtctcttattt

SEQ ID NO: 25729 - DNA, 25 bp, Homo sapiens
agatatgggggcttcatgagaggct

SEQ ID NO: 25730 - DNA, 25 bp, Homo sapiens
tcatgagaagagtaggtcgcccaga

SEQ ID NO: 25731 - DNA, 25 bp, Homo sapiens
ggtcgcccagagtggtggatggact

SEQ ID NO: 25732 - DNA, 25 bp, Homo sapiens
atggaggtttcctgaagcgctttgc

SEQ ID NO: 25733 - DNA, 25 bp, Homo sapiens
tctgccctccgacgaagaaggcgaa

SEQ ID NO: 25734 - DNA, 25 bp, Homo sapiens
caaattgaccaatagctgctgcttt

SEQ ID NO: 25735 - DNA, 25 bp, Homo sapiens
tagctgctgctttcatattttggat

SEQ ID NO: 25736 - DNA, 25 bp, Homo sapiens
ttggataagggtctgtggtcccggc

SEQ ID NO: 25737 - DNA, 25 bp, Homo sapiens
ggcgtgtgctcacgtgtgtatgcac

SEQ ID NO: 25738 - DNA, 25 bp, Homo sapiens
gtatccatgcggagttgatgctttg

SEQ ID NO: 25739 - DNA, 25 bp, Homo sapiens
gaattggctcatgaaggttcttctc

SEQ ID NO: 25740 - DNA, 25 bp, Homo sapiens
aggttcttctcaagggtgcgagctc

SEQ ID NO: 25741 - DNA, 25 bp, Homo sapiens
ccttccttcttattgactgggagac

SEQ ID NO: 25742 - DNA, 25 bp, Homo sapiens
tgctctcgacagattcttcttgtgt

SEQ ID NO: 25743 - DNA, 25 bp, Homo sapiens
agaagtctagcctcaggtttctacc

SEQ ID NO: 25744 - DNA, 25 bp, Homo sapiens
aagggaggagcatttcatttggagt

SEQ ID NO: 25745 - DNA, 25 bp, Homo sapiens
gcagcttttccatatcagctcaacc

SEQ ID NO: 25746 - DNA, 25 bp, Homo sapiens
gccgccagtccattcttaaggaact

SEQ ID NO: 25747 - DNA, 25 bp, Homo sapiens
ggaactgccgactaggactgatgat

SEQ ID NO: 25748 - DNA, 25 bp, Homo sapiens
gaatgttcacactggttaatctttt

SEQ ID NO: 25749 - DNA, 25 bp, Homo sapiens
gtgtttccagatggttcttctaacc

SEQ ID NO: 25750 - DNA, 25 bp, Homo sapiens
gcgaggcaagggttgcactggacca

SEQ ID NO: 25751 - DNA, 25 bp, Homo sapiens
aaggctgaggcttggccatctagca

SEQ ID NO: 25752 - DNA, 25 bp, Homo sapiens
ggccatctagcattccatacaaaat

SEQ ID NO: 25753 - DNA, 25 bp, Homo sapiens
ggtctgcctcaaccgtgagatagga

SEQ ID NO: 25754 - DNA, 25 bp, Homo sapiens
aggagagtctctggtactagctgct

SEQ ID NO: 25755 - DNA, 25 bp, Homo sapiens
agcagtgcccttcatccagggcagt

SEQ ID NO: 25756 - DNA, 25 bp, Homo sapiens
tcagctttaccctctgaacttctga

SEQ ID NO: 25757 - DNA, 25 bp, Homo sapiens
ttaccctctgaacttctgatcgaag

SEQ ID NO: 25758 - DNA, 25 bp, Homo sapiens
acttctgatcgaaggtcatccctct

SEQ ID NO: 25759 - DNA, 25 bp, Homo sapiens
acaagggccaatggaaccaagtttg

SEQ ID NO: 25760 - DNA, 25 bp, Homo sapiens
ggaaccaagtttgagtcttgccagg

SEQ ID NO: 25761 - DNA, 25 bp, Homo sapiens
gagtcttgccaggtcaatacttggg

SEQ ID NO: 25762 - DNA, 25 bp, Homo sapiens
gccaggtcaatacttgggtcctgag

SEQ ID NO: 25763 - DNA, 25 bp, Homo sapiens
acttgggtcctgagtatggtgacta

SEQ ID NO: 25764 - DNA, 25 bp, Homo sapiens
tatggtgactagtatctgttttgtt

SEQ ID NO: 25765 - DNA, 25 bp, Homo sapiens
tatgtgtgtattattccagccagaa

SEQ ID NO: 25766 - DNA, 25 bp, Homo sapiens
ggaaatgctaattcagctcctccag

SEQ ID NO: 25767 - DNA, 25 bp, Homo sapiens
acctcagatgctttcagtgctctgt

SEQ ID NO: 25768 - DNA, 25 bp, Homo sapiens
gctttcagtgctctgtctgaggatg

SEQ ID NO: 25769 - DNA, 25 bp, Homo sapiens
atatgcatatgcaaactcgaccccc

SEQ ID NO: 25770 - DNA, 25 bp, Homo sapiens
cccgttcctgcccagataatggctc

SEQ ID NO: 25771 - DNA, 25 bp, Homo sapiens
atggctcaataactctgaggctggt

SEQ ID NO: 25772 - DNA, 25 bp, Homo sapiens
tgaggctggttgctcagcctctgag

SEQ ID NO: 25773 - DNA, 25 bp, Homo sapiens
tacgccagcccgggtgagagaggga

SEQ ID NO: 25774 - DNA, 25 bp, Homo sapiens
gagtgttcggtgaaacaagtgggat

SEQ ID NO: 25775 - DNA, 25 bp, Homo sapiens
gggattttctgggccagcaagtctt

SEQ ID NO: 25776 - DNA, 25 bp, Homo sapiens
ttctgggccagcaagtcttccaaac

SEQ ID NO: 25777 - DNA, 25 bp, Homo sapiens
aaactgtatatgatgcatcctgtct

SEQ ID NO: 25778 - DNA, 25 bp, Homo sapiens
agcaaggatgctgcctttggtctct

SEQ ID NO: 25779 - DNA, 25 bp, Homo sapiens
tgtataaaagtcccgtgtctctcgc

SEQ ID NO: 25780 - DNA, 25 bp, Homo sapiens
tctgctgctgttcctagactgagca

SEQ ID NO: 25781 - DNA, 25 bp, Homo sapiens
gagcattgcatttcttgatcaacca

SEQ ID NO: 25782 - DNA, 25 bp, Homo sapiens
gtgatgggggcggccaaggtgacac

SEQ ID NO: 25783 - DNA, 25 bp, Homo sapiens
aggtgacactgggtccaggagctcc

SEQ ID NO: 25784 - DNA, 25 bp, Homo sapiens
ctgtcccatggatcctgaaactgca

SEQ ID NO: 25785 - DNA, 25 bp, Homo sapiens
ccctgttgcctgggctgacaggagc

SEQ ID NO: 25786 - DNA, 25 bp, Homo sapiens
ggggatgctgtggaaacctggctta

SEQ ID NO: 25787 - DNA, 25 bp, Homo sapiens
cttattcttctaaagccaccagcaa

SEQ ID NO: 25788 - DNA, 25 bp, Homo sapiens
gccaccagcaaattgtgcctaagcg

SEQ ID NO: 25789 - DNA, 25 bp, Homo sapiens
taaggaggtctctgtaccatggctc

SEQ ID NO: 25790 - DNA, 25 bp, Homo sapiens
caaagcagactgcccgcaaatcgac

SEQ ID NO: 25791 - DNA, 25 bp, Homo sapiens
agagtgcgccctctactggaggggt

SEQ ID NO: 25792 - DNA, 25 bp, Homo sapiens
aaacctcatcgttacaggcctggta

SEQ ID NO: 25793 - DNA, 25 bp, Homo sapiens
tactgtggcgctccgtgaaattaga

SEQ ID NO: 25794 - DNA, 25 bp, Homo sapiens
gaacttctgattcgcaaacttccct

SEQ ID NO: 25795 - DNA, 25 bp, Homo sapiens
aaaacagatctgcgcttccagagcg

SEQ ID NO: 25796 - DNA, 25 bp, Homo sapiens
cgcagctatcggtgctttgcaggag

SEQ ID NO: 25797 - DNA, 25 bp, Homo sapiens
gaagacaccaacctgtgtgctatcc

SEQ ID NO: 25798 - DNA, 25 bp, Homo sapiens
gtgctatccatgccaaacgtgtaac

SEQ ID NO: 25799 - DNA, 25 bp, Homo sapiens
gccaaaagacatccagctagcacgc

SEQ ID NO: 25800 - DNA, 25 bp, Homo sapiens
gtttattgccattatagcgcctgta

SEQ ID NO: 25801 - DNA, 25 bp, Homo sapiens
agtagatctgctttctgttcatctc

SEQ ID NO: 25802 - DNA, 25 bp, Homo sapiens
gttcatctctttgtcctgaatggct

SEQ ID NO: 25803 - DNA, 25 bp, Homo sapiens
ccctggatgcgcaagctgcacataa

SEQ ID NO: 25804 - DNA, 25 bp, Homo sapiens
tcatgacaacataggcggcccggaa

SEQ ID NO: 25805 - DNA, 25 bp, Homo sapiens
cgttacctgacccgcagaaggagga

SEQ ID NO: 25806 - DNA, 25 bp, Homo sapiens
aaatagcacatgctctttgcctctc

SEQ ID NO: 25807 - DNA, 25 bp, Homo sapiens
cgtccctgagtatctgagcgtttaa

SEQ ID NO: 25808 - DNA, 25 bp, Homo sapiens
tagcggatcccgcgtagtgtcagta

SEQ ID NO: 25809 - DNA, 25 bp, Homo sapiens
aggtgactttctgaaactcccttgt

SEQ ID NO: 25810 - DNA, 25 bp, Homo sapiens
tcgttgccctaattcatcttttaat

SEQ ID NO: 25811 - DNA, 25 bp, Homo sapiens
gaagtgaagtgatggactccgattt

SEQ ID NO: 25812 - DNA, 25 bp, Homo sapiens
gatggactccgatttggagagtagt

SEQ ID NO: 25813 - DNA, 25 bp, Homo sapiens
gtttaagcaccatggccttgatgat

SEQ ID NO: 25814 - DNA, 25 bp, Homo sapiens
ggccttgatgattcactgttgggga

SEQ ID NO: 25815 - DNA, 25 bp, Homo sapiens
gatgattcactgttggggagaagaa

SEQ ID NO: 25816 - DNA, 25 bp, Homo sapiens
gaaaagtaactggttgtcacctatg

SEQ ID NO: 25817 - DNA, 25 bp, Homo sapiens
actggttgtcacctatgagaccctt

SEQ ID NO: 25818 - DNA, 25 bp, Homo sapiens
ttgtcacctatgagacccttacgtg

SEQ ID NO: 25819 - DNA, 25 bp, Homo sapiens
acctatgagacccttacgtgattgt

SEQ ID NO: 25820 - DNA, 25 bp, Homo sapiens
gagacccttacgtgattgttagtta

SEQ ID NO: 25821 - DNA, 25 bp, Homo sapiens
ttcaaagcagctgtaatttagttaa

SEQ ID NO: 25822 - DNA, 25 bp, Homo sapiens
ggattggtctggtgtcagctgtgtt

SEQ ID NO: 25823 - DNA, 25 bp, Homo sapiens
attgcacacctaaatcctgattata

SEQ ID NO: 25824 - DNA, 25 bp, Homo sapiens
ttataggcttttcatttctccgcaa

SEQ ID NO: 25825 - DNA, 25 bp, Homo sapiens
ttctccgcaaagcctttattttggc

SEQ ID NO: 25826 - DNA, 25 bp, Homo sapiens
gtctgaccccaaacgttattgtcca

SEQ ID NO: 25827 - DNA, 25 bp, Homo sapiens
gactggacagcagcttttgtttctt

SEQ ID NO: 25828 - DNA, 25 bp, Homo sapiens
gcttttgtttcttgaccctgtaata

SEQ ID NO: 25829 - DNA, 25 bp, Homo sapiens
gggttatagtcgtgattttcgctaa

SEQ ID NO: 25830 - DNA, 25 bp, Homo sapiens
atgacttgtttctgttgtacttgag

SEQ ID NO: 25831 - DNA, 25 bp, Homo sapiens
gaacagactacgtgctcagcttaga

SEQ ID NO: 25832 - DNA, 25 bp, Homo sapiens
gaatctctagctgaccagtttgact

SEQ ID NO: 25833 - DNA, 25 bp, Homo sapiens
accgaccagatgtttgtgttctttc

SEQ ID NO: 25834 - DNA, 25 bp, Homo sapiens
accatcaaggtgtactgccagcgca

SEQ ID NO: 25835 - DNA, 25 bp, Homo sapiens
caaggtgtactgccagcgcatgcag

SEQ ID NO: 25836 - DNA, 25 bp, Homo sapiens
gcaggaggagaacatcacacgggct

SEQ ID NO: 25837 - DNA, 25 bp, Homo sapiens
aggagaacatcacacgggctctcat

SEQ ID NO: 25838 - DNA, 25 bp, Homo sapiens
gtggtgcagcagggcatgacaccct

SEQ ID NO: 25839 - DNA, 25 bp, Homo sapiens
tcatcaacatcacggagcacgagct

SEQ ID NO: 25840 - DNA, 25 bp, Homo sapiens
acatcacggagcacgagctagtccc

SEQ ID NO: 25841 - DNA, 25 bp, Homo sapiens
cctgagcacgtcgtcatgaccaagg

SEQ ID NO: 25842 - DNA, 25 bp, Homo sapiens
gcccagtgagacggctggcaggtac

SEQ ID NO: 25843 - DNA, 25 bp, Homo sapiens
tgagacggctggcaggtacatcacc

SEQ ID NO: 25844 - DNA, 25 bp, Homo sapiens
tgcgtgctcatccgaaagcggggga

SEQ ID NO: 25845 - DNA, 25 bp, Homo sapiens
gagccaggacagagggtggtcgtcg

SEQ ID NO: 25846 - DNA, 25 bp, Homo sapiens
agagggtggtcgtcgtggatgatct

SEQ ID NO: 25847 - DNA, 25 bp, Homo sapiens
ctccagctggatcccagggaaatat

SEQ ID NO: 25848 - DNA, 25 bp, Homo sapiens
gatcccagggaaatatcagccttgg

SEQ ID NO: 25849 - DNA, 25 bp, Homo sapiens
tcagccttgggcaactgcagtgacc

SEQ ID NO: 25850 - DNA, 25 bp, Homo sapiens
tgggcaactgcagtgaccaggggca

SEQ ID NO: 25851 - DNA, 25 bp, Homo sapiens
cacagggaacacattcctttgctgg

SEQ ID NO: 25852 - DNA, 25 bp, Homo sapiens
acacattcctttgctggggttcagc

SEQ ID NO: 25853 - DNA, 25 bp, Homo sapiens
tggggcaaagctgtgtttcagccac

SEQ ID NO: 25854 - DNA, 25 bp, Homo sapiens
aggcgtggtattcagggacatctcg

SEQ ID NO: 25855 - DNA, 25 bp, Homo sapiens
tttttaagacttcttgtctctctcc

SEQ ID NO: 25856 - DNA, 25 bp, Homo sapiens
aacgagtcctcaagttcagtatttt

SEQ ID NO: 25857 - DNA, 25 bp, Homo sapiens
tacaatacgtttctactttccctga

SEQ ID NO: 25858 - DNA, 25 bp, Homo sapiens
tgattttcaaactggttgcctgcat

SEQ ID NO: 25859 - DNA, 25 bp, Homo sapiens
ggaaggcacatttttgcactatatt

SEQ ID NO: 25860 - DNA, 25 bp, Homo sapiens
agtgcagcacgataggcgcttaacc

SEQ ID NO: 25861 - DNA, 25 bp, Homo sapiens
taggcgcttaaccagtattgccata

SEQ ID NO: 25862 - DNA, 25 bp, Homo sapiens
gtattgccatagaaactgcctcttt

SEQ ID NO: 25863 - DNA, 25 bp, Homo sapiens
aactgcctcttttcatgtgggatga

SEQ ID NO: 25864 - DNA, 25 bp, Homo sapiens
gacatttgcaagttcttgtatcctg

SEQ ID NO: 25865 - DNA, 25 bp, Homo sapiens
gctattacacctgctgtacacacac

SEQ ID NO: 25866 - DNA, 25 bp, Homo sapiens
cagttccggatccccatggaaatga

SEQ ID NO: 25867 - DNA, 25 bp, Homo sapiens
ggaaatgacaagggtggacctcagg

SEQ ID NO: 25868 - DNA, 25 bp, Homo sapiens
ggacctcaggaattacctcgagggc

SEQ ID NO: 25869 - DNA, 25 bp, Homo sapiens
gagggcatctataacgtgcccgtgg

SEQ ID NO: 25870 - DNA, 25 bp, Homo sapiens
tgctgtgcggacacgggtgcagcat

SEQ ID NO: 25871 - DNA, 25 bp, Homo sapiens
acgggtgcagcatggctctaacaag

SEQ ID NO: 25872 - DNA, 25 bp, Homo sapiens
gtgaggatcaagaagccggactaca

SEQ ID NO: 25873 - DNA, 25 bp, Homo sapiens
agaagccggactacaaggtcgccta

SEQ ID NO: 25874 - DNA, 25 bp, Homo sapiens
ttcccagatctgtttcccgagaaag

SEQ ID NO: 25875 - DNA, 25 bp, Homo sapiens
ttcccgagaaagacgagagccctga

SEQ ID NO: 25876 - DNA, 25 bp, Homo sapiens
agagcagtcccgacacctaaataaa

SEQ ID NO: 25877 - DNA, 25 bp, Homo sapiens
ggacagccagggtaaccaggagccg

SEQ ID NO: 25878 - DNA, 25 bp, Homo sapiens
ccgacaacaactcctgacgcaatgg

SEQ ID NO: 25879 - DNA, 25 bp, Homo sapiens
gacgcaatggttcagccttttacta

SEQ ID NO: 25880 - DNA, 25 bp, Homo sapiens
gtatggggtgccacacactcaagac

SEQ ID NO: 25881 - DNA, 25 bp, Homo sapiens
gactatgccggccagaccggtgagc

SEQ ID NO: 25882 - DNA, 25 bp, Homo sapiens
gtgagcataacctgacactctacgg

SEQ ID NO: 25883 - DNA, 25 bp, Homo sapiens
tctacggaagtacgcaagcccacgg

SEQ ID NO: 25884 - DNA, 25 bp, Homo sapiens
aaatctaccccgaaacggctgcatg

SEQ ID NO: 25885 - DNA, 25 bp, Homo sapiens
acggctgcatgtctctaatattcct

SEQ ID NO: 25886 - DNA, 25 bp, Homo sapiens
ccctgacctccggcagatgtttggg

SEQ ID NO: 25887 - DNA, 25 bp, Homo sapiens
ggatgcagaacgagcctctgactcc

SEQ ID NO: 25888 - DNA, 25 bp, Homo sapiens
agcacaggtgcacaggtcttagata

SEQ ID NO: 25889 - DNA, 25 bp, Homo sapiens
aggtcttagatatacagctcagtga

SEQ ID NO: 25890 - DNA, 25 bp, Homo sapiens
gaagcttcagaaatgcatgcatgca

SEQ ID NO: 25891 - DNA, 25 bp, Homo sapiens
atcaagatacggaagagcccagcac

SEQ ID NO: 25892 - DNA, 25 bp, Homo sapiens
tccatcatgcccctttgcagaaaat

SEQ ID NO: 25893 - DNA, 25 bp, Homo sapiens
tttgcagaaaatactgcctcctcca

SEQ ID NO: 25894 - DNA, 25 bp, Homo sapiens
gcctcctccagtaaacactattctg

SEQ ID NO: 25895 - DNA, 25 bp, Homo sapiens
agattagttttgcctcttcgtgaac

SEQ ID NO: 25896 - DNA, 25 bp, Homo sapiens
aactgtcctgtgtgatttcttgtat

SEQ ID NO: 25897 - DNA, 25 bp, Homo sapiens
atgggtggtgtgctattgtatcaac

SEQ ID NO: 25898 - DNA, 25 bp, Homo sapiens
ggtatttgggtggttttcagatttg

SEQ ID NO: 25899 - DNA, 25 bp, Homo sapiens
cgtcacttgcaacttgctattcgtg

SEQ ID NO: 25900 - DNA, 25 bp, Homo sapiens
aggatgcctggattccttgttatct

SEQ ID NO: 25901 - DNA, 25 bp, Homo sapiens
ttccttgttatctcaggactctaaa

SEQ ID NO: 25902 - DNA, 25 bp, Homo sapiens
aaatactctaacagctgtccagtgt

SEQ ID NO: 25903 - DNA, 25 bp, Homo sapiens
tgcaacttgctattcgtggagatga

SEQ ID NO: 25904 - DNA, 25 bp, Homo sapiens
tgcctttttgtaattctatttgagc

SEQ ID NO: 25905 - DNA, 25 bp, Homo sapiens
ccaaccaaccaaatttctgcattcg

SEQ ID NO: 25906 - DNA, 25 bp, Homo sapiens
tctgcattcgagtcttaaccatatt

SEQ ID NO: 25907 - DNA, 25 bp, Homo sapiens
atttaagtgttactgtggcttcaaa

SEQ ID NO: 25908 - DNA, 25 bp, Homo sapiens
gggttttgattgagttgactgtttt

SEQ ID NO: 25909 - DNA, 25 bp, Homo sapiens
ccactctggtggataagttcaataa

SEQ ID NO: 25910 - DNA, 25 bp, Homo sapiens
tgcaggtaagacctgctccggggtc

SEQ ID NO: 25911 - DNA, 25 bp, Homo sapiens
gggctgtcactaggagatccgtagc

SEQ ID NO: 25912 - DNA, 25 bp, Homo sapiens
gatccgtagcccagacggtgacttt

SEQ ID NO: 25913 - DNA, 25 bp, Homo sapiens
cggtgactttcgtatgagctattta

SEQ ID NO: 25914 - DNA, 25 bp, Homo sapiens
taactttattttcttcagaatctgc

SEQ ID NO: 25915 - DNA, 25 bp, Homo sapiens
atctgctgtagattgagctgtgcgt

SEQ ID NO: 25916 - DNA, 25 bp, Homo sapiens
gctgtgcgtgaaattgctagtaagt

SEQ ID NO: 25917 - DNA, 25 bp, Homo sapiens
agttctgacatgttaatgcgtctgt

SEQ ID NO: 25918 - DNA, 25 bp, Homo sapiens
aatgcgtctgtctttaaatctgaat

SEQ ID NO: 25919 - DNA, 25 bp, Homo sapiens
atctgaattgttaccataaacgtgt

SEQ ID NO: 25920 - DNA, 25 bp, Homo sapiens
ttaatggaacttgctggtctgtgga

SEQ ID NO: 25921 - DNA, 25 bp, Homo sapiens
ccaccgcctgccagtgtgagaggcg

SEQ ID NO: 25922 - DNA, 25 bp, Homo sapiens
gtgagaggcggccactttcatggca

SEQ ID NO: 25923 - DNA, 25 bp, Homo sapiens
ccttggaaaagtcctctcttcccag

SEQ ID NO: 25924 - DNA, 25 bp, Homo sapiens
tcccagctcctgattctggatctga

SEQ ID NO: 25925 - DNA, 25 bp, Homo sapiens
ctgagattctcagatcacaggcccc

SEQ ID NO: 25926 - DNA, 25 bp, Homo sapiens
gccatccatgcgtggacgctgtgtg

SEQ ID NO: 25927 - DNA, 25 bp, Homo sapiens
aggatgacgggatcccgcacaagct

SEQ ID NO: 25928 - DNA, 25 bp, Homo sapiens
caaagacccagtgtcatttgctcct

SEQ ID NO: 25929 - DNA, 25 bp, Homo sapiens
tgccttgcatattacttgagcttaa

SEQ ID NO: 25930 - DNA, 25 bp, Homo sapiens
taaataggagcctttctactggttt

SEQ ID NO: 25931 - DNA, 25 bp, Homo sapiens
aacctcagcagatctgagccaccgc

SEQ ID NO: 25932 - DNA, 25 bp, Homo sapiens
ctgctgagctgttgtcactgatcgg

SEQ ID NO: 25933 - DNA, 25 bp, Homo sapiens
tgggggggtagggtagcacaccagc

SEQ ID NO: 25934 - DNA, 25 bp, Homo sapiens
atagccttcctgggcacaactagct

SEQ ID NO: 25935 - DNA, 25 bp, Homo sapiens
atgggtctttattctgagtttccta

SEQ ID NO: 25936 - DNA, 25 bp, Homo sapiens
cagagataggggcccagtctccatg

SEQ ID NO: 25937 - DNA, 25 bp, Homo sapiens
aggggctcagaagctgcactaggcc

SEQ ID NO: 25938 - DNA, 25 bp, Homo sapiens
ccccatgtgtctccttgaattgatg

SEQ ID NO: 25939 - DNA, 25 bp, Homo sapiens
atgctcctgggagggatgcgtgact

SEQ ID NO: 25940 - DNA, 25 bp, Homo sapiens
gactatgtggtgttgcacccggggc

SEQ ID NO: 25941 - DNA, 25 bp, Homo sapiens
ggctgcaaacgtctccgtgcagccc

SEQ ID NO: 25942 - DNA, 25 bp, Homo sapiens
tgtcctgctctgagtatcctgagat

SEQ ID NO: 25943 - DNA, 25 bp, Homo sapiens
gaatctcatagcttgtcagctcatt

SEQ ID NO: 25944 - DNA, 25 bp, Homo sapiens
gcttgtcagctcatttgcagcttac

SEQ ID NO: 25945 - DNA, 25 bp, Homo sapiens
ggtttcttccacaaaaatgataagc

SEQ ID NO: 25946 - DNA, 25 bp, Homo sapiens
aatgataagccatcaccaaactcag

SEQ ID NO: 25947 - DNA, 25 bp, Homo sapiens
gaacaaaattctgttaccctggaag

SEQ ID NO: 25948 - DNA, 25 bp, Homo sapiens
gaagtcctgcttgtgaaagtttgcc

SEQ ID NO: 25949 - DNA, 25 bp, Homo sapiens
gttcccacaggtaaaaagcaggtgc

SEQ ID NO: 25950 - DNA, 25 bp, Homo sapiens
gtcccttgcagtttccagtaatgaa

SEQ ID NO: 25951 - DNA, 25 bp, Homo sapiens
ggtgaagtcttactcgttgctattt

SEQ ID NO: 25952 - DNA, 25 bp, Homo sapiens
gttgctatttagagtgactcgtcca

SEQ ID NO: 25953 - DNA, 25 bp, Homo sapiens
ggggaaaagacatttgttgcacaaa

SEQ ID NO: 25954 - DNA, 25 bp, Homo sapiens
tgctgagcctagttcctggtcagta

SEQ ID NO: 25955 - DNA, 25 bp, Homo sapiens
tgaacagtgcattttggctttggat

SEQ ID NO: 25956 - DNA, 25 bp, Homo sapiens
ggacaagcttgctgagtttctctac

SEQ ID NO: 25957 - DNA, 25 bp, Homo sapiens
gtttctctaccatattctgagcaca

SEQ ID NO: 25958 - DNA, 25 bp, Homo sapiens
cacacggtctcttttgttctaactt

SEQ ID NO: 25959 - DNA, 25 bp, Homo sapiens
ttttgttctaacttcagcttcactg

SEQ ID NO: 25960 - DNA, 25 bp, Homo sapiens
cagcttcactgacactgggttgagc

SEQ ID NO: 25961 - DNA, 25 bp, Homo sapiens
cactgggttgagcactactgtatgt

SEQ ID NO: 25962 - DNA, 25 bp, Homo sapiens
gacacaccagcccattagttgttaa

SEQ ID NO: 25963 - DNA, 25 bp, Homo sapiens
tttcatttgctattgtactttcatt

SEQ ID NO: 25964 - DNA, 25 bp, Homo sapiens
gtttctgtttcatgatccttatgta

SEQ ID NO: 25965 - DNA, 25 bp, Homo sapiens
gtgttccacatcattgacttactgc

SEQ ID NO: 25966 - DNA, 25 bp, Homo sapiens
taatctttcatgtagctttggctct

SEQ ID NO: 25967 - DNA, 25 bp, Homo sapiens
ctttggctctcctaaagacctcaaa

SEQ ID NO: 25968 - DNA, 25 bp, Homo sapiens
gtaggtaactccagctgttgcattt

SEQ ID NO: 25969 - DNA, 25 bp, Homo sapiens
gttgcatttatactgggaatcttca

SEQ ID NO: 25970 - DNA, 25 bp, Homo sapiens
agtactgttttagctgtgcatgtca

SEQ ID NO: 25971 - DNA, 25 bp, Homo sapiens
gtgcatgtcatatccacaaagactt

SEQ ID NO: 25972 - DNA, 25 bp, Homo sapiens
gacttttagcaggtgaactgttcca

SEQ ID NO: 25973 - DNA, 25 bp, Homo sapiens
gaactgttccaagactgacacaagg

SEQ ID NO: 25974 - DNA, 25 bp, Homo sapiens
aggatgtttcaaacttgcctctgtc

SEQ ID NO: 25975 - DNA, 25 bp, Homo sapiens
caaacttgcctctgtctgtagaaaa

SEQ ID NO: 25976 - DNA, 25 bp, Homo sapiens
gaaaatggctaaattcgtgatccgc

SEQ ID NO: 25977 - DNA, 25 bp, Homo sapiens
atggctaaattcgtgatccgcccag

SEQ ID NO: 25978 - DNA, 25 bp, Homo sapiens
gccgactgcagtgacatactgcggc

SEQ ID NO: 25979 - DNA, 25 bp, Homo sapiens
gtgacatactgcggctgatcaagga

SEQ ID NO: 25980 - DNA, 25 bp, Homo sapiens
ggaagaacaagtaatcttaactgaa

SEQ ID NO: 25981 - DNA, 25 bp, Homo sapiens
ttaactgaaaaagatctgctagaag

SEQ ID NO: 25982 - DNA, 25 bp, Homo sapiens
gaagatggttttggagagcacccct

SEQ ID NO: 25983 - DNA, 25 bp, Homo sapiens
ccttttaccactgcctggttgcaga

SEQ ID NO: 25984 - DNA, 25 bp, Homo sapiens
accactgcctggttgcagaagtgcc

SEQ ID NO: 25985 - DNA, 25 bp, Homo sapiens
tgcctggttgcagaagtgccgaaag

SEQ ID NO: 25986 - DNA, 25 bp, Homo sapiens
agtgccgaaagagcactggactccg

SEQ ID NO: 25987 - DNA, 25 bp, Homo sapiens
agttttgcttttgactccaggaaca

SEQ ID NO: 25988 - DNA, 25 bp, Homo sapiens
tctcagaagtccctgtttattccaa

SEQ ID NO: 25989 - DNA, 25 bp, Homo sapiens
agctgcacagtgttggtttccttgt

SEQ ID NO: 25990 - DNA, 25 bp, Homo sapiens
atggttatccaattgctctttcaca

SEQ ID NO: 25991 - DNA, 25 bp, Homo sapiens
attgctctttcacaggtagcctatt

SEQ ID NO: 25992 - DNA, 25 bp, Homo sapiens
ataaaaatctagcacactcttctct

SEQ ID NO: 25993 - DNA, 25 bp, Homo sapiens
gcctgaattggctatgcagtacatt

SEQ ID NO: 25994 - DNA, 25 bp, Homo sapiens
accagttttccagaacactcttagc

SEQ ID NO: 25995 - DNA, 25 bp, Homo sapiens
tgacatgaggcagttccttccaggt

SEQ ID NO: 25996 - DNA, 25 bp, Homo sapiens
ccttccaggtgattctgtttcctta

SEQ ID NO: 25997 - DNA, 25 bp, Homo sapiens
ttattgttatctttacctcctgagt

SEQ ID NO: 25998 - DNA, 25 bp, Homo sapiens
gaaatttgtttggacttccacttga

SEQ ID NO: 25999 - DNA, 25 bp, Homo sapiens
ccaatttacatccacattttaggtc

SEQ ID NO: 26000 - DNA, 25 bp, Homo sapiens
acatccacattttaggtccaacagc

SEQ ID NO: 26001 - DNA, 25 bp, Homo sapiens
ggtccaacagcaagaagttcagaga

SEQ ID NO: 26002 - DNA, 25 bp, Homo sapiens
gagagagatttcccaaccagacatt

SEQ ID NO: 26003 - DNA, 25 bp, Homo sapiens
caaccagacattgggtcactcactg

SEQ ID NO: 26004 - DNA, 25 bp, Homo sapiens
agacattgggtcactcactggtcac

SEQ ID NO: 26005 - DNA, 25 bp, Homo sapiens
caccttgccagtgcattttattaga

SEQ ID NO: 26006 - DNA, 25 bp, Homo sapiens
agaagggaatctgttgtagcaaatg

SEQ ID NO: 26007 - DNA, 25 bp, Homo sapiens
gtagcaaatgggaataaacctgggt

SEQ ID NO: 26008 - DNA, 25 bp, Homo sapiens
taaacctgggtttctatagacccag

SEQ ID NO: 26009 - DNA, 25 bp, Homo sapiens
gtatttggtcccagttgggtacatt

SEQ ID NO: 26010 - DNA, 25 bp, Homo sapiens
tcctgattttggagacttaaaacca

SEQ ID NO: 26011 - DNA, 25 bp, Homo sapiens
atgggtaacatgactcttgttggat

SEQ ID NO: 26012 - DNA, 25 bp, Homo sapiens
atgactcttgttggattgttatttt

SEQ ID NO: 26013 - DNA, 25 bp, Homo sapiens
tattttttgtttgcaatggggaatt

SEQ ID NO: 26014 - DNA, 25 bp, Homo sapiens
gaagcatcaagtctctttcttacca

SEQ ID NO: 26015 - DNA, 25 bp, Homo sapiens
ttcttaccaaagtcttgttaggtgg

SEQ ID NO: 26016 - DNA, 25 bp, Homo sapiens
taggtggtttatagttcttttggct

SEQ ID NO: 26017 - DNA, 25 bp, Homo sapiens
gacttccacttgagacagtaaagag

SEQ ID NO: 26018 - DNA, 25 bp, Homo sapiens
agagagtattagacacccagtaaaa

SEQ ID NO: 26019 - DNA, 25 bp, Homo sapiens
ttagacacccagtaaaaactgccat

SEQ ID NO: 26020 - DNA, 25 bp, Homo sapiens
gccgaactgtcaccgaacgtacagc

SEQ ID NO: 26021 - DNA, 25 bp, Homo sapiens
cgtacagctgtatccactgcagagc

SEQ ID NO: 26022 - DNA, 25 bp, Homo sapiens
acacctggccaatcatgacgagctc

SEQ ID NO: 26023 - DNA, 25 bp, Homo sapiens
tccaagtcctttcaggggagccagg

SEQ ID NO: 26024 - DNA, 25 bp, Homo sapiens
tgcatgcggttgccgacatctactg

SEQ ID NO: 26025 - DNA, 25 bp, Homo sapiens
gagtaatgtgcgaactttcccttct

SEQ ID NO: 26026 - DNA, 25 bp, Homo sapiens
taggagcatctggtgacagcctttc

SEQ ID NO: 26027 - DNA, 25 bp, Homo sapiens
gccctctgacctcaaaggctagctg

SEQ ID NO: 26028 - DNA, 25 bp, Homo sapiens
tagctgcgcatagctcttgacactc

SEQ ID NO: 26029 - DNA, 25 bp, Homo sapiens
tgtgggtaaggtgtccctcggatct

SEQ ID NO: 26030 - DNA, 25 bp, Homo sapiens
tgtcctcttcgtgtacacagttgtt

SEQ ID NO: 26031 - DNA, 25 bp, Homo sapiens
ggagccggaggtggcaattcaccga

SEQ ID NO: 26032 - DNA, 25 bp, Homo sapiens
caattcaccgaattcgaatcaccct

SEQ ID NO: 26033 - DNA, 25 bp, Homo sapiens
gacgcggtcgtaagggctgaggatt

SEQ ID NO: 26034 - DNA, 25 bp, Homo sapiens
gaaaggaccagttcgaatgcctacc

SEQ ID NO: 26035 - DNA, 25 bp, Homo sapiens
gttcgaatgcctaccaagactttga

SEQ ID NO: 26036 - DNA, 25 bp, Homo sapiens
gacgtgggatcgtttccagatgaga

SEQ ID NO: 26037 - DNA, 25 bp, Homo sapiens
gaattcacaagcgactcattgactt

SEQ ID NO: 26038 - DNA, 25 bp, Homo sapiens
gacttgcacagtccttctgagattg

SEQ ID NO: 26039 - DNA, 25 bp, Homo sapiens
gattacttccatcagtattgagcca

SEQ ID NO: 26040 - DNA, 25 bp, Homo sapiens
gtggaagtcaccattgcagatgctt

SEQ ID NO: 26041 - DNA, 25 bp, Homo sapiens
cgctctcgccgaggaacaagtcggt

SEQ ID NO: 26042 - DNA, 25 bp, Homo sapiens
ttccccagcccagggtggacttaga

SEQ ID NO: 26043 - DNA, 25 bp, Homo sapiens
ggtggacttagaaagcaggggctac

SEQ ID NO: 26044 - DNA, 25 bp, Homo sapiens
gggctacaagagggaatccccgaag

SEQ ID NO: 26045 - DNA, 25 bp, Homo sapiens
gaatccccgaaggtgctggaggtgg

SEQ ID NO: 26046 - DNA, 25 bp, Homo sapiens
gagaggcagagagcggtctcaggct

SEQ ID NO: 26047 - DNA, 25 bp, Homo sapiens
gagaaagccaggcaggtagccaggg

SEQ ID NO: 26048 - DNA, 25 bp, Homo sapiens
caggctggtgggaggggcgcccacc

SEQ ID NO: 26049 - DNA, 25 bp, Homo sapiens
ccctgctgcaggggctctggagaga

SEQ ID NO: 26050 - DNA, 25 bp, Homo sapiens
ggcaggtagccagggggactagccc

SEQ ID NO: 26051 - DNA, 25 bp, Homo sapiens
ggactagcccctgtggagactgggg

SEQ ID NO: 26052 - DNA, 25 bp, Homo sapiens
tggggggcttgaaattgtccccgtg

SEQ ID NO: 26053 - DNA, 25 bp, Homo sapiens
caagatggtagctgccatccctggg

SEQ ID NO: 26054 - DNA, 25 bp, Homo sapiens
actcctcctatcggggtgtagaagg

SEQ ID NO: 26055 - DNA, 25 bp, Homo sapiens
agaggtcaactcagtggaacacggt

SEQ ID NO: 26056 - DNA, 25 bp, Homo sapiens
gaacacggttctcccaaacagattt

SEQ ID NO: 26057 - DNA, 25 bp, Homo sapiens
gtaattccgaaaatccacgcatgcg

SEQ ID NO: 26058 - DNA, 25 bp, Homo sapiens
aatccacgcatgcgcaaacatacgc

SEQ ID NO: 26059 - DNA, 25 bp, Homo sapiens
aacatacgcatacactcccatgttc

SEQ ID NO: 26060 - DNA, 25 bp, Homo sapiens
gttcctggacagtttatagctacca

SEQ ID NO: 26061 - DNA, 25 bp, Homo sapiens
gctaccataacctggcattttccaa

SEQ ID NO: 26062 - DNA, 25 bp, Homo sapiens
acataccatgtagactcttggatac

SEQ ID NO: 26063 - DNA, 25 bp, Homo sapiens
ttcccccactggctgtattatagga

SEQ ID NO: 26064 - DNA, 25 bp, Homo sapiens
acagcatggtggtggaacaccccga

SEQ ID NO: 26065 - DNA, 25 bp, Homo sapiens
gcatggtggtggaacaccccgagtt

SEQ ID NO: 26066 - DNA, 25 bp, Homo sapiens
tggcctgcagatctggcgtgtggag

SEQ ID NO: 26067 - DNA, 25 bp, Homo sapiens
gcagatctggcgtgtggagaagttc

SEQ ID NO: 26068 - DNA, 25 bp, Homo sapiens
tgtggagaagttcgatctggtgccc

SEQ ID NO: 26069 - DNA, 25 bp, Homo sapiens
cgtgcccaccaacctttatggagac

SEQ ID NO: 26070 - DNA, 25 bp, Homo sapiens
caccaacctttatggagacttcttc

SEQ ID NO: 26071 - DNA, 25 bp, Homo sapiens
aagacagtgcagctgaggaacggaa

SEQ ID NO: 26072 - DNA, 25 bp, Homo sapiens
acagtgcagctgaggaacggaaatc

SEQ ID NO: 26073 - DNA, 25 bp, Homo sapiens
atctgcagtatgacctccactactg

SEQ ID NO: 26074 - DNA, 25 bp, Homo sapiens
tgcagtatgacctccactactggct

SEQ ID NO: 26075 - DNA, 25 bp, Homo sapiens
gaaggggaagggttgggtgctgacg

SEQ ID NO: 26076 - DNA, 25 bp, Homo sapiens
gggtgctgacgggcaggagcacaaa

SEQ ID NO: 26077 - DNA, 25 bp, Homo sapiens
cacattcgatgtgttccgacagagg

SEQ ID NO: 26078 - DNA, 25 bp, Homo sapiens
acaagcgggccaacaaatagatcaa

SEQ ID NO: 26079 - DNA, 25 bp, Homo sapiens
aagccttgaagcagcaattgccctt

SEQ ID NO: 26080 - DNA, 25 bp, Homo sapiens
aattgcccttaaaacatcatccctg

SEQ ID NO: 26081 - DNA, 25 bp, Homo sapiens
tcacccccgagaggacaacaggcat

SEQ ID NO: 26082 - DNA, 25 bp, Homo sapiens
acaggcatctggaagtgctctctcg

SEQ ID NO: 26083 - DNA, 25 bp, Homo sapiens
tctggcttgtttccatcactggaaa

SEQ ID NO: 26084 - DNA, 25 bp, Homo sapiens
gaattgtagtgtttttggtccttga

SEQ ID NO: 26085 - DNA, 25 bp, Homo sapiens
tgttgttaatcatttagccgttgca

SEQ ID NO: 26086 - DNA, 25 bp, Homo sapiens
gaatggtggactcatctttggttaa

SEQ ID NO: 26087 - DNA, 25 bp, Homo sapiens
tatctgtgtgtagaccactgcttcc

SEQ ID NO: 26088 - DNA, 25 bp, Homo sapiens
agaccactgcttcccagagtatgat

SEQ ID NO: 26089 - DNA, 25 bp, Homo sapiens
agtttgtttctgctgattacacccg

SEQ ID NO: 26090 - DNA, 25 bp, Homo sapiens
gacgccttagataacagccatccta

SEQ ID NO: 26091 - DNA, 25 bp, Homo sapiens
attgaagtcagtgtgggccatccat

SEQ ID NO: 26092 - DNA, 25 bp, Homo sapiens
tgtgggccatccatctgaggttgat

SEQ ID NO: 26093 - DNA, 25 bp, Homo sapiens
gtgcatctgtcatccgaatgctgca

SEQ ID NO: 26094 - DNA, 25 bp, Homo sapiens
ccaaaaattcctgttcttcatcccg

SEQ ID NO: 26095 - DNA, 25 bp, Homo sapiens
ctgccgcaggtaatctttaatagct

SEQ ID NO: 26096 - DNA, 25 bp, Homo sapiens
attgtcactctatccaggctgggac

SEQ ID NO: 26097 - DNA, 25 bp, Homo sapiens
gatggactctgtgactacatgacta

SEQ ID NO: 26098 - DNA, 25 bp, Homo sapiens
aagcccaggccttaggagacaggca

SEQ ID NO: 26099 - DNA, 25 bp, Homo sapiens
gttcagtcttttggagggtcagctc

SEQ ID NO: 26100 - DNA, 25 bp, Homo sapiens
ctcagccatcacgcatggagtccaa

SEQ ID NO: 26101 - DNA, 25 bp, Homo sapiens
ccaccctgagacgtcatgctggaga

SEQ ID NO: 26102 - DNA, 25 bp, Homo sapiens
ctgagacgtcatgctggagacccac

SEQ ID NO: 26103 - DNA, 25 bp, Homo sapiens
acctgtggatgccccagtcaagagt

SEQ ID NO: 26104 - DNA, 25 bp, Homo sapiens
cttcaccaacttcacttgatgctgt

SEQ ID NO: 26105 - DNA, 25 bp, Homo sapiens
ccaacttcacttgatgctgtgagga

SEQ ID NO: 26106 - DNA, 25 bp, Homo sapiens
gtgaggaacagaactgcccatccaa

SEQ ID NO: 26107 - DNA, 25 bp, Homo sapiens
gccagaatttctaacccacaaagcc

SEQ ID NO: 26108 - DNA, 25 bp, Homo sapiens
tattccaggtagacatcccagagca

SEQ ID NO: 26109 - DNA, 25 bp, Homo sapiens
aggtagacatcccagagcacctgat

SEQ ID NO: 26110 - DNA, 25 bp, Homo sapiens
cacctgatccctttggggcatgaag

SEQ ID NO: 26111 - DNA, 25 bp, Homo sapiens
gtgtgatgcctccttaggcacacag

SEQ ID NO: 26112 - DNA, 25 bp, Homo sapiens
ggcacacaggcaatgtctcaagtac

SEQ ID NO: 26113 - DNA, 25 bp, Homo sapiens
ggcaaagctgccagtaaatgtctca

SEQ ID NO: 26114 - DNA, 25 bp, Homo sapiens
aatgtctcagcattgctgctaattt

SEQ ID NO: 26115 - DNA, 25 bp, Homo sapiens
gctgctaattttggtcctgctagtt

SEQ ID NO: 26116 - DNA, 25 bp, Homo sapiens
ggtcctgctagtttctggattgtac

SEQ ID NO: 26117 - DNA, 25 bp, Homo sapiens
gggactcgttgacattggggaaact

SEQ ID NO: 26118 - DNA, 25 bp, Homo sapiens
gaaactttgcaatgccccgaagact

SEQ ID NO: 26119 - DNA, 25 bp, Homo sapiens
gccagaagtaagcttgctcttttcc

SEQ ID NO: 26120 - DNA, 25 bp, Homo sapiens
tggctgaccatcacgaggctgaata

SEQ ID NO: 26121 - DNA, 25 bp, Homo sapiens
tggctgccgtgtatgagcatccatc

SEQ ID NO: 26122 - DNA, 25 bp, Homo sapiens
tcatcagccgccaagaggccttgga

SEQ ID NO: 26123 - DNA, 25 bp, Homo sapiens
aagaggccttggagctcatgaacca

SEQ ID NO: 26124 - DNA, 25 bp, Homo sapiens
gaaccagaaccttgacatctatgaa

SEQ ID NO: 26125 - DNA, 25 bp, Homo sapiens
atggcattcatggattcaactttac

SEQ ID NO: 26126 - DNA, 25 bp, Homo sapiens
caagaacatccatttatccattttt

SEQ ID NO: 26127 - DNA, 25 bp, Homo sapiens
ccatttttggacttcatgccgtctc

SEQ ID NO: 26128 - DNA, 25 bp, Homo sapiens
aggtggtcaggtggaacccatgcct

SEQ ID NO: 26129 - DNA, 25 bp, Homo sapiens
gcctcaccgcttcaatgacacagag

SEQ ID NO: 26130 - DNA, 25 bp, Homo sapiens
tttttccaggctttaggtatcacca

SEQ ID NO: 26131 - DNA, 25 bp, Homo sapiens
ggtatcaccactaaaatctccaggg

SEQ ID NO: 26132 - DNA, 25 bp, Homo sapiens
caccactaaaatctccaggggcacc

SEQ ID NO: 26133 - DNA, 25 bp, Homo sapiens
taaaatctccaggggcaccattgaa

SEQ ID NO: 26134 - DNA, 25 bp, Homo sapiens
atctccaggggcaccattgaaatcc

SEQ ID NO: 26135 - DNA, 25 bp, Homo sapiens
ccattgccccatgtgaagtcactgt

SEQ ID NO: 26136 - DNA, 25 bp, Homo sapiens
ccccatgtgaagtcactgtgccagc

SEQ ID NO: 26137 - DNA, 25 bp, Homo sapiens
ccagcccagaacactggtctcgggc

SEQ ID NO: 26138 - DNA, 25 bp, Homo sapiens
agcccagaacactggtctcgggccc

SEQ ID NO: 26139 - DNA, 25 bp, Homo sapiens
gaacactggtctcgggcccgagaag

SEQ ID NO: 26140 - DNA, 25 bp, Homo sapiens
tggtctcgggcccgagaagacctcc

SEQ ID NO: 26141 - DNA, 25 bp, Homo sapiens
aaatgtgttacactcagccaggctg

SEQ ID NO: 26142 - DNA, 25 bp, Homo sapiens
cagccaggctgctgggggatgcttc

SEQ ID NO: 26143 - DNA, 25 bp, Homo sapiens
gggatgcttcagtttcctttacaga

SEQ ID NO: 26144 - DNA, 25 bp, Homo sapiens
actgcgtggtgggaatccaggccaa

SEQ ID NO: 26145 - DNA, 25 bp, Homo sapiens
gagtctctaatgttggtgacagctc

SEQ ID NO: 26146 - DNA, 25 bp, Homo sapiens
gacagctctcaatcctcatataggg

SEQ ID NO: 26147 - DNA, 25 bp, Homo sapiens
aactgctatcgaacttggctatctc

SEQ ID NO: 26148 - DNA, 25 bp, Homo sapiens
ggctatctcacagcagagcagtttg

SEQ ID NO: 26149 - DNA, 25 bp, Homo sapiens
tgctgggtccaaagtgatttacata

SEQ ID NO: 26150 - DNA, 25 bp, Homo sapiens
tgaacttaagcatctctagcagagc

SEQ ID NO: 26151 - DNA, 25 bp, Homo sapiens
gagtctctaatgttttcaagccaat

SEQ ID NO: 26152 - DNA, 25 bp, Homo sapiens
tccaatcccacaccatcaggaagaa

SEQ ID NO: 26153 - DNA, 25 bp, Homo sapiens
aggaagaaggtgcctgtcggggctc

SEQ ID NO: 26154 - DNA, 25 bp, Homo sapiens
tcggggctcacttgaagcctgtcag

SEQ ID NO: 26155 - DNA, 25 bp, Homo sapiens
aacacaacgccaacagaagcacatt

SEQ ID NO: 26156 - DNA, 25 bp, Homo sapiens
cacatttgtcttccagaacaccgtg

SEQ ID NO: 26157 - DNA, 25 bp, Homo sapiens
gaacaccgtgccttagaaatgcttt

SEQ ID NO: 26158 - DNA, 25 bp, Homo sapiens
ggaattagctatcttagtgccaact

SEQ ID NO: 26159 - DNA, 25 bp, Homo sapiens
tagtgccaactgctttttatttttt

SEQ ID NO: 26160 - DNA, 25 bp, Homo sapiens
gttattttttatcactactctggga

SEQ ID NO: 26161 - DNA, 25 bp, Homo sapiens
tactctgggaaatggtttgtcttca

SEQ ID NO: 26162 - DNA, 25 bp, Homo sapiens
aaagatacctggtctgccttgtaca

SEQ ID NO: 26163 - DNA, 25 bp, Homo sapiens
gacgcctgcagacatttacagagcc

SEQ ID NO: 26164 - DNA, 25 bp, Homo sapiens
cagagcctttgttgatgttgtgaat

SEQ ID NO: 26165 - DNA, 25 bp, Homo sapiens
ggagaatatgtccctcgcaaatcca

SEQ ID NO: 26166 - DNA, 25 bp, Homo sapiens
cgcaaatccatcctgaagtctcgaa

SEQ ID NO: 26167 - DNA, 25 bp, Homo sapiens
gaagccacttgcagtgacaccagtg

SEQ ID NO: 26168 - DNA, 25 bp, Homo sapiens
acttttgcccttatcagtaacacct

SEQ ID NO: 26169 - DNA, 25 bp, Homo sapiens
gtaacacctgaggttttgcggctag

SEQ ID NO: 26170 - DNA, 25 bp, Homo sapiens
ggttttgcggctagttggctattca

SEQ ID NO: 26171 - DNA, 25 bp, Homo sapiens
tggctattcaagaaacctcgcccct

SEQ ID NO: 26172 - DNA, 25 bp, Homo sapiens
gcccctctgaatgtcatactgtaat

SEQ ID NO: 26173 - DNA, 25 bp, Homo sapiens
aacagcactggcagtggccactctg

SEQ ID NO: 26174 - DNA, 25 bp, Homo sapiens
cccggagcgctaggagcgcgcggaa

SEQ ID NO: 26175 - DNA, 25 bp, Homo sapiens
aggagccatggctctggacgggata

SEQ ID NO: 26176 - DNA, 25 bp, Homo sapiens
aaggatgccagatggctgctacgcg

SEQ ID NO: 26177 - DNA, 25 bp, Homo sapiens
tgctacgcggacgggacgtgggaac

SEQ ID NO: 26178 - DNA, 25 bp, Homo sapiens
gggaactgagtgtccatgtgacgga

SEQ ID NO: 26179 - DNA, 25 bp, Homo sapiens
atgtgacggacctgaaccgcgatgt

SEQ ID NO: 26180 - DNA, 25 bp, Homo sapiens
gatgtcaccctgagagtgaccggcg

SEQ ID NO: 26181 - DNA, 25 bp, Homo sapiens
gaccggcgaggtgcacattggaggc

SEQ ID NO: 26182 - DNA, 25 bp, Homo sapiens
agattggtctgaccatgctctctgg

SEQ ID NO: 26183 - DNA, 25 bp, Homo sapiens
gcagatgctaagcttcagttcaccc

SEQ ID NO: 26184 - DNA, 25 bp, Homo sapiens
atatcagacaccccgaagaactttc

SEQ ID NO: 26185 - DNA, 25 bp, Homo sapiens
gatactaattatacactcaacacag

SEQ ID NO: 26186 - DNA, 25 bp, Homo sapiens
cactcaacacagattccttggactg

SEQ ID NO: 26187 - DNA, 25 bp, Homo sapiens
atgaccacctaatggatttccttgc

SEQ ID NO: 26188 - DNA, 25 bp, Homo sapiens
ggagtacattacttttcttgaagac

SEQ ID NO: 26189 - DNA, 25 bp, Homo sapiens
gaagacctcaagagttttgtcaaga

SEQ ID NO: 26190 - DNA, 25 bp, Homo sapiens
caagagccagtagagcagacagatg

SEQ ID NO: 26191 - DNA, 25 bp, Homo sapiens
gacagatgctgaaagccatagtttc

SEQ ID NO: 26192 - DNA, 25 bp, Homo sapiens
catagtttcatggcaggctttggcc

SEQ ID NO: 26193 - DNA, 25 bp, Homo sapiens
aggctttggccagtgaacaaatcct

SEQ ID NO: 26194 - DNA, 25 bp, Homo sapiens
aatcctactctgaagctagacatgt

SEQ ID NO: 26195 - DNA, 25 bp, Homo sapiens
gattatcatcctaatatcatggggg

SEQ ID NO: 26196 - DNA, 25 bp, Homo sapiens
tctggtcgccggccaaggaaaaacg

SEQ ID NO: 26197 - DNA, 25 bp, Homo sapiens
gaaaaacgaggctggaccctgaaca

SEQ ID NO: 26198 - DNA, 25 bp, Homo sapiens
ccacatgccgttggcaaccacaggt

SEQ ID NO: 26199 - DNA, 25 bp, Homo sapiens
ggcaaccacaggtcattcagcgaca

SEQ ID NO: 26200 - DNA, 25 bp, Homo sapiens
cagcgacaagaatggcctcaccagc

SEQ ID NO: 26201 - DNA, 25 bp, Homo sapiens
gcctcaccagcaagcgggagctgcg

SEQ ID NO: 26202 - DNA, 25 bp, Homo sapiens
ggagctgcggcccgaagatgacatg

SEQ ID NO: 26203 - DNA, 25 bp, Homo sapiens
aggaagctttgacaggtccatacct

SEQ ID NO: 26204 - DNA, 25 bp, Homo sapiens
atatcatgcgcacaatcattgagtt

SEQ ID NO: 26205 - DNA, 25 bp, Homo sapiens
tgagtttctgtctttcttgcatctc

SEQ ID NO: 26206 - DNA, 25 bp, Homo sapiens
ttgcatctcaaagaggccggtgccc

SEQ ID NO: 26207 - DNA, 25 bp, Homo sapiens
tagtgctcccagactcaacactggg

SEQ ID NO: 26208 - DNA, 25 bp, Homo sapiens
gactcaacactgggactctgagttc

SEQ ID NO: 26209 - DNA, 25 bp, Homo sapiens
ggacaggcctcactagtcttgaggc

SEQ ID NO: 26210 - DNA, 25 bp, Homo sapiens
cactagtcttgaggcccagcctagg

SEQ ID NO: 26211 - DNA, 25 bp, Homo sapiens
tgaggcccagcctaggatggtagtc

SEQ ID NO: 26212 - DNA, 25 bp, Homo sapiens
ggcccagcctaggatggtagtcagg

SEQ ID NO: 26213 - DNA, 25 bp, Homo sapiens
ggtagtcaggggaaggagcgagatt

SEQ ID NO: 26214 - DNA, 25 bp, Homo sapiens
ggagcgagattccaacttcaacatc

SEQ ID NO: 26215 - DNA, 25 bp, Homo sapiens
gattccaacttcaacatctgtgacc

SEQ ID NO: 26216 - DNA, 25 bp, Homo sapiens
caacttcaacatctgtgacctcaag

SEQ ID NO: 26217 - DNA, 25 bp, Homo sapiens
ccctgctgcccaactggatggaaaa

SEQ ID NO: 26218 - DNA, 25 bp, Homo sapiens
acttaggtaattgtagggcgaggat

SEQ ID NO: 26219 - DNA, 25 bp, Homo sapiens
aaatcacttagcagcaactgaagac

SEQ ID NO: 26220 - DNA, 25 bp, Homo sapiens
gaagacaattatcaaccacgtggag

SEQ ID NO: 26221 - DNA, 25 bp, Homo sapiens
aaatcaaaccgagcagggctgtgtg

SEQ ID NO: 26222 - DNA, 25 bp, Homo sapiens
gcagggctgtgtgaaacatggttgt

SEQ ID NO: 26223 - DNA, 25 bp, Homo sapiens
acatggttgtaatatgcgactgcga

SEQ ID NO: 26224 - DNA, 25 bp, Homo sapiens
tatgcgactgcgaacactgaactct

SEQ ID NO: 26225 - DNA, 25 bp, Homo sapiens
tgcgaacactgaactctacgccact

SEQ ID NO: 26226 - DNA, 25 bp, Homo sapiens
aggtgtcatggactgttgccaccat

SEQ ID NO: 26227 - DNA, 25 bp, Homo sapiens
gccaccatgtattcatccagagttc

SEQ ID NO: 26228 - DNA, 25 bp, Homo sapiens
agcatgctttctttgagttttaaat

SEQ ID NO: 26229 - DNA, 25 bp, Homo sapiens
agaggccacagatcaccatcaatga

SEQ ID NO: 26230 - DNA, 25 bp, Homo sapiens
aaggaggatgtcatctccactctgc

SEQ ID NO: 26231 - DNA, 25 bp, Homo sapiens
tacctcaatctcatcaactactaca

SEQ ID NO: 26232 - DNA, 25 bp, Homo sapiens
ccagtacatcctcacactgtcagag

SEQ ID NO: 26233 - DNA, 25 bp, Homo sapiens
tgcggatcgactccaagtgtctgca

SEQ ID NO: 26234 - DNA, 25 bp, Homo sapiens
gcacttcactcccaaggactggagc

SEQ ID NO: 26235 - DNA, 25 bp, Homo sapiens
gaagtggtgaccagacactgcccac

SEQ ID NO: 26236 - DNA, 25 bp, Homo sapiens
tgcccactgcagtgccaagacggca

SEQ ID NO: 26237 - DNA, 25 bp, Homo sapiens
ggctgcaaaaatttctggcttctct

SEQ ID NO: 26238 - DNA, 25 bp, Homo sapiens
cctcctatcctatcgaagctactgg

SEQ ID NO: 26239 - DNA, 25 bp, Homo sapiens
tggtcccagaccatcctggagatcc

SEQ ID NO: 26240 - DNA, 25 bp, Homo sapiens
atgctgtttgggtacaagccctcca

SEQ ID NO: 26241 - DNA, 25 bp, Homo sapiens
ggtacaagccctccaagatagaagt

SEQ ID NO: 26242 - DNA, 25 bp, Homo sapiens
aagtggattctgtgatgtcttcaat

SEQ ID NO: 26243 - DNA, 25 bp, Homo sapiens
acttctggtatattactcgaggggt

SEQ ID NO: 26244 - DNA, 25 bp, Homo sapiens
agcctttgacacctactatcgtgga

SEQ ID NO: 26245 - DNA, 25 bp, Homo sapiens
ttaggcaggtggctcccaaattacc

SEQ ID NO: 26246 - DNA, 25 bp, Homo sapiens
gagattcagatggtcacgtcagctt

SEQ ID NO: 26247 - DNA, 25 bp, Homo sapiens
gtcacgtcagctttagagactttga

SEQ ID NO: 26248 - DNA, 25 bp, Homo sapiens
gagactttgaatatgccctgaacta

SEQ ID NO: 26249 - DNA, 25 bp, Homo sapiens
ggaagcctaactattgtgaactact

SEQ ID NO: 26250 - DNA, 25 bp, Homo sapiens
atgtcagcagactctactctactaa

SEQ ID NO: 26251 - DNA, 25 bp, Homo sapiens
agctcagcgcctttttgcgaaactc

SEQ ID NO: 26252 - DNA, 25 bp, Homo sapiens
tgcgaaactctactattcctcatct

SEQ ID NO: 26253 - DNA, 25 bp, Homo sapiens
atctcctgtgcagtgggacgactcg

SEQ ID NO: 26254 - DNA, 25 bp, Homo sapiens
aagtcaggtcacgattatgggccca

SEQ ID NO: 26255 - DNA, 25 bp, Homo sapiens
aaaatgatccctatgctcttgcatc

SEQ ID NO: 26256 - DNA, 25 bp, Homo sapiens
cagatcagccagcaaaactcccaga

SEQ ID NO: 26257 - DNA, 25 bp, Homo sapiens
ttgggcaactccgaatgtttccttc

SEQ ID NO: 26258 - DNA, 25 bp, Homo sapiens
tacttcttggattgttggttctcgc

SEQ ID NO: 26259 - DNA, 25 bp, Homo sapiens
tggttctcgccattttaaccttagc

SEQ ID NO: 26260 - DNA, 25 bp, Homo sapiens
cagagccagacctcctcaggaggac

SEQ ID NO: 26261 - DNA, 25 bp, Homo sapiens
gacaaatgacaagacccctgaggca

SEQ ID NO: 26262 - DNA, 25 bp, Homo sapiens
gcaaagcggcgcaggccggagtggc

SEQ ID NO: 26263 - DNA, 25 bp, Homo sapiens
caggagccggcatcatggattcctt

SEQ ID NO: 26264 - DNA, 25 bp, Homo sapiens
gactgggtgctgagcatcgatggcg

SEQ ID NO: 26265 - DNA, 25 bp, Homo sapiens
ggtgctgagcatcgatggcgagaat

SEQ ID NO: 26266 - DNA, 25 bp, Homo sapiens
tggcgagaatgcgggtagcctcaca

SEQ ID NO: 26267 - DNA, 25 bp, Homo sapiens
tagcctcacacacatcgaagctcag

SEQ ID NO: 26268 - DNA, 25 bp, Homo sapiens
cctcacacacatcgaagctcagaac

SEQ ID NO: 26269 - DNA, 25 bp, Homo sapiens
gaagctcagaacaagatccgggcct

SEQ ID NO: 26270 - DNA, 25 bp, Homo sapiens
tcagaacaagatccgggcctgcggg

SEQ ID NO: 26271 - DNA, 25 bp, Homo sapiens
cttccggctgcaagggggcaaggac

SEQ ID NO: 26272 - DNA, 25 bp, Homo sapiens
ccggctgcaagggggcaaggacttc

SEQ ID NO: 26273 - DNA, 25 bp, Homo sapiens
gcaacgggtgactggaagggcctga

SEQ ID NO: 26274 - DNA, 25 bp, Homo sapiens
gaccattcagaacagacaggcccag

SEQ ID NO: 26275 - DNA, 25 bp, Homo sapiens
ggcccagattgaggtggtgccttct

SEQ ID NO: 26276 - DNA, 25 bp, Homo sapiens
ccctgatcatcaaagccctcaagga

SEQ ID NO: 26277 - DNA, 25 bp, Homo sapiens
aacattgctcgacagatgcggcacc

SEQ ID NO: 26278 - DNA, 25 bp, Homo sapiens
agatcctggggactgcccagtcagt

SEQ ID NO: 26279 - DNA, 25 bp, Homo sapiens
tgttgatggccgccatcctcatgac

SEQ ID NO: 26280 - DNA, 25 bp, Homo sapiens
agtggtgctgtggaatgcccagccg

SEQ ID NO: 26281 - DNA, 25 bp, Homo sapiens
tgcccagccgtaagtgacattttca

SEQ ID NO: 26282 - DNA, 25 bp, Homo sapiens
gttactggtggggtgggataatcct

SEQ ID NO: 26283 - DNA, 25 bp, Homo sapiens
ttttctttcccacagagttaagcac

SEQ ID NO: 26284 - DNA, 25 bp, Homo sapiens
gctctagcagcaaggcagtaacacc

SEQ ID NO: 26285 - DNA, 25 bp, Homo sapiens
gcaaggcagtaacaccacaaaagca

SEQ ID NO: 26286 - DNA, 25 bp, Homo sapiens
aaccacatgggaaaactcagcactg

SEQ ID NO: 26287 - DNA, 25 bp, Homo sapiens
gaaaactcagcactggtggtggtgg

SEQ ID NO: 26288 - DNA, 25 bp, Homo sapiens
tacggagtggtgtccatgtgcatcg

SEQ ID NO: 26289 - DNA, 25 bp, Homo sapiens
gtgaacactgatgacatggtatagg

SEQ ID NO: 26290 - DNA, 25 bp, Homo sapiens
tggggtgttgagccacccatcagac

SEQ ID NO: 26291 - DNA, 25 bp, Homo sapiens
tcagaccctctttagctgtgcaaga

SEQ ID NO: 26292 - DNA, 25 bp, Homo sapiens
gccacaaggccatggttaattctta

SEQ ID NO: 26293 - DNA, 25 bp, Homo sapiens
ggccatggttaattcttaaggcaag

SEQ ID NO: 26294 - DNA, 25 bp, Homo sapiens
aaggcaaggcaaatccatggatgag

SEQ ID NO: 26295 - DNA, 25 bp, Homo sapiens
aagccactgttgccaggacagacgc

SEQ ID NO: 26296 - DNA, 25 bp, Homo sapiens
agactcactctgtggagacaccata

SEQ ID NO: 26297 - DNA, 25 bp, Homo sapiens
ctctgtggagacaccatacggctct

SEQ ID NO: 26298 - DNA, 25 bp, Homo sapiens
gatccttacctaccacgatgtggga

SEQ ID NO: 26299 - DNA, 25 bp, Homo sapiens
accacgatgtgggactcaactataa

SEQ ID NO: 26300 - DNA, 25 bp, Homo sapiens
aactataaatcttgcttccagccac

SEQ ID NO: 26301 - DNA, 25 bp, Homo sapiens
cttccagccactgtttcagttcgag

SEQ ID NO: 26302 - DNA, 25 bp, Homo sapiens
aatcattcagaactttgtgcgggtt

SEQ ID NO: 26303 - DNA, 25 bp, Homo sapiens
tgtgcgggttcatgtggatgcccct

SEQ ID NO: 26304 - DNA, 25 bp, Homo sapiens
agcttgcagacatgatcccttgcgt

SEQ ID NO: 26305 - DNA, 25 bp, Homo sapiens
ttgcgtcctgcagtacctaaatttc

SEQ ID NO: 26306 - DNA, 25 bp, Homo sapiens
ctctcggtgactactatcgctgtca

SEQ ID NO: 26307 - DNA, 25 bp, Homo sapiens
cggtgactactatcgctgtcatgtc

SEQ ID NO: 26308 - DNA, 25 bp, Homo sapiens
gcggtcctcgagtatctgaccgccg

SEQ ID NO: 26309 - DNA, 25 bp, Homo sapiens
cctcgagtatctgaccgccgagatc

SEQ ID NO: 26310 - DNA, 25 bp, Homo sapiens
gactactatcgctgtcatgtctggt

SEQ ID NO: 26311 - DNA, 25 bp, Homo sapiens
tactatcgctgtcatgtctggtcgt

SEQ ID NO: 26312 - DNA, 25 bp, Homo sapiens
cgcaacgacgaggaactgaacaagc

SEQ ID NO: 26313 - DNA, 25 bp, Homo sapiens
gctgtcatgtctggtcgtggcaagc

SEQ ID NO: 26314 - DNA, 25 bp, Homo sapiens
tcatgtctggtcgtggcaagcaagg

SEQ ID NO: 26315 - DNA, 25 bp, Homo sapiens
gtctggtcgtggcaagcaaggaggc

SEQ ID NO: 26316 - DNA, 25 bp, Homo sapiens
gtcgtggcaagcaaggaggcaaggc

SEQ ID NO: 26317 - DNA, 25 bp, Homo sapiens
ctccttattaccataatctagcctg

SEQ ID NO: 26318 - DNA, 25 bp, Homo sapiens
ctagcctgattcctgtcagagagtg

SEQ ID NO: 26319 - DNA, 25 bp, Homo sapiens
gagagtggaactcgagacctctgat

SEQ ID NO: 26320 - DNA, 25 bp, Homo sapiens
gagacctctgataatccacatggcc

SEQ ID NO: 26321 - DNA, 25 bp, Homo sapiens
gccatggagtagagctgtgcctgcc

SEQ ID NO: 26322 - DNA, 25 bp, Homo sapiens
ttcttctgtcaatccatattcttta

SEQ ID NO: 26323 - DNA, 25 bp, Homo sapiens
aatttactagtttctcctgtgttct

SEQ ID NO: 26324 - DNA, 25 bp, Homo sapiens
tactcagtacatattgtgggatcac

SEQ ID NO: 26325 - DNA, 25 bp, Homo sapiens
gggctttgtgttttactggtcttgc

SEQ ID NO: 26326 - DNA, 25 bp, Homo sapiens
gttttactggtcttgccttggataa

SEQ ID NO: 26327 - DNA, 25 bp, Homo sapiens
gtgggatcacagctacaaaagcatt

SEQ ID NO: 26328 - DNA, 25 bp, Homo sapiens
ttcaatgttgtggcctggcacggga

SEQ ID NO: 26329 - DNA, 25 bp, Homo sapiens
tggcctggcacgggaattatacacc

SEQ ID NO: 26330 - DNA, 25 bp, Homo sapiens
ggcacgggaattatacaccctacaa

SEQ ID NO: 26331 - DNA, 25 bp, Homo sapiens
tacaccctacaagtacaacctgaag

SEQ ID NO: 26332 - DNA, 25 bp, Homo sapiens
atggttatcaactcagtggcctttg

SEQ ID NO: 26333 - DNA, 25 bp, Homo sapiens
catccattttcacagtattgactgc

SEQ ID NO: 26334 - DNA, 25 bp, Homo sapiens
gtattgactgctaagtctgtccgcc

SEQ ID NO: 26335 - DNA, 25 bp, Homo sapiens
ctggagtggccattgctgattttgt

SEQ ID NO: 26336 - DNA, 25 bp, Homo sapiens
ttcccacctcgatggggggttgctg

SEQ ID NO: 26337 - DNA, 25 bp, Homo sapiens
cctcgatggggggttgctgataaga

SEQ ID NO: 26338 - DNA, 25 bp, Homo sapiens
tgctgataagaccttcaggcctcct

SEQ ID NO: 26339 - DNA, 25 bp, Homo sapiens
cttcggaaccagtgcagcggccgat

SEQ ID NO: 26340 - DNA, 25 bp, Homo sapiens
cagtgcagcggccgatcagtaaaca

SEQ ID NO: 26341 - DNA, 25 bp, Homo sapiens
tgcagcggccgatcagtaaacacag

SEQ ID NO: 26342 - DNA, 25 bp, Homo sapiens
gcggccgatcagtaaacacagagac

SEQ ID NO: 26343 - DNA, 25 bp, Homo sapiens
acacagagactggggatcgatcatg

SEQ ID NO: 26344 - DNA, 25 bp, Homo sapiens
gactggggatcgatcatggggcttt

SEQ ID NO: 26345 - DNA, 25 bp, Homo sapiens
ggatcgatcatggggctttgtaagt

SEQ ID NO: 26346 - DNA, 25 bp, Homo sapiens
gggctttgtaagtgccccaagagaa

SEQ ID NO: 26347 - DNA, 25 bp, Homo sapiens
ccaagagaaaggtgaccaacctgtt

SEQ ID NO: 26348 - DNA, 25 bp, Homo sapiens
gttctgcttcgaacatcgggtcaac

SEQ ID NO: 26349 - DNA, 25 bp, Homo sapiens
tcgaacatcgggtcaacgtctgcga

SEQ ID NO: 26350 - DNA, 25 bp, Homo sapiens
aaattcgagaccaagagcgcgcggg

SEQ ID NO: 26351 - DNA, 25 bp, Homo sapiens
aaagaccttggatcctgactagttt

SEQ ID NO: 26352 - DNA, 25 bp, Homo sapiens
ggggtcatccagttatgggactatc

SEQ ID NO: 26353 - DNA, 25 bp, Homo sapiens
gactatcggatgtgcactctcattg

SEQ ID NO: 26354 - DNA, 25 bp, Homo sapiens
ggtccagtgcgaggcattgacttcc

SEQ ID NO: 26355 - DNA, 25 bp, Homo sapiens
ttgacttccataagcagcagccact

SEQ ID NO: 26356 - DNA, 25 bp, Homo sapiens
gccactgttcgtctctggaggagat

SEQ ID NO: 26357 - DNA, 25 bp, Homo sapiens
gaattacaagcttcggcgctgtctt

SEQ ID NO: 26358 - DNA, 25 bp, Homo sapiens
tgtcttttcacattgcttgggcact

SEQ ID NO: 26359 - DNA, 25 bp, Homo sapiens
atattcgcaccacgttttttcatca

SEQ ID NO: 26360 - DNA, 25 bp, Homo sapiens
gattctgagtgcctccgatgatcag

SEQ ID NO: 26361 - DNA, 25 bp, Homo sapiens
aagataagctcgagctgactcccac

SEQ ID NO: 26362 - DNA, 25 bp, Homo sapiens
ctccctctccacgagagtcaacagg

SEQ ID NO: 26363 - DNA, 25 bp, Homo sapiens
ggagactttgttcatggctggggac

SEQ ID NO: 26364 - DNA, 25 bp, Homo sapiens
ccgaggctaccagtggggaggcggg

SEQ ID NO: 26365 - DNA, 25 bp, Homo sapiens
ggatcagggctatggtttgggtatg

SEQ ID NO: 26366 - DNA, 25 bp, Homo sapiens
tttgggtatggtttgcttgccccca

SEQ ID NO: 26367 - DNA, 25 bp, Homo sapiens
gcttccaggaggacatctactgcca

SEQ ID NO: 26368 - DNA, 25 bp, Homo sapiens
tctactgccacaagttcatccagca

SEQ ID NO: 26369 - DNA, 25 bp, Homo sapiens
atccagcaagtctacctggcactct

SEQ ID NO: 26370 - DNA, 25 bp, Homo sapiens
atctactgctgtctcaaccacaggt

SEQ ID NO: 26371 - DNA, 25 bp, Homo sapiens
ccatgggtcacacccaccaaggaag

SEQ ID NO: 26372 - DNA, 25 bp, Homo sapiens
ggtctggatggggccacctatgacc

SEQ ID NO: 26373 - DNA, 25 bp, Homo sapiens
gtacctgctggactcgaatagctgg

SEQ ID NO: 26374 - DNA, 25 bp, Homo sapiens
atcgaggagatgccctctgaacgcc

SEQ ID NO: 26375 - DNA, 25 bp, Homo sapiens
ctcaacgacttcctccaggagtatg

SEQ ID NO: 26376 - DNA, 25 bp, Homo sapiens
caggggtgccaggtgtgagggctgc

SEQ ID NO: 26377 - DNA, 25 bp, Homo sapiens
tccgctgggaggaacctgaacctgg

SEQ ID NO: 26378 - DNA, 25 bp, Homo sapiens
aagctggaagcactgctgtgtccgc

SEQ ID NO: 26379 - DNA, 25 bp, Homo sapiens
gtgtccgctttcatgaacacagcct

SEQ ID NO: 26380 - DNA, 25 bp, Homo sapiens
tgggaccagggcatattaaaggctt

SEQ ID NO: 26381 - DNA, 25 bp, Homo sapiens
gtccccaattcgccctatagggagc

SEQ ID NO: 26382 - DNA, 25 bp, Homo sapiens
cttgcagaaaatccccttttcgcca

SEQ ID NO: 26383 - DNA, 25 bp, Homo sapiens
aacaggggtgctcagtactttacgc

SEQ ID NO: 26384 - DNA, 25 bp, Homo sapiens
ttacgccaagctgattttgaggccc

SEQ ID NO: 26385 - DNA, 25 bp, Homo sapiens
ggcccataacattctcagggagtct

SEQ ID NO: 26386 - DNA, 25 bp, Homo sapiens
attacattttgatcgggacccactt

SEQ ID NO: 26387 - DNA, 25 bp, Homo sapiens
acccacttcaaaagcagccttcatg

SEQ ID NO: 26388 - DNA, 25 bp, Homo sapiens
gcagccttcatgccagagatctgtg

SEQ ID NO: 26389 - DNA, 25 bp, Homo sapiens
gtgacttcatgactggtatacctgc

SEQ ID NO: 26390 - DNA, 25 bp, Homo sapiens
gtatacctgcaacacctggcaatga

SEQ ID NO: 26391 - DNA, 25 bp, Homo sapiens
cacctggcaatgagatccctgtaga

SEQ ID NO: 26392 - DNA, 25 bp, Homo sapiens
aaagcccccaggaactactgagtgg

SEQ ID NO: 26393 - DNA, 25 bp, Homo sapiens
ttgtttgcatattcatctcttcgcc

SEQ ID NO: 26394 - DNA, 25 bp, Homo sapiens
gccactgacacagacgagctgcagc

SEQ ID NO: 26395 - DNA, 25 bp, Homo sapiens
tccccttccagaaccctgaagagca

SEQ ID NO: 26396 - DNA, 25 bp, Homo sapiens
tcttccccgagaacttcactgagag

SEQ ID NO: 26397 - DNA, 25 bp, Homo sapiens
cactgagagggtcccatgacggcgg

SEQ ID NO: 26398 - DNA, 25 bp, Homo sapiens
gcagcctccgggcgtgtgaagaaca

SEQ ID NO: 26399 - DNA, 25 bp, Homo sapiens
gagacccccaggcagaggggcgttc

SEQ ID NO: 26400 - DNA, 25 bp, Homo sapiens
ttaggtcgttttccaaagagccgcg

SEQ ID NO: 26401 - DNA, 25 bp, Homo sapiens
caagtccggcggaattcaccagtgt

SEQ ID NO: 26402 - DNA, 25 bp, Homo sapiens
caccagtgttcctgaagctgctgtg

SEQ ID NO: 26403 - DNA, 25 bp, Homo sapiens
agctgctgtgtcctctagttgagtt

SEQ ID NO: 26404 - DNA, 25 bp, Homo sapiens
cgcagacggtctgtgtgctgtttga

SEQ ID NO: 26405 - DNA, 25 bp, Homo sapiens
atgaaagtatccagccaaccgtgta

SEQ ID NO: 26406 - DNA, 25 bp, Homo sapiens
atagaaagttcaagcgtcctcagta

SEQ ID NO: 26407 - DNA, 25 bp, Homo sapiens
gtcctcagtaagccttgttcagtga

SEQ ID NO: 26408 - DNA, 25 bp, Homo sapiens
gaagaccctcctgccaaaaggaaat

SEQ ID NO: 26409 - DNA, 25 bp, Homo sapiens
cagcccaaccaaaggggttctcatg

SEQ ID NO: 26410 - DNA, 25 bp, Homo sapiens
gttctcatgtatcagccatcttctg

SEQ ID NO: 26411 - DNA, 25 bp, Homo sapiens
agccatcttctgtaagggtgcccag

SEQ ID NO: 26412 - DNA, 25 bp, Homo sapiens
tgtaagggtgcccagtgtgacttcg

SEQ ID NO: 26413 - DNA, 25 bp, Homo sapiens
tattccgccttcattaacagactac

SEQ ID NO: 26414 - DNA, 25 bp, Homo sapiens
aacagactactcagtaccattccac

SEQ ID NO: 26415 - DNA, 25 bp, Homo sapiens
ttccaccatacgccaatatcaagca

SEQ ID NO: 26416 - DNA, 25 bp, Homo sapiens
gccaagctaaataactccagtccaa

SEQ ID NO: 26417 - DNA, 25 bp, Homo sapiens
taaagaggattgcactgcctccatg

SEQ ID NO: 26418 - DNA, 25 bp, Homo sapiens
tgcctccatggaaccttcagcaatt

SEQ ID NO: 26419 - DNA, 25 bp, Homo sapiens
ttcagcaattgaactcccagattat

SEQ ID NO: 26420 - DNA, 25 bp, Homo sapiens
aaaatatatcgctatcgtctcctat

SEQ ID NO: 26421 - DNA, 25 bp, Homo sapiens
tcgtctcctatgagcaacgccagaa

SEQ ID NO: 26422 - DNA, 25 bp, Homo sapiens
gagtacagagctttgcatgccagga

SEQ ID NO: 26423 - DNA, 25 bp, Homo sapiens
cgcctttctccaggctcaaaagagt

SEQ ID NO: 26424 - DNA, 25 bp, Homo sapiens
taaagcagtctagtcccaattacca

SEQ ID NO: 26425 - DNA, 25 bp, Homo sapiens
aacaagctggctcacatcaaaaggc

SEQ ID NO: 26426 - DNA, 25 bp, Homo sapiens
agtcatggtcctagaactctgcttg

SEQ ID NO: 26427 - DNA, 25 bp, Homo sapiens
tcatagccattttaactccaaagaa

SEQ ID NO: 26428 - DNA, 25 bp, Homo sapiens
ggatcaagatgtataaactgttgtt

SEQ ID NO: 26429 - DNA, 25 bp, Homo sapiens
taaactgttgtttaattacgtgaga

SEQ ID NO: 26430 - DNA, 25 bp, Homo sapiens
tacgtgagaaacatcttcagtggcc

SEQ ID NO: 26431 - DNA, 25 bp, Homo sapiens
tacagctatacccagaccttttata

SEQ ID NO: 26432 - DNA, 25 bp, Homo sapiens
agctatacccagaccttttataggt

SEQ ID NO: 26433 - DNA, 25 bp, Homo sapiens
tacccagaccttttataggtaatga

SEQ ID NO: 26434 - DNA, 25 bp, Homo sapiens
caaaacctgtcctcagaattctata

SEQ ID NO: 26435 - DNA, 25 bp, Homo sapiens
acctgtcctcagaattctataaagt

SEQ ID NO: 26436 - DNA, 25 bp, Homo sapiens
gaagcagtaagcagcatctgaagcc

SEQ ID NO: 26437 - DNA, 25 bp, Homo sapiens
gcagtaagcagcatctgaagccaca

SEQ ID NO: 26438 - DNA, 25 bp, Homo sapiens
agagttactctgtgtacgtgtacaa

SEQ ID NO: 26439 - DNA, 25 bp, Homo sapiens
gaattctttcgttaacgacatattt

SEQ ID NO: 26440 - DNA, 25 bp, Homo sapiens
gacaacagcttttagacatatcttt

SEQ ID NO: 26441 - DNA, 25 bp, Homo sapiens
acatatcttttccaacagtcgtcac

SEQ ID NO: 26442 - DNA, 25 bp, Homo sapiens
atatcttttccaacagtcgtcactg

SEQ ID NO: 26443 - DNA, 25 bp, Homo sapiens
tttccaacagtcgtcactgctggac

SEQ ID NO: 26444 - DNA, 25 bp, Homo sapiens
aacagtcgtcactgctggacactgt

SEQ ID NO: 26445 - DNA, 25 bp, Homo sapiens
aaccaatgaaaatgagtgatcctag

SEQ ID NO: 26446 - DNA, 25 bp, Homo sapiens
aaatggaggtattttgaacaatcaa

SEQ ID NO: 26447 - DNA, 25 bp, Homo sapiens
gaaggacaaatgaacacctggctga

SEQ ID NO: 26448 - DNA, 25 bp, Homo sapiens
aaattagctcttttttctatgcata

SEQ ID NO: 26449 - DNA, 25 bp, Homo sapiens
gcgacaatatccagggcatcaccaa

SEQ ID NO: 26450 - DNA, 25 bp, Homo sapiens
cttgctcgccgcggcggcgtgaagc

SEQ ID NO: 26451 - DNA, 25 bp, Homo sapiens
atctccggcctcatctacgaggaga

SEQ ID NO: 26452 - DNA, 25 bp, Homo sapiens
gactcgcggggtgctgaaggtgttc

SEQ ID NO: 26453 - DNA, 25 bp, Homo sapiens
gttcctggagaacgtgatccgggac

SEQ ID NO: 26454 - DNA, 25 bp, Homo sapiens
gacctatacagagcacgccaagcgc

SEQ ID NO: 26455 - DNA, 25 bp, Homo sapiens
gtcaccgccatggatgtggtctacg

SEQ ID NO: 26456 - DNA, 25 bp, Homo sapiens
tacggtttcggtggttgagcgtcct

SEQ ID NO: 26457 - DNA, 25 bp, Homo sapiens
tgagcgtccttttctaccaataaaa

SEQ ID NO: 26458 - DNA, 25 bp, Homo sapiens
atgtctggccgcggcaaaggcggga

SEQ ID NO: 26459 - DNA, 25 bp, Homo sapiens
gctaagcgccaccgtaaagtactgc

SEQ ID NO: 26460 - DNA, 25 bp, Homo sapiens
attcggaactgtgaagcaccttata

SEQ ID NO: 26461 - DNA, 25 bp, Homo sapiens
gttagtagcccaacagatacatcga

SEQ ID NO: 26462 - DNA, 25 bp, Homo sapiens
gccaccatctgccatttgttggttt

SEQ ID NO: 26463 - DNA, 25 bp, Homo sapiens
gtagctgtgtactttctgatcggag

SEQ ID NO: 26464 - DNA, 25 bp, Homo sapiens
gtactttctgatcggagctgtttaa

SEQ ID NO: 26465 - DNA, 25 bp, Homo sapiens
tgtttaagagttacggctggtccca

SEQ ID NO: 26466 - DNA, 25 bp, Homo sapiens
tcccacctcactggatcttgatgtt

SEQ ID NO: 26467 - DNA, 25 bp, Homo sapiens
gaggactctagacaacaacttagca

SEQ ID NO: 26468 - DNA, 25 bp, Homo sapiens
aacacagactgtccaagctctgcag

SEQ ID NO: 26469 - DNA, 25 bp, Homo sapiens
agctctgcagtattcaactgttgat

SEQ ID NO: 26470 - DNA, 25 bp, Homo sapiens
gatggtccactaacagcaagcaaag

SEQ ID NO: 26471 - DNA, 25 bp, Homo sapiens
gcaaaagctaaaacgcgttcttcca

SEQ ID NO: 26472 - DNA, 25 bp, Homo sapiens
ccgcaaaggcaactactccgaacga

SEQ ID NO: 26473 - DNA, 25 bp, Homo sapiens
agcggtgctggaatatctgacggcc

SEQ ID NO: 26474 - DNA, 25 bp, Homo sapiens
gacggccgagatcttagagctagct

SEQ ID NO: 26475 - DNA, 25 bp, Homo sapiens
tagagctagctggcaacgcggctcg

SEQ ID NO: 26476 - DNA, 25 bp, Homo sapiens
gtggattgttagttcttctgctgtt

SEQ ID NO: 26477 - DNA, 25 bp, Homo sapiens
gcttctaggtcgcgtgaccatcgcg

SEQ ID NO: 26478 - DNA, 25 bp, Homo sapiens
ggccgtattgctgcctaagaagacg

SEQ ID NO: 26479 - DNA, 25 bp, Homo sapiens
tagtcaaatccgtcagtgatcccga

SEQ ID NO: 26480 - DNA, 25 bp, Homo sapiens
taggaagccactatgtctggacgtg

SEQ ID NO: 26481 - DNA, 25 bp, Homo sapiens
aagcaaggcggcaaagctcgggcaa

SEQ ID NO: 26482 - DNA, 25 bp, Homo sapiens
gatgcatatcgcactgatttggaag

SEQ ID NO: 26483 - DNA, 25 bp, Homo sapiens
agaactgaatcttggaccacgtgac

SEQ ID NO: 26484 - DNA, 25 bp, Homo sapiens
ttggaccacgtgacgcaaacactct

SEQ ID NO: 26485 - DNA, 25 bp, Homo sapiens
gacgcaaacactctgccaaagattg

SEQ ID NO: 26486 - DNA, 25 bp, Homo sapiens
aaagattgagcagtcacagcatctc

SEQ ID NO: 26487 - DNA, 25 bp, Homo sapiens
agcatctcttccaagcacataagga

SEQ ID NO: 26488 - DNA, 25 bp, Homo sapiens
aatgcgcaatgatgtttctgtcaaa

SEQ ID NO: 26489 - DNA, 25 bp, Homo sapiens
tttccacaatgccattgccgcttac

SEQ ID NO: 26490 - DNA, 25 bp, Homo sapiens
ccgcttactttgctgggaatcagaa

SEQ ID NO: 26491 - DNA, 25 bp, Homo sapiens
tcagaagcagcttgaacagacactt

SEQ ID NO: 26492 - DNA, 25 bp, Homo sapiens
gagactcttcttggggccattaatt

SEQ ID NO: 26493 - DNA, 25 bp, Homo sapiens
ggtagtacacgggcctggtgaggca

SEQ ID NO: 26494 - DNA, 25 bp, Homo sapiens
ggtgaggcaacagctgtggagtggg

SEQ ID NO: 26495 - DNA, 25 bp, Homo sapiens
atgcagatcctgagttcctgctgta

SEQ ID NO: 26496 - DNA, 25 bp, Homo sapiens
atcctgagttcctgctgtatgagca

SEQ ID NO: 26497 - DNA, 25 bp, Homo sapiens
gtatgagcagggatatccatgctta

SEQ ID NO: 26498 - DNA, 25 bp, Homo sapiens
tatccatgcttatgtatccaaacac

SEQ ID NO: 26499 - DNA, 25 bp, Homo sapiens
gtatccaaacacagagacccatggg

SEQ ID NO: 26500 - DNA, 25 bp, Homo sapiens
gacccatgggaacaaatgagacaca

SEQ ID NO: 26501 - DNA, 25 bp, Homo sapiens
atagatactgagacctgtgtgtaca

SEQ ID NO: 26502 - DNA, 25 bp, Homo sapiens
gtacagtaggaccatgcactcacac

SEQ ID NO: 26503 - DNA, 25 bp, Homo sapiens
cacacacatatcacagttttcacac

SEQ ID NO: 26504 - DNA, 25 bp, Homo sapiens
agaggcagcagagcattcagactcc

SEQ ID NO: 26505 - DNA, 25 bp, Homo sapiens
gagcattcagactccaaacagaccc

SEQ ID NO: 26506 - DNA, 25 bp, Homo sapiens
gtggctccctcggaatgctaagggg

SEQ ID NO: 26507 - DNA, 25 bp, Homo sapiens
ggatcggacatgaaaggaccctgtg

SEQ ID NO: 26508 - DNA, 25 bp, Homo sapiens
aggaccctgtgagccgattgtccta

SEQ ID NO: 26509 - DNA, 25 bp, Homo sapiens
gttatcagtgcttcccgagtgagca

SEQ ID NO: 26510 - DNA, 25 bp, Homo sapiens
acttcttgctggtctagtcacgcat

SEQ ID NO: 26511 - DNA, 25 bp, Homo sapiens
agtcacgcatgcagtgttggggatg

SEQ ID NO: 26512 - DNA, 25 bp, Homo sapiens
gagtgagcatggaacacttcgagtt

SEQ ID NO: 26513 - DNA, 25 bp, Homo sapiens
tggggatgccttggtttttactgct

SEQ ID NO: 26514 - DNA, 25 bp, Homo sapiens
ttatagacagtcgttcccagtgtgg

SEQ ID NO: 26515 - DNA, 25 bp, Homo sapiens
tgagtgtgaacctgatgccagcgcc

SEQ ID NO: 26516 - DNA, 25 bp, Homo sapiens
gccagcctacaatgtcaactctgtg

SEQ ID NO: 26517 - DNA, 25 bp, Homo sapiens
gaacactctcaacgccatgaatggg

SEQ ID NO: 26518 - DNA, 25 bp, Homo sapiens
tacagcatgtcccagccaatgatga

SEQ ID NO: 26519 - DNA, 25 bp, Homo sapiens
gtggctaccacagcaatcatggcta

SEQ ID NO: 26520 - DNA, 25 bp, Homo sapiens
ccccaataccctatgcagatgcaga

SEQ ID NO: 26521 - DNA, 25 bp, Homo sapiens
gcatgatgggcacccagccatatgc

SEQ ID NO: 26522 - DNA, 25 bp, Homo sapiens
ggcatgtccaaacagtctctcaatg

SEQ ID NO: 26523 - DNA, 25 bp, Homo sapiens
aaacctacggggcatgactatggga

SEQ ID NO: 26524 - DNA, 25 bp, Homo sapiens
gactatgggatggatctgcacaaat

SEQ ID NO: 26525 - DNA, 25 bp, Homo sapiens
tacccaattcgccctatagtgagtc

SEQ ID NO: 26526 - DNA, 25 bp, Homo sapiens
tggccagaagttgcaagttgtacag

SEQ ID NO: 26527 - DNA, 25 bp, Homo sapiens
ccagaagttgcaagttgtacaggct

SEQ ID NO: 26528 - DNA, 25 bp, Homo sapiens
ctgacattgcctcgatcgacagtga

SEQ ID NO: 26529 - DNA, 25 bp, Homo sapiens
gacattgcctcgatcgacagtgatg

SEQ ID NO: 26530 - DNA, 25 bp, Homo sapiens
cattgcctcgatcgacagtgatgct

SEQ ID NO: 26531 - DNA, 25 bp, Homo sapiens
ttgcctcgatcgacagtgatgctgt

SEQ ID NO: 26532 - DNA, 25 bp, Homo sapiens
gacagtgatgctgtcgttcacccga

SEQ ID NO: 26533 - DNA, 25 bp, Homo sapiens
ttcacccgacaaacactgacttcta

SEQ ID NO: 26534 - DNA, 25 bp, Homo sapiens
acactgacttctacatcggtggtga

SEQ ID NO: 26535 - DNA, 25 bp, Homo sapiens
actgacttctacatcggtggtgaag

SEQ ID NO: 26536 - DNA, 25 bp, Homo sapiens
ggtggtgaagtaggaaacacgctgg

SEQ ID NO: 26537 - DNA, 25 bp, Homo sapiens
aatagtccagtttggggtgcagaca

SEQ ID NO: 26538 - DNA, 25 bp, Homo sapiens
actgcttggccctggctgatgataa

SEQ ID NO: 26539 - DNA, 25 bp, Homo sapiens
catcggcagcggcaggaacggtttt

SEQ ID NO: 26540 - DNA, 25 bp, Homo sapiens
gattctgaaggccatctccagttac

SEQ ID NO: 26541 - DNA, 25 bp, Homo sapiens
tctccagttacttcgtgtctacaat

SEQ ID NO: 26542 - DNA, 25 bp, Homo sapiens
atgtcctcttccatcaaaacggtgt

SEQ ID NO: 26543 - DNA, 25 bp, Homo sapiens
tcaaaacggtgtacttcgtgctttt

SEQ ID NO: 26544 - DNA, 25 bp, Homo sapiens
gccaagctggacgccaactaggctg

SEQ ID NO: 26545 - DNA, 25 bp, Homo sapiens
tgagcaatgacagaaccagctgcac

SEQ ID NO: 26546 - DNA, 25 bp, Homo sapiens
ggcccttggaagtagctggagctgc

SEQ ID NO: 26547 - DNA, 25 bp, Homo sapiens
tgcctgccaagtttgtgatccactg

SEQ ID NO: 26548 - DNA, 25 bp, Homo sapiens
ccatcggtgcggactccaaggaggt

SEQ ID NO: 26549 - DNA, 25 bp, Homo sapiens
gcaaggggtgcttcaaggccattgt

SEQ ID NO: 26550 - DNA, 25 bp, Homo sapiens
ggagtacaaggggaccgtctggcac

SEQ ID NO: 26551 - DNA, 25 bp, Homo sapiens
agactgcttcacctgtagtaactgc

SEQ ID NO: 26552 - DNA, 25 bp, Homo sapiens
cttctactgcgtgacttgccatgag

SEQ ID NO: 26553 - DNA, 25 bp, Homo sapiens
aaggctccagtgtggtggcctatga

SEQ ID NO: 26554 - DNA, 25 bp, Homo sapiens
gaaggacaatcctggcacgactact

SEQ ID NO: 26555 - DNA, 25 bp, Homo sapiens
cgactactgcttccactgcaaaaaa

SEQ ID NO: 26556 - DNA, 25 bp, Homo sapiens
aaaatgctccgtgaatctggccaac

SEQ ID NO: 26557 - DNA, 25 bp, Homo sapiens
gccaacaagcgctttgttttccacc

SEQ ID NO: 26558 - DNA, 25 bp, Homo sapiens
agcaagtgtattgtcccgactgtgc

SEQ ID NO: 26559 - DNA, 25 bp, Homo sapiens
tctctttgcacacgaggagcctgaa

SEQ ID NO: 26560 - DNA, 25 bp, Homo sapiens
gaagacccactttcatgatttgcca

SEQ ID NO: 26561 - DNA, 25 bp, Homo sapiens
tgccatgtggtgcctcagtgattct

SEQ ID NO: 26562 - DNA, 25 bp, Homo sapiens
attctcggtaacaacggcttcatct

SEQ ID NO: 26563 - DNA, 25 bp, Homo sapiens
ggcttcatctggatttacccaacac

SEQ ID NO: 26564 - DNA, 25 bp, Homo sapiens
aagcagggggcttcattgcaaacct

SEQ ID NO: 26565 - DNA, 25 bp, Homo sapiens
gatcgagaggtgatatcccggcttc

SEQ ID NO: 26566 - DNA, 25 bp, Homo sapiens
tatcccggcttcggaactgcatcat

SEQ ID NO: 26567 - DNA, 25 bp, Homo sapiens
ctgcatcatctcgctggtaactcag

SEQ ID NO: 26568 - DNA, 25 bp, Homo sapiens
catcccttccacatcagatcaaaga

SEQ ID NO: 26569 - DNA, 25 bp, Homo sapiens
agaagcacgggactgtggaccttgc

SEQ ID NO: 26570 - DNA, 25 bp, Homo sapiens
tgacatgccaacttaccagatccga

SEQ ID NO: 26571 - DNA, 25 bp, Homo sapiens
tactgctgctttgccacagggagtg

SEQ ID NO: 26572 - DNA, 25 bp, Homo sapiens
agggagtggtgatggctgcatcgcc

SEQ ID NO: 26573 - DNA, 25 bp, Homo sapiens
ctgcatcgcccggaagtttgcacag

SEQ ID NO: 26574 - DNA, 25 bp, Homo sapiens
cacagtccccagcagctggcagaag

SEQ ID NO: 26575 - DNA, 25 bp, Homo sapiens
gcaacacgcaaacgagagctgaggc

SEQ ID NO: 26576 - DNA, 25 bp, Homo sapiens
gaagctgccaaagaatgtcgacgtc

SEQ ID NO: 26577 - DNA, 25 bp, Homo sapiens
ccgagttgcagtgctggaagtccag

SEQ ID NO: 26578 - DNA, 25 bp, Homo sapiens
gtggcttcttttctttgtatcattc

SEQ ID NO: 26579 - DNA, 25 bp, Homo sapiens
gtatcattcatcttcttctttaatc

SEQ ID NO: 26580 - DNA, 25 bp, Homo sapiens
aagatcgagcctcctactgaggccg

SEQ ID NO: 26581 - DNA, 25 bp, Homo sapiens
aggcttagtcagcagggctctgcca

SEQ ID NO: 26582 - DNA, 25 bp, Homo sapiens
gaaggtcaggactcatctgggcatg

SEQ ID NO: 26583 - DNA, 25 bp, Homo sapiens
acacccaccatgccaggggtggcaa

SEQ ID NO: 26584 - DNA, 25 bp, Homo sapiens
gattggtgatggctacccagagcac

SEQ ID NO: 26585 - DNA, 25 bp, Homo sapiens
tacccagagcaccgcattgagcgtc

SEQ ID NO: 26586 - DNA, 25 bp, Homo sapiens
cattgagcgtctaaggccactgtgc

SEQ ID NO: 26587 - DNA, 25 bp, Homo sapiens
gccactggctccgatgggatgtggt

SEQ ID NO: 26588 - DNA, 25 bp, Homo sapiens
tgaatgccggtgatttgctgttcct

SEQ ID NO: 26589 - DNA, 25 bp, Homo sapiens
tcctggggtatagcacgtccactga

SEQ ID NO: 26590 - DNA, 25 bp, Homo sapiens
cccagcagcggtgacgtggtcagca

SEQ ID NO: 26591 - DNA, 25 bp, Homo sapiens
gtggtcagcatgcacaggagctcca

SEQ ID NO: 26592 - DNA, 25 bp, Homo sapiens
gcaactactccgagcgagtcggggc

SEQ ID NO: 26593 - DNA, 25 bp, Homo sapiens
gcgccagtgtatctggcggcggtgt

SEQ ID NO: 26594 - DNA, 25 bp, Homo sapiens
gtccggacgcggcaagcaaggcgga

SEQ ID NO: 26595 - DNA, 25 bp, Homo sapiens
cgccgagatcctggagctggcgggc

SEQ ID NO: 26596 - DNA, 25 bp, Homo sapiens
gacaacaagaagacccgcatcatcc

SEQ ID NO: 26597 - DNA, 25 bp, Homo sapiens
gtcacaattgctcagggcggtgttc

SEQ ID NO: 26598 - DNA, 25 bp, Homo sapiens
aggcggaaaggcccgagctaaggct

SEQ ID NO: 26599 - DNA, 25 bp, Homo sapiens
gactgagagtcaccacaaggccaag

SEQ ID NO: 26600 - DNA, 25 bp, Homo sapiens
aagttcgcaatggctcgtaccaagc

SEQ ID NO: 26601 - DNA, 25 bp, Homo sapiens
ctggccaccaaggctgctcgaaaga

SEQ ID NO: 26602 - DNA, 25 bp, Homo sapiens
gagctaaggctaagacccgctcttc

SEQ ID NO: 26603 - DNA, 25 bp, Homo sapiens
tcggctgctgtgggccaacaagcct

SEQ ID NO: 26604 - DNA, 25 bp, Homo sapiens
gccaacaagcctgataagctgcagc

SEQ ID NO: 26605 - DNA, 25 bp, Homo sapiens
ggacgagatcctcgagtgggagtct

SEQ ID NO: 26606 - DNA, 25 bp, Homo sapiens
gagtgggagtctcgggtgactcaat

SEQ ID NO: 26607 - DNA, 25 bp, Homo sapiens
agggacttcgagaggatttcaacag

SEQ ID NO: 26608 - DNA, 25 bp, Homo sapiens
aatccaaggacttcaagaaccacgt

SEQ ID NO: 26609 - DNA, 25 bp, Homo sapiens
agaaccacgtgatcaagtaccttga

SEQ ID NO: 26610 - DNA, 25 bp, Homo sapiens
ttgagacactcctttactcacagca

SEQ ID NO: 26611 - DNA, 25 bp, Homo sapiens
ggcaaagtactgggaagccttcctt

SEQ ID NO: 26612 - DNA, 25 bp, Homo sapiens
tcctgaggcaaaggccatctcctaa

SEQ ID NO: 26613 - DNA, 25 bp, Homo sapiens
ccagttactctaaccgttatttcat

SEQ ID NO: 26614 - DNA, 25 bp, Homo sapiens
tcgcctgctccgcaaaggcaactat

SEQ ID NO: 26615 - DNA, 25 bp, Homo sapiens
gcaactatgcggagcgggtcggtgc

SEQ ID NO: 26616 - DNA, 25 bp, Homo sapiens
ccttttgccatgtctgggcgtggca

SEQ ID NO: 26617 - DNA, 25 bp, Homo sapiens
cggcggtgctggagtacctgaccgc

SEQ ID NO: 26618 - DNA, 25 bp, Homo sapiens
caacaagaagactcgcatcatcccg

SEQ ID NO: 26619 - DNA, 25 bp, Homo sapiens
gctggccatccgcaacgatgaggag

SEQ ID NO: 26620 - DNA, 25 bp, Homo sapiens
agtcaccatcgcacagggtggcgtc

SEQ ID NO: 26621 - DNA, 25 bp, Homo sapiens
ctgcccaagaagaccgagagccacc

SEQ ID NO: 26622 - DNA, 25 bp, Homo sapiens
aagcagggaggcaaagctcgcgcca

SEQ ID NO: 26623 - DNA, 25 bp, Homo sapiens
ttagtttgcagcaactcaatcccaa

SEQ ID NO: 26624 - DNA, 25 bp, Homo sapiens
tcagagccacctacaattttgtgga

SEQ ID NO: 26625 - DNA, 25 bp, Homo sapiens
gccctaccataatgcctttgatcag

SEQ ID NO: 26626 - DNA, 25 bp, Homo sapiens
tacagaccgctgtcatgccaaacgg

SEQ ID NO: 26627 - DNA, 25 bp, Homo sapiens
caactgctgcaatagttcctccagg

SEQ ID NO: 26628 - DNA, 25 bp, Homo sapiens
atctatacaccctatgagtacccct

SEQ ID NO: 26629 - DNA, 25 bp, Homo sapiens
gcaccagctacatcaatccttgagt

SEQ ID NO: 26630 - DNA, 25 bp, Homo sapiens
taaccgtcaccggcaactaacctat

SEQ ID NO: 26631 - DNA, 25 bp, Homo sapiens
tgagactcttacccaatgatgacct

SEQ ID NO: 26632 - DNA, 25 bp, Homo sapiens
gcctgcctgctgatcagttaactgg

SEQ ID NO: 26633 - DNA, 25 bp, Homo sapiens
ttaactgggaatcgcctttgcttgc

SEQ ID NO: 26634 - DNA, 25 bp, Homo sapiens
gttcgtcttaccatctaaccaaaca

SEQ ID NO: 26635 - DNA, 25 bp, Homo sapiens
ataagggcccaattattccacagca

SEQ ID NO: 26636 - DNA, 25 bp, Homo sapiens
ttctcagtttttgctgattgctaag

SEQ ID NO: 26637 - DNA, 25 bp, Homo sapiens
aacagtatttccacaatagggttca

SEQ ID NO: 26638 - DNA, 25 bp, Homo sapiens
attcctgcaaaattacctaccccag

SEQ ID NO: 26639 - DNA, 25 bp, Homo sapiens
ccccagttcatctctgctgaacatt

SEQ ID NO: 26640 - DNA, 25 bp, Homo sapiens
ttggaaaccatgcactagccaaccc

SEQ ID NO: 26641 - DNA, 25 bp, Homo sapiens
ccaacccaactgacttctgctaggt

SEQ ID NO: 26642 - DNA, 25 bp, Homo sapiens
gctaggtagaggcatttgtcttaga

SEQ ID NO: 26643 - DNA, 25 bp, Homo sapiens
gagagcgcgggagagagtgagagag

SEQ ID NO: 26644 - DNA, 25 bp, Homo sapiens
acaacacttgttatgaggggcctgt

SEQ ID NO: 26645 - DNA, 25 bp, Homo sapiens
ttcacatcttagttaagctccttaa

SEQ ID NO: 26646 - DNA, 25 bp, Homo sapiens
aagctccttaagtttgaaggctgca

SEQ ID NO: 26647 - DNA, 25 bp, Homo sapiens
ggcatgcagtttcttacttatctag

SEQ ID NO: 26648 - DNA, 25 bp, Homo sapiens
tagacgtgttgagtgagtgctgagt

SEQ ID NO: 26649 - DNA, 25 bp, Homo sapiens
ctgccacttttgttaccattgtcac

SEQ ID NO: 26650 - DNA, 25 bp, Homo sapiens
actatgtgtaaaccagtcccaccac

SEQ ID NO: 26651 - DNA, 25 bp, Homo sapiens
ccagtcccaccacttattactaata

SEQ ID NO: 26652 - DNA, 25 bp, Homo sapiens
caatatatatatcctgtccttatat

SEQ ID NO: 26653 - DNA, 25 bp, Homo sapiens
tctagagtacattttccatcatgtt

SEQ ID NO: 26654 - DNA, 25 bp, Homo sapiens
tttcctctcctgcagaatacataca

SEQ ID NO: 26655 - DNA, 25 bp, Homo sapiens
gaatcacatttccatactgtctgtt

SEQ ID NO: 26656 - DNA, 25 bp, Homo sapiens
atttccatactgtctgttattttat

SEQ ID NO: 26657 - DNA, 25 bp, Homo sapiens
tattgggtttctttagtttatgttg

SEQ ID NO: 26658 - DNA, 25 bp, Homo sapiens
ttgtcaaggggctttgcattcaaac

SEQ ID NO: 26659 - DNA, 25 bp, Homo sapiens
gcattcaaactgcttttccagggct

SEQ ID NO: 26660 - DNA, 25 bp, Homo sapiens
cttttccagggctatactcagaaga

SEQ ID NO: 26661 - DNA, 25 bp, Homo sapiens
gagtacagactttgaggtttcatca

SEQ ID NO: 26662 - DNA, 25 bp, Homo sapiens
ctgctcctatgtgggtacctgagtc

SEQ ID NO: 26663 - DNA, 25 bp, Homo sapiens
gggtacctgagtcaaaattgtcatt

SEQ ID NO: 26664 - DNA, 25 bp, Homo sapiens
aaatttccttcttgtaccatttctg

SEQ ID NO: 26665 - DNA, 25 bp, Homo sapiens
cttcttgtaccatttctgtttagtt

SEQ ID NO: 26666 - DNA, 25 bp, Homo sapiens
gatgaaactgacaatccaatttgaa

SEQ ID NO: 26667 - DNA, 25 bp, Homo sapiens
ttgtgtcgacgtctgtctagcttaa

SEQ ID NO: 26668 - DNA, 25 bp, Homo sapiens
gacgtctgtctagcttaaatgaatg

SEQ ID NO: 26669 - DNA, 25 bp, Homo sapiens
gagaacttcactgagagggtcccat

SEQ ID NO: 26670 - DNA, 25 bp, Homo sapiens
cactgagagggtcccatgacggcgg

SEQ ID NO: 26671 - DNA, 25 bp, Homo sapiens
gcagcctccgggcgtgtgaagaaca

SEQ ID NO: 26672 - DNA, 25 bp, Homo sapiens
gaacacctcctcccgaaaaatgtgt

SEQ ID NO: 26673 - DNA, 25 bp, Homo sapiens
tgttttcgtttttcatcttttgaag

SEQ ID NO: 26674 - DNA, 25 bp, Homo sapiens
ggaaatcaagaggagacccccaggc

SEQ ID NO: 26675 - DNA, 25 bp, Homo sapiens
gagacccccaggcagaggggcgttc

SEQ ID NO: 26676 - DNA, 25 bp, Homo sapiens
gaaaggccttggcttggtggttcct

SEQ ID NO: 26677 - DNA, 25 bp, Homo sapiens
ttggtggttccttcttagttggagt

SEQ ID NO: 26678 - DNA, 25 bp, Homo sapiens
ggttccttcttagttggagttcctg

SEQ ID NO: 26679 - DNA, 25 bp, Homo sapiens
tcttttcctggcagctgctgtgggt

SEQ ID NO: 26680 - DNA, 25 bp, Homo sapiens
tcaatgccattaacaagtgccccct

SEQ ID NO: 26681 - DNA, 25 bp, Homo sapiens
tgccctgaaggcctggggcgggaag

SEQ ID NO: 26682 - DNA, 25 bp, Homo sapiens
aggagtatgtcaagcgagccctggc

SEQ ID NO: 26683 - DNA, 25 bp, Homo sapiens
gccaacagccttgcctgtcaaggaa

SEQ ID NO: 26684 - DNA, 25 bp, Homo sapiens
aaagtacactccgagcggtcaggct

SEQ ID NO: 26685 - DNA, 25 bp, Homo sapiens
tcgtctctaaccacgcctattaagc

SEQ ID NO: 26686 - DNA, 25 bp, Homo sapiens
attaagcggaggtgttcccaggctg

SEQ ID NO: 26687 - DNA, 25 bp, Homo sapiens
ttccctcgtgacagtggtgtgtggt

SEQ ID NO: 26688 - DNA, 25 bp, Homo sapiens
tgtgtggtgtcgtctgtgaatgcta

SEQ ID NO: 26689 - DNA, 25 bp, Homo sapiens
gtgaatgctaagtccatcacccttt

SEQ ID NO: 26690 - DNA, 25 bp, Homo sapiens
tgaggagattgccatggcgaccgtc

SEQ ID NO: 26691 - DNA, 25 bp, Homo sapiens
tttcttggtctccagtaaccctggt

SEQ ID NO: 26692 - DNA, 25 bp, Homo sapiens
tctccagtaaccctggtcttttcat

SEQ ID NO: 26693 - DNA, 25 bp, Homo sapiens
taaccctggtcttttcataactgct

SEQ ID NO: 26694 - DNA, 25 bp, Homo sapiens
cctggtcttttcataactgctcgag

SEQ ID NO: 26695 - DNA, 25 bp, Homo sapiens
tggtcttttcataactgctcgagat

SEQ ID NO: 26696 - DNA, 25 bp, Homo sapiens
gcccaggtttcagactctgattgca

SEQ ID NO: 26697 - DNA, 25 bp, Homo sapiens
acaaatgaattccccccaggaatca

SEQ ID NO: 26698 - DNA, 25 bp, Homo sapiens
tgaattccccccaggaatcattcaa

SEQ ID NO: 26699 - DNA, 25 bp, Homo sapiens
aggttgagaggagacccctgttaag

SEQ ID NO: 26700 - DNA, 25 bp, Homo sapiens
gagaggagacccctgttaagtcaag

SEQ ID NO: 26701 - DNA, 25 bp, Homo sapiens
ggagacccctgttaagtcaagaaga

SEQ ID NO: 26702 - DNA, 25 bp, Homo sapiens
gctacaggccaaatttgagcacctt

SEQ ID NO: 26703 - DNA, 25 bp, Homo sapiens
gagcaccttaagagacttcaccaag

SEQ ID NO: 26704 - DNA, 25 bp, Homo sapiens
ctacctccgagatatttcacagcca

SEQ ID NO: 26705 - DNA, 25 bp, Homo sapiens
ttcacagccagtcctttctggcaac

SEQ ID NO: 26706 - DNA, 25 bp, Homo sapiens
gtcctttctggcaacaggcagcaac

SEQ ID NO: 26707 - DNA, 25 bp, Homo sapiens
gacaaggaccgtaagaactccaatt

SEQ ID NO: 26708 - DNA, 25 bp, Homo sapiens
gagcacagaaggtcatcatcacaag

SEQ ID NO: 26709 - DNA, 25 bp, Homo sapiens
gctgttatttgttttatcacttcta

SEQ ID NO: 26710 - DNA, 25 bp, Homo sapiens
ggtgaacagccacagttactgatat

SEQ ID NO: 26711 - DNA, 25 bp, Homo sapiens
gatactacaagttgagcatctctaa

SEQ ID NO: 26712 - DNA, 25 bp, Homo sapiens
tctttttgagcactgacttgacccc

SEQ ID NO: 26713 - DNA, 25 bp, Homo sapiens
gtatgcaagactgattctgtttgga

SEQ ID NO: 26714 - DNA, 25 bp, Homo sapiens
aacagtttcctatttggctgcattc

SEQ ID NO: 26715 - DNA, 25 bp, Homo sapiens
gctgcattctaggaggcctcctgac

SEQ ID NO: 26716 - DNA, 25 bp, Homo sapiens
aggcctcctgacttattcatagtat

SEQ ID NO: 26717 - DNA, 25 bp, Homo sapiens
ttcatagtattgtcgcctggtggca

SEQ ID NO: 26718 - DNA, 25 bp, Homo sapiens
ttgtcgcctggtggcattggtgtgg

SEQ ID NO: 26719 - DNA, 25 bp, Homo sapiens
gcttgtcctgctacttgctaaagtt

SEQ ID NO: 26720 - DNA, 25 bp, Homo sapiens
gctacttgctaaagttctctttctt

SEQ ID NO: 26721 - DNA, 25 bp, Homo sapiens
aatgaccatctcacaaaaacgagtt

SEQ ID NO: 26722 - DNA, 25 bp, Homo sapiens
gagtttagttgaatgctcaattcct

SEQ ID NO: 26723 - DNA, 25 bp, Homo sapiens
gctcaattccttacaaaatcttcat

SEQ ID NO: 26724 - DNA, 25 bp, Homo sapiens
gaccgtgagctggaggagtaccgca

SEQ ID NO: 26725 - DNA, 25 bp, Homo sapiens
aagaaaagagtcctccagaccagcc

SEQ ID NO: 26726 - DNA, 25 bp, Homo sapiens
tcccagcactcccatcaagctggag

SEQ ID NO: 26727 - DNA, 25 bp, Homo sapiens
gctggaggaagaccttgtgccggag

SEQ ID NO: 26728 - DNA, 25 bp, Homo sapiens
tgccggagccgactactggagatga

SEQ ID NO: 26729 - DNA, 25 bp, Homo sapiens
gacagtgatgctgccacctttaagc

SEQ ID NO: 26730 - DNA, 25 bp, Homo sapiens
tctgtcccctgatgaaccttcagaa

SEQ ID NO: 26731 - DNA, 25 bp, Homo sapiens
cactcggcttcccaatgttagagaa

SEQ ID NO: 26732 - DNA, 25 bp, Homo sapiens
ggaccctggcagcgatgggtctcca

SEQ ID NO: 26733 - DNA, 25 bp, Homo sapiens
taccccgtcctttctgaagaagagc

SEQ ID NO: 26734 - DNA, 25 bp, Homo sapiens
agaagagtgactcctgaaagccctg

SEQ ID NO: 26735 - DNA, 25 bp, Homo sapiens
gatcggggggatgaccagctggagt

SEQ ID NO: 26736 - DNA, 25 bp, Homo sapiens
ggatgacagagacagcgccaatggc

SEQ ID NO: 26737 - DNA, 25 bp, Homo sapiens
atcttatcccattatttctttacct

SEQ ID NO: 26738 - DNA, 25 bp, Homo sapiens
ttctttacctaggcgcttgtctaag

SEQ ID NO: 26739 - DNA, 25 bp, Homo sapiens
tcaaatttttcaccagatcctctcc

SEQ ID NO: 26740 - DNA, 25 bp, Homo sapiens
tcttcagcacatgctcactgttctc

SEQ ID NO: 26741 - DNA, 25 bp, Homo sapiens
ttgtccttcccatgttcattaattc

SEQ ID NO: 26742 - DNA, 25 bp, Homo sapiens
tgttcattaattcatattgccccgc

SEQ ID NO: 26743 - DNA, 25 bp, Homo sapiens
tcctttgacgctcctagtagttttg

SEQ ID NO: 26744 - DNA, 25 bp, Homo sapiens
acaccctcacattagtgtgctgcgt

SEQ ID NO: 26745 - DNA, 25 bp, Homo sapiens
gagggggacctactggatgatgatg

SEQ ID NO: 26746 - DNA, 25 bp, Homo sapiens
ttagattcagattcctggtgcctcc

SEQ ID NO: 26747 - DNA, 25 bp, Homo sapiens
cctgggaacagactcctgtagaccc

SEQ ID NO: 26748 - DNA, 25 bp, Homo sapiens
ctagtctcctgagcctatagagccc

SEQ ID NO: 26749 - DNA, 25 bp, Homo sapiens
tagagcccccaggagactgggaccc

SEQ ID NO: 26750 - DNA, 25 bp, Homo sapiens
gggacccaaagaacttcacagcaca

SEQ ID NO: 26751 - DNA, 25 bp, Homo sapiens
tcacagcacacttaccgaatgcaga

SEQ ID NO: 26752 - DNA, 25 bp, Homo sapiens
tgcagagagcagctttcctggcttt

SEQ ID NO: 26753 - DNA, 25 bp, Homo sapiens
gcagaggctctgaagcactttcctt

SEQ ID NO: 26754 - DNA, 25 bp, Homo sapiens
tagcaacagcagctctgtacctcat

SEQ ID NO: 26755 - DNA, 25 bp, Homo sapiens
tctgttgatcccacctttgaagagg

SEQ ID NO: 26756 - DNA, 25 bp, Homo sapiens
gacacagtgctcaccttaattgcgc

SEQ ID NO: 26757 - DNA, 25 bp, Homo sapiens
tggggctgagcaaggcctacgtagg

SEQ ID NO: 26758 - DNA, 25 bp, Homo sapiens
caggcaacaacatgctgctggtggg

SEQ ID NO: 26759 - DNA, 25 bp, Homo sapiens
tgctggtgggggttcatggcccaag

SEQ ID NO: 26760 - DNA, 25 bp, Homo sapiens
ccccctgcgaggagatcctggtgaa

SEQ ID NO: 26761 - DNA, 25 bp, Homo sapiens
gatcctggtgaagcacgtgggcagc

SEQ ID NO: 26762 - DNA, 25 bp, Homo sapiens
gcgtgtcctacctgctcaaggacaa

SEQ ID NO: 26763 - DNA, 25 bp, Homo sapiens
gggggagtacacactggtggtcaaa

SEQ ID NO: 26764 - DNA, 25 bp, Homo sapiens
aatggggggacgagcacatcccagg

SEQ ID NO: 26765 - DNA, 25 bp, Homo sapiens
tctcggctttcacttgggcagaggg

SEQ ID NO: 26766 - DNA, 25 bp, Homo sapiens
gagggagccatttggtggcgctgct

SEQ ID NO: 26767 - DNA, 25 bp, Homo sapiens
tgtcttctttggttctgggaggggt

SEQ ID NO: 26768 - DNA, 25 bp, Homo sapiens
gtctctttcctactgagcacatatt

SEQ ID NO: 26769 - DNA, 25 bp, Homo sapiens
aggctgtgctttctaaggactgctc

SEQ ID NO: 26770 - DNA, 25 bp, Homo sapiens
gactgctcttagccagtgactgcag

SEQ ID NO: 26771 - DNA, 25 bp, Homo sapiens
gcagagcagggataccaaggcaggc

SEQ ID NO: 26772 - DNA, 25 bp, Homo sapiens
ccaacctccttggactgcaaacaat

SEQ ID NO: 26773 - DNA, 25 bp, Homo sapiens
ctgcaaacaatctaggacacctcca

SEQ ID NO: 26774 - DNA, 25 bp, Homo sapiens
ccagccttccttggtttggatgttt

SEQ ID NO: 26775 - DNA, 25 bp, Homo sapiens
ttgtcccctccttaatttatgttga

SEQ ID NO: 26776 - DNA, 25 bp, Homo sapiens
atgggatcaggtgcccttatgaaaa

SEQ ID NO: 26777 - DNA, 25 bp, Homo sapiens
atgagccctcaacagacaactgcac

SEQ ID NO: 26778 - DNA, 25 bp, Homo sapiens
gacaactgcacctactgatgttttg

SEQ ID NO: 26779 - DNA, 25 bp, Homo sapiens
aagtgtcatttgcaacccagatgta

SEQ ID NO: 26780 - DNA, 25 bp, Homo sapiens
ttaaaagtattccatgctcagtatt

SEQ ID NO: 26781 - DNA, 25 bp, Homo sapiens
gtattttttattgtcctgctacagc

SEQ ID NO: 26782 - DNA, 25 bp, Homo sapiens
gtcctgctacagctagtgtgctttt

SEQ ID NO: 26783 - DNA, 25 bp, Homo sapiens
ttaaggctattgtcctttgttcctt

SEQ ID NO: 26784 - DNA, 25 bp, Homo sapiens
gtgcatcgtgatgtgattgcttggc

SEQ ID NO: 26785 - DNA, 25 bp, Homo sapiens
gtgattgcttggctattgtctgaat

SEQ ID NO: 26786 - DNA, 25 bp, Homo sapiens
gactaatgctttgattggatttgcc

SEQ ID NO: 26787 - DNA, 25 bp, Homo sapiens
atttgccagttcaccggacagtgat

SEQ ID NO: 26788 - DNA, 25 bp, Homo sapiens
atataatcggtttcagtgcaactgg

SEQ ID NO: 26789 - DNA, 25 bp, Homo sapiens
gtgcaactggatggtctgcttttaa

SEQ ID NO: 26790 - DNA, 25 bp, Homo sapiens
ggaaaacttcgaagcagctgttggc

SEQ ID NO: 26791 - DNA, 25 bp, Homo sapiens
ctccccttattgctgatgtttatta

SEQ ID NO: 26792 - DNA, 25 bp, Homo sapiens
gagggggtggtcatcacgaggaaca

SEQ ID NO: 26793 - DNA, 25 bp, Homo sapiens
agagatggcccagcagacatttggc

SEQ ID NO: 26794 - DNA, 25 bp, Homo sapiens
gatcctttgaatggagcgtggttcc

SEQ ID NO: 26795 - DNA, 25 bp, Homo sapiens
gagcgtggttccgagttgagacaaa

SEQ ID NO: 26796 - DNA, 25 bp, Homo sapiens
gttgagacaaattacgaccactgga

SEQ ID NO: 26797 - DNA, 25 bp, Homo sapiens
ttacgaccactggaagccagcaccc

SEQ ID NO: 26798 - DNA, 25 bp, Homo sapiens
gccagcacccaaggaagatgaccgg

SEQ ID NO: 26799 - DNA, 25 bp, Homo sapiens
tgccatcaaggcccttaatgctaca

SEQ ID NO: 26800 - DNA, 25 bp, Homo sapiens
tgctacaggacaagcaaacctcagc

SEQ ID NO: 26801 - DNA, 25 bp, Homo sapiens
atggaatgcgtgaggctggcttctg

SEQ ID NO: 26802 - DNA, 25 bp, Homo sapiens
gacttcctgttgtcttcatcaaagc

SEQ ID NO: 26803 - DNA, 25 bp, Homo sapiens
tcaaagcttttttccgtggtattct

SEQ ID NO: 26804 - DNA, 25 bp, Homo sapiens
ggagggcatctgtgttagtcctttc

SEQ ID NO: 26805 - DNA, 25 bp, Homo sapiens
ccgccacactcactgtcagtattaa

SEQ ID NO: 26806 - DNA, 25 bp, Homo sapiens
gcagcctgttgataagctaccctgt

SEQ ID NO: 26807 - DNA, 25 bp, Homo sapiens
ccctgtctcaccatgtgctggtgtg

SEQ ID NO: 26808 - DNA, 25 bp, Homo sapiens
tagatggaatccccactggtcagag

SEQ ID NO: 26809 - DNA, 25 bp, Homo sapiens
aaagctatgcggacactccagcttg

SEQ ID NO: 26810 - DNA, 25 bp, Homo sapiens
acccgctagtctggctgttaagagg

SEQ ID NO: 26811 - DNA, 25 bp, Homo sapiens
gaaagcaaccattcctatttttgtt

SEQ ID NO: 26812 - DNA, 25 bp, Homo sapiens
gttgtaacaatatctatgaccactg

SEQ ID NO: 26813 - DNA, 25 bp, Homo sapiens
atgaccactgttagcccattatatt

SEQ ID NO: 26814 - DNA, 25 bp, Homo sapiens
gtaagttttcatatcatgtgctgta

SEQ ID NO: 26815 - DNA, 25 bp, Homo sapiens
tcatgtgctgtaaagttttcctaaa

SEQ ID NO: 26816 - DNA, 25 bp, Homo sapiens
gaggctttaacgtaaacactggtga

SEQ ID NO: 26817 - DNA, 25 bp, Homo sapiens
ggtgacataaaccattcattgctac

SEQ ID NO: 26818 - DNA, 25 bp, Homo sapiens
accattcattgctacgttgcttatt

SEQ ID NO: 26819 - DNA, 25 bp, Homo sapiens
gttgcttattgtgtttttatgctgt

SEQ ID NO: 26820 - DNA, 25 bp, Homo sapiens
tatgctgttttatacttttttatga

SEQ ID NO: 26821 - DNA, 25 bp, Homo sapiens
aaaaatgcttttatcttgctataga

SEQ ID NO: 26822 - DNA, 25 bp, Homo sapiens
gtggactgtattttgatgcaacaac

SEQ ID NO: 26823 - DNA, 25 bp, Homo sapiens
caccacagatgtctcccagatgggc

SEQ ID NO: 26824 - DNA, 25 bp, Homo sapiens
cagatgtctcccagatgggccttgg

SEQ ID NO: 26825 - DNA, 25 bp, Homo sapiens
ctgcccagcagagctggcttctggg

SEQ ID NO: 26826 - DNA, 25 bp, Homo sapiens
ccagcagagctggcttctgggtcca

SEQ ID NO: 26827 - DNA, 25 bp, Homo sapiens
gcacgtggctcatggggcagaattg

SEQ ID NO: 26828 - DNA, 25 bp, Homo sapiens
cgtggctcatggggcagaattgcca

SEQ ID NO: 26829 - DNA, 25 bp, Homo sapiens
ccttgagatctctgctctttgtcag

SEQ ID NO: 26830 - DNA, 25 bp, Homo sapiens
tctctgctctttgtcagagatttgc

SEQ ID NO: 26831 - DNA, 25 bp, Homo sapiens
gactcacgtttttgttgttttctca

SEQ ID NO: 26832 - DNA, 25 bp, Homo sapiens
tcacgtttttgttgttttctcatca

SEQ ID NO: 26833 - DNA, 25 bp, Homo sapiens
gtttttgttgttttctcatcattcc

SEQ ID NO: 26834 - DNA, 25 bp, Homo sapiens
ggtctaatctcttttgtgtttttgt

SEQ ID NO: 26835 - DNA, 25 bp, Homo sapiens
gcccggctgcgtagcagttgagtga

SEQ ID NO: 26836 - DNA, 25 bp, Homo sapiens
aaggtggcctgttgcagtgcagagt

SEQ ID NO: 26837 - DNA, 25 bp, Homo sapiens
gtgcagagtgctgagctgcttcctg

SEQ ID NO: 26838 - DNA, 25 bp, Homo sapiens
ttcttctgattgctcctggggaaaa

SEQ ID NO: 26839 - DNA, 25 bp, Homo sapiens
ggaaaacacgccttgtcctgaagaa

SEQ ID NO: 26840 - DNA, 25 bp, Homo sapiens
taaaatgcctgtcaactgcacttcc

SEQ ID NO: 26841 - DNA, 25 bp, Homo sapiens
gcagtgagcacatctagctgacgat

SEQ ID NO: 26842 - DNA, 25 bp, Homo sapiens
agctgacgataatcacaccttttcc

SEQ ID NO: 26843 - DNA, 25 bp, Homo sapiens
tacgctaaccattgtttctgtagtt

SEQ ID NO: 26844 - DNA, 25 bp, Homo sapiens
tgttttcttggtgttatcttttctc

SEQ ID NO: 26845 - DNA, 25 bp, Homo sapiens
ctaccgccttgttttaggagcctgc

SEQ ID NO: 26846 - DNA, 25 bp, Homo sapiens
ctcctgtcagtatgaaaccctcacc

SEQ ID NO: 26847 - DNA, 25 bp, Homo sapiens
aaccctcacctgaaaaatgccagcc

SEQ ID NO: 26848 - DNA, 25 bp, Homo sapiens
ttcaacaggcacattatttccccct

SEQ ID NO: 26849 - DNA, 25 bp, Homo sapiens
tttccccctgagatccataagggaa

SEQ ID NO: 26850 - DNA, 25 bp, Homo sapiens
aaaatagtagtcctttggtcatcct

SEQ ID NO: 26851 - DNA, 25 bp, Homo sapiens
gtcctttggtcatcctatttttgct

SEQ ID NO: 26852 - DNA, 25 bp, Homo sapiens
gagttttctctcattatcagattct

SEQ ID NO: 26853 - DNA, 25 bp, Homo sapiens
agtgtgctacagacttcttattata

SEQ ID NO: 26854 - DNA, 25 bp, Homo sapiens
aacagcattctattctacatcaaaa

SEQ ID NO: 26855 - DNA, 25 bp, Homo sapiens
taaaatccttaggggctttatctat

SEQ ID NO: 26856 - DNA, 25 bp, Homo sapiens
gatggttagagatgagcggaggttt

SEQ ID NO: 26857 - DNA, 25 bp, Homo sapiens
aaggatggagacctcattgccacca

SEQ ID NO: 26858 - DNA, 25 bp, Homo sapiens
aggaggagttcacagctttcctgca

SEQ ID NO: 26859 - DNA, 25 bp, Homo sapiens
gagtatattggtgacatgtacagcc

SEQ ID NO: 26860 - DNA, 25 bp, Homo sapiens
gccatgatgggaatactgatgagcc

SEQ ID NO: 26861 - DNA, 25 bp, Homo sapiens
agagcagtttgttgagtttcgggat

SEQ ID NO: 26862 - DNA, 25 bp, Homo sapiens
gagaccaaagactggatccttccct

SEQ ID NO: 26863 - DNA, 25 bp, Homo sapiens
tccttccctcagactatgatcatgc

SEQ ID NO: 26864 - DNA, 25 bp, Homo sapiens
ggcagaagccaggcacctggtctat

SEQ ID NO: 26865 - DNA, 25 bp, Homo sapiens
ggatggcaagcttaccaaggaggag

SEQ ID NO: 26866 - DNA, 25 bp, Homo sapiens
ggagatcgttgacaagtatgactta

SEQ ID NO: 26867 - DNA, 25 bp, Homo sapiens
gcaggatgggggactgatcggtgcc

SEQ ID NO: 26868 - DNA, 25 bp, Homo sapiens
ggaagagcgggaatccgtgggccca

SEQ ID NO: 26869 - DNA, 25 bp, Homo sapiens
tggtcatcgcagtggccattgccac

SEQ ID NO: 26870 - DNA, 25 bp, Homo sapiens
gtcatcgtcatcagcctggtgatgc

SEQ ID NO: 26871 - DNA, 25 bp, Homo sapiens
gaggcagtatggcaccatcagccac

SEQ ID NO: 26872 - DNA, 25 bp, Homo sapiens
tggaggttgatccaatgctcacccc

SEQ ID NO: 26873 - DNA, 25 bp, Homo sapiens
gaaccatggctatgagaaccccacc

SEQ ID NO: 26874 - DNA, 25 bp, Homo sapiens
accccacctacaaatacctggagca

SEQ ID NO: 26875 - DNA, 25 bp, Homo sapiens
ttaggtggcagggagcgcggcagcc

SEQ ID NO: 26876 - DNA, 25 bp, Homo sapiens
ggcggagggatgcagatgtgcaggc

SEQ ID NO: 26877 - DNA, 25 bp, Homo sapiens
tcctctctggactttctccaaaggc

SEQ ID NO: 26878 - DNA, 25 bp, Homo sapiens
gatgtatcggcaagcagtgtaaacg

SEQ ID NO: 26879 - DNA, 25 bp, Homo sapiens
gcagtgtaaacggaggacttgggga

SEQ ID NO: 26880 - DNA, 25 bp, Homo sapiens
gaaaaaggaccacatagtccatcga

SEQ ID NO: 26881 - DNA, 25 bp, Homo sapiens
atagtccatcgaagaagagtccttg

SEQ ID NO: 26882 - DNA, 25 bp, Homo sapiens
agagtccttggaacaagcaactggc

SEQ ID NO: 26883 - DNA, 25 bp, Homo sapiens
tggaacaagcaactggctattgaaa

SEQ ID NO: 26884 - DNA, 25 bp, Homo sapiens
agtgcagagtgcttggctgtttcct

SEQ ID NO: 26885 - DNA, 25 bp, Homo sapiens
ctcccgattgctcctgtgtaaagat

SEQ ID NO: 26886 - DNA, 25 bp, Homo sapiens
cctgtgtaaagatgccttgtcgtgc

SEQ ID NO: 26887 - DNA, 25 bp, Homo sapiens
gatgccttgtcgtgcagaaacaaat

SEQ ID NO: 26888 - DNA, 25 bp, Homo sapiens
aacggagcatacagtgagcacatct

SEQ ID NO: 26889 - DNA, 25 bp, Homo sapiens
aacgatcgcgtcttcgagaaagaac

SEQ ID NO: 26890 - DNA, 25 bp, Homo sapiens
ccacacgttccggcagtcggatacg

SEQ ID NO: 26891 - DNA, 25 bp, Homo sapiens
ggcagtcggatacgcctcgaaaaag

SEQ ID NO: 26892 - DNA, 25 bp, Homo sapiens
gacaggttcacaatatgtgcctaaa

SEQ ID NO: 26893 - DNA, 25 bp, Homo sapiens
cagaggacaactttgactttcaaga

SEQ ID NO: 26894 - DNA, 25 bp, Homo sapiens
agtgacatcttgaaaccacctcacc

SEQ ID NO: 26895 - DNA, 25 bp, Homo sapiens
cagaaccattggagcacctgtggcc

SEQ ID NO: 26896 - DNA, 25 bp, Homo sapiens
ctcggcacactgcttatcacttgaa

SEQ ID NO: 26897 - DNA, 25 bp, Homo sapiens
gtgttatatttatctgtgtgtctga

SEQ ID NO: 26898 - DNA, 25 bp, Homo sapiens
cccactggttcaaacgtcacggagc

SEQ ID NO: 26899 - DNA, 25 bp, Homo sapiens
tcaaacgtcacggagcaggttcccc

SEQ ID NO: 26900 - DNA, 25 bp, Homo sapiens
ttctgactttgacctcttagagacg

SEQ ID NO: 26901 - DNA, 25 bp, Homo sapiens
agagacgcagtctgcttgttccgac

SEQ ID NO: 26902 - DNA, 25 bp, Homo sapiens
gttccgacacttcagaaagcagcgc

SEQ ID NO: 26903 - DNA, 25 bp, Homo sapiens
agaaagcagcgctgcagggggccaa

SEQ ID NO: 26904 - DNA, 25 bp, Homo sapiens
ccaaaatcccaaccatgtctaagaa

SEQ ID NO: 26905 - DNA, 25 bp, Homo sapiens
tgtctaagaagaccaccactgcctc

SEQ ID NO: 26906 - DNA, 25 bp, Homo sapiens
aggtcccaagcgataacactgtcta

SEQ ID NO: 26907 - DNA, 25 bp, Homo sapiens
tgcctcctggtaaccctgtaatgga

SEQ ID NO: 26908 - DNA, 25 bp, Homo sapiens
attaatagggtttctgcgcggtgca

SEQ ID NO: 26909 - DNA, 25 bp, Homo sapiens
ggattattcctaaatgcatcttctt

SEQ ID NO: 26910 - DNA, 25 bp, Homo sapiens
tataaacttgacttgctatctcagc

SEQ ID NO: 26911 - DNA, 25 bp, Homo sapiens
cccaaaaggctgtccgggcaatggc

SEQ ID NO: 26912 - DNA, 25 bp, Homo sapiens
ctgtccgggcaatggcagtgctgac

SEQ ID NO: 26913 - DNA, 25 bp, Homo sapiens
ggcagtgctgacagatcacccatat

SEQ ID NO: 26914 - DNA, 25 bp, Homo sapiens
tttcctcctgcaccgtggaggtggg

SEQ ID NO: 26915 - DNA, 25 bp, Homo sapiens
tggaggtggggatctgcccaacagc

SEQ ID NO: 26916 - DNA, 25 bp, Homo sapiens
tgcccaacagccaggaggcactgca

SEQ ID NO: 26917 - DNA, 25 bp, Homo sapiens
ctgtgtcctgctcagaactggagaa

SEQ ID NO: 26918 - DNA, 25 bp, Homo sapiens
gaactggagaaggctggcgccgggc

SEQ ID NO: 26919 - DNA, 25 bp, Homo sapiens
gctggccaggggtaggatagtatag

SEQ ID NO: 26920 - DNA, 25 bp, Homo sapiens
gcagtagttgggagagagcctcaat

SEQ ID NO: 26921 - DNA, 25 bp, Homo sapiens
ggagagagcctcaatattgggggag

SEQ ID NO: 26922 - DNA, 25 bp, Homo sapiens
accaggatcatctacgaccgaaagt

SEQ ID NO: 26923 - DNA, 25 bp, Homo sapiens
gaccgaaagttcctgctggagtgca

SEQ ID NO: 26924 - DNA, 25 bp, Homo sapiens
ggagtgcaagaactcacccattgcc

SEQ ID NO: 26925 - DNA, 25 bp, Homo sapiens
gagatacccgatgacgcacaatttg

SEQ ID NO: 26926 - DNA, 25 bp, Homo sapiens
gtgcagatgacctggcatgtggagt

SEQ ID NO: 26927 - DNA, 25 bp, Homo sapiens
gttacagagggatccctcatgccac

SEQ ID NO: 26928 - DNA, 25 bp, Homo sapiens
ggcctcatctaatctggaagggagt

SEQ ID NO: 26929 - DNA, 25 bp, Homo sapiens
gagtgacttgttagttccaggcctc

SEQ ID NO: 26930 - DNA, 25 bp, Homo sapiens
ccaggcctcctttagttctgaggca

SEQ ID NO: 26931 - DNA, 25 bp, Homo sapiens
gaggcagctagaccagggataggag

SEQ ID NO: 26932 - DNA, 25 bp, Homo sapiens
gtaagtcaccttctgactgcttagt

SEQ ID NO: 26933 - DNA, 25 bp, Homo sapiens
acttctctattgacacttttacctc

SEQ ID NO: 26934 - DNA, 25 bp, Homo sapiens
tgacacttttacctcaccgaggggg

SEQ ID NO: 26935 - DNA, 25 bp, Homo sapiens
gaactgctgttccctagaatgaagg

SEQ ID NO: 26936 - DNA, 25 bp, Homo sapiens
agaatgaaggtctgttgtttggttt

SEQ ID NO: 26937 - DNA, 25 bp, Homo sapiens
ttatatgattttgctggactatttc

SEQ ID NO: 26938 - DNA, 25 bp, Homo sapiens
ggactatttcactagaaaccacgta

SEQ ID NO: 26939 - DNA, 25 bp, Homo sapiens
gaataggactaactgatctcttttg

SEQ ID NO: 26940 - DNA, 25 bp, Homo sapiens
aaaggggctgatttgcttattcatc

SEQ ID NO: 26941 - DNA, 25 bp, Homo sapiens
atgtggacagtaatcttaatttcaa

SEQ ID NO: 26942 - DNA, 25 bp, Homo sapiens
gaggatactacggtgtagcttaagt

SEQ ID NO: 26943 - DNA, 25 bp, Homo sapiens
agcacaaattacttctaacaaggca

SEQ ID NO: 26944 - DNA, 25 bp, Homo sapiens
gtgtcacactgtattaggatctgca

SEQ ID NO: 26945 - DNA, 25 bp, Homo sapiens
gatctgcatttctaaaactgacgtg

SEQ ID NO: 26946 - DNA, 25 bp, Homo sapiens
ttaaaagccaatgcaacccacccaa

SEQ ID NO: 26947 - DNA, 25 bp, Homo sapiens
aacccacccaattgaatctgcattt

SEQ ID NO: 26948 - DNA, 25 bp, Homo sapiens
gggcaattgattgggccattccgag

SEQ ID NO: 26949 - DNA, 25 bp, Homo sapiens
gattgtttaaccaaacccagttgca

SEQ ID NO: 26950 - DNA, 25 bp, Homo sapiens
tacagatccacgtgtactggcacct

SEQ ID NO: 26951 - DNA, 25 bp, Homo sapiens
ggcacctcagaagaccaaatcatgg

SEQ ID NO: 26952 - DNA, 25 bp, Homo sapiens
tacaatgtctttatccctgtgggca

SEQ ID NO: 26953 - DNA, 25 bp, Homo sapiens
ggggctactgttgttacagtctcat

SEQ ID NO: 26954 - DNA, 25 bp, Homo sapiens
acagtctcatatgtatcccagcaca

SEQ ID NO: 26955 - DNA, 25 bp, Homo sapiens
ggaagtcctgatactgaatctccag

SEQ ID NO: 26956 - DNA, 25 bp, Homo sapiens
gaatctccagtgttagtgaatgact

SEQ ID NO: 26957 - DNA, 25 bp, Homo sapiens
gaagatttaccactgaaactgacaa

SEQ ID NO: 26958 - DNA, 25 bp, Homo sapiens
gaacctgaaacggtgggagcccaga

SEQ ID NO: 26959 - DNA, 25 bp, Homo sapiens
gggagcccagagtatatgagatgtc

SEQ ID NO: 26960 - DNA, 25 bp, Homo sapiens
atgtcttcagaggctcatctaactc

SEQ ID NO: 26961 - DNA, 25 bp, Homo sapiens
catctaactctgtccttacatactc

SEQ ID NO: 26962 - DNA, 25 bp, Homo sapiens
gtttgacactgcttttttgataggt

SEQ ID NO: 26963 - DNA, 25 bp, Homo sapiens
tgataggtgtggtcatttctcccca

SEQ ID NO: 26964 - DNA, 25 bp, Homo sapiens
gatttaagccttgacacactgtgtt

SEQ ID NO: 26965 - DNA, 25 bp, Homo sapiens
atttttttccccattgtgatgtttg

SEQ ID NO: 26966 - DNA, 25 bp, Homo sapiens
gtatccaggctaagacaaccaaacc

SEQ ID NO: 26967 - DNA, 25 bp, Homo sapiens
caaaaagccgatctgcacaggccgc

SEQ ID NO: 26968 - DNA, 25 bp, Homo sapiens
gccgcacctgaaccaagatttgaac

SEQ ID NO: 26969 - DNA, 25 bp, Homo sapiens
gtccaacatctttgatgatcccctg

SEQ ID NO: 26970 - DNA, 25 bp, Homo sapiens
gatcccctgaatgcctttggaggcc

SEQ ID NO: 26971 - DNA, 25 bp, Homo sapiens
ggccagtagagcacacagggtatcc

SEQ ID NO: 26972 - DNA, 25 bp, Homo sapiens
cacatgttaccctgcagctacattg

SEQ ID NO: 26973 - DNA, 25 bp, Homo sapiens
gtatttttctgcactggtttaatca

SEQ ID NO: 26974 - DNA, 25 bp, Homo sapiens
tagttagccttgctggggccataat

SEQ ID NO: 26975 - DNA, 25 bp, Homo sapiens
tcagggtgtgtatgccacctgacca

SEQ ID NO: 26976 - DNA, 25 bp, Homo sapiens
gccacctgaccagaagtctttgtta

SEQ ID NO: 26977 - DNA, 25 bp, Homo sapiens
ctaccagccctgtaatggcatggcc

SEQ ID NO: 26978 - DNA, 25 bp, Homo sapiens
tacccctgggtctataactaccagc

SEQ ID NO: 26979 - DNA, 25 bp, Homo sapiens
gaagggatctttgcccaggaattcc

SEQ ID NO: 26980 - DNA, 25 bp, Homo sapiens
ggaattccccgacttggagaatgtg

SEQ ID NO: 26981 - DNA, 25 bp, Homo sapiens
tgtggtcaagggccaccacgttagc

SEQ ID NO: 26982 - DNA, 25 bp, Homo sapiens
ttggagatgacctgtactccggctg

SEQ ID NO: 26983 - DNA, 25 bp, Homo sapiens
cctgcaggtccagttctggcacaaa

SEQ ID NO: 26984 - DNA, 25 bp, Homo sapiens
gaatgtgaaccagatagctttccct

SEQ ID NO: 26985 - DNA, 25 bp, Homo sapiens
gaccactccaaatggtgcgtgtccc

SEQ ID NO: 26986 - DNA, 25 bp, Homo sapiens
cctggacctgcgtgggtgacatgaa

SEQ ID NO: 26987 - DNA, 25 bp, Homo sapiens
gagaggagcaacggggtgggggcac

SEQ ID NO: 26988 - DNA, 25 bp, Homo sapiens
ggctttcttatctaaactgcactga

SEQ ID NO: 26989 - DNA, 25 bp, Homo sapiens
gtaactattacctaccagtattgtt

SEQ ID NO: 26990 - DNA, 25 bp, Homo sapiens
ttgtagcttgctgcttgtttcacca

SEQ ID NO: 26991 - DNA, 25 bp, Homo sapiens
ctgcttgtttcaccactggtcaaat

SEQ ID NO: 26992 - DNA, 25 bp, Homo sapiens
aaccattaaattgccattcactttt

SEQ ID NO: 26993 - DNA, 25 bp, Homo sapiens
aagtgtgtgtcctctgaggtgcttg

SEQ ID NO: 26994 - DNA, 25 bp, Homo sapiens
gtacactgcagaactgcccattctc

SEQ ID NO: 26995 - DNA, 25 bp, Homo sapiens
ccattctcattactgtgtcctattt

SEQ ID NO: 26996 - DNA, 25 bp, Homo sapiens
ctgtgtcctattttattcatgcctg

SEQ ID NO: 26997 - DNA, 25 bp, Homo sapiens
tttattcatgcctgtgtgtttttct

SEQ ID NO: 26998 - DNA, 25 bp, Homo sapiens
tcatgagcacttttgctggttccag

SEQ ID NO: 26999 - DNA, 25 bp, Homo sapiens
gacaaaaagacaaacacacccacac

SEQ ID NO: 27000 - DNA, 25 bp, Homo sapiens
cccacacgcagtctttgcagtatct

SEQ ID NO: 27001 - DNA, 25 bp, Homo sapiens
ggaagttacttcaagcacttgccag

SEQ ID NO: 27002 - DNA, 25 bp, Homo sapiens
gcacttgccagtactatgatattca

SEQ ID NO: 27003 - DNA, 25 bp, Homo sapiens
tcaagtaccttgcagcatttctctg

SEQ ID NO: 27004 - DNA, 25 bp, Homo sapiens
catttctctgccattgctttcaatg

SEQ ID NO: 27005 - DNA, 25 bp, Homo sapiens
ggcatcctggatattagacctatta

SEQ ID NO: 27006 - DNA, 25 bp, Homo sapiens
gaggttttcttttgcttgagtggac

SEQ ID NO: 27007 - DNA, 25 bp, Homo sapiens
gtagcacctgtatcattgaactcat

SEQ ID NO: 27008 - DNA, 25 bp, Homo sapiens
taaaacacgtcccttaactgcattg

SEQ ID NO: 27009 - DNA, 25 bp, Homo sapiens
gggtttattttgatttctcatctga

SEQ ID NO: 27010 - DNA, 25 bp, Homo sapiens
aaagctttactttacaatgcccaat

SEQ ID NO: 27011 - DNA, 25 bp, Homo sapiens
acaatgcccaattggaggccttaca

SEQ ID NO: 27012 - DNA, 25 bp, Homo sapiens
aggccttacatggaatgctgctctc

SEQ ID NO: 27013 - DNA, 25 bp, Homo sapiens
atgtccgagatccttccagatgaat

SEQ ID NO: 27014 - DNA, 25 bp, Homo sapiens
aatggaacctcttctgatttgagct

SEQ ID NO: 27015 - DNA, 25 bp, Homo sapiens
tttgagctcacaatgtctctctgca

SEQ ID NO: 27016 - DNA, 25 bp, Homo sapiens
tgcaccaagctccatgactcaggat

SEQ ID NO: 27017 - DNA, 25 bp, Homo sapiens
aaagaccagttgttttcacagcctc

SEQ ID NO: 27018 - DNA, 25 bp, Homo sapiens
cacagcctccagtgttaaggacagc

SEQ ID NO: 27019 - DNA, 25 bp, Homo sapiens
gaggacgaatccatgaaccaaccag

SEQ ID NO: 27020 - DNA, 25 bp, Homo sapiens
atgactgcacttggtcacacaagac

SEQ ID NO: 27021 - DNA, 25 bp, Homo sapiens
ctcccctcacccagagaaatacatg

SEQ ID NO: 27022 - DNA, 25 bp, Homo sapiens
atcatgtccctgaaacgaatgctgg

SEQ ID NO: 27023 - DNA, 25 bp, Homo sapiens
ttggagtccccaagactcacctaga

SEQ ID NO: 27024 - DNA, 25 bp, Homo sapiens
ttggagaggtgtccagtggctccgg

SEQ ID NO: 27025 - DNA, 25 bp, Homo sapiens
agtggctccggggagacgttcagct

SEQ ID NO: 27026 - DNA, 25 bp, Homo sapiens
ttcagctaccctgactttctcagga

SEQ ID NO: 27027 - DNA, 25 bp, Homo sapiens
gctgggcaagagatctgccatccta

SEQ ID NO: 27028 - DNA, 25 bp, Homo sapiens
ccccccagccaagaaagctatctct

SEQ ID NO: 27029 - DNA, 25 bp, Homo sapiens
aagctatctctgagttgccctgatt

SEQ ID NO: 27030 - DNA, 25 bp, Homo sapiens
ggggcttctaatgacccagatatgg

SEQ ID NO: 27031 - DNA, 25 bp, Homo sapiens
tgctgaaaaccctccagtcagcgct

SEQ ID NO: 27032 - DNA, 25 bp, Homo sapiens
acagagcttcctgtacacagttgca

SEQ ID NO: 27033 - DNA, 25 bp, Homo sapiens
cacagttgcatgtactgcattatgc

SEQ ID NO: 27034 - DNA, 25 bp, Homo sapiens
atattttatgtaacctgtccactgt

SEQ ID NO: 27035 - DNA, 25 bp, Homo sapiens
acctgtccactgttggtaggcactt

SEQ ID NO: 27036 - DNA, 25 bp, Homo sapiens
gagttgttttagtcttttgctatca

SEQ ID NO: 27037 - DNA, 25 bp, Homo sapiens
gggatgattaaccctgatttactgc

SEQ ID NO: 27038 - DNA, 25 bp, Homo sapiens
gaaattgctctgctattctgctgga

SEQ ID NO: 27039 - DNA, 25 bp, Homo sapiens
tccagtcactcttgggctagactca

SEQ ID NO: 27040 - DNA, 25 bp, Homo sapiens
ttgggctagactcaacgttcttaaa

SEQ ID NO: 27041 - DNA, 25 bp, Homo sapiens
aaaactatgtggccatcaccaaatt

SEQ ID NO: 27042 - DNA, 25 bp, Homo sapiens
ttcccaaattccagcctggcatgag

SEQ ID NO: 27043 - DNA, 25 bp, Homo sapiens
aagtcagtgtgggccatccatctga

SEQ ID NO: 27044 - DNA, 25 bp, Homo sapiens
gtgcatctgtcatccgaatgctgca

SEQ ID NO: 27045 - DNA, 25 bp, Homo sapiens
atgctgccgcaggtaatctttaata

SEQ ID NO: 27046 - DNA, 25 bp, Homo sapiens
attgtcactctatccaggctgggac

SEQ ID NO: 27047 - DNA, 25 bp, Homo sapiens
caaaaaattcctgttcttcatcccg

SEQ ID NO: 27048 - DNA, 25 bp, Homo sapiens
ccgccagtgggttgctctggttgtg

SEQ ID NO: 27049 - DNA, 25 bp, Homo sapiens
ggacatgaacttgcccatcaatggt

SEQ ID NO: 27050 - DNA, 25 bp, Homo sapiens
ggaatggtggactcatctttggtta

SEQ ID NO: 27051 - DNA, 25 bp, Homo sapiens
agaccactgcttcccagagtatgat

SEQ ID NO: 27052 - DNA, 25 bp, Homo sapiens
agtttgtttctgctgattacacccg

SEQ ID NO: 27053 - DNA, 25 bp, Homo sapiens
gacgccttagataacagccatccta

SEQ ID NO: 27054 - DNA, 25 bp, Homo sapiens
gtcaaaacggagagtcacccaactg

SEQ ID NO: 27055 - DNA, 25 bp, Homo sapiens
gagtcacccaactgtgtggaagaca

SEQ ID NO: 27056 - DNA, 25 bp, Homo sapiens
actgtgtggaagacaagatgctctc

SEQ ID NO: 27057 - DNA, 25 bp, Homo sapiens
ttgcagtacttacccttggctaaga

SEQ ID NO: 27058 - DNA, 25 bp, Homo sapiens
cagtacttacccttggctaagaact

SEQ ID NO: 27059 - DNA, 25 bp, Homo sapiens
tatgtcgctgtccaagagaaggctg

SEQ ID NO: 27060 - DNA, 25 bp, Homo sapiens
ggctgtggaagaacctatacaactg

SEQ ID NO: 27061 - DNA, 25 bp, Homo sapiens
tacaactgtgtttaatctccaaagc

SEQ ID NO: 27062 - DNA, 25 bp, Homo sapiens
ccgcccttttgtgtgtgaacatgct

SEQ ID NO: 27063 - DNA, 25 bp, Homo sapiens
gtctcactaggcatgctgttgtaca

SEQ ID NO: 27064 - DNA, 25 bp, Homo sapiens
gctgttgtacatgatcctgacaaga

SEQ ID NO: 27065 - DNA, 25 bp, Homo sapiens
tctccaaatcaaaccacagtatatg

SEQ ID NO: 27066 - DNA, 25 bp, Homo sapiens
aaaggcacaccacatctgaataatc

SEQ ID NO: 27067 - DNA, 25 bp, Homo sapiens
gtaagttttcatatcatgtgctgta

SEQ ID NO: 27068 - DNA, 25 bp, Homo sapiens
tcatgtgctgtaaagttttcctaaa

SEQ ID NO: 27069 - DNA, 25 bp, Homo sapiens
gaggctttaacgtaaacactggtga

SEQ ID NO: 27070 - DNA, 25 bp, Homo sapiens
ggtgacataaaccattcattgctac

SEQ ID NO: 27071 - DNA, 25 bp, Homo sapiens
accattcattgctacgttgcttatt

SEQ ID NO: 27072 - DNA, 25 bp, Homo sapiens
gttgcttattgtgtttttatgctgt

SEQ ID NO: 27073 - DNA, 25 bp, Homo sapiens
tatgctgttttatacttttttatga

SEQ ID NO: 27074 - DNA, 25 bp, Homo sapiens
aaaaatgcttttatcttgctataga

SEQ ID NO: 27075 - DNA, 25 bp, Homo sapiens
actgtggactgtattttgttgcaac

SEQ ID NO: 27076 - DNA, 25 bp, Homo sapiens
acaatagtactgtgcctctttcttc

SEQ ID NO: 27077 - DNA, 25 bp, Homo sapiens
cctctttcttctcaaacaatggatg

SEQ ID NO: 27078 - DNA, 25 bp, Homo sapiens
ggtgacaggtagctgggacctaggc

SEQ ID NO: 27079 - DNA, 25 bp, Homo sapiens
ggacctaggctatcttaccatgaag

SEQ ID NO: 27080 - DNA, 25 bp, Homo sapiens
aatttggcacagttactcactttgt

SEQ ID NO: 27081 - DNA, 25 bp, Homo sapiens
gaaatctagctgctgaatacgctga

SEQ ID NO: 27082 - DNA, 25 bp, Homo sapiens
aaatccttgttcactgaagtctttc

SEQ ID NO: 27083 - DNA, 25 bp, Homo sapiens
ggatttcccagtaggggtttctgca

SEQ ID NO: 27084 - DNA, 25 bp, Homo sapiens
gtttctgcatatcacctgtatagta

SEQ ID NO: 27085 - DNA, 25 bp, Homo sapiens
gtgcatgttctctacacaattgtaa

SEQ ID NO: 27086 - DNA, 25 bp, Homo sapiens
aactgttgcacttgtcaactttcaa

SEQ ID NO: 27087 - DNA, 25 bp, Homo sapiens
tcgccagcgatgaaagctttggggc

SEQ ID NO: 27088 - DNA, 25 bp, Homo sapiens
tgttgttctccggagtcggctgaag

SEQ ID NO: 27089 - DNA, 25 bp, Homo sapiens
ggtcagggtggtgaaggagctccgg

SEQ ID NO: 27090 - DNA, 25 bp, Homo sapiens
ggccgtgcacaatgggctgggtgag

SEQ ID NO: 27091 - DNA, 25 bp, Homo sapiens
gctgcaggcctggacatggatgtcg

SEQ ID NO: 27092 - DNA, 25 bp, Homo sapiens
atggatgtcgggaagcaggccatgc

SEQ ID NO: 27093 - DNA, 25 bp, Homo sapiens
caggccatgcagtaccaggtcctga

SEQ ID NO: 27094 - DNA, 25 bp, Homo sapiens
aggtggtgattgacagaggcccctc

SEQ ID NO: 27095 - DNA, 25 bp, Homo sapiens
tcctcctacctgtccaatgtggatg

SEQ ID NO: 27096 - DNA, 25 bp, Homo sapiens
gtggatgtctacctggacggacacc

SEQ ID NO: 27097 - DNA, 25 bp, Homo sapiens
ctcatcaccacggtgcagggcgacg

SEQ ID NO: 27098 - DNA, 25 bp, Homo sapiens
gccgagtactggaacagccagaagg

SEQ ID NO: 27099 - DNA, 25 bp, Homo sapiens
cacctactgcagacacaactacggg

SEQ ID NO: 27100 - DNA, 25 bp, Homo sapiens
tctgtgagtggtttctatccaggca

SEQ ID NO: 27101 - DNA, 25 bp, Homo sapiens
agtggtttctatccaggcagcattg

SEQ ID NO: 27102 - DNA, 25 bp, Homo sapiens
atggagactggaccttccagaccct

SEQ ID NO: 27103 - DNA, 25 bp, Homo sapiens
ggagtggagaggtttacacctgcca

SEQ ID NO: 27104 - DNA, 25 bp, Homo sapiens
ggtttacacctgccaagtggagcac

SEQ ID NO: 27105 - DNA, 25 bp, Homo sapiens
cgagccctctcacagtggaatggag

SEQ ID NO: 27106 - DNA, 25 bp, Homo sapiens
gcacggtctgaatctgcacagagca

SEQ ID NO: 27107 - DNA, 25 bp, Homo sapiens
gaatctgcacagagcaagatgctga

SEQ ID NO: 27108 - DNA, 25 bp, Homo sapiens
agatgctgagtggagtcgggggctt

SEQ ID NO: 27109 - DNA, 25 bp, Homo sapiens
acccggatgcctaacagctcaaaga

SEQ ID NO: 27110 - DNA, 25 bp, Homo sapiens
ttccatccagggtgccatcagtaat

SEQ ID NO: 27111 - DNA, 25 bp, Homo sapiens
atcagtaatcatgccactactcacc

SEQ ID NO: 27112 - DNA, 25 bp, Homo sapiens
cactactcaccagtgttgttcgcca

SEQ ID NO: 27113 - DNA, 25 bp, Homo sapiens
cctaccttgttatccttctcaagaa

SEQ ID NO: 27114 - DNA, 25 bp, Homo sapiens
caagaagctgaagtgtacgccctct

SEQ ID NO: 27115 - DNA, 25 bp, Homo sapiens
aataggctgcagtgtcgcttatgaa

SEQ ID NO: 27116 - DNA, 25 bp, Homo sapiens
agtgctgactctagcatcagcctct

SEQ ID NO: 27117 - DNA, 25 bp, Homo sapiens
atcagcctctaccgattgattttcc

SEQ ID NO: 27118 - DNA, 25 bp, Homo sapiens
gttcccatttctagttcacgttgaa

SEQ ID NO: 27119 - DNA, 25 bp, Homo sapiens
tcacgttgaatgacaggcctggagc

SEQ ID NO: 27120 - DNA, 25 bp, Homo sapiens
gtgataccagcaatagttcttcccc

SEQ ID NO: 27121 - DNA, 25 bp, Homo sapiens
gaccctaaaaagtctgccagtcgcc

SEQ ID NO: 27122 - DNA, 25 bp, Homo sapiens
tcgccctgggagtcgggctgggagt

SEQ ID NO: 27123 - DNA, 25 bp, Homo sapiens
gcagccggcgaggaagtgacgcttc

SEQ ID NO: 27124 - DNA, 25 bp, Homo sapiens
gcttctgactttgacctcttagaga

SEQ ID NO: 27125 - DNA, 25 bp, Homo sapiens
agagacgcagtctgcttgttccgac

SEQ ID NO: 27126 - DNA, 25 bp, Homo sapiens
tgtctaagaagaccaccactgcctc

SEQ ID NO: 27127 - DNA, 25 bp, Homo sapiens
aggtcccaagcgataacactgtcta

SEQ ID NO: 27128 - DNA, 25 bp, Homo sapiens
caagccactatccactttgaatcct

SEQ ID NO: 27129 - DNA, 25 bp, Homo sapiens
gaatcctgctccatacattgggtgt

SEQ ID NO: 27130 - DNA, 25 bp, Homo sapiens
tgcctcctggtaaccctgtaatgga

SEQ ID NO: 27131 - DNA, 25 bp, Homo sapiens
gctgtttctgactggaacgtgggcc

SEQ ID NO: 27132 - DNA, 25 bp, Homo sapiens
tccccagacccaagagctgtgagct

SEQ ID NO: 27133 - DNA, 25 bp, Homo sapiens
aatcatggcattcacacagcccata

SEQ ID NO: 27134 - DNA, 25 bp, Homo sapiens
gactctgactttgagacggtgtacc

SEQ ID NO: 27135 - DNA, 25 bp, Homo sapiens
gacggtgtaccagcagtgtgtcagg

SEQ ID NO: 27136 - DNA, 25 bp, Homo sapiens
cagtgtgtcaggtgctgcagagcgt

SEQ ID NO: 27137 - DNA, 25 bp, Homo sapiens
gaaggcccactgaggcaggttcgtg

SEQ ID NO: 27138 - DNA, 25 bp, Homo sapiens
tcctgcatttctcagtcggtgtgta

SEQ ID NO: 27139 - DNA, 25 bp, Homo sapiens
cggtgtgtaatcacgttccagggcc

SEQ ID NO: 27140 - DNA, 25 bp, Homo sapiens
cccagctctttgttcagttgactta

SEQ ID NO: 27141 - DNA, 25 bp, Homo sapiens
aaatcagtttgtgttcggcaggaga

SEQ ID NO: 27142 - DNA, 25 bp, Homo sapiens
tggacttctcaaaccaacagtggcc

SEQ ID NO: 27143 - DNA, 25 bp, Homo sapiens
cttctcaaaccaacagtggcctctc

SEQ ID NO: 27144 - DNA, 25 bp, Homo sapiens
ctcaaaccaacagtggcctctcaga

SEQ ID NO: 27145 - DNA, 25 bp, Homo sapiens
aacagtggcctctcagaaccagaac

SEQ ID NO: 27146 - DNA, 25 bp, Homo sapiens
tcccacctagcaagttagtatctga

SEQ ID NO: 27147 - DNA, 25 bp, Homo sapiens
gtatctgatgacttggattcatctt

SEQ ID NO: 27148 - DNA, 25 bp, Homo sapiens
gacttggattcatctttagccaacc

SEQ ID NO: 27149 - DNA, 25 bp, Homo sapiens
gattcatctttagccaaccttgtgg

SEQ ID NO: 27150 - DNA, 25 bp, Homo sapiens
tcatctttagccaaccttgtgggca

SEQ ID NO: 27151 - DNA, 25 bp, Homo sapiens
ttagccaaccttgtgggcaatcttg

SEQ ID NO: 27152 - DNA, 25 bp, Homo sapiens
aaccttgtgggcaatcttggcatcg

SEQ ID NO: 27153 - DNA, 25 bp, Homo sapiens
cacataggaagctcacacctggctc

SEQ ID NO: 27154 - DNA, 25 bp, Homo sapiens
gctccgccaaatccagacaagcagt

SEQ ID NO: 27155 - DNA, 25 bp, Homo sapiens
ccgccaaatccagacaagcagtttc

SEQ ID NO: 27156 - DNA, 25 bp, Homo sapiens
gccaaatccagacaagcagtttctg

SEQ ID NO: 27157 - DNA, 25 bp, Homo sapiens
cctctccgccagtgggatggaaaca

SEQ ID NO: 27158 - DNA, 25 bp, Homo sapiens
aagatgcgaccccagtcataaacta

SEQ ID NO: 27159 - DNA, 25 bp, Homo sapiens
gatgcgaccccagtcataaactatg

SEQ ID NO: 27160 - DNA, 25 bp, Homo sapiens
gcgaccccagtcataaactatgatc

SEQ ID NO: 27161 - DNA, 25 bp, Homo sapiens
ccccagtcataaactatgatctctt

SEQ ID NO: 27162 - DNA, 25 bp, Homo sapiens
tgatctcttatatgccatctccaag

SEQ ID NO: 27163 - DNA, 25 bp, Homo sapiens
tctcttatatgccatctccaagctg

SEQ ID NO: 27164 - DNA, 25 bp, Homo sapiens
tacacagtcacctttcactgaggtc

SEQ ID NO: 27165 - DNA, 25 bp, Homo sapiens
cactgaggtcaggagcccctgagca

SEQ ID NO: 27166 - DNA, 25 bp, Homo sapiens
tttcatgatctactgtgcacatcca

SEQ ID NO: 27167 - DNA, 25 bp, Homo sapiens
cagtcccctgctaaagttgctcagg

SEQ ID NO: 27168 - DNA, 25 bp, Homo sapiens
caggtgttctagtcctgacttcacc

SEQ ID NO: 27169 - DNA, 25 bp, Homo sapiens
ggtgtgtgccctagggtatgtaccc

SEQ ID NO: 27170 - DNA, 25 bp, Homo sapiens
tacctaaaggatgacctgctccaga

SEQ ID NO: 27171 - DNA, 25 bp, Homo sapiens
gcaccagcacagcatgtattttctt

SEQ ID NO: 27172 - DNA, 25 bp, Homo sapiens
tgaaagttctggcttgtagacccct

SEQ ID NO: 27173 - DNA, 25 bp, Homo sapiens
cctcccctcctttgcaaaggtatgg

SEQ ID NO: 27174 - DNA, 25 bp, Homo sapiens
gtaaaatgggctccctggtatctcc

SEQ ID NO: 27175 - DNA, 25 bp, Homo sapiens
ggcttggatcctgaatcgtgtaggg

SEQ ID NO: 27176 - DNA, 25 bp, Homo sapiens
gatcctgaatcgtgtaggggactac

SEQ ID NO: 27177 - DNA, 25 bp, Homo sapiens
gtaggggactacggatatcctgctg

SEQ ID NO: 27178 - DNA, 25 bp, Homo sapiens
aggggactacggatatcctgctgat

SEQ ID NO: 27179 - DNA, 25 bp, Homo sapiens
tatcctgctgatgtgttgttctctt

SEQ ID NO: 27180 - DNA, 25 bp, Homo sapiens
ttctcttctcgacttacacatttta

SEQ ID NO: 27181 - DNA, 25 bp, Homo sapiens
ctcttctcgacttacacattttata

SEQ ID NO: 27182 - DNA, 25 bp, Homo sapiens
ttctcgacttacacattttatatgg

SEQ ID NO: 27183 - DNA, 25 bp, Homo sapiens
ggaagatctgtggccaatcattagc

SEQ ID NO: 27184 - DNA, 25 bp, Homo sapiens
gatctgtggccaatcattagcaaac

SEQ ID NO: 27185 - DNA, 25 bp, Homo sapiens
tgtggccaatcattagcaaacaaat

SEQ ID NO: 27186 - DNA, 25 bp, Homo sapiens
gagttttgctgtcaatatgaacact

SEQ ID NO: 27187 - DNA, 25 bp, Homo sapiens
ccctgacatcccttaagactcaagt

SEQ ID NO: 27188 - DNA, 25 bp, Homo sapiens
taagactcaagtcttgatactttgt

SEQ ID NO: 27189 - DNA, 25 bp, Homo sapiens
tcttccttattgttaatgcttatag

SEQ ID NO: 27190 - DNA, 25 bp, Homo sapiens
gattccttgttatcttttagcccat

SEQ ID NO: 27191 - DNA, 25 bp, Homo sapiens
tgttatcttttagcccatgtcatcc

SEQ ID NO: 27192 - DNA, 25 bp, Homo sapiens
agcccatgtcatccgaatcatttgc

SEQ ID NO: 27193 - DNA, 25 bp, Homo sapiens
tgtcatccgaatcatttgctgtttc

SEQ ID NO: 27194 - DNA, 25 bp, Homo sapiens
catttgctgtttctagcctaggtgc

SEQ ID NO: 27195 - DNA, 25 bp, Homo sapiens
gcctaggtgctttgactatgccagc

SEQ ID NO: 27196 - DNA, 25 bp, Homo sapiens
ctatgccagcttgtatttcttcaga

SEQ ID NO: 27197 - DNA, 25 bp, Homo sapiens
tgtggtgggcagcaacatggacaag

SEQ ID NO: 27198 - DNA, 25 bp, Homo sapiens
gggcagcaacatggacaagatctac

SEQ ID NO: 27199 - DNA, 25 bp, Homo sapiens
acatggacaagatctacatcgtgat

SEQ ID NO: 27200 - DNA, 25 bp, Homo sapiens
agcacgacctcaagagcctgatgga

SEQ ID NO: 27201 - DNA, 25 bp, Homo sapiens
gacctcaagagcctgatggagacca

SEQ ID NO: 27202 - DNA, 25 bp, Homo sapiens
tggagaccatgaaacagcccttcct

SEQ ID NO: 27203 - DNA, 25 bp, Homo sapiens
ccaggggaggtgaagaccctgatga

SEQ ID NO: 27204 - DNA, 25 bp, Homo sapiens
gaaacacctgcacgacaactggatc

SEQ ID NO: 27205 - DNA, 25 bp, Homo sapiens
ggaatactccacggccgtggacatg

SEQ ID NO: 27206 - DNA, 25 bp, Homo sapiens
tactccacggccgtggacatgtggt

SEQ ID NO: 27207 - DNA, 25 bp, Homo sapiens
tcttcggggagctgctgactcagaa

SEQ ID NO: 27208 - DNA, 25 bp, Homo sapiens
ctgtccccgtgttgcatgaaggagc

SEQ ID NO: 27209 - DNA, 25 bp, Homo sapiens
gcattgactggtttacaggccctgc

SEQ ID NO: 27210 - DNA, 25 bp, Homo sapiens
ttggacgccttcccaaatctgaagg

SEQ ID NO: 27211 - DNA, 25 bp, Homo sapiens
aatctgaaggacttcatctcccgct

SEQ ID NO: 27212 - DNA, 25 bp, Homo sapiens
catctcccgctttgagggcttggag

SEQ ID NO: 27213 - DNA, 25 bp, Homo sapiens
aagatggctgtctggggcaacaagt

SEQ ID NO: 27214 - DNA, 25 bp, Homo sapiens
gggagtgaggagcccatactcagcc

SEQ ID NO: 27215 - DNA, 25 bp, Homo sapiens
ttactcccaagacttcattgtccct

SEQ ID NO: 27216 - DNA, 25 bp, Homo sapiens
catgcaggccctttgaagcctcagc

SEQ ID NO: 27217 - DNA, 25 bp, Homo sapiens
cttccttcctgcttagtggttgtgt

SEQ ID NO: 27218 - DNA, 25 bp, Homo sapiens
tgtgtctgctttaaagcctgcctgg

SEQ ID NO: 27219 - DNA, 25 bp, Homo sapiens
gaaaatggtttgccgctggagtatc

SEQ ID NO: 27220 - DNA, 25 bp, Homo sapiens
atctaagggtattctatgtgctaat

SEQ ID NO: 27221 - DNA, 25 bp, Homo sapiens
atctgggggatctccacgtttgatc

SEQ ID NO: 27222 - DNA, 25 bp, Homo sapiens
cagcagtgctctgaaggagtatctt

SEQ ID NO: 27223 - DNA, 25 bp, Homo sapiens
ggagtatcttacttgggtgattcct

SEQ ID NO: 27224 - DNA, 25 bp, Homo sapiens
gggtgattccttgtttttagactat

SEQ ID NO: 27225 - DNA, 25 bp, Homo sapiens
acaaatgaatgtgagtaccccttct

SEQ ID NO: 27226 - DNA, 25 bp, Homo sapiens
attgatcttaagtgtctccttgctc

SEQ ID NO: 27227 - DNA, 25 bp, Homo sapiens
gtgtctccttgctctggtaaaagat

SEQ ID NO: 27228 - DNA, 25 bp, Homo sapiens
agatagatttgtagctcacttgatg

SEQ ID NO: 27229 - DNA, 25 bp, Homo sapiens
gaattgctctgctctgtctgagatt

SEQ ID NO: 27230 - DNA, 25 bp, Homo sapiens
cagaacactcatgtctacagctggc

SEQ ID NO: 27231 - DNA, 25 bp, Homo sapiens
ataaaaaaaacatcctgctgcggct

SEQ ID NO: 27232 - DNA, 25 bp, Homo sapiens
gaggccaggccatgtttggggcctt

SEQ ID NO: 27233 - DNA, 25 bp, Homo sapiens
ggccttgttctgacagcattctggc

SEQ ID NO: 27234 - DNA, 25 bp, Homo sapiens
tggcccccaggaaacctgttgtgca

SEQ ID NO: 27235 - DNA, 25 bp, Homo sapiens
gaaacctgttgtgcagagctcttcc

SEQ ID NO: 27236 - DNA, 25 bp, Homo sapiens
tccacacaccctggctttgaagtgg

SEQ ID NO: 27237 - DNA, 25 bp, Homo sapiens
agtggagtctgtgactgctctgcat

SEQ ID NO: 27238 - DNA, 25 bp, Homo sapiens
aaaccattgcaggtgccagtgtccc

SEQ ID NO: 27239 - DNA, 25 bp, Homo sapiens
gttagccagatgcttgtgtatcctc

SEQ ID NO: 27240 - DNA, 25 bp, Homo sapiens
gcttgtgtatcctcagaccaaactg

SEQ ID NO: 27241 - DNA, 25 bp, Homo sapiens
aactggttccagagaaagactaagc

SEQ ID NO: 27242 - DNA, 25 bp, Homo sapiens
gtcagctttctcatattgagagctc

SEQ ID NO: 27243 - DNA, 25 bp, Homo sapiens
gctttctcatattgagagctctgct

SEQ ID NO: 27244 - DNA, 25 bp, Homo sapiens
ttttcattttccccttaggcatatt

SEQ ID NO: 27245 - DNA, 25 bp, Homo sapiens
cattttccccttaggcatatttagt

SEQ ID NO: 27246 - DNA, 25 bp, Homo sapiens
ggcatatttagtatttttcccccag

SEQ ID NO: 27247 - DNA, 25 bp, Homo sapiens
tttcccccaggcagatcattctgag

SEQ ID NO: 27248 - DNA, 25 bp, Homo sapiens
gatcattctgagtgtgcgagtgtgt

SEQ ID NO: 27249 - DNA, 25 bp, Homo sapiens
gtgcgagtgtgtgtgcacatgttac

SEQ ID NO: 27250 - DNA, 25 bp, Homo sapiens
gtgtgtgtgcacatgttacaaaggc

SEQ ID NO: 27251 - DNA, 25 bp, Homo sapiens
gttacaaaggcaactaccatgttaa

SEQ ID NO: 27252 - DNA, 25 bp, Homo sapiens
cagaagggctatagctggtcccaga

SEQ ID NO: 27253 - DNA, 25 bp, Homo sapiens
ggagctgagtagtagccagtctgct

SEQ ID NO: 27254 - DNA, 25 bp, Homo sapiens
ctgctgtgaccacaggctcaggtcc

SEQ ID NO: 27255 - DNA, 25 bp, Homo sapiens
cctgctgcttggccacagcagtggc

SEQ ID NO: 27256 - DNA, 25 bp, Homo sapiens
gtggctgggcaagtgggaaccacta

SEQ ID NO: 27257 - DNA, 25 bp, Homo sapiens
actatctcttgggagcccccaaaag

SEQ ID NO: 27258 - DNA, 25 bp, Homo sapiens
gccagaggcgctacgaagctttgcc

SEQ ID NO: 27259 - DNA, 25 bp, Homo sapiens
gaagctttgcccagatgaagccagg

SEQ ID NO: 27260 - DNA, 25 bp, Homo sapiens
gtttgccttcttacggatttagacg

SEQ ID NO: 27261 - DNA, 25 bp, Homo sapiens
acggatttagacgaggttcgaggct

SEQ ID NO: 27262 - DNA, 25 bp, Homo sapiens
tcacctatcagggcagctctcagga

SEQ ID NO: 27263 - DNA, 25 bp, Homo sapiens
acagaggtgtctgcacttccatgta

SEQ ID NO: 27264 - DNA, 25 bp, Homo sapiens
ttccatgtacaacaaacgctccggg

SEQ ID NO: 27265 - DNA, 25 bp, Homo sapiens
gaaagccagttggcagcccacatgt

SEQ ID NO: 27266 - DNA, 25 bp, Homo sapiens
cacatgtggttacctcacaccagtc

SEQ ID NO: 27267 - DNA, 25 bp, Homo sapiens
cagtggagagcactcccgatttgga

SEQ ID NO: 27268 - DNA, 25 bp, Homo sapiens
attcctttgaatccaattttggcct

SEQ ID NO: 27269 - DNA, 25 bp, Homo sapiens
tgatgaagggacacttgggcccctg

SEQ ID NO: 27270 - DNA, 25 bp, Homo sapiens
ccctgcctcaggtagatggtgttca

SEQ ID NO: 27271 - DNA, 25 bp, Homo sapiens
ggtgttcagacacagcagactgcag

SEQ ID NO: 27272 - DNA, 25 bp, Homo sapiens
gttatatgagtgtttcttctgaaga

SEQ ID NO: 27273 - DNA, 25 bp, Homo sapiens
tgctataaaggagcatcccctccac

SEQ ID NO: 27274 - DNA, 25 bp, Homo sapiens
gatgctcatctctggtatcacgaat

SEQ ID NO: 27275 - DNA, 25 bp, Homo sapiens
aggaggcttggacagagggccggcg

SEQ ID NO: 27276 - DNA, 25 bp, Homo sapiens
ctatgtgctcccagaggtttccaag

SEQ ID NO: 27277 - DNA, 25 bp, Homo sapiens
tattgggagctcatgcactcttggc

SEQ ID NO: 27278 - DNA, 25 bp, Homo sapiens
cagcacagttagccctggtggctcg

SEQ ID NO: 27279 - DNA, 25 bp, Homo sapiens
gtggctcgagcccataatgtaccag

SEQ ID NO: 27280 - DNA, 25 bp, Homo sapiens
ctgatgcctttgtctctaatgagct

SEQ ID NO: 27281 - DNA, 25 bp, Homo sapiens
gatgaccctgatgatctgcaatgta

SEQ ID NO: 27282 - DNA, 25 bp, Homo sapiens
gaacatgttgcgctggctaactggc

SEQ ID NO: 27283 - DNA, 25 bp, Homo sapiens
ctagtctatgatgtgactcccccag

SEQ ID NO: 27284 - DNA, 25 bp, Homo sapiens
ggatctggtgatcacggagctgggg

SEQ ID NO: 27285 - DNA, 25 bp, Homo sapiens
acagtgaagtgtgaggcccacccta

SEQ ID NO: 27286 - DNA, 25 bp, Homo sapiens
gcccaccctagagccaaggtgacgc

SEQ ID NO: 27287 - DNA, 25 bp, Homo sapiens
gtgacgctgaatggggttccagccc

SEQ ID NO: 27288 - DNA, 25 bp, Homo sapiens
tatacacaagaaccagacccgggag

SEQ ID NO: 27289 - DNA, 25 bp, Homo sapiens
gtccgggaaactggacgtggccaga

SEQ ID NO: 27290 - DNA, 25 bp, Homo sapiens
cattgcccgagctcaagtgtctaaa

SEQ ID NO: 27291 - DNA, 25 bp, Homo sapiens
taaaggatggcactttcccactgcc

SEQ ID NO: 27292 - DNA, 25 bp, Homo sapiens
agtgactgtcactcgagatcttgag

SEQ ID NO: 27293 - DNA, 25 bp, Homo sapiens
cgagatcttgagggcacctacctct

SEQ ID NO: 27294 - DNA, 25 bp, Homo sapiens
gagcactcaaggggaggtcacccgc

SEQ ID NO: 27295 - DNA, 25 bp, Homo sapiens
ccccccggtatgagattgtcatcat

SEQ ID NO: 27296 - DNA, 25 bp, Homo sapiens
caatgtccacagccagggagcagcc

SEQ ID NO: 27297 - DNA, 25 bp, Homo sapiens
gggcgcacgtgttccaaattgaccc

SEQ ID NO: 27298 - DNA, 25 bp, Homo sapiens
gtaccgcatcatcagcatcggaggc

SEQ ID NO: 27299 - DNA, 25 bp, Homo sapiens
ggccatcatcaacagcactgtcact

SEQ ID NO: 27300 - DNA, 25 bp, Homo sapiens
aagttcgggcagtgggccgacagtc

SEQ ID NO: 27301 - DNA, 25 bp, Homo sapiens
agtcgcgccaacacagtctatggcc

SEQ ID NO: 27302 - DNA, 25 bp, Homo sapiens
gctttgcctctgaacagcatctgac

SEQ ID NO: 27303 - DNA, 25 bp, Homo sapiens
gacacagtttgccgagaagttccag

SEQ ID NO: 27304 - DNA, 25 bp, Homo sapiens
cccagtcggctctggttgttggcag

SEQ ID NO: 27305 - DNA, 25 bp, Homo sapiens
tggggctgtttttgagcttctcatt

SEQ ID NO: 27306 - DNA, 25 bp, Homo sapiens
gagggacactcatagtccctcctct

SEQ ID NO: 27307 - DNA, 25 bp, Homo sapiens
gaatgaggcctacagggttcaccag

SEQ ID NO: 27308 - DNA, 25 bp, Homo sapiens
gagaggaatccacaggaccaccaga

SEQ ID NO: 27309 - DNA, 25 bp, Homo sapiens
tggctaagtcccaccataacagcta

SEQ ID NO: 27310 - DNA, 25 bp, Homo sapiens
acatccacaggcctggacctgggat

SEQ ID NO: 27311 - DNA, 25 bp, Homo sapiens
ggatgtagtttggctcaggtgtccc

SEQ ID NO: 27312 - DNA, 25 bp, Homo sapiens
gtgtccctgcagttggcaaggagtc

SEQ ID NO: 27313 - DNA, 25 bp, Homo sapiens
gcaaggagtcagtactcagtccctg

SEQ ID NO: 27314 - DNA, 25 bp, Homo sapiens
aatttgaggtcctggctgagccaag

SEQ ID NO: 27315 - DNA, 25 bp, Homo sapiens
aatggaccagatctacctcagtatt

SEQ ID NO: 27316 - DNA, 25 bp, Homo sapiens
ggacaccagtggcttcaaacttcct

SEQ ID NO: 27317 - DNA, 25 bp, Homo sapiens
aacttcctggtttcatgatatcttg

SEQ ID NO: 27318 - DNA, 25 bp, Homo sapiens
tggccttggggtactgctggccagg

SEQ ID NO: 27319 - DNA, 25 bp, Homo sapiens
aaggatccactgggtgaatcctccc

SEQ ID NO: 27320 - DNA, 25 bp, Homo sapiens
ctcgcactgttgtggcaggcagcag

SEQ ID NO: 27321 - DNA, 25 bp, Homo sapiens
ctgtccgggcaatggcagtgctgac

SEQ ID NO: 27322 - DNA, 25 bp, Homo sapiens
agtgctgacagatcacccatatgcc

SEQ ID NO: 27323 - DNA, 25 bp, Homo sapiens
gatgacgcagctgctgactgtctct

SEQ ID NO: 27324 - DNA, 25 bp, Homo sapiens
tttcctcctgcaccgtggaggtggg

SEQ ID NO: 27325 - DNA, 25 bp, Homo sapiens
atctgcccaacagccaggaggcact

SEQ ID NO: 27326 - DNA, 25 bp, Homo sapiens
tgcagaagctctctgatgtcaccct

SEQ ID NO: 27327 - DNA, 25 bp, Homo sapiens
tacctgtgtcctgctcagaactgga

SEQ ID NO: 27328 - DNA, 25 bp, Homo sapiens
gaactggagaaggctggcgccgggc

SEQ ID NO: 27329 - DNA, 25 bp, Homo sapiens
gtcaagcatcttcggccgatattta

SEQ ID NO: 27330 - DNA, 25 bp, Homo sapiens
taaacatgggcagcttccttcagga

SEQ ID NO: 27331 - DNA, 25 bp, Homo sapiens
cttcaggatgatcaccgaggctccc

SEQ ID NO: 27332 - DNA, 25 bp, Homo sapiens
ctccctactctccagaatccagggg

SEQ ID NO: 27333 - DNA, 25 bp, Homo sapiens
gttttacaccggtcacattttctat

SEQ ID NO: 27334 - DNA, 25 bp, Homo sapiens
cacaaggtacgaacctctcaggcct

SEQ ID NO: 27335 - DNA, 25 bp, Homo sapiens
tcttgcctgcttcactgtggatggg

SEQ ID NO: 27336 - DNA, 25 bp, Homo sapiens
aagaggtgacaacctcagtctccct

SEQ ID NO: 27337 - DNA, 25 bp, Homo sapiens
tctccctttgggacctgtccaaggg

SEQ ID NO: 27338 - DNA, 25 bp, Homo sapiens
gagacactggactttttacccattt

SEQ ID NO: 27339 - DNA, 25 bp, Homo sapiens
acaagagttaatgccctaccctctg

SEQ ID NO: 27340 - DNA, 25 bp, Homo sapiens
gaaaactcagtgcaggttgccctta

SEQ ID NO: 27341 - DNA, 25 bp, Homo sapiens
cagtgcaggttgcccttaattttcc

SEQ ID NO: 27342 - DNA, 25 bp, Homo sapiens
caagtctagttgccctttagcacct

SEQ ID NO: 27343 - DNA, 25 bp, Homo sapiens
ttagcacctaaagatctgcacccca

SEQ ID NO: 27344 - DNA, 25 bp, Homo sapiens
ccccaaaccaatgtcaccataaaga

SEQ ID NO: 27345 - DNA, 25 bp, Homo sapiens
gagtgggtgtgatcccaacggggtt

SEQ ID NO: 27346 - DNA, 25 bp, Homo sapiens
tgatcccaacggggttttgtaactg

SEQ ID NO: 27347 - DNA, 25 bp, Homo sapiens
gtgagcttctcatcttttcatatac

SEQ ID NO: 27348 - DNA, 25 bp, Homo sapiens
tctaacccccggtactcattgaatc

SEQ ID NO: 27349 - DNA, 25 bp, Homo sapiens
gatttgcaaggactttgataccatt

SEQ ID NO: 27350 - DNA, 25 bp, Homo sapiens
gccaagatggcaaaaaccccgactc

SEQ ID NO: 27351 - DNA, 25 bp, Homo sapiens
catacatcgtgtacatgcttcaaga

SEQ ID NO: 27352 - DNA, 25 bp, Homo sapiens
catcctggaggactggacagccatc

SEQ ID NO: 27353 - DNA, 25 bp, Homo sapiens
caaaaaggctagggcagctgtgtcc

SEQ ID NO: 27354 - DNA, 25 bp, Homo sapiens
agctgtgtcccctcagaagagaaaa

SEQ ID NO: 27355 - DNA, 25 bp, Homo sapiens
acagctgtggccgtggagctgacct

SEQ ID NO: 27356 - DNA, 25 bp, Homo sapiens
gctgacctgaccaggcaaggctgct

SEQ ID NO: 27357 - DNA, 25 bp, Homo sapiens
cactcctgaagatccatctcttggg

SEQ ID NO: 27358 - DNA, 25 bp, Homo sapiens
ctcttggggctcccctgacagagaa

SEQ ID NO: 27359 - DNA, 25 bp, Homo sapiens
gctcccctgacagagaagacagccg

SEQ ID NO: 27360 - DNA, 25 bp, Homo sapiens
gacagccgaagtcaaagccacatcc

SEQ ID NO: 27361 - DNA, 25 bp, Homo sapiens
caaagccacatcctcttgctgatgt

SEQ ID NO: 27362 - DNA, 25 bp, Homo sapiens
cgtctacatgggtgactccgatgtc

SEQ ID NO: 27363 - DNA, 25 bp, Homo sapiens
acatgggtgactccgatgtctacac

SEQ ID NO: 27364 - DNA, 25 bp, Homo sapiens
tgggtgactccgatgtctacaccgt

SEQ ID NO: 27365 - DNA, 25 bp, Homo sapiens
tgtctacaccgtgcaccatatggtg

SEQ ID NO: 27366 - DNA, 25 bp, Homo sapiens
gcacgtggaggatggaggtccggcc

SEQ ID NO: 27367 - DNA, 25 bp, Homo sapiens
cgtggaggatggaggtccggccagt

SEQ ID NO: 27368 - DNA, 25 bp, Homo sapiens
cagggcttcgtcaaggtgacctcat

SEQ ID NO: 27369 - DNA, 25 bp, Homo sapiens
tcgtcaaggtgacctcatcacccat

SEQ ID NO: 27370 - DNA, 25 bp, Homo sapiens
caaggtgacctcatcacccatgtca

SEQ ID NO: 27371 - DNA, 25 bp, Homo sapiens
tgacctcatcacccatgtcaatggg

SEQ ID NO: 27372 - DNA, 25 bp, Homo sapiens
atgtcaatggggaacctgtgcatgg

SEQ ID NO: 27373 - DNA, 25 bp, Homo sapiens
gcagaggctgaggctgtggtgctga

SEQ ID NO: 27374 - DNA, 25 bp, Homo sapiens
gtgctgacactgctggcgatttatg

SEQ ID NO: 27375 - DNA, 25 bp, Homo sapiens
tggcgatttatgcagctggcctggc

SEQ ID NO: 27376 - DNA, 25 bp, Homo sapiens
acccaccgggtggtaagcacacagg

SEQ ID NO: 27377 - DNA, 25 bp, Homo sapiens
gctggtagccctgatctacctagca

SEQ ID NO: 27378 - DNA, 25 bp, Homo sapiens
agcactgcagctgggctgcatcgcc

SEQ ID NO: 27379 - DNA, 25 bp, Homo sapiens
gctagcccagggtgtgctggagcac

SEQ ID NO: 27380 - DNA, 25 bp, Homo sapiens
ggctgcttttctggaatgtgctctt

SEQ ID NO: 27381 - DNA, 25 bp, Homo sapiens
ctggaagtgagatctgcctgtccgg

SEQ ID NO: 27382 - DNA, 25 bp, Homo sapiens
gctgggacagagactccccaaggac

SEQ ID NO: 27383 - DNA, 25 bp, Homo sapiens
attctgcctccttctggggaaataa

SEQ ID NO: 27384 - DNA, 25 bp, Homo sapiens
aagcccctgtcgattgaggcagatg

SEQ ID NO: 27385 - DNA, 25 bp, Homo sapiens
gcagatgacaatggctgcttccccc

SEQ ID NO: 27386 - DNA, 25 bp, Homo sapiens
ctctgtcggaagtgccacactgcta

SEQ ID NO: 27387 - DNA, 25 bp, Homo sapiens
actgctagagcccagacctgagtga

SEQ ID NO: 27388 - DNA, 25 bp, Homo sapiens
ctgagtgaggacaggccctcttcag

SEQ ID NO: 27389 - DNA, 25 bp, Homo sapiens
ccattgtggaccacccacactgaga

SEQ ID NO: 27390 - DNA, 25 bp, Homo sapiens
ttattgttttgatgtctagcccctc

SEQ ID NO: 27391 - DNA, 25 bp, Homo sapiens
gacccaggacccaacatggtctagg

SEQ ID NO: 27392 - DNA, 25 bp, Homo sapiens
ggtctagggatgcaggatccccgcc

SEQ ID NO: 27393 - DNA, 25 bp, Homo sapiens
caccaggtttagtgctgctgctttc

SEQ ID NO: 27394 - DNA, 25 bp, Homo sapiens
cccccatgctgccaagttgtagcta

SEQ ID NO: 27395 - DNA, 25 bp, Homo sapiens
gacctgagatgctggtcaagccccc

SEQ ID NO: 27396 - DNA, 25 bp, Homo sapiens
tcaagccccctttgattgagttcat

SEQ ID NO: 27397 - DNA, 25 bp, Homo sapiens
tgagccgttgctaatgccaggccag

SEQ ID NO: 27398 - DNA, 25 bp, Homo sapiens
gtcaccacaaccaccaagggggaga

SEQ ID NO: 27399 - DNA, 25 bp, Homo sapiens
gggaatctcaggcctattaccagag

SEQ ID NO: 27400 - DNA, 25 bp, Homo sapiens
gaggatcgagcatggtcctcttctc

SEQ ID NO: 27401 - DNA, 25 bp, Homo sapiens
tttcctcatcttcctgatagtggga

SEQ ID NO: 27402 - DNA, 25 bp, Homo sapiens
ctttctaatctttttccagcttgag

SEQ ID NO: 27403 - DNA, 25 bp, Homo sapiens
gcagcccttttagtggtggtgtctc

SEQ ID NO: 27404 - DNA, 25 bp, Homo sapiens
tctctctttgtcccggataggctaa

SEQ ID NO: 27405 - DNA, 25 bp, Homo sapiens
atacccttggcactgatgggcactg

SEQ ID NO: 27406 - DNA, 25 bp, Homo sapiens
ggatctccagtccacaagttgaaga

SEQ ID NO: 27407 - DNA, 25 bp, Homo sapiens
gagggcgatagtcgttttcttgcaa

SEQ ID NO: 27408 - DNA, 25 bp, Homo sapiens
gaattatacccatctaccaaaagca

SEQ ID NO: 27409 - DNA, 25 bp, Homo sapiens
agcagatatttttgcgcttgccctc

SEQ ID NO: 27410 - DNA, 25 bp, Homo sapiens
gcttgccctcacagtggtatgtgct

SEQ ID NO: 27411 - DNA, 25 bp, Homo sapiens
gggtagattacctcggataccacaa

SEQ ID NO: 27412 - DNA, 25 bp, Homo sapiens
ggataccacaagtgctttcccaaga

SEQ ID NO: 27413 - DNA, 25 bp, Homo sapiens
gaagaccttcagcaatggcactggt

SEQ ID NO: 27414 - DNA, 25 bp, Homo sapiens
tcagtattgctgtccgcttctagaa

SEQ ID NO: 27415 - DNA, 25 bp, Homo sapiens
actgaccggatggccactaggtcca

SEQ ID NO: 27416 - DNA, 25 bp, Homo sapiens
ggtccaccacccagagtaatagaac

SEQ ID NO: 27417 - DNA, 25 bp, Homo sapiens
acaaaaagaactgtcctttctgcgc

SEQ ID NO: 27418 - DNA, 25 bp, Homo sapiens
tattttgatgtttccttaatgtgta

SEQ ID NO: 27419 - DNA, 25 bp, Homo sapiens
tttgatgtttccttaatgtgtaatt

SEQ ID NO: 27420 - DNA, 25 bp, Homo sapiens
gacagaccaaagttaaacaagcctc

SEQ ID NO: 27421 - DNA, 25 bp, Homo sapiens
atcactactattgattctagttcca

SEQ ID NO: 27422 - DNA, 25 bp, Homo sapiens
tattgattctagttccagttggtgg

SEQ ID NO: 27423 - DNA, 25 bp, Homo sapiens
tgatgtatcgcctatacatggcaga

SEQ ID NO: 27424 - DNA, 25 bp, Homo sapiens
gtatcgcctatacatggcagaggac

SEQ ID NO: 27425 - DNA, 25 bp, Homo sapiens
ggcagaggactgaacacctcctcag

SEQ ID NO: 27426 - DNA, 25 bp, Homo sapiens
gactgaacacctcctcagaagtcag

SEQ ID NO: 27427 - DNA, 25 bp, Homo sapiens
ctgaacacctcctcagaagtcagcg

SEQ ID NO: 27428 - DNA, 25 bp, Homo sapiens
aagcgcaagcgcagtcgtaaggaga

SEQ ID NO: 27429 - DNA, 25 bp, Homo sapiens
gcgcagtcgtaaggagagctactcc

SEQ ID NO: 27430 - DNA, 25 bp, Homo sapiens
gtgctaaaacaggttcaccccgata

SEQ ID NO: 27431 - DNA, 25 bp, Homo sapiens
taaaacaggttcaccccgatactgg

SEQ ID NO: 27432 - DNA, 25 bp, Homo sapiens
aagcacgcagtgtccgaaggtacca

SEQ ID NO: 27433 - DNA, 25 bp, Homo sapiens
gtccgaaggtaccaaggctgtcacc

SEQ ID NO: 27434 - DNA, 25 bp, Homo sapiens
ggctgtcaccaagtatacaagctcc

SEQ ID NO: 27435 - DNA, 25 bp, Homo sapiens
tacaagctccaagtaaatgtgtgct

SEQ ID NO: 27436 - DNA, 25 bp, Homo sapiens
tcagctcctgctccgaagaagggtt

SEQ ID NO: 27437 - DNA, 25 bp, Homo sapiens
cctgctccgaagaagggttccaaga

SEQ ID NO: 27438 - DNA, 25 bp, Homo sapiens
gttccaagaaggctgtgaccaaggc

SEQ ID NO: 27439 - DNA, 25 bp, Homo sapiens
ggaagcatcttggaggtcgactgtg

SEQ ID NO: 27440 - DNA, 25 bp, Homo sapiens
gtcgactgtgacatactgatcccag

SEQ ID NO: 27441 - DNA, 25 bp, Homo sapiens
tgatcccagctgccactgagaagca

SEQ ID NO: 27442 - DNA, 25 bp, Homo sapiens
aggtgccaatgggccaacaactcca

SEQ ID NO: 27443 - DNA, 25 bp, Homo sapiens
agctatggccgtttgaccttcaaat

SEQ ID NO: 27444 - DNA, 25 bp, Homo sapiens
aagggattctaactaccacttgctc

SEQ ID NO: 27445 - DNA, 25 bp, Homo sapiens
ggtggaactattcccattgtaccca

SEQ ID NO: 27446 - DNA, 25 bp, Homo sapiens
tgtacccacggcagagttccaagac

SEQ ID NO: 27447 - DNA, 25 bp, Homo sapiens
tgtgcactctgccttggcatacaca

SEQ ID NO: 27448 - DNA, 25 bp, Homo sapiens
cacaatggagcgttctgccaggcaa

SEQ ID NO: 27449 - DNA, 25 bp, Homo sapiens
aacagctgcctatgtcaatgccatt

SEQ ID NO: 27450 - DNA, 25 bp, Homo sapiens
gaagcgtcttctgaggatctagttg

SEQ ID NO: 27451 - DNA, 25 bp, Homo sapiens
ggctttctttctgggtttgggccat

SEQ ID NO: 27452 - DNA, 25 bp, Homo sapiens
ggccatttcagttctcatgtgtgta

SEQ ID NO: 27453 - DNA, 25 bp, Homo sapiens
gaatagccatggcgatctccagcac

SEQ ID NO: 27454 - DNA, 25 bp, Homo sapiens
tccctctcttagtgttctttaatca

SEQ ID NO: 27455 - DNA, 25 bp, Homo sapiens
tggaagcctttcattttacacgccc

SEQ ID NO: 27456 - DNA, 25 bp, Homo sapiens
cgccctgaagcagtcttctttgcta

SEQ ID NO: 27457 - DNA, 25 bp, Homo sapiens
aaatgatacactactgctgcagctc

SEQ ID NO: 27458 - DNA, 25 bp, Homo sapiens
gctcacaaacacctctgcatattac

SEQ ID NO: 27459 - DNA, 25 bp, Homo sapiens
cctcctgctcctcaagagtgtggtc

SEQ ID NO: 27460 - DNA, 25 bp, Homo sapiens
tggtctattttgccatcatcacctg

SEQ ID NO: 27461 - DNA, 25 bp, Homo sapiens
gcctccaccacttggagtaccgagc

SEQ ID NO: 27462 - DNA, 25 bp, Homo sapiens
accacttggagtaccgagctcagga

SEQ ID NO: 27463 - DNA, 25 bp, Homo sapiens
cagatgtcaggggcctgaccaccct

SEQ ID NO: 27464 - DNA, 25 bp, Homo sapiens
ccccagtgtccgagagcagcaaggt

SEQ ID NO: 27465 - DNA, 25 bp, Homo sapiens
agagcagcaaggtcgtcgtggtgga

SEQ ID NO: 27466 - DNA, 25 bp, Homo sapiens
ggtcgtcgtggtggagagtgtcatg

SEQ ID NO: 27467 - DNA, 25 bp, Homo sapiens
gccttttgggagtgcgtggtggtgg

SEQ ID NO: 27468 - DNA, 25 bp, Homo sapiens
ggacgacattgcctgtatgatcggg

SEQ ID NO: 27469 - DNA, 25 bp, Homo sapiens
tgtatgatcgggtaccgaccttgcc

SEQ ID NO: 27470 - DNA, 25 bp, Homo sapiens
gaccttgcccctggatgaaatggtg

SEQ ID NO: 27471 - DNA, 25 bp, Homo sapiens
atcttcatcttcaacgttgtgtact

SEQ ID NO: 27472 - DNA, 25 bp, Homo sapiens
gtgcttgtcattccagagtgctgag

SEQ ID NO: 27473 - DNA, 25 bp, Homo sapiens
taagtctcacccattatctggaata

SEQ ID NO: 27474 - DNA, 25 bp, Homo sapiens
gaatgctgaactccttgttagccct

SEQ ID NO: 27475 - DNA, 25 bp, Homo sapiens
tccttgttagcccttcagattgtta

SEQ ID NO: 27476 - DNA, 25 bp, Homo sapiens
tggttctcatttggtctgccagaat

SEQ ID NO: 27477 - DNA, 25 bp, Homo sapiens
ttgtgttccctggctgatgatccag

SEQ ID NO: 27478 - DNA, 25 bp, Homo sapiens
gatccagaacagtggctcgtatccc

SEQ ID NO: 27479 - DNA, 25 bp, Homo sapiens
tcgtatcccaaatctgtcagcatct

SEQ ID NO: 27480 - DNA, 25 bp, Homo sapiens
cagcatctggctgtctagaatgtgg

SEQ ID NO: 27481 - DNA, 25 bp, Homo sapiens
gagacggagatcctaaggtccaaca

SEQ ID NO: 27482 - DNA, 25 bp, Homo sapiens
agaatgcattccctgaatctgtgcc

SEQ ID NO: 27483 - DNA, 25 bp, Homo sapiens
tgcctcaacctcccgagtagttaaa

SEQ ID NO: 27484 - DNA, 25 bp, Homo sapiens
tttctgagacggagtcttgctctgt

SEQ ID NO: 27485 - DNA, 25 bp, Homo sapiens
gagtgcagtgatgcaatctcggctc

SEQ ID NO: 27486 - DNA, 25 bp, Homo sapiens
caccacacctggactagtttttttg

SEQ ID NO: 27487 - DNA, 25 bp, Homo sapiens
agaggcggggtttcatcatgttggc

SEQ ID NO: 27488 - DNA, 25 bp, Homo sapiens
actcctaacatcaggcgatctgcct

SEQ ID NO: 27489 - DNA, 25 bp, Homo sapiens
gactacaggcctgagctacggtgcc

SEQ ID NO: 27490 - DNA, 25 bp, Homo sapiens
cctggccagctggccttttcattgt

SEQ ID NO: 27491 - DNA, 25 bp, Homo sapiens
gctggccttttcattgttgatttta

SEQ ID NO: 27492 - DNA, 25 bp, Homo sapiens
tttattgagtaagcccttgctcagt

SEQ ID NO: 27493 - DNA, 25 bp, Homo sapiens
taagcccttgctcagtaaatttaat

SEQ ID NO: 27494 - DNA, 25 bp, Homo sapiens
agagaagggggttttgattgtgata

SEQ ID NO: 27495 - DNA, 25 bp, Homo sapiens
gagcagttggctacttgattacaac

SEQ ID NO: 27496 - DNA, 25 bp, Homo sapiens
ttgggctaggatgagctgactccct

SEQ ID NO: 27497 - DNA, 25 bp, Homo sapiens
atgagctgactcccttagagcaaag

SEQ ID NO: 27498 - DNA, 25 bp, Homo sapiens
gcaaaggagagacagcccccattac

SEQ ID NO: 27499 - DNA, 25 bp, Homo sapiens
aaataccatttttgcctggggcttg

SEQ ID NO: 27500 - DNA, 25 bp, Homo sapiens
ccagcatggcaccttattgttttga

SEQ ID NO: 27501 - DNA, 25 bp, Homo sapiens
agcaacttcgttgaattttcaccaa

SEQ ID NO: 27502 - DNA, 25 bp, Homo sapiens
gaattttcaccaacttattacttga

SEQ ID NO: 27503 - DNA, 25 bp, Homo sapiens
tataatatagcctgtccgtttgctg

SEQ ID NO: 27504 - DNA, 25 bp, Homo sapiens
gctgtgatatattttcctagtggtt

SEQ ID NO: 27505 - DNA, 25 bp, Homo sapiens
agacctttcctaccatgaagatgtt

SEQ ID NO: 27506 - DNA, 25 bp, Homo sapiens
aatgaccgtgacggctggaatccct

SEQ ID NO: 27507 - DNA, 25 bp, Homo sapiens
tgtgtgcatgaacttctgtgccgcc

SEQ ID NO: 27508 - DNA, 25 bp, Homo sapiens
agagcacggttgtccaggatgaccc

SEQ ID NO: 27509 - DNA, 25 bp, Homo sapiens
agtcaccgtgtctgtacaccaagat

SEQ ID NO: 27510 - DNA, 25 bp, Homo sapiens
ctgtacaccaagatgcaccttacgc

SEQ ID NO: 27511 - DNA, 25 bp, Homo sapiens
ccttcctgcccatatggtatgtgga

SEQ ID NO: 27512 - DNA, 25 bp, Homo sapiens
tggaagctatgactcaggacctccc

SEQ ID NO: 27513 - DNA, 25 bp, Homo sapiens
ggcacctgacaaaactgctgacgac

SEQ ID NO: 27514 - DNA, 25 bp, Homo sapiens
gctgacgacaccgtatgagcggcag

SEQ ID NO: 27515 - DNA, 25 bp, Homo sapiens
accgctcctccgggagcttatgtac

SEQ ID NO: 27516 - DNA, 25 bp, Homo sapiens
gcgaaacctgcggagccagatttgt

SEQ ID NO: 27517 - DNA, 25 bp, Homo sapiens
ccagatttgtacaggtggcccacct

SEQ ID NO: 27518 - DNA, 25 bp, Homo sapiens
cccatgtgcttatccacactggtga

SEQ ID NO: 27519 - DNA, 25 bp, Homo sapiens
agccctatccctgtgaaatctgtgg

SEQ ID NO: 27520 - DNA, 25 bp, Homo sapiens
ctgcatttccgtcacaaaagccagc

SEQ ID NO: 27521 - DNA, 25 bp, Homo sapiens
acaaaagccagctgcgacttcactt

SEQ ID NO: 27522 - DNA, 25 bp, Homo sapiens
gacttcacttgcgccagaagcatgg

SEQ ID NO: 27523 - DNA, 25 bp, Homo sapiens
ccaaggtgcaataccgcgtgtcagc

SEQ ID NO: 27524 - DNA, 25 bp, Homo sapiens
ctccccaaagcctgctgaagcatgg

SEQ ID NO: 27525 - DNA, 25 bp, Homo sapiens
ggagtgttgatgctttcgtctccag

SEQ ID NO: 27526 - DNA, 25 bp, Homo sapiens
tgatgtagtgcctctttcatccact

SEQ ID NO: 27527 - DNA, 25 bp, Homo sapiens
gattgctgacttcggattggcccga

SEQ ID NO: 27528 - DNA, 25 bp, Homo sapiens
agacaaggtgcaaagttccccatca

SEQ ID NO: 27529 - DNA, 25 bp, Homo sapiens
gccctgtacgggaggttcacaatca

SEQ ID NO: 27530 - DNA, 25 bp, Homo sapiens
gtgtggtcttttggaatcttactca

SEQ ID NO: 27531 - DNA, 25 bp, Homo sapiens
atcttactcacagagctggtcacca

SEQ ID NO: 27532 - DNA, 25 bp, Homo sapiens
ggaagagtgccatacccaggcatga

SEQ ID NO: 27533 - DNA, 25 bp, Homo sapiens
gtggagcgaggctacaggatgccct

SEQ ID NO: 27534 - DNA, 25 bp, Homo sapiens
ccatctctctgcatgagctcatgat

SEQ ID NO: 27535 - DNA, 25 bp, Homo sapiens
gagctcatgatccactgctggaaaa

SEQ ID NO: 27536 - DNA, 25 bp, Homo sapiens
ttttgagtacttgcagagcttcctg

SEQ ID NO: 27537 - DNA, 25 bp, Homo sapiens
gcttcctggaagactactttaccgc

SEQ ID NO: 27538 - DNA, 25 bp, Homo sapiens
gtacctcgctggacctggagttaga

SEQ ID NO: 27539 - DNA, 25 bp, Homo sapiens
ctgacccaggagatctcggtgctga

SEQ ID NO: 27540 - DNA, 25 bp, Homo sapiens
ttgcgtgaggacgagcgtttccgcc

SEQ ID NO: 27541 - DNA, 25 bp, Homo sapiens
gagggcagctgccaaggatgtgcac

SEQ ID NO: 27542 - DNA, 25 bp, Homo sapiens
acaggctccgaggccagagctgtaa

SEQ ID NO: 27543 - DNA, 25 bp, Homo sapiens
acccccagaagttcagtctttcagg

SEQ ID NO: 27544 - DNA, 25 bp, Homo sapiens
gagaagatggcatttttcacccggc

SEQ ID NO: 27545 - DNA, 25 bp, Homo sapiens
tttcacccggcctcggatgaatatc

SEQ ID NO: 27546 - DNA, 25 bp, Homo sapiens
agctctctctgcagatgacgtctaa

SEQ ID NO: 27547 - DNA, 25 bp, Homo sapiens
tttgttccactgaccaggctgtgaa

SEQ ID NO: 27548 - DNA, 25 bp, Homo sapiens
gagtcacaagtcctctagtgctctt

SEQ ID NO: 27549 - DNA, 25 bp, Homo sapiens
tccccaggatgccgagacacaacta

SEQ ID NO: 27550 - DNA, 25 bp, Homo sapiens
tcaagtcgctgtgtgccaagcacgg

SEQ ID NO: 27551 - DNA, 25 bp, Homo sapiens
gcacggcctcagctacgaagtgaag

SEQ ID NO: 27552 - DNA, 25 bp, Homo sapiens
aaagacccagacgtgacggtggcgc

SEQ ID NO: 27553 - DNA, 25 bp, Homo sapiens
gaagaaacgcagatacctaccctac

SEQ ID NO: 27554 - DNA, 25 bp, Homo sapiens
aaatctggcgtacatgctggtgtgc

SEQ ID NO: 27555 - DNA, 25 bp, Homo sapiens
gcatgcagtgggcggatttgctctg

SEQ ID NO: 27556 - DNA, 25 bp, Homo sapiens
gccactggttcgtgtggatcacaca

SEQ ID NO: 27557 - DNA, 25 bp, Homo sapiens
gaaccacatccccaaggagatcggc

SEQ ID NO: 27558 - DNA, 25 bp, Homo sapiens
acgagaagcaccgggactgggtcag

SEQ ID NO: 27559 - DNA, 25 bp, Homo sapiens
tttcaccaactggttcagcgggcac

SEQ ID NO: 27560 - DNA, 25 bp, Homo sapiens
agtggccaaactgcaggatgaaaga

SEQ ID NO: 27561 - DNA, 25 bp, Homo sapiens
gatgaaagaacagtgcggaagatct

SEQ ID NO: 27562 - DNA, 25 bp, Homo sapiens
ggaagatctgtgctttggatgacaa

SEQ ID NO: 27563 - DNA, 25 bp, Homo sapiens
tttggatgacaacgtctgcatggcc

SEQ ID NO: 27564 - DNA, 25 bp, Homo sapiens
cctcaccgccgatgcaaggatagtc

SEQ ID NO: 27565 - DNA, 25 bp, Homo sapiens
atgcaaggatagtcatcaacagggc

SEQ ID NO: 27566 - DNA, 25 bp, Homo sapiens
tcatcaacagggcccgggtggagtg

SEQ ID NO: 27567 - DNA, 25 bp, Homo sapiens
tcaacagggcccgggtggagtgcca

SEQ ID NO: 27568 - DNA, 25 bp, Homo sapiens
ccgggtggagtgccagagccaccgg

SEQ ID NO: 27569 - DNA, 25 bp, Homo sapiens
gaagcagcgttatacgcagagcaat

SEQ ID NO: 27570 - DNA, 25 bp, Homo sapiens
gcgttatacgcagagcaatgggcgc

SEQ ID NO: 27571 - DNA, 25 bp, Homo sapiens
ttcagtttccattgagagctctgtt

SEQ ID NO: 27572 - DNA, 25 bp, Homo sapiens
aaggtatcttaggagtgcagattat

SEQ ID NO: 27573 - DNA, 25 bp, Homo sapiens
tttgattctgggctgagttattaca

SEQ ID NO: 27574 - DNA, 25 bp, Homo sapiens
gttattacagttatggtatgaccag

SEQ ID NO: 27575 - DNA, 25 bp, Homo sapiens
tcctttcttatgaaccttcctgatt

SEQ ID NO: 27576 - DNA, 25 bp, Homo sapiens
gattttttaacttagatttctcact

SEQ ID NO: 27577 - DNA, 25 bp, Homo sapiens
gatttctcactaagtttcctgagtt

SEQ ID NO: 27578 - DNA, 25 bp, Homo sapiens
aagtttcctgagttattagtaagat

SEQ ID NO: 27579 - DNA, 25 bp, Homo sapiens
catttaggtgtgagttccttagctt

SEQ ID NO: 27580 - DNA, 25 bp, Homo sapiens
ccttagcttctgcctataggaacat

SEQ ID NO: 27581 - DNA, 25 bp, Homo sapiens
atgaaaggtcatctaggtgtgtgtt

SEQ ID NO: 27582 - DNA, 25 bp, Homo sapiens
tgtggctgtggatttcacccaggag

SEQ ID NO: 27583 - DNA, 25 bp, Homo sapiens
cacccaggaggagtggcggcaactg

SEQ ID NO: 27584 - DNA, 25 bp, Homo sapiens
cggcaactggaccctgatgagaaga

SEQ ID NO: 27585 - DNA, 25 bp, Homo sapiens
agccatctagtttctgtggggtatg

SEQ ID NO: 27586 - DNA, 25 bp, Homo sapiens
ttatcaccaagccaaacatcatcat

SEQ ID NO: 27587 - DNA, 25 bp, Homo sapiens
atgtcaacatagtccagaacctgct

SEQ ID NO: 27588 - DNA, 25 bp, Homo sapiens
gaacctgctaaggccatcaaaccta

SEQ ID NO: 27589 - DNA, 25 bp, Homo sapiens
gaagtcagtccatcagatttgctct

SEQ ID NO: 27590 - DNA, 25 bp, Homo sapiens
gatttgctctgggccagtggtactg

SEQ ID NO: 27591 - DNA, 25 bp, Homo sapiens
gtggtactgagtctaagcactgcag

SEQ ID NO: 27592 - DNA, 25 bp, Homo sapiens
aacagtctggatgctggtgccacta

SEQ ID NO: 27593 - DNA, 25 bp, Homo sapiens
tcatggtttccatggttaccggcct

SEQ ID NO: 27594 - DNA, 25 bp, Homo sapiens
cctccatgggcattcttgttgttgg

SEQ ID NO: 27595 - DNA, 25 bp, Homo sapiens
gtctatgagcgtctgacctggacca

SEQ ID NO: 27596 - DNA, 25 bp, Homo sapiens
gccttcaagcgccagtttgtggagc

SEQ ID NO: 27597 - DNA, 25 bp, Homo sapiens
gcagcttgtcatcagctacactggc

SEQ ID NO: 27598 - DNA, 25 bp, Homo sapiens
gcaggaactgtctgggacctttgct

SEQ ID NO: 27599 - DNA, 25 bp, Homo sapiens
gacctttgctcatctgtgtcagcaa

SEQ ID NO: 27600 - DNA, 25 bp, Homo sapiens
gtgtcagcaagttgacgtcacccgg

SEQ ID NO: 27601 - DNA, 25 bp, Homo sapiens
gctggagcgcaagacgtgctgacac

SEQ ID NO: 27602 - DNA, 25 bp, Homo sapiens
gtgctgacacagtgagttttctctg

SEQ ID NO: 27603 - DNA, 25 bp, Homo sapiens
gttactcctgtatcattgctcataa

SEQ ID NO: 27604 - DNA, 25 bp, Homo sapiens
acatgcaacatgctgttcctccagc

SEQ ID NO: 27605 - DNA, 25 bp, Homo sapiens
gtacctttggggcatgggggcatta

SEQ ID NO: 27606 - DNA, 25 bp, Homo sapiens
gggatgcttgtgtaatcgaccacct

SEQ ID NO: 27607 - DNA, 25 bp, Homo sapiens
tccagagaagcatcccagggctttg

SEQ ID NO: 27608 - DNA, 25 bp, Homo sapiens
ggctttgtgacagtctctaattccc

SEQ ID NO: 27609 - DNA, 25 bp, Homo sapiens
tcccttcccttctcgttaagaatca

SEQ ID NO: 27610 - DNA, 25 bp, Homo sapiens
gtattcattgggttactcctattat

SEQ ID NO: 27611 - DNA, 25 bp, Homo sapiens
agatctttagcttttattccttatt

SEQ ID NO: 27612 - DNA, 25 bp, Homo sapiens
ttattgatcatgttgctggctttta

SEQ ID NO: 27613 - DNA, 25 bp, Homo sapiens
gcgaaggaggagcactgcctcagcc

SEQ ID NO: 27614 - DNA, 25 bp, Homo sapiens
gcctcagcctttgcacatggtaatg

SEQ ID NO: 27615 - DNA, 25 bp, Homo sapiens
ctcccgctggctctatgaagcgatg

SEQ ID NO: 27616 - DNA, 25 bp, Homo sapiens
gatggccaaggcttgggagccctgg

SEQ ID NO: 27617 - DNA, 25 bp, Homo sapiens
ctcaggtacttatcgtccgtggaaa

SEQ ID NO: 27618 - DNA, 25 bp, Homo sapiens
tatcgtccgtggaaacccaggaagg

SEQ ID NO: 27619 - DNA, 25 bp, Homo sapiens
ctcaatatgaatttttgttcccgtg

SEQ ID NO: 27620 - DNA, 25 bp, Homo sapiens
tgttcccgtgagaacttctggctct

SEQ ID NO: 27621 - DNA, 25 bp, Homo sapiens
agaacttctggctcttgatcaactc

SEQ ID NO: 27622 - DNA, 25 bp, Homo sapiens
gggagcttcaggctgctgaggatcg

SEQ ID NO: 27623 - DNA, 25 bp, Homo sapiens
gtgcatataattggccacattcccc

SEQ ID NO: 27624 - DNA, 25 bp, Homo sapiens
gtgggtaaccatgaaagcacacctg

SEQ ID NO: 27625 - DNA, 25 bp, Homo sapiens
cttcattgagggcaaccactcctcc

SEQ ID NO: 27626 - DNA, 25 bp, Homo sapiens
gctatccagcgtactccaaagattc

SEQ ID NO: 27627 - DNA, 25 bp, Homo sapiens
agattcaggtttactcacgtcatcc

SEQ ID NO: 27628 - DNA, 25 bp, Homo sapiens
atttcctgaattgctatgtgtctgg

SEQ ID NO: 27629 - DNA, 25 bp, Homo sapiens
ggtttcatccatccgacattgaagt

SEQ ID NO: 27630 - DNA, 25 bp, Homo sapiens
agtggagcattcagacttgtctttc

SEQ ID NO: 27631 - DNA, 25 bp, Homo sapiens
tcagcaaggactggtctttctatct

SEQ ID NO: 27632 - DNA, 25 bp, Homo sapiens
ctttctatctcttgtactacactga

SEQ ID NO: 27633 - DNA, 25 bp, Homo sapiens
ctgaattcacccccactgaaaaaga

SEQ ID NO: 27634 - DNA, 25 bp, Homo sapiens
agatgagtatgcctgccgtgtgaac

SEQ ID NO: 27635 - DNA, 25 bp, Homo sapiens
gccgtgtgaaccatgtgactttgtc

SEQ ID NO: 27636 - DNA, 25 bp, Homo sapiens
ctttctggcctggaggctatccagc

SEQ ID NO: 27637 - DNA, 25 bp, Homo sapiens
gtttcttactgctcatggattacat

SEQ ID NO: 27638 - DNA, 25 bp, Homo sapiens
gtataaaccccatagctctgtattt

SEQ ID NO: 27639 - DNA, 25 bp, Homo sapiens
gctgctgttaccagtccaaaagtct

SEQ ID NO: 27640 - DNA, 25 bp, Homo sapiens
ccaaaagtctgatgacctcggtccc

SEQ ID NO: 27641 - DNA, 25 bp, Homo sapiens
ctcggtccccatgaacggaacaagc

SEQ ID NO: 27642 - DNA, 25 bp, Homo sapiens
gaaccacgatcaaaacaaccacaac

SEQ ID NO: 27643 - DNA, 25 bp, Homo sapiens
aacacagaccggagcagccataagg

SEQ ID NO: 27644 - DNA, 25 bp, Homo sapiens
gggttctatttctgtatgcccttgg

SEQ ID NO: 27645 - DNA, 25 bp, Homo sapiens
ttggtgtgcactgcgatcttctaca

SEQ ID NO: 27646 - DNA, 25 bp, Homo sapiens
gcagcttgagaattgccctcagtga

SEQ ID NO: 27647 - DNA, 25 bp, Homo sapiens
agtgaacatcttaagcagcgtcgag

SEQ ID NO: 27648 - DNA, 25 bp, Homo sapiens
agagaccgagtgaacctaccttcat

SEQ ID NO: 27649 - DNA, 25 bp, Homo sapiens
agtgaacctaccttcatttcaggag

SEQ ID NO: 27650 - DNA, 25 bp, Homo sapiens
ttcaggagggattggccgcttggca

SEQ ID NO: 27651 - DNA, 25 bp, Homo sapiens
attggccgcttggcacatgacaact

SEQ ID NO: 27652 - DNA, 25 bp, Homo sapiens
catgacaactttgccagcttttcct

SEQ ID NO: 27653 - DNA, 25 bp, Homo sapiens
ttttcctcccttgggttctgatatt

SEQ ID NO: 27654 - DNA, 25 bp, Homo sapiens
tcccttgggttctgatattgccgca

SEQ ID NO: 27655 - DNA, 25 bp, Homo sapiens
ccccaacctcagacttaccaggaag

SEQ ID NO: 27656 - DNA, 25 bp, Homo sapiens
ttatgtaagagcaccttcctcactt

SEQ ID NO: 27657 - DNA, 25 bp, Homo sapiens
ggtaaatgatgtggtgcctgaggtc

SEQ ID NO: 27658 - DNA, 25 bp, Homo sapiens
acctcttaacaatttctgtccttca

SEQ ID NO: 27659 - DNA, 25 bp, Homo sapiens
gattgtgggcggtggagcgccagac

SEQ ID NO: 27660 - DNA, 25 bp, Homo sapiens
taaagtcagatgccacctaccaggg

SEQ ID NO: 27661 - DNA, 25 bp, Homo sapiens
aaattaggagtcagctgccagcgtt

SEQ ID NO: 27662 - DNA, 25 bp, Homo sapiens
tggacctaactgcccaggcaggcga

SEQ ID NO: 27663 - DNA, 25 bp, Homo sapiens
gcaggcgagagctacttccagagcc

SEQ ID NO: 27664 - DNA, 25 bp, Homo sapiens
ttccagagccttccagtgcatggga

SEQ ID NO: 27665 - DNA, 25 bp, Homo sapiens
tagcggtgtctcctctttgaaatta

SEQ ID NO: 27666 - DNA, 25 bp, Homo sapiens
aaagctgcacctgatgatgctgcct

SEQ ID NO: 27667 - DNA, 25 bp, Homo sapiens
ttgtctgggcccttgtttacaagca

SEQ ID NO: 27668 - DNA, 25 bp, Homo sapiens
tcctgaggggagccatgctctagcc

SEQ ID NO: 27669 - DNA, 25 bp, Homo sapiens
cccctcagttcgtgctgcaataaag

SEQ ID NO: 27670 - DNA, 25 bp, Homo sapiens
ggggcagtctggtacggaacatatt

SEQ ID NO: 27671 - DNA, 25 bp, Homo sapiens
ggaacatatttattgcctccatgca

SEQ ID NO: 27672 - DNA, 25 bp, Homo sapiens
gcctccatgcatgtgtgtgtgtgtc

SEQ ID NO: 27673 - DNA, 25 bp, Homo sapiens
tggtgaggactggtgtgcgtggaca

SEQ ID NO: 27674 - DNA, 25 bp, Homo sapiens
gtgtggggctctttcagggaccaca

SEQ ID NO: 27675 - DNA, 25 bp, Homo sapiens
ggagggagcagtttgcagtgcccag

SEQ ID NO: 27676 - DNA, 25 bp, Homo sapiens
gccaccctgaaatccccaataatgg

SEQ ID NO: 27677 - DNA, 25 bp, Homo sapiens
atatgcacaggttcttggactgatt

SEQ ID NO: 27678 - DNA, 25 bp, Homo sapiens
tacccaattcgccctatagtgagtc

SEQ ID NO: 27679 - DNA, 25 bp, Homo sapiens
ttggaccagcggttgtgaccatctt

SEQ ID NO: 27680 - DNA, 25 bp, Homo sapiens
ccatctttcctgagcaccaagggct

SEQ ID NO: 27681 - DNA, 25 bp, Homo sapiens
aagtccgattgtagtggtgctcagt

SEQ ID NO: 27682 - DNA, 25 bp, Homo sapiens
gtagtggtgctcagtggcagcatgg

SEQ ID NO: 27683 - DNA, 25 bp, Homo sapiens
cagcatggaacctgcatttcataga

SEQ ID NO: 27684 - DNA, 25 bp, Homo sapiens
gattcctatagttcaccgagtcttg

SEQ ID NO: 27685 - DNA, 25 bp, Homo sapiens
ggttgatgaccgaggcctctataaa

SEQ ID NO: 27686 - DNA, 25 bp, Homo sapiens
ggagagccaggggatttgttcctta

SEQ ID NO: 27687 - DNA, 25 bp, Homo sapiens
gacgatcctcatgaatgactatcct

SEQ ID NO: 27688 - DNA, 25 bp, Homo sapiens
ttttgctgggtttattcgtgctggt

SEQ ID NO: 27689 - DNA, 25 bp, Homo sapiens
gagtaagaagcctgccttgctgttc

SEQ ID NO: 27690 - DNA, 25 bp, Homo sapiens
ggaatgattgtctcatcggcactaa

SEQ ID NO: 27691 - DNA, 25 bp, Homo sapiens
gaagatgccatagttttcgttactg

SEQ ID NO: 27692 - DNA, 25 bp, Homo sapiens
gaagaagcctttgtaaatgacattg

SEQ ID NO: 27693 - DNA, 25 bp, Homo sapiens
tgacattgacgagtcgtccccaggc

SEQ ID NO: 27694 - DNA, 25 bp, Homo sapiens
tgagtgggaacgggtggcccggctg

SEQ ID NO: 27695 - DNA, 25 bp, Homo sapiens
gctgtgtgactttaaccccaagtct

SEQ ID NO: 27696 - DNA, 25 bp, Homo sapiens
aagtctagcaagcaggccaaagatg

SEQ ID NO: 27697 - DNA, 25 bp, Homo sapiens
caccctgtggaaacactacatctgc

SEQ ID NO: 27698 - DNA, 25 bp, Homo sapiens
acatctgcaatatcttaatcctact

SEQ ID NO: 27699 - DNA, 25 bp, Homo sapiens
taatcctactcagtgaagctcttca

SEQ ID NO: 27700 - DNA, 25 bp, Homo sapiens
agctcttcacagtcattggattaat

SEQ ID NO: 27701 - DNA, 25 bp, Homo sapiens
tgttgagttcttttggaccaaacct

SEQ ID NO: 27702 - DNA, 25 bp, Homo sapiens
ttgtctttagagttgttcattgttt

SEQ ID NO: 27703 - DNA, 25 bp, Homo sapiens
gattcttgaagaacattccacttgt

SEQ ID NO: 27704 - DNA, 25 bp, Homo sapiens
gatgtttttattcctctgtatccaa

SEQ ID NO: 27705 - DNA, 25 bp, Homo sapiens
aaacaaaacatcacctcattcaaag

SEQ ID NO: 27706 - DNA, 25 bp, Homo sapiens
ttctggtcaggcctaaagctcttcc

SEQ ID NO: 27707 - DNA, 25 bp, Homo sapiens
aaagctcttccgcaatattcttctt

SEQ ID NO: 27708 - DNA, 25 bp, Homo sapiens
atggactccttacagatgacacctt

SEQ ID NO: 27709 - DNA, 25 bp, Homo sapiens
gggaagctgctaaatcgttacctta

SEQ ID NO: 27710 - DNA, 25 bp, Homo sapiens
attatagcacttctcaatgccacac

SEQ ID NO: 27711 - DNA, 25 bp, Homo sapiens
gtgcaaccaggtagcagcatgtcta

SEQ ID NO: 27712 - DNA, 25 bp, Homo sapiens
gccatgaggacatctattccacagc

SEQ ID NO: 27713 - DNA, 25 bp, Homo sapiens
gaatcaagcagaatccttcatagga

SEQ ID NO: 27714 - DNA, 25 bp, Homo sapiens
caatctgatttcatcgtcgtggcct

SEQ ID NO: 27715 - DNA, 25 bp, Homo sapiens
taacacctgcaaccgagggactctg

SEQ ID NO: 27716 - DNA, 25 bp, Homo sapiens
gactctgcaacaaggacttcttcca

SEQ ID NO: 27717 - DNA, 25 bp, Homo sapiens
caacatcagcaggggcgacgtcgta

SEQ ID NO: 27718 - DNA, 25 bp, Homo sapiens
cctgtaccaggccttggccagtggt

SEQ ID NO: 27719 - DNA, 25 bp, Homo sapiens
gattctgccccacattggcagtgcc

SEQ ID NO: 27720 - DNA, 25 bp, Homo sapiens
caccatgtccttgttggcagctaac

SEQ ID NO: 27721 - DNA, 25 bp, Homo sapiens
acaacttgctggctggcctgagagg

SEQ ID NO: 27722 - DNA, 25 bp, Homo sapiens
acagtacaggtggagggccgggaag

SEQ ID NO: 27723 - DNA, 25 bp, Homo sapiens
gcaaaccgtgccctggtattgtcag

SEQ ID NO: 27724 - DNA, 25 bp, Homo sapiens
gacacacccaggcttgatttggatc

SEQ ID NO: 27725 - DNA, 25 bp, Homo sapiens
gatgaagagggtagagtgggctgct

SEQ ID NO: 27726 - DNA, 25 bp, Homo sapiens
ggctgctggtgtcgcatcaagattt

SEQ ID NO: 27727 - DNA, 25 bp, Homo sapiens
agatttggcaggatcggcttcctca

SEQ ID NO: 27728 - DNA, 25 bp, Homo sapiens
tccccttagagtgctgtgagatgag

SEQ ID NO: 27729 - DNA, 25 bp, Homo sapiens
gggacagggccatggggtagggtga

SEQ ID NO: 27730 - DNA, 25 bp, Homo sapiens
gaagggatcctaatcccttcctctc

SEQ ID NO: 27731 - DNA, 25 bp, Homo sapiens
ctcccattcaccctgtgtaacagga

SEQ ID NO: 27732 - DNA, 25 bp, Homo sapiens
ggaagtgccttaacctagagggtcg

SEQ ID NO: 27733 - DNA, 25 bp, Homo sapiens
aggttgtgtcactgactcaggctgc

SEQ ID NO: 27734 - DNA, 25 bp, Homo sapiens
tcatctgaccttagtttgctgccat

SEQ ID NO: 27735 - DNA, 25 bp, Homo sapiens
gctgccatcagtctagtggtttcgt

SEQ ID NO: 27736 - DNA, 25 bp, Homo sapiens
gcgcctgcgcgaggaagaagtagac

SEQ ID NO: 27737 - DNA, 25 bp, Homo sapiens
ggaagaagtagacgctgatgcagct

SEQ ID NO: 27738 - DNA, 25 bp, Homo sapiens
tctatctgcattttgcctaccacaa

SEQ ID NO: 27739 - DNA, 25 bp, Homo sapiens
acagccaaagctgttgcggtgaccc

SEQ ID NO: 27740 - DNA, 25 bp, Homo sapiens
gtcctgatgacatgtttcgtagatg

SEQ ID NO: 27741 - DNA, 25 bp, Homo sapiens
cagctgccactgagctgtagctgcg

SEQ ID NO: 27742 - DNA, 25 bp, Homo sapiens
cttgatgcctgtcggcacttctgaa

SEQ ID NO: 27743 - DNA, 25 bp, Homo sapiens
ctgtcggcacttctgaaaggcacaa

SEQ ID NO: 27744 - DNA, 25 bp, Homo sapiens
cacaaggccaagaactcctggccag

SEQ ID NO: 27745 - DNA, 25 bp, Homo sapiens
gccaggactgcaaggctctgcagcc

SEQ ID NO: 27746 - DNA, 25 bp, Homo sapiens
atgggtcagctcctttgagaacccc

SEQ ID NO: 27747 - DNA, 25 bp, Homo sapiens
tctaagatctacgacacactccagt

SEQ ID NO: 27748 - DNA, 25 bp, Homo sapiens
tgcctgggttctgcacaaggcctac

SEQ ID NO: 27749 - DNA, 25 bp, Homo sapiens
tggccatctccttcaaagggctggc

SEQ ID NO: 27750 - DNA, 25 bp, Homo sapiens
tcatcaccaagggctgccaggcaga

SEQ ID NO: 27751 - DNA, 25 bp, Homo sapiens
agaggctgaccgtgctgaagtgagt

SEQ ID NO: 27752 - DNA, 25 bp, Homo sapiens
gagtcgctttgccaagaactttctg

SEQ ID NO: 27753 - DNA, 25 bp, Homo sapiens
cctcttcaacctgtatgggcagccc

SEQ ID NO: 27754 - DNA, 25 bp, Homo sapiens
ggaaaccatcagaacttacctcacc

SEQ ID NO: 27755 - DNA, 25 bp, Homo sapiens
gccagtgagaaggtgctcgaccctg

SEQ ID NO: 27756 - DNA, 25 bp, Homo sapiens
cagattgtctgtcctggacctggtc

SEQ ID NO: 27757 - DNA, 25 bp, Homo sapiens
cggccctacctagattgctaacaaa

SEQ ID NO: 27758 - DNA, 25 bp, Homo sapiens
tgtacgaccttctaagtggccacat

SEQ ID NO: 27759 - DNA, 25 bp, Homo sapiens
gaagaagctgaccaaccacaaggcc

SEQ ID NO: 27760 - DNA, 25 bp, Homo sapiens
cctgtgtgcgtgacgtcagttggca

SEQ ID NO: 27761 - DNA, 25 bp, Homo sapiens
tcagttggcacccctttgaagagaa

SEQ ID NO: 27762 - DNA, 25 bp, Homo sapiens
ttcgtgggacgggaacctgcgtctg

SEQ ID NO: 27763 - DNA, 25 bp, Homo sapiens
agtaccgccaggctgagtacttcca

SEQ ID NO: 27764 - DNA, 25 bp, Homo sapiens
gaatctgaggaatgtgccagcgccc

SEQ ID NO: 27765 - DNA, 25 bp, Homo sapiens
caacctccagccccatatagggtga

SEQ ID NO: 27766 - DNA, 25 bp, Homo sapiens
tggaagattctccccatggggcaga

SEQ ID NO: 27767 - DNA, 25 bp, Homo sapiens
gtccctatctctggccagagtttgg

SEQ ID NO: 27768 - DNA, 25 bp, Homo sapiens
gtggcctctgccagcaagagaagtg

SEQ ID NO: 27769 - DNA, 25 bp, Homo sapiens
gaaggcagtggcggccacttctaca

SEQ ID NO: 27770 - DNA, 25 bp, Homo sapiens
cctcccctcagaatccaatgagcca

SEQ ID NO: 27771 - DNA, 25 bp, Homo sapiens
gaaacttccagttggtgcttgcgtg

SEQ ID NO: 27772 - DNA, 25 bp, Homo sapiens
aatcttttgaagttggcgccggaca

SEQ ID NO: 27773 - DNA, 25 bp, Homo sapiens
ggtctccaattgctatgtttctcac

SEQ ID NO: 27774 - DNA, 25 bp, Homo sapiens
atgagaattacagccttcctacctg

SEQ ID NO: 27775 - DNA, 25 bp, Homo sapiens
tcatccgcttgatccagtggcatat

SEQ ID NO: 27776 - DNA, 25 bp, Homo sapiens
agagtctctctcgtatgggatctga

SEQ ID NO: 27777 - DNA, 25 bp, Homo sapiens
agctctctcaaaagtgcttggcaga

SEQ ID NO: 27778 - DNA, 25 bp, Homo sapiens
aatgagtttgcccgtgctcatacgt

SEQ ID NO: 27779 - DNA, 25 bp, Homo sapiens
tcatacgtcttcaacccagttgcaa

SEQ ID NO: 27780 - DNA, 25 bp, Homo sapiens
cccctgaatacctgctcagcgagga

SEQ ID NO: 27781 - DNA, 25 bp, Homo sapiens
cagcgaggaggagcgcttggcgtgg

SEQ ID NO: 27782 - DNA, 25 bp, Homo sapiens
agcgcttggcgtgggaacagcagga

SEQ ID NO: 27783 - DNA, 25 bp, Homo sapiens
ggagccaggcgagaggaagctgagc

SEQ ID NO: 27784 - DNA, 25 bp, Homo sapiens
ctgagctttttgccacgcaagttcc

SEQ ID NO: 27785 - DNA, 25 bp, Homo sapiens
cggcagcgcaagatgagggtgaatg

SEQ ID NO: 27786 - DNA, 25 bp, Homo sapiens
gtgaatgtagaccctgaggacctca

SEQ ID NO: 27787 - DNA, 25 bp, Homo sapiens
tgccaggccctggtctacaggggcc

SEQ ID NO: 27788 - DNA, 25 bp, Homo sapiens
cgtggggggcgtggtgaagagtgtg

SEQ ID NO: 27789 - DNA, 25 bp, Homo sapiens
tggggtggtcgtgctgaagtcaaca

SEQ ID NO: 27790 - DNA, 25 bp, Homo sapiens
ctgaagtcaacagagcctttaccct

SEQ ID NO: 27791 - DNA, 25 bp, Homo sapiens
acagagacgcaagagaaaaatccac

SEQ ID NO: 27792 - DNA, 25 bp, Homo sapiens
aatccactgccttccaaagaaacga

SEQ ID NO: 27793 - DNA, 25 bp, Homo sapiens
cactgccttccaaagaaacgattga

SEQ ID NO: 27794 - DNA, 25 bp, Homo sapiens
ggagaagcaagcaggcgaatcgtaa

SEQ ID NO: 27795 - DNA, 25 bp, Homo sapiens
agcaggcgaatcgtaatgaggcgtg

SEQ ID NO: 27796 - DNA, 25 bp, Homo sapiens
tgcactgtacattccacaagcattg

SEQ ID NO: 27797 - DNA, 25 bp, Homo sapiens
actgtacattccacaagcattgcct

SEQ ID NO: 27798 - DNA, 25 bp, Homo sapiens
agatgcaaagaggttggatcaagtt

SEQ ID NO: 27799 - DNA, 25 bp, Homo sapiens
aagtttaaatgactgtgctgcccct

SEQ ID NO: 27800 - DNA, 25 bp, Homo sapiens
gaaagaacttgcatgttggtgaagg

SEQ ID NO: 27801 - DNA, 25 bp, Homo sapiens
gctgtaatgcagtttaatcagagtg

SEQ ID NO: 27802 - DNA, 25 bp, Homo sapiens
tggaggaagttctccagcttcagct

SEQ ID NO: 27803 - DNA, 25 bp, Homo sapiens
caagcatcaccctgggagtttcctg

SEQ ID NO: 27804 - DNA, 25 bp, Homo sapiens
gggagtttcctgagggttttctcat

SEQ ID NO: 27805 - DNA, 25 bp, Homo sapiens
aaatgagggctgcacattgcctgtt

SEQ ID NO: 27806 - DNA, 25 bp, Homo sapiens
attgcctgttctgcttcgaagtatt

SEQ ID NO: 27807 - DNA, 25 bp, Homo sapiens
aaagtcacccaaacacttctgcttt

SEQ ID NO: 27808 - DNA, 25 bp, Homo sapiens
tgctttcacttaagtgtctggcccg

SEQ ID NO: 27809 - DNA, 25 bp, Homo sapiens
gtctggcccgcaatactgtaggaac

SEQ ID NO: 27810 - DNA, 25 bp, Homo sapiens
tatccacagtactcactttttccaa

SEQ ID NO: 27811 - DNA, 25 bp, Homo sapiens
gaaatatctttctcttacctgttat

SEQ ID NO: 27812 - DNA, 25 bp, Homo sapiens
tatgtgccaaagctttactactgtg

SEQ ID NO: 27813 - DNA, 25 bp, Homo sapiens
ccgccatttcctctgaagcaggtga

SEQ ID NO: 27814 - DNA, 25 bp, Homo sapiens
gaagcaggtgaaggtccccataatg

SEQ ID NO: 27815 - DNA, 25 bp, Homo sapiens
tgacgcaaaataccaccttggcgcc

SEQ ID NO: 27816 - DNA, 25 bp, Homo sapiens
ctacacgggagacgacgtccgcatc

SEQ ID NO: 27817 - DNA, 25 bp, Homo sapiens
tccgcatcgtccgtgacgacatgct

SEQ ID NO: 27818 - DNA, 25 bp, Homo sapiens
catgctgtgtgccgggaacacccgg

SEQ ID NO: 27819 - DNA, 25 bp, Homo sapiens
cgtgtcacctactacttggactgga

SEQ ID NO: 27820 - DNA, 25 bp, Homo sapiens
ttggactggatccaccactatgtcc

SEQ ID NO: 27821 - DNA, 25 bp, Homo sapiens
atgtccccaaaaagccgtgagtcag

SEQ ID NO: 27822 - DNA, 25 bp, Homo sapiens
gtgagtcaggcctgggttggccacc

SEQ ID NO: 27823 - DNA, 25 bp, Homo sapiens
gccacctgggtcactggaggaccaa

SEQ ID NO: 27824 - DNA, 25 bp, Homo sapiens
cacacagttcaaggcagaggtgcgg

SEQ ID NO: 27825 - DNA, 25 bp, Homo sapiens
caaggcagaggtgcggggcgctgag

SEQ ID NO: 27826 - DNA, 25 bp, Homo sapiens
cgctgagattgagtacgccatggcc

SEQ ID NO: 27827 - DNA, 25 bp, Homo sapiens
ttgagtacgccatggcctactctaa

SEQ ID NO: 27828 - DNA, 25 bp, Homo sapiens
gcctactctaaagccgcatttgaaa

SEQ ID NO: 27829 - DNA, 25 bp, Homo sapiens
gaaagtgatgtccctctgaaaactg

SEQ ID NO: 27830 - DNA, 25 bp, Homo sapiens
caaaacagcagtggctcacaggccc

SEQ ID NO: 27831 - DNA, 25 bp, Homo sapiens
cacaggcccggggcattcaaagctg

SEQ ID NO: 27832 - DNA, 25 bp, Homo sapiens
ccggggcattcaaagctgagctgtc

SEQ ID NO: 27833 - DNA, 25 bp, Homo sapiens
ctggggaccagcgaagaccaccagc

SEQ ID NO: 27834 - DNA, 25 bp, Homo sapiens
gtcctatctgtacttcacacagttc

SEQ ID NO: 27835 - DNA, 25 bp, Homo sapiens
aacagtctggatgctggtgccacta

SEQ ID NO: 27836 - DNA, 25 bp, Homo sapiens
gaaggcttaactctttcagctctga

SEQ ID NO: 27837 - DNA, 25 bp, Homo sapiens
ctctgagctcactgtgtgcactgag

SEQ ID NO: 27838 - DNA, 25 bp, Homo sapiens
tgcactgagcgatgtcaccatttct

SEQ ID NO: 27839 - DNA, 25 bp, Homo sapiens
ctgccacgcgtcggtgaaggttggg

SEQ ID NO: 27840 - DNA, 25 bp, Homo sapiens
gttgggactcgactggtgtttgatc

SEQ ID NO: 27841 - DNA, 25 bp, Homo sapiens
gaagcagttattttctacgctacct

SEQ ID NO: 27842 - DNA, 25 bp, Homo sapiens
ctacgctacctgtgcgccataagga

SEQ ID NO: 27843 - DNA, 25 bp, Homo sapiens
attaagaagacgtgcctgcttcccc

SEQ ID NO: 27844 - DNA, 25 bp, Homo sapiens
tctgccgtgattgtcagtttcctga

SEQ ID NO: 27845 - DNA, 25 bp, Homo sapiens
gtccatcagatttgctctgggccag

SEQ ID NO: 27846 - DNA, 25 bp, Homo sapiens
ttacagaaactgactcatgctgccc

SEQ ID NO: 27847 - DNA, 25 bp, Homo sapiens
ccccctgcatgctgtttatgaaagg

SEQ ID NO: 27848 - DNA, 25 bp, Homo sapiens
aaaggaactcctcaagaaccactct

SEQ ID NO: 27849 - DNA, 25 bp, Homo sapiens
accactctgtggtttcagcaagcag

SEQ ID NO: 27850 - DNA, 25 bp, Homo sapiens
gaggttcgacaggggctcaaagcct

SEQ ID NO: 27851 - DNA, 25 bp, Homo sapiens
aagcctattccaattggcctaccta

SEQ ID NO: 27852 - DNA, 25 bp, Homo sapiens
atcctcagctctacgtttctggaga

SEQ ID NO: 27853 - DNA, 25 bp, Homo sapiens
ggagatacacgcatctgaagaacta

SEQ ID NO: 27854 - DNA, 25 bp, Homo sapiens
tataatttgtcccaaagctcccaaa

SEQ ID NO: 27855 - DNA, 25 bp, Homo sapiens
caaatgaagcttctatgatgctctt

SEQ ID NO: 27856 - DNA, 25 bp, Homo sapiens
ctcaaattggccaacataccctcag

SEQ ID NO: 27857 - DNA, 25 bp, Homo sapiens
tccatctgccaccgtggcactggta

SEQ ID NO: 27858 - DNA, 25 bp, Homo sapiens
ctgccaccgtggcactggtattgct

SEQ ID NO: 27859 - DNA, 25 bp, Homo sapiens
accgtggcactggtattgctttgag

SEQ ID NO: 27860 - DNA, 25 bp, Homo sapiens
actggtattgctttgagtgcagggg

SEQ ID NO: 27861 - DNA, 25 bp, Homo sapiens
gttactccctgggaactttgagtct

SEQ ID NO: 27862 - DNA, 25 bp, Homo sapiens
ctccctgggaactttgagtcttatt

SEQ ID NO: 27863 - DNA, 25 bp, Homo sapiens
tgggaactttgagtcttatttggaa

SEQ ID NO: 27864 - DNA, 25 bp, Homo sapiens
ccagcactgatccacacagctaagt

SEQ ID NO: 27865 - DNA, 25 bp, Homo sapiens
tgatccacacagctaagtttgcact

SEQ ID NO: 27866 - DNA, 25 bp, Homo sapiens
gacacttgatgtgggacctaggaaa

SEQ ID NO: 27867 - DNA, 25 bp, Homo sapiens
gtgggacctaggaaaaggcctgaag

SEQ ID NO: 27868 - DNA, 25 bp, Homo sapiens
aggccctgcgtgtggatggtgacac

SEQ ID NO: 27869 - DNA, 25 bp, Homo sapiens
ggccctgcgttgtggatggtgacac

SEQ ID NO: 27870 - DNA, 25 bp, Homo sapiens
gtggaatgtcatccttacttcaacc

SEQ ID NO: 27871 - DNA, 25 bp, Homo sapiens
tctggttgcctatagtgctctggga

SEQ ID NO: 27872 - DNA, 25 bp, Homo sapiens
tctgggatccctccgagaagaacca

SEQ ID NO: 27873 - DNA, 25 bp, Homo sapiens
cttggaggacccagtcctttgtgcc

SEQ ID NO: 27874 - DNA, 25 bp, Homo sapiens
gctaccagctacagcgtggggttgt

SEQ ID NO: 27875 - DNA, 25 bp, Homo sapiens
tgtggtcctggccaagagctacaat

SEQ ID NO: 27876 - DNA, 25 bp, Homo sapiens
tgacccttgatatttttgctggccc

SEQ ID NO: 27877 - DNA, 25 bp, Homo sapiens
ccccctaattatccgatctctgatg

SEQ ID NO: 27878 - DNA, 25 bp, Homo sapiens
gcatgaggtctgccagaaggccctg

SEQ ID NO: 27879 - DNA, 25 bp, Homo sapiens
gtggtggcggatcatggtctcacct

SEQ ID NO: 27880 - DNA, 25 bp, Homo sapiens
caccaagctgggtatcacgcaactc

SEQ ID NO: 27881 - DNA, 25 bp, Homo sapiens
cgagaacgtgtcggtcattgcctgg

SEQ ID NO: 27882 - DNA, 25 bp, Homo sapiens
ctggagcgcccaacgatgatcaaat

SEQ ID NO: 27883 - DNA, 25 bp, Homo sapiens
aacaatatccgggagctggtgggcc

SEQ ID NO: 27884 - DNA, 25 bp, Homo sapiens
tggtgggccacaaggtgaacctgca

SEQ ID NO: 27885 - DNA, 25 bp, Homo sapiens
gtataactggaagctggacgaggcc

SEQ ID NO: 27886 - DNA, 25 bp, Homo sapiens
ccggtcaagtacttctccatcgacc

SEQ ID NO: 27887 - DNA, 25 bp, Homo sapiens
tccatcgaccgcgtattccggaatg

SEQ ID NO: 27888 - DNA, 25 bp, Homo sapiens
tattccggaatgagaccctggacgc

SEQ ID NO: 27889 - DNA, 25 bp, Homo sapiens
tgagttccaccagatcgagggcgtg

SEQ ID NO: 27890 - DNA, 25 bp, Homo sapiens
ggaccatctcctttcggatgaaacc

SEQ ID NO: 27891 - DNA, 25 bp, Homo sapiens
actcgcagtgccagcatgaagctcc

SEQ ID NO: 27892 - DNA, 25 bp, Homo sapiens
agataccacacggccatacggagat

SEQ ID NO: 27893 - DNA, 25 bp, Homo sapiens
cagaatctgtcaagtctcggggtct

SEQ ID NO: 27894 - DNA, 25 bp, Homo sapiens
gcactgagttattcgtggctcctgt

SEQ ID NO: 27895 - DNA, 25 bp, Homo sapiens
tgtgggtgtagccagcaagcgccac

SEQ ID NO: 27896 - DNA, 25 bp, Homo sapiens
aaccagcctccagccggaaggagaa

SEQ ID NO: 27897 - DNA, 25 bp, Homo sapiens
tgaggctctcaggggttgtgacatc

SEQ ID NO: 27898 - DNA, 25 bp, Homo sapiens
gcatcatctgcaaccgagaggactc

SEQ ID NO: 27899 - DNA, 25 bp, Homo sapiens
ggggacagaaatctgactcctcgct

SEQ ID NO: 27900 - DNA, 25 bp, Homo sapiens
gcaaagcagggggcttcagaccctc

SEQ ID NO: 27901 - DNA, 25 bp, Homo sapiens
ttgcactttgagcccgtggggtgag

SEQ ID NO: 27902 - DNA, 25 bp, Homo sapiens
gtggggtgaggagttggcaatttgg

SEQ ID NO: 27903 - DNA, 25 bp, Homo sapiens
tcggggaactccagaccaagggtga

SEQ ID NO: 27904 - DNA, 25 bp, Homo sapiens
cagaccaagggtgagggcgcctttc

SEQ ID NO: 27905 - DNA, 25 bp, Homo sapiens
aaaaggaagtgcccaacatctccca

SEQ ID NO: 27906 - DNA, 25 bp, Homo sapiens
cgttcccgcagaccaaagagagtgt

SEQ ID NO: 27907 - DNA, 25 bp, Homo sapiens
gccagctccagagtgggggggctgt

SEQ ID NO: 27908 - DNA, 25 bp, Homo sapiens
ctgtcccagggggcaagaaggggtg

SEQ ID NO: 27909 - DNA, 25 bp, Homo sapiens
aagaaggggtgtcagggcccagtga

SEQ ID NO: 27910 - DNA, 25 bp, Homo sapiens
gggcccagtgacaaaatcattgggg

SEQ ID NO: 27911 - DNA, 25 bp, Homo sapiens
ccagctgctgccttcatattgaagg

SEQ ID NO: 27912 - DNA, 25 bp, Homo sapiens
tcaccaagttccttctggatcacca

SEQ ID NO: 27913 - DNA, 25 bp, Homo sapiens
tcctcctggcatcaggggccatgaa

SEQ ID NO: 27914 - DNA, 25 bp, Homo sapiens
gaagccccctggagagagatgttgg

SEQ ID NO: 27915 - DNA, 25 bp, Homo sapiens
ggcctcgctgttaccagaagacgtt

SEQ ID NO: 27916 - DNA, 25 bp, Homo sapiens
cagaagacgtttttctctgccttac

SEQ ID NO: 27917 - DNA, 25 bp, Homo sapiens
tgaaagccagagggtgccagcgaca

SEQ ID NO: 27918 - DNA, 25 bp, Homo sapiens
agaactaccaggtgcttcgtttcct

SEQ ID NO: 27919 - DNA, 25 bp, Homo sapiens
tcctgactgctttcctggtgcagat

SEQ ID NO: 27920 - DNA, 25 bp, Homo sapiens
cactaacctggctgttgttttcggc

SEQ ID NO: 27921 - DNA, 25 bp, Homo sapiens
cctgctgtggcccaaggatgcggcc

SEQ ID NO: 27922 - DNA, 25 bp, Homo sapiens
gccatcaccctcaaggccattaatc

SEQ ID NO: 27923 - DNA, 25 bp, Homo sapiens
gacagaaccccagtttgtatgtaca

SEQ ID NO: 27924 - DNA, 25 bp, Homo sapiens
gtacattattcatattcctctctgt

SEQ ID NO: 27925 - DNA, 25 bp, Homo sapiens
tcctctctgttgtgtttcgggggga

SEQ ID NO: 27926 - DNA, 25 bp, Homo sapiens
gcatgaagttgcccttaaccactaa

SEQ ID NO: 27927 - DNA, 25 bp, Homo sapiens
gatttttgcgcagacttatacatgt

SEQ ID NO: 27928 - DNA, 25 bp, Homo sapiens
agttatgatcatcgttttcctgcct

SEQ ID NO: 27929 - DNA, 25 bp, Homo sapiens
cccaccatcatcaaacactcagtta

SEQ ID NO: 27930 - DNA, 25 bp, Homo sapiens
tggaatttcctctctgtgacagaac

SEQ ID NO: 27931 - DNA, 25 bp, Homo sapiens
attgtccttcagttttgaggccatg

SEQ ID NO: 27932 - DNA, 25 bp, Homo sapiens
gacagcttatacttctcaaaattca

SEQ ID NO: 27933 - DNA, 25 bp, Homo sapiens
gtgagtctttttgtgttactccaaa

SEQ ID NO: 27934 - DNA, 25 bp, Homo sapiens
ctggcctcagatacacctaagaagc

SEQ ID NO: 27935 - DNA, 25 bp, Homo sapiens
taggggcaaggttcattctcctgct

SEQ ID NO: 27936 - DNA, 25 bp, Homo sapiens
ggttcattctcctgctttaaaaagt

SEQ ID NO: 27937 - DNA, 25 bp, Homo sapiens
caatcatctccttaacaggggtcgt

SEQ ID NO: 27938 - DNA, 25 bp, Homo sapiens
ggtcgtaagcctggtttgcttctat

SEQ ID NO: 27939 - DNA, 25 bp, Homo sapiens
taacttctgctaggtattactctct

SEQ ID NO: 27940 - DNA, 25 bp, Homo sapiens
attactctctactcctaaagttatt

SEQ ID NO: 27941 - DNA, 25 bp, Homo sapiens
taattaaccatctacctctgttttt

SEQ ID NO: 27942 - DNA, 25 bp, Homo sapiens
ggcagcttgaaatgttggtcctaat

SEQ ID NO: 27943 - DNA, 25 bp, Homo sapiens
tttttcctcttctatagacttgaga

SEQ ID NO: 27944 - DNA, 25 bp, Homo sapiens
ccaggtaattgtctctttttctaat

SEQ ID NO: 27945 - DNA, 25 bp, Homo sapiens
ttattatgccctctttggtactata

SEQ ID NO: 27946 - DNA, 25 bp, Homo sapiens
gccctctttggtactatatgccatg

SEQ ID NO: 27947 - DNA, 25 bp, Homo sapiens
atatgccatggatgtgaatttccca

SEQ ID NO: 27948 - DNA, 25 bp, Homo sapiens
gaatttcccatagaagctggtgaca

SEQ ID NO: 27949 - DNA, 25 bp, Homo sapiens
gaagctggtgacatgttcctggaag

SEQ ID NO: 27950 - DNA, 25 bp, Homo sapiens
tgacatgttcctggaagctctgggc

SEQ ID NO: 27951 - DNA, 25 bp, Homo sapiens
acacctggcatgacacttgctttgt

SEQ ID NO: 27952 - DNA, 25 bp, Homo sapiens
cttgctttgtatgctcagtgtgttg

SEQ ID NO: 27953 - DNA, 25 bp, Homo sapiens
ggaaggtcagacctttttctccaag

SEQ ID NO: 27954 - DNA, 25 bp, Homo sapiens
caagaaggacaagcccctgtgtaag

SEQ ID NO: 27955 - DNA, 25 bp, Homo sapiens
gcccctgtgtaagaaacatgctcat

SEQ ID NO: 27956 - DNA, 25 bp, Homo sapiens
agatgacctcaagcagtttggccta

SEQ ID NO: 27957 - DNA, 25 bp, Homo sapiens
caagcagtttggcctaacaaccagt

SEQ ID NO: 27958 - DNA, 25 bp, Homo sapiens
taacaaccagtattccgttccgagg

SEQ ID NO: 27959 - DNA, 25 bp, Homo sapiens
tattccgttccgaggttgcatcaga

SEQ ID NO: 27960 - DNA, 25 bp, Homo sapiens
gttgcatcagatccctgaagctcac

SEQ ID NO: 27961 - DNA, 25 bp, Homo sapiens
caagccactggaggttaattttgcc

SEQ ID NO: 27962 - DNA, 25 bp, Homo sapiens
aggccctggaactgaggggcgttca

SEQ ID NO: 27963 - DNA, 25 bp, Homo sapiens
aggggcgttcaacctgtatcatgcc

SEQ ID NO: 27964 - DNA, 25 bp, Homo sapiens
gtatcatgcccagccaactaataaa

SEQ ID NO: 27965 - DNA, 25 bp, Homo sapiens
gagtctgtcaaaacaagtatatcaa

SEQ ID NO: 27966 - DNA, 25 bp, Homo sapiens
aattaaactaatttgtgcatgtaca

SEQ ID NO: 27967 - DNA, 25 bp, Homo sapiens
tctgccgtgattgtcagtttcctga

SEQ ID NO: 27968 - DNA, 25 bp, Homo sapiens
agaactgactcctagaagtacccca

SEQ ID NO: 27969 - DNA, 25 bp, Homo sapiens
acccctgctccttggaggacaacgt

SEQ ID NO: 27970 - DNA, 25 bp, Homo sapiens
aacagtctggatgctggtgccacta

SEQ ID NO: 27971 - DNA, 25 bp, Homo sapiens
agtttgccgacctaactcaggtgga

SEQ ID NO: 27972 - DNA, 25 bp, Homo sapiens
ctctgagctcactttgtgcactgag

SEQ ID NO: 27973 - DNA, 25 bp, Homo sapiens
tgagtgatgtcaccatttctacctg

SEQ ID NO: 27974 - DNA, 25 bp, Homo sapiens
tttctacctgccgtgtatcagcgaa

SEQ ID NO: 27975 - DNA, 25 bp, Homo sapiens
gttgggactcgactggtgtttgatc

SEQ ID NO: 27976 - DNA, 25 bp, Homo sapiens
gaagcagttattttctacgctacct

SEQ ID NO: 27977 - DNA, 25 bp, Homo sapiens
tacgctacctgtgcaccataaagaa

SEQ ID NO: 27978 - DNA, 25 bp, Homo sapiens
gacagccctttaagacgacatctcc

SEQ ID NO: 27979 - DNA, 25 bp, Homo sapiens
tgagccagggggacgctcttttgaa

SEQ ID NO: 27980 - DNA, 25 bp, Homo sapiens
gatatgccgcagaaggatccgtgcc

SEQ ID NO: 27981 - DNA, 25 bp, Homo sapiens
atccgtgccagaagcaagcctgtga

SEQ ID NO: 27982 - DNA, 25 bp, Homo sapiens
agtgtcaggctgtcatccaagaact

SEQ ID NO: 27983 - DNA, 25 bp, Homo sapiens
gcgtaagtgttgtgctcagtatccc

SEQ ID NO: 27984 - DNA, 25 bp, Homo sapiens
gggaagatctgtcgtctgttcagga

SEQ ID NO: 27985 - DNA, 25 bp, Homo sapiens
aacctaacacggaagtctgcatcaa

SEQ ID NO: 27986 - DNA, 25 bp, Homo sapiens
ttcttctgaagtgctgctccatgtt

SEQ ID NO: 27987 - DNA, 25 bp, Homo sapiens
ctgctccatgtttccaccaaatgaa

SEQ ID NO: 27988 - DNA, 25 bp, Homo sapiens
cctcctgactcttcaggccaggtag

SEQ ID NO: 27989 - DNA, 25 bp, Homo sapiens
tgaaatgaccagcttgtgtgcccac

SEQ ID NO: 27990 - DNA, 25 bp, Homo sapiens
ttgtgtgcccactggcaggtacatc

SEQ ID NO: 27991 - DNA, 25 bp, Homo sapiens
ccactggcaggtacatcgccatgcc

SEQ ID NO: 27992 - DNA, 25 bp, Homo sapiens
gccatgccacagcctatagggttgt

SEQ ID NO: 27993 - DNA, 25 bp, Homo sapiens
gaatccctccaggataggcaaaagc

SEQ ID NO: 27994 - DNA, 25 bp, Homo sapiens
gcaaaagcaagaatccactgtgggt

SEQ ID NO: 27995 - DNA, 25 bp, Homo sapiens
gtgggtggagggacaaccaggcatt

SEQ ID NO: 27996 - DNA, 25 bp, Homo sapiens
accaggcattgcttctatggacttc

SEQ ID NO: 27997 - DNA, 25 bp, Homo sapiens
gaaggacctagtgtgagcataatgg

SEQ ID NO: 27998 - DNA, 25 bp, Homo sapiens
aaaaacacaatcacttcctacacga

SEQ ID NO: 27999 - DNA, 25 bp, Homo sapiens
tccaaccattccaccagcaaaagaa

SEQ ID NO: 28000 - DNA, 25 bp, Homo sapiens
gcaggcacttgcgtggatgtttctc

SEQ ID NO: 28001 - DNA, 25 bp, Homo sapiens
cgatatttaggctctcttccaactc

SEQ ID NO: 28002 - DNA, 25 bp, Homo sapiens
ggatttttctctttgcatgtttgaa

SEQ ID NO: 28003 - DNA, 25 bp, Homo sapiens
gagacttccaggggattgccatctt

SEQ ID NO: 28004 - DNA, 25 bp, Homo sapiens
ctatgtccctagctgcaggaagccc

SEQ ID NO: 28005 - DNA, 25 bp, Homo sapiens
ttttttccaagcacgaagccaccag

SEQ ID NO: 28006 - DNA, 25 bp, Homo sapiens
gaagggacatggatgtgctcctgcc

SEQ ID NO: 28007 - DNA, 25 bp, Homo sapiens
ctgggactgcctggagatttgtcag

SEQ ID NO: 28008 - DNA, 25 bp, Homo sapiens
aagtaccttggagcattctgttatt

SEQ ID NO: 28009 - DNA, 25 bp, Homo sapiens
aaggaggttgctgactgtactgaca

SEQ ID NO: 28010 - DNA, 25 bp, Homo sapiens
acaggctctaagtcattttctccaa

SEQ ID NO: 28011 - DNA, 25 bp, Homo sapiens
gtgctctcagtaaaacggtattcta

SEQ ID NO: 28012 - DNA, 25 bp, Homo sapiens
gaatctgatattattcctgaggatt

SEQ ID NO: 28013 - DNA, 25 bp, Homo sapiens
gatgttgatcatcctctaccaataa

SEQ ID NO: 28014 - DNA, 25 bp, Homo sapiens
tgatcatcctctaccaataagcaat

SEQ ID NO: 28015 - DNA, 25 bp, Homo sapiens
gcaatccactaacaagcagtcaacc

SEQ ID NO: 28016 - DNA, 25 bp, Homo sapiens
gggattgtactggagctttttctga

SEQ ID NO: 28017 - DNA, 25 bp, Homo sapiens
gtactggagctttttctgatgagtt

SEQ ID NO: 28018 - DNA, 25 bp, Homo sapiens
gatgagttgtcatttaagcgtggtg

SEQ ID NO: 28019 - DNA, 25 bp, Homo sapiens
ggtgatgtgatttacattcttagca

SEQ ID NO: 28020 - DNA, 25 bp, Homo sapiens
tgaagggagccattggcttggtgcc

SEQ ID NO: 28021 - DNA, 25 bp, Homo sapiens
ggcagaaacggtggtgtgctctcag

SEQ ID NO: 28022 - DNA, 25 bp, Homo sapiens
gctgcgctcagaggaacaagccagg

SEQ ID NO: 28023 - DNA, 25 bp, Homo sapiens
ggaacaagccaggcgtgtacacaag

SEQ ID NO: 28024 - DNA, 25 bp, Homo sapiens
agccaggcgtgtacacaaggctccc

SEQ ID NO: 28025 - DNA, 25 bp, Homo sapiens
ggatcaaagagaacactggggtata

SEQ ID NO: 28026 - DNA, 25 bp, Homo sapiens
gagaacactggggtataggggccgg

SEQ ID NO: 28027 - DNA, 25 bp, Homo sapiens
ccacccaaatgtgtacacctgcggg

SEQ ID NO: 28028 - DNA, 25 bp, Homo sapiens
cccaaatgtgtacacctgcggggcc

SEQ ID NO: 28029 - DNA, 25 bp, Homo sapiens
ccccagaacatacactgtgaactca

SEQ ID NO: 28030 - DNA, 25 bp, Homo sapiens
accctggaaaacagacgggtctgag

SEQ ID NO: 28031 - DNA, 25 bp, Homo sapiens
aacagacgggtctgagactgaaaat

SEQ ID NO: 28032 - DNA, 25 bp, Homo sapiens
ctgaaaatggtttaccagctcccag

SEQ ID NO: 28033 - DNA, 25 bp, Homo sapiens
ggccatttcagttctcatgtgtgta

SEQ ID NO: 28034 - DNA, 25 bp, Homo sapiens
ggttttcaaaccagtgggcacacag

SEQ ID NO: 28035 - DNA, 25 bp, Homo sapiens
tccctctcttagtgttctttaatca

SEQ ID NO: 28036 - DNA, 25 bp, Homo sapiens
ataactgcctggaagcctttcattt

SEQ ID NO: 28037 - DNA, 25 bp, Homo sapiens
tggaagcctttcattttacacgccc

SEQ ID NO: 28038 - DNA, 25 bp, Homo sapiens
cgccctgaagcagtcttctttgcta

SEQ ID NO: 28039 - DNA, 25 bp, Homo sapiens
ttatgtggtgtgtttttccgtaata

SEQ ID NO: 28040 - DNA, 25 bp, Homo sapiens
cactactgctgcagctcacaaacac

SEQ ID NO: 28041 - DNA, 25 bp, Homo sapiens
gctcacaaacacctctgcatattac

SEQ ID NO: 28042 - DNA, 25 bp, Homo sapiens
tctgcatattacatgtacctcctcc

SEQ ID NO: 28043 - DNA, 25 bp, Homo sapiens
gtgtggtctattttgccatcatcac

SEQ ID NO: 28044 - DNA, 25 bp, Homo sapiens
gcacttgaaccagattatagattta

SEQ ID NO: 28045 - DNA, 25 bp, Homo sapiens
aaactagaatagccagtatttatgt

SEQ ID NO: 28046 - DNA, 25 bp, Homo sapiens
gtgcaatacgaattatgcaatcaca

SEQ ID NO: 28047 - DNA, 25 bp, Homo sapiens
atcacaatacatttgtagctcccga

SEQ ID NO: 28048 - DNA, 25 bp, Homo sapiens
aatacatttgtagctcccgagtgtc

SEQ ID NO: 28049 - DNA, 25 bp, Homo sapiens
atttgtagctcccgagtgtcctaaa

SEQ ID NO: 28050 - DNA, 25 bp, Homo sapiens
gtagctcccgagtgtcctaaaggga

SEQ ID NO: 28051 - DNA, 25 bp, Homo sapiens
gtcctaaagggagtgcacttctttg

SEQ ID NO: 28052 - DNA, 25 bp, Homo sapiens
acttctttgaagctggtgtgttaat

SEQ ID NO: 28053 - DNA, 25 bp, Homo sapiens
gaagctggtgtgttaatactatgta

SEQ ID NO: 28054 - DNA, 25 bp, Homo sapiens
taactttcaaatgatgctgctgcca

SEQ ID NO: 28055 - DNA, 25 bp, Homo sapiens
tgtaatcccagttacacagaagact

SEQ ID NO: 28056 - DNA, 25 bp, Homo sapiens
gaggacagcgtgcttttgtgtactg

SEQ ID NO: 28057 - DNA, 25 bp, Homo sapiens
agcgtgcttttgtgtactgttggaa

SEQ ID NO: 28058 - DNA, 25 bp, Homo sapiens
ccacagctgactgggcagcaggcac

SEQ ID NO: 28059 - DNA, 25 bp, Homo sapiens
tgactgggcagcaggcacaggccct

SEQ ID NO: 28060 - DNA, 25 bp, Homo sapiens
acccgagcaggccggagttggctcg

SEQ ID NO: 28061 - DNA, 25 bp, Homo sapiens
cgagcaggccggagttggctcgcat

SEQ ID NO: 28062 - DNA, 25 bp, Homo sapiens
ctgcctgtgtacatttctccagata

SEQ ID NO: 28063 - DNA, 25 bp, Homo sapiens
acatttctccagataccctatggct

SEQ ID NO: 28064 - DNA, 25 bp, Homo sapiens
ccagataccctatggctaattttgt

SEQ ID NO: 28065 - DNA, 25 bp, Homo sapiens
ggctaattttgttataactgcacag

SEQ ID NO: 28066 - DNA, 25 bp, Homo sapiens
aggccagttcgttggatggctcttg

SEQ ID NO: 28067 - DNA, 25 bp, Homo sapiens
ctctagcgctagtgatgtgtgggcc

SEQ ID NO: 28068 - DNA, 25 bp, Homo sapiens
tgggaactcatgactctgggccaga

SEQ ID NO: 28069 - DNA, 25 bp, Homo sapiens
atggttaccgaatagcccagccaat

SEQ ID NO: 28070 - DNA, 25 bp, Homo sapiens
cccagccaatcaactgtcctgatga

SEQ ID NO: 28071 - DNA, 25 bp, Homo sapiens
tatttgctgtgatggcctgttgctg

SEQ ID NO: 28072 - DNA, 25 bp, Homo sapiens
cctgttgctgggccttagatccaga

SEQ ID NO: 28073 - DNA, 25 bp, Homo sapiens
gtttcagcagctggtacagtgccta

SEQ ID NO: 28074 - DNA, 25 bp, Homo sapiens
gcctaacagagtttcatgcagccct

SEQ ID NO: 28075 - DNA, 25 bp, Homo sapiens
aggaagaaggtgcctgtcggggctc

SEQ ID NO: 28076 - DNA, 25 bp, Homo sapiens
tcggggctcacttgaagcctgtcag

SEQ ID NO: 28077 - DNA, 25 bp, Homo sapiens
catgacagtgcccagctggtgactg

SEQ ID NO: 28078 - DNA, 25 bp, Homo sapiens
agctggtgactggtacttcattctc

SEQ ID NO: 28079 - DNA, 25 bp, Homo sapiens
ggcctacggtgggcatggccattca

SEQ ID NO: 28080 - DNA, 25 bp, Homo sapiens
tggccattcagaactccatctgttc

SEQ ID NO: 28081 - DNA, 25 bp, Homo sapiens
gaggtgtgaacatggaccactccac

SEQ ID NO: 28082 - DNA, 25 bp, Homo sapiens
cctcctccatagcccatgagttggg

SEQ ID NO: 28083 - DNA, 25 bp, Homo sapiens
tgggcctggaccatgatttgcctgg

SEQ ID NO: 28084 - DNA, 25 bp, Homo sapiens
gcctccaagccggacttagggcttc

SEQ ID NO: 28085 - DNA, 25 bp, Homo sapiens
cttagggcttcaagaggcgggcgtg

SEQ ID NO: 28086 - DNA, 25 bp, Homo sapiens
tcccctaccatgactgaaggcgcca

SEQ ID NO: 28087 - DNA, 25 bp, Homo sapiens
tggcggtgtcttaagactccgggca

SEQ ID NO: 28088 - DNA, 25 bp, Homo sapiens
ttcagaaggccagggaggacatctt

SEQ ID NO: 28089 - DNA, 25 bp, Homo sapiens
gaaggccagggaggacatctttatg

SEQ ID NO: 28090 - DNA, 25 bp, Homo sapiens
ggaggacatctttatggagaccctg

SEQ ID NO: 28091 - DNA, 25 bp, Homo sapiens
aggacatctttatggagaccctgaa

SEQ ID NO: 28092 - DNA, 25 bp, Homo sapiens
gaaactgaagtgcctggcctacgac

SEQ ID NO: 28093 - DNA, 25 bp, Homo sapiens
aaactgaagtgcctggcctacgact

SEQ ID NO: 28094 - DNA, 25 bp, Homo sapiens
tacgacttctacccagggaaaattg

SEQ ID NO: 28095 - DNA, 25 bp, Homo sapiens
tacccagggaaaattgatgtgcact

SEQ ID NO: 28096 - DNA, 25 bp, Homo sapiens
gtgcaggagcctgagttacggggag

SEQ ID NO: 28097 - DNA, 25 bp, Homo sapiens
ggagcctgagttacggggagatgtt

SEQ ID NO: 28098 - DNA, 25 bp, Homo sapiens
tgagttacggggagatgttcttcac

SEQ ID NO: 28099 - DNA, 25 bp, Homo sapiens
ccggtcagcaggatcatcgtgcacc

SEQ ID NO: 28100 - DNA, 25 bp, Homo sapiens
ctacaccgcccagatcggagcggac

SEQ ID NO: 28101 - DNA, 25 bp, Homo sapiens
ggagctggaggagccggtgaacgtc

SEQ ID NO: 28102 - DNA, 25 bp, Homo sapiens
gtcactggctggggcgatgtggaca

SEQ ID NO: 28103 - DNA, 25 bp, Homo sapiens
tgtggacaatgatgagcgcctccca

SEQ ID NO: 28104 - DNA, 25 bp, Homo sapiens
ccgccatttcctctgaagcaggtga

SEQ ID NO: 28105 - DNA, 25 bp, Homo sapiens
gaagcaggtgaaggtccccataatg

SEQ ID NO: 28106 - DNA, 25 bp, Homo sapiens
tgacgcaaaataccaccttggcgcc

SEQ ID NO: 28107 - DNA, 25 bp, Homo sapiens
ctacacgggagacgacgtccgcatc

SEQ ID NO: 28108 - DNA, 25 bp, Homo sapiens
tcgtccgtgacgacatgctgtgtgc

SEQ ID NO: 28109 - DNA, 25 bp, Homo sapiens
gagggactcatgccaggtggcgact

SEQ ID NO: 28110 - DNA, 25 bp, Homo sapiens
cccacctgctaaccaatggcgagac

SEQ ID NO: 28111 - DNA, 25 bp, Homo sapiens
gggacccaggccagtgaggggtact

SEQ ID NO: 28112 - DNA, 25 bp, Homo sapiens
gaggggtacttcagtcaatcacagg

SEQ ID NO: 28113 - DNA, 25 bp, Homo sapiens
caggaggaggagtttgcccaatcgg

SEQ ID NO: 28114 - DNA, 25 bp, Homo sapiens
tgcccaatcggaagagctctgtgcc

SEQ ID NO: 28115 - DNA, 25 bp, Homo sapiens
cctcctgtgttctacaacaagcctc

SEQ ID NO: 28116 - DNA, 25 bp, Homo sapiens
acaagcctccagagatcgacatcac

SEQ ID NO: 28117 - DNA, 25 bp, Homo sapiens
gatcgacatcacatgctgggatgca

SEQ ID NO: 28118 - DNA, 25 bp, Homo sapiens
atgcagacccagttccagaagagga

SEQ ID NO: 28119 - DNA, 25 bp, Homo sapiens
cgagggtggtgattagcggtggcgc

SEQ ID NO: 28120 - DNA, 25 bp, Homo sapiens
gggcctgacttttacagcttttctc

SEQ ID NO: 28121 - DNA, 25 bp, Homo sapiens
ggggctcgaagggtccttgtagccg

SEQ ID NO: 28122 - DNA, 25 bp, Homo sapiens
tgctgctggggggatcacagaccat

SEQ ID NO: 28123 - DNA, 25 bp, Homo sapiens
ttctttctttcggccaggctgaggc

SEQ ID NO: 28124 - DNA, 25 bp, Homo sapiens
ggctgaggccctgacgtggatgggc

SEQ ID NO: 28125 - DNA, 25 bp, Homo sapiens
ggatgggcaaactgcaggcctggga

SEQ ID NO: 28126 - DNA, 25 bp, Homo sapiens
ggttcgcaaagtgcaaagctttctt

SEQ ID NO: 28127 - DNA, 25 bp, Homo sapiens
gcaaagctttcttgtgcatgacgcc

SEQ ID NO: 28128 - DNA, 25 bp, Homo sapiens
ccctgggctgcattgggttggtggc

SEQ ID NO: 28129 - DNA, 25 bp, Homo sapiens
gggctgcattgggttggtggcccac

SEQ ID NO: 28130 - DNA, 25 bp, Homo sapiens
gggccccgttggaagactgagtgcc

SEQ ID NO: 28131 - DNA, 25 bp, Homo sapiens
ccgttggaagactgagtgcccgggg

SEQ ID NO: 28132 - DNA, 25 bp, Homo sapiens
cgtgtttccaaaccagttgtgccgt

SEQ ID NO: 28133 - DNA, 25 bp, Homo sapiens
cttctctggccttgtgaggttgtgg

SEQ ID NO: 28134 - DNA, 25 bp, Homo sapiens
ggaatccagaactaggtctaccttc

SEQ ID NO: 28135 - DNA, 25 bp, Homo sapiens
ggtctaccttcaacatttatgcagt

SEQ ID NO: 28136 - DNA, 25 bp, Homo sapiens
gatattctttacaccaagccatcag

SEQ ID NO: 28137 - DNA, 25 bp, Homo sapiens
aagccatcaggctccttttatcaaa

SEQ ID NO: 28138 - DNA, 25 bp, Homo sapiens
tttgaatgtccaccagacaccagcc

SEQ ID NO: 28139 - DNA, 25 bp, Homo sapiens
gccccggggggcacagagagaacaa

SEQ ID NO: 28140 - DNA, 25 bp, Homo sapiens
acattcctctctgtcaacatcgaga

SEQ ID NO: 28141 - DNA, 25 bp, Homo sapiens
gcttctggtgggtgcattttctggc

SEQ ID NO: 28142 - DNA, 25 bp, Homo sapiens
acggttgcaacagtgttccttttct

SEQ ID NO: 28143 - DNA, 25 bp, Homo sapiens
aaagattggctttccttggagtgaa

SEQ ID NO: 28144 - DNA, 25 bp, Homo sapiens
aaacccatcgacaagaaggcacctg

SEQ ID NO: 28145 - DNA, 25 bp, Homo sapiens
tttatgccccacgtctgagaatcaa

SEQ ID NO: 28146 - DNA, 25 bp, Homo sapiens
gagaatcaacaagcggatcctgcag

SEQ ID NO: 28147 - DNA, 25 bp, Homo sapiens
gatcctgcagctctgcatgggcaac

SEQ ID NO: 28148 - DNA, 25 bp, Homo sapiens
aaccatgagttgtatatgcgccgca

SEQ ID NO: 28149 - DNA, 25 bp, Homo sapiens
atatgcgccgcaggaagcctgacac

SEQ ID NO: 28150 - DNA, 25 bp, Homo sapiens
ggaagcctgacaccatcgaggtgca

SEQ ID NO: 28151 - DNA, 25 bp, Homo sapiens
aggaacagacctttggcttggagtt

SEQ ID NO: 28152 - DNA, 25 bp, Homo sapiens
ggcttggagttgatgcccttggact

SEQ ID NO: 28153 - DNA, 25 bp, Homo sapiens
gatgcccttggactgaatatttatg

SEQ ID NO: 28154 - DNA, 25 bp, Homo sapiens
gactcatggccaatgtgggcggctt

SEQ ID NO: 28155 - DNA, 25 bp, Homo sapiens
aaagacctgctgtactgactggggc

SEQ ID NO: 28156 - DNA, 25 bp, Homo sapiens
gccagttcttccttatccaggagaa

SEQ ID NO: 28157 - DNA, 25 bp, Homo sapiens
gacagtcagcccttgtaggtagctc

SEQ ID NO: 28158 - DNA, 25 bp, Homo sapiens
taggtagctcctacatgagtgccct

SEQ ID NO: 28159 - DNA, 25 bp, Homo sapiens
tgtaggcagcatcgcagctggctac

SEQ ID NO: 28160 - DNA, 25 bp, Homo sapiens
gaccgggccatggcaaaggcgggac

SEQ ID NO: 28161 - DNA, 25 bp, Homo sapiens
ggcctgttgctgttcatgatggctg

SEQ ID NO: 28162 - DNA, 25 bp, Homo sapiens
gatggctggcatgacagtgtccatg

SEQ ID NO: 28163 - DNA, 25 bp, Homo sapiens
tccatgtacctcttccgggtaacag

SEQ ID NO: 28164 - DNA, 25 bp, Homo sapiens
gggtaacagtgaccagtgactcccc

SEQ ID NO: 28165 - DNA, 25 bp, Homo sapiens
gcttttgcagtcgtgtaatgggccc

SEQ ID NO: 28166 - DNA, 25 bp, Homo sapiens
ttgcagtcgtgtaatgggcccaagt

SEQ ID NO: 28167 - DNA, 25 bp, Homo sapiens
ctaggcgacgagacccagtggctag

SEQ ID NO: 28168 - DNA, 25 bp, Homo sapiens
gacccagtggctagaagttcaccat

SEQ ID NO: 28169 - DNA, 25 bp, Homo sapiens
ggctagaagttcaccatgtctattc

SEQ ID NO: 28170 - DNA, 25 bp, Homo sapiens
caccatgtctattctcaagatccat

SEQ ID NO: 28171 - DNA, 25 bp, Homo sapiens
tctcaagatccatgccagggagatc

SEQ ID NO: 28172 - DNA, 25 bp, Homo sapiens
cagggagatctttgactctcgcggg

SEQ ID NO: 28173 - DNA, 25 bp, Homo sapiens
ctctcgcgggaatcccactgttgag

SEQ ID NO: 28174 - DNA, 25 bp, Homo sapiens
cgcgggaatcccactgttgaggttg

SEQ ID NO: 28175 - DNA, 25 bp, Homo sapiens
tgaggttgatctcttcacctcaaaa

SEQ ID NO: 28176 - DNA, 25 bp, Homo sapiens
agttgcattcctttgagtcacataa

SEQ ID NO: 28177 - DNA, 25 bp, Homo sapiens
ttccaggttcagtggtcacctcaca

SEQ ID NO: 28178 - DNA, 25 bp, Homo sapiens
gaagacgggccaccagagttgttgt

SEQ ID NO: 28179 - DNA, 25 bp, Homo sapiens
atctgatttctcctggaatcccaat

SEQ ID NO: 28180 - DNA, 25 bp, Homo sapiens
gtccttgaccactagtttgatgcca

SEQ ID NO: 28181 - DNA, 25 bp, Homo sapiens
gatgccatctccattttgggtgacc

SEQ ID NO: 28182 - DNA, 25 bp, Homo sapiens
tgggtgacctgtttcaccagcaggc

SEQ ID NO: 28183 - DNA, 25 bp, Homo sapiens
aagccactcagttgatgctcacact

SEQ ID NO: 28184 - DNA, 25 bp, Homo sapiens
aagtgaactgcctttctttcaatcc

SEQ ID NO: 28185 - DNA, 25 bp, Homo sapiens
gagttcattcttgccacaggatcag

SEQ ID NO: 28186 - DNA, 25 bp, Homo sapiens
gactgttgccttgtgggatctgaga

SEQ ID NO: 28187 - DNA, 25 bp, Homo sapiens
agttgcagacaagatccagctcatc

SEQ ID NO: 28188 - DNA, 25 bp, Homo sapiens
gattggcacttctctgtttgatgaa

SEQ ID NO: 28189 - DNA, 25 bp, Homo sapiens
gcagacaagatccagctcatcaata

SEQ ID NO: 28190 - DNA, 25 bp, Homo sapiens
gggagccaagattgtcaaagaccta

SEQ ID NO: 28191 - DNA, 25 bp, Homo sapiens
gtcaaagacctaatgtccaaagctg

SEQ ID NO: 28192 - DNA, 25 bp, Homo sapiens
gacctaatgtccaaagctgagaaga

SEQ ID NO: 28193 - DNA, 25 bp, Homo sapiens
ggtgtgaagattaccttgcctgttg

SEQ ID NO: 28194 - DNA, 25 bp, Homo sapiens
gaagattaccttgcctgttgacttt

SEQ ID NO: 28195 - DNA, 25 bp, Homo sapiens
aagatccagctcatcaataatatgc

SEQ ID NO: 28196 - DNA, 25 bp, Homo sapiens
ccttgcctgttgactttgtcactgc

SEQ ID NO: 28197 - DNA, 25 bp, Homo sapiens
gctcatcaataatatgctggacaaa

SEQ ID NO: 28198 - DNA, 25 bp, Homo sapiens
cgaccactttgtcaagctcatttcc

SEQ ID NO: 28199 - DNA, 25 bp, Homo sapiens
caacgaatttggccacactcagtcc

SEQ ID NO: 28200 - DNA, 25 bp, Homo sapiens
tcctcacagttgccatgtagacccc

SEQ ID NO: 28201 - DNA, 25 bp, Homo sapiens
cgcaccttgtcatgtaccatcaata

SEQ ID NO: 28202 - DNA, 25 bp, Homo sapiens
ggactcatgaccacagtccatgcca

SEQ ID NO: 28203 - DNA, 25 bp, Homo sapiens
ccctccgggaaactgtggcgtgatg

SEQ ID NO: 28204 - DNA, 25 bp, Homo sapiens
caaggtcatccctgagctgaacggg

SEQ ID NO: 28205 - DNA, 25 bp, Homo sapiens
cactgccaacgtgtcggtggtggac

SEQ ID NO: 28206 - DNA, 25 bp, Homo sapiens
gacctgccgtctagaaaaacctgcc

SEQ ID NO: 28207 - DNA, 25 bp, Homo sapiens
acactgagcaccaggtggtctcctc

SEQ ID NO: 28208 - DNA, 25 bp, Homo sapiens
tctcctctgacttcaacagcgacac

SEQ ID NO: 28209 - DNA, 25 bp, Homo sapiens
tacctcggatcatgggtgggctcta

SEQ ID NO: 28210 - DNA, 25 bp, Homo sapiens
tgggtgggctctaggtgaacatgga

SEQ ID NO: 28211 - DNA, 25 bp, Homo sapiens
gagaatgggccaaatacagcaattt

SEQ ID NO: 28212 - DNA, 25 bp, Homo sapiens
attttgatgttgctacccatgttcc

SEQ ID NO: 28213 - DNA, 25 bp, Homo sapiens
catgttcccctgatattctatgttc

SEQ ID NO: 28214 - DNA, 25 bp, Homo sapiens
atgttcctggaaggacggcttcact

SEQ ID NO: 28215 - DNA, 25 bp, Homo sapiens
tggaaggacggcttcacttccggag

SEQ ID NO: 28216 - DNA, 25 bp, Homo sapiens
ggaggcaggcgagaagcttttccct

SEQ ID NO: 28217 - DNA, 25 bp, Homo sapiens
gattccgcctcacagttgatggagc

SEQ ID NO: 28218 - DNA, 25 bp, Homo sapiens
caggcaggcaatccatggaccttgt

SEQ ID NO: 28219 - DNA, 25 bp, Homo sapiens
ggaccttgtggaacttgtgtctctt

SEQ ID NO: 28220 - DNA, 25 bp, Homo sapiens
aaggaccttcgttaagtgataattg

SEQ ID NO: 28221 - DNA, 25 bp, Homo sapiens
gcctctcagccatgaccgttatgag

SEQ ID NO: 28222 - DNA, 25 bp, Homo sapiens
tatcccccattcgaacttaacagat

SEQ ID NO: 28223 - DNA, 25 bp, Homo sapiens
ttcgaacttaacagatgcctcctct

SEQ ID NO: 28224 - DNA, 25 bp, Homo sapiens
taaaatcgtagcttgtacagatcaa

SEQ ID NO: 28225 - DNA, 25 bp, Homo sapiens
tgggcagaatgaagtatgtttgttt

SEQ ID NO: 28226 - DNA, 25 bp, Homo sapiens
atagagtttgcctcaacacatgtga

SEQ ID NO: 28227 - DNA, 25 bp, Homo sapiens
ttgcctcaacacatgtgagggccaa

SEQ ID NO: 28228 - DNA, 25 bp, Homo sapiens
gagggccaaataacctgctagctag

SEQ ID NO: 28229 - DNA, 25 bp, Homo sapiens
aataacctgctagctaggcagtaat

SEQ ID NO: 28230 - DNA, 25 bp, Homo sapiens
gctaggcagtaataaactctgttac

SEQ ID NO: 28231 - DNA, 25 bp, Homo sapiens
gaaatgcctcctgttcagttcaaac

SEQ ID NO: 28232 - DNA, 25 bp, Homo sapiens
gttagtggagcgtttggtggaatgg

SEQ ID NO: 28233 - DNA, 25 bp, Homo sapiens
gagtcaaacagactgctgtctgccc

SEQ ID NO: 28234 - DNA, 25 bp, Homo sapiens
ctgtctgcccttatacgacacagta

SEQ ID NO: 28235 - DNA, 25 bp, Homo sapiens
ttgtgcagagtggtggcatcaagca

SEQ ID NO: 28236 - DNA, 25 bp, Homo sapiens
gcatcaagcatctagttaccatggc

SEQ ID NO: 28237 - DNA, 25 bp, Homo sapiens
gcagaatgaagctcttgttgctttg

SEQ ID NO: 28238 - DNA, 25 bp, Homo sapiens
gctttagaattgggcactgctgaga

SEQ ID NO: 28239 - DNA, 25 bp, Homo sapiens
tccatggtcctgatatgtgctctta

SEQ ID NO: 28240 - DNA, 25 bp, Homo sapiens
gtgctcttatgggatctgaatgtct

SEQ ID NO: 28241 - DNA, 25 bp, Homo sapiens
agatgtcgtatccaaacttcgcagt

SEQ ID NO: 28242 - DNA, 25 bp, Homo sapiens
attgcagaggctgttggtcttccaa

SEQ ID NO: 28243 - DNA, 25 bp, Homo sapiens
gtgctttctctcctcaaggaatgcc

SEQ ID NO: 28244 - DNA, 25 bp, Homo sapiens
tcttccaagtattcctgttcatcca

SEQ ID NO: 28245 - DNA, 25 bp, Homo sapiens
aatgggtggctcagcaccaccagat

SEQ ID NO: 28246 - DNA, 25 bp, Homo sapiens
gaagtctcaaagtgccctacaatgt

SEQ ID NO: 28247 - DNA, 25 bp, Homo sapiens
caatgttggacctggctttactgga

SEQ ID NO: 28248 - DNA, 25 bp, Homo sapiens
gtcaagatgcacatccactctacca

SEQ ID NO: 28249 - DNA, 25 bp, Homo sapiens
gtcattctgggaggtcaccgggact

SEQ ID NO: 28250 - DNA, 25 bp, Homo sapiens
ccgggactcatgggtgtttggtggt

SEQ ID NO: 28251 - DNA, 25 bp, Homo sapiens
gtttggtggtattgaccctcagagt

SEQ ID NO: 28252 - DNA, 25 bp, Homo sapiens
agtggagcagctgttgttcatgaaa

SEQ ID NO: 28253 - DNA, 25 bp, Homo sapiens
ccagaactgcagccagtccttgctg

SEQ ID NO: 28254 - DNA, 25 bp, Homo sapiens
caccacggtccccaagatgattgtg

SEQ ID NO: 28255 - DNA, 25 bp, Homo sapiens
ggacatccagtctcacagcagagtc

SEQ ID NO: 28256 - DNA, 25 bp, Homo sapiens
cagcagagtcatctcctatgcaggc

SEQ ID NO: 28257 - DNA, 25 bp, Homo sapiens
atgcaggctgcctgactcagatgtc

SEQ ID NO: 28258 - DNA, 25 bp, Homo sapiens
atgtctctctttgccatttttggag

SEQ ID NO: 28259 - DNA, 25 bp, Homo sapiens
gctcctgagtgtgatggcctatgac

SEQ ID NO: 28260 - DNA, 25 bp, Homo sapiens
ccatcatgaacccgtgtttctgtgc

SEQ ID NO: 28261 - DNA, 25 bp, Homo sapiens
ctcccagctgcacaacttgattgcc

SEQ ID NO: 28262 - DNA, 25 bp, Homo sapiens
attgccttacaagtgacctgcttca

SEQ ID NO: 28263 - DNA, 25 bp, Homo sapiens
aattcctaatttcttctgtgaccct

SEQ ID NO: 28264 - DNA, 25 bp, Homo sapiens
ctgtccttccactaagcttggtaga

SEQ ID NO: 28265 - DNA, 25 bp, Homo sapiens
gtttgcacatcatttaattctcgtt

SEQ ID NO: 28266 - DNA, 25 bp, Homo sapiens
catgcacaagtctttacagctgtca

SEQ ID NO: 28267 - DNA, 25 bp, Homo sapiens
tacagctgtcattctagagtttagg

SEQ ID NO: 28268 - DNA, 25 bp, Homo sapiens
tacgtatgtttgttcacctactctt

SEQ ID NO: 28269 - DNA, 25 bp, Homo sapiens
gttcacctactcttatagtcaatgc

SEQ ID NO: 28270 - DNA, 25 bp, Homo sapiens
agtcaatgcgttcatcgtttcagcc

SEQ ID NO: 28271 - DNA, 25 bp, Homo sapiens
aatagtctgtccctttagccagttt

SEQ ID NO: 28272 - DNA, 25 bp, Homo sapiens
gccagttttcatgtctgcacaagac

SEQ ID NO: 28273 - DNA, 25 bp, Homo sapiens
agacctttcaataggcctttcaaat

SEQ ID NO: 28274 - DNA, 25 bp, Homo sapiens
taagggtgaggaccccaactctagc

SEQ ID NO: 28275 - DNA, 25 bp, Homo sapiens
ctcagcctcccgagaagctaggact

SEQ ID NO: 28276 - DNA, 25 bp, Homo sapiens
gctaggactacaggcgtgtgccacc

SEQ ID NO: 28277 - DNA, 25 bp, Homo sapiens
tctcactttgttgtccaggctgaca

SEQ ID NO: 28278 - DNA, 25 bp, Homo sapiens
gtccaggctgacagaactgcatttt

SEQ ID NO: 28279 - DNA, 25 bp, Homo sapiens
gctgacagaactgcatttttaattc

SEQ ID NO: 28280 - DNA, 25 bp, Homo sapiens
tataattctttataggacttcctgg

SEQ ID NO: 28281 - DNA, 25 bp, Homo sapiens
ttctttataggacttcctggtcaat

SEQ ID NO: 28282 - DNA, 25 bp, Homo sapiens
ggacttcctggtcaatacagtaatg

SEQ ID NO: 28283 - DNA, 25 bp, Homo sapiens
taatttaagtggtctcactctgtta

SEQ ID NO: 28284 - DNA, 25 bp, Homo sapiens
gtctcactctgttacccaggatgga

SEQ ID NO: 28285 - DNA, 25 bp, Homo sapiens
gttacccaggatggagtgcagtggt

SEQ ID NO: 28286 - DNA, 25 bp, Homo sapiens
cccacccctcttgagtgtcttgggg

SEQ ID NO: 28287 - DNA, 25 bp, Homo sapiens
tgagtgtcttggggacagctctttc

SEQ ID NO: 28288 - DNA, 25 bp, Homo sapiens
ctctttccacccctggaagatggaa

SEQ ID NO: 28289 - DNA, 25 bp, Homo sapiens
caaggacctggaaacccatgcttcg

SEQ ID NO: 28290 - DNA, 25 bp, Homo sapiens
acccatgcttcgagacaacgtgact

SEQ ID NO: 28291 - DNA, 25 bp, Homo sapiens
tccctgcagcggcatagcattcgta

SEQ ID NO: 28292 - DNA, 25 bp, Homo sapiens
agcattcgtagcaggggcaggcgct

SEQ ID NO: 28293 - DNA, 25 bp, Homo sapiens
gcaggcgctgcatggagggggctgc

SEQ ID NO: 28294 - DNA, 25 bp, Homo sapiens
ctgtgccagggtggcctctgaaatg

SEQ ID NO: 28295 - DNA, 25 bp, Homo sapiens
tctgaaatgtgccagggagccccta

SEQ ID NO: 28296 - DNA, 25 bp, Homo sapiens
ttaatgggagggtgggtgggccgca

SEQ ID NO: 28297 - DNA, 25 bp, Homo sapiens
tctggagaccttgctggcagtgcta

SEQ ID NO: 28298 - DNA, 25 bp, Homo sapiens
cccagcaactcagcagcagaaccaa

SEQ ID NO: 28299 - DNA, 25 bp, Homo sapiens
cagaaccaagatgggccccaggctc

SEQ ID NO: 28300 - DNA, 25 bp, Homo sapiens
tcctccatatggcccagggcttacc

SEQ ID NO: 28301 - DNA, 25 bp, Homo sapiens
agaggctcttgagacctgatgccct

SEQ ID NO: 28302 - DNA, 25 bp, Homo sapiens
cctgtctgctctgctgctacagagg

SEQ ID NO: 28303 - DNA, 25 bp, Homo sapiens
agcccacgcttaggaatgcttgcct

SEQ ID NO: 28304 - DNA, 25 bp, Homo sapiens
caggcaggcagctgtacccaagctg

SEQ ID NO: 28305 - DNA, 25 bp, Homo sapiens
gcagcctgtaaccatcggctgggcc

SEQ ID NO: 28306 - DNA, 25 bp, Homo sapiens
acactcacgccctgtgggtgatggt

SEQ ID NO: 28307 - DNA, 25 bp, Homo sapiens
ggactgtcactgtggacgccaaaat

SEQ ID NO: 28308 - DNA, 25 bp, Homo sapiens
tgtggggcacacattgggtcacgcc

SEQ ID NO: 28309 - DNA, 25 bp, Homo sapiens
ttgggtcacgccattactgggggct

SEQ ID NO: 28310 - DNA, 25 bp, Homo sapiens
ggaagtaatgctgagcctgcgaggc

SEQ ID NO: 28311 - DNA, 25 bp, Homo sapiens
ggcctgacatcacttaccaggagcc

SEQ ID NO: 28312 - DNA, 25 bp, Homo sapiens
gcagccttgcctctatgagatcaaa

SEQ ID NO: 28313 - DNA, 25 bp, Homo sapiens
gagtgtgcccagaaccagggtgaca

SEQ ID NO: 28314 - DNA, 25 bp, Homo sapiens
gggtgacatcaagctctgtgagggt

SEQ ID NO: 28315 - DNA, 25 bp, Homo sapiens
ggtgctgaaacagtgccgacttgca

SEQ ID NO: 28316 - DNA, 25 bp, Homo sapiens
atcagttaaacctctcctgtcattc

SEQ ID NO: 28317 - DNA, 25 bp, Homo sapiens
ttcctagcttccttgcttcagaatt

SEQ ID NO: 28318 - DNA, 25 bp, Homo sapiens
gtttgtgtggcctccttaaactagc

SEQ ID NO: 28319 - DNA, 25 bp, Homo sapiens
agttacctactattctgacatttta

SEQ ID NO: 28320 - DNA, 25 bp, Homo sapiens
cttgtgctggtgttttggatcttat

SEQ ID NO: 28321 - DNA, 25 bp, Homo sapiens
gatgctgagcatgttctgcactggt

SEQ ID NO: 28322 - DNA, 25 bp, Homo sapiens
tttacacacatacgtgctacccaga

SEQ ID NO: 28323 - DNA, 25 bp, Homo sapiens
agacagcaacatacgcactcctaaa

SEQ ID NO: 28324 - DNA, 25 bp, Homo sapiens
aagtatctaactcatttccaaacat

SEQ ID NO: 28325 - DNA, 25 bp, Homo sapiens
taaacctcttgatttccagcaacat

SEQ ID NO: 28326 - DNA, 25 bp, Homo sapiens
aacacctgctactcaaaacacaact

SEQ ID NO: 28327 - DNA, 25 bp, Homo sapiens
atatctggtatgttgcaagctttca

SEQ ID NO: 28328 - DNA, 25 bp, Homo sapiens
ataaatttgcctcctagttcacttt

SEQ ID NO: 28329 - DNA, 25 bp, Homo sapiens
tgaacctaactttctcttattggtg

SEQ ID NO: 28330 - DNA, 25 bp, Homo sapiens
tagaagttcccccaattacaaactg

SEQ ID NO: 28331 - DNA, 25 bp, Homo sapiens
ggacatactggttttaatacctgct

SEQ ID NO: 28332 - DNA, 25 bp, Homo sapiens
aatacctgctttgcatattcacaca

SEQ ID NO: 28333 - DNA, 25 bp, Homo sapiens
atattcacacatggtcaactgggac

SEQ ID NO: 28334 - DNA, 25 bp, Homo sapiens
aaaaatcttttttcacttctcatga

SEQ ID NO: 28335 - DNA, 25 bp, Homo sapiens
ttcacttctcatgatagctgttata

SEQ ID NO: 28336 - DNA, 25 bp, Homo sapiens
gcacatttggtttattaacccttgc

SEQ ID NO: 28337 - DNA, 25 bp, Homo sapiens
ttgctccttgcatggctcattaggt

SEQ ID NO: 28338 - DNA, 25 bp, Homo sapiens
acattttcagctatatttacttttt

SEQ ID NO: 28339 - DNA, 25 bp, Homo sapiens
gcttgagtttcccattttaaaatct

SEQ ID NO: 28340 - DNA, 25 bp, Homo sapiens
gttggtaggcacatcgtgtcaagtg

SEQ ID NO: 28341 - DNA, 25 bp, Homo sapiens
gggaccgctataaggccagtcggac

SEQ ID NO: 28342 - DNA, 25 bp, Homo sapiens
tcgtggccatcttccacaagtactc

SEQ ID NO: 28343 - DNA, 25 bp, Homo sapiens
ttccacaagtactccggcagggagg

SEQ ID NO: 28344 - DNA, 25 bp, Homo sapiens
tccggcagggagggtgacaagcaca

SEQ ID NO: 28345 - DNA, 25 bp, Homo sapiens
ccgctataaggccagtcggactgcg

SEQ ID NO: 28346 - DNA, 25 bp, Homo sapiens
gacaagcacaccctgagcaagaagg

SEQ ID NO: 28347 - DNA, 25 bp, Homo sapiens
gctgatccagaaggagctcaccatt

SEQ ID NO: 28348 - DNA, 25 bp, Homo sapiens
gaaggagctcaccattggctcgaag

SEQ ID NO: 28349 - DNA, 25 bp, Homo sapiens
agctcaccattggctcgaagctgca

SEQ ID NO: 28350 - DNA, 25 bp, Homo sapiens
ctcaccattggctcgaagctgcagg

SEQ ID NO: 28351 - DNA, 25 bp, Homo sapiens
gccagtcggactgcgacatagccca

SEQ ID NO: 28352 - DNA, 25 bp, Homo sapiens
tctgtctggtcttcctctagaaggt

SEQ ID NO: 28353 - DNA, 25 bp, Homo sapiens
ttcctctagaaggttctaccgcaga

SEQ ID NO: 28354 - DNA, 25 bp, Homo sapiens
tgcacatactcactggactgttcca

SEQ ID NO: 28355 - DNA, 25 bp, Homo sapiens
cactgcagctgaagttcattacctg

SEQ ID NO: 28356 - DNA, 25 bp, Homo sapiens
tgaaggacgcctcatcatttcattc

SEQ ID NO: 28357 - DNA, 25 bp, Homo sapiens
gtgtacagtgtgcaacttccaacct

SEQ ID NO: 28358 - DNA, 25 bp, Homo sapiens
gcaacttccaacctttttatctgtt

SEQ ID NO: 28359 - DNA, 25 bp, Homo sapiens
tttagcgtcattccaaaaccacacc

SEQ ID NO: 28360 - DNA, 25 bp, Homo sapiens
ttcctcctttattgtagcactcagc

SEQ ID NO: 28361 - DNA, 25 bp, Homo sapiens
aatctgtacatccctcagaggcagc

SEQ ID NO: 28362 - DNA, 25 bp, Homo sapiens
ggagttggcagtcatcacggtagat

SEQ ID NO: 28363 - DNA, 25 bp, Homo sapiens
gctgcttaagctggcccacaagtac

SEQ ID NO: 28364 - DNA, 25 bp, Homo sapiens
acgtcccaacgaagagaccacctgt

SEQ ID NO: 28365 - DNA, 25 bp, Homo sapiens
accacctgtccttcgagcaggagtt

SEQ ID NO: 28366 - DNA, 25 bp, Homo sapiens
ttaacaccgtcaccaccttggtgga

SEQ ID NO: 28367 - DNA, 25 bp, Homo sapiens
gattgcacacgacgtggatcccatc

SEQ ID NO: 28368 - DNA, 25 bp, Homo sapiens
aaatgggggtcccttactgcattat

SEQ ID NO: 28369 - DNA, 25 bp, Homo sapiens
cactgtcgccttcacacaggtgaac

SEQ ID NO: 28370 - DNA, 25 bp, Homo sapiens
cagatacgatgagatccgccgtcac

SEQ ID NO: 28371 - DNA, 25 bp, Homo sapiens
gccgtcactggggtggcaatgtcct

SEQ ID NO: 28372 - DNA, 25 bp, Homo sapiens
caatgtcctgggtcctaagtctgtg

SEQ ID NO: 28373 - DNA, 25 bp, Homo sapiens
taagtctgtggctcgtatcgccaag

SEQ ID NO: 28374 - DNA, 25 bp, Homo sapiens
gctgccttgcctgtaactcagcaaa

SEQ ID NO: 28375 - DNA, 25 bp, Homo sapiens
acagaggtgtcagagccagttgtca

SEQ ID NO: 28376 - DNA, 25 bp, Homo sapiens
gtgtcagagccagttgtcactcagc

SEQ ID NO: 28377 - DNA, 25 bp, Homo sapiens
gttggtcttacagggtttgactgcc

SEQ ID NO: 28378 - DNA, 25 bp, Homo sapiens
cagggtttgactgccgatgtggaaa

SEQ ID NO: 28379 - DNA, 25 bp, Homo sapiens
tgttttgtggacttcaccgttactc

SEQ ID NO: 28380 - DNA, 25 bp, Homo sapiens
tcaccgttactctgacaagcacaac

SEQ ID NO: 28381 - DNA, 25 bp, Homo sapiens
caagcacaactgtccgtatgattac

SEQ ID NO: 28382 - DNA, 25 bp, Homo sapiens
aactgtccgtatgattacaaagcag

SEQ ID NO: 28383 - DNA, 25 bp, Homo sapiens
gagaatccagttgttgtggctgaaa

SEQ ID NO: 28384 - DNA, 25 bp, Homo sapiens
gaagagactgaaactttgtttttat

SEQ ID NO: 28385 - DNA, 25 bp, Homo sapiens
tctgatcaagttcttgttatttcca

SEQ ID NO: 28386 - DNA, 25 bp, Homo sapiens
tgctgtcacttacatctataactgg

SEQ ID NO: 28387 - DNA, 25 bp, Homo sapiens
catctataactgggcctacggcttt

SEQ ID NO: 28388 - DNA, 25 bp, Homo sapiens
gaagatgaccttctgggcaatgcca

SEQ ID NO: 28389 - DNA, 25 bp, Homo sapiens
ttctacacatctgcctaacttggga

SEQ ID NO: 28390 - DNA, 25 bp, Homo sapiens
atgtgggagaaaatcgctgctgctg

SEQ ID NO: 28391 - DNA, 25 bp, Homo sapiens
tccaggcgactttgaacccattttt

SEQ ID NO: 28392 - DNA, 25 bp, Homo sapiens
gtgtcttttcactaattacctatac

SEQ ID NO: 28393 - DNA, 25 bp, Homo sapiens
acctatactatgccaatatttcctt

SEQ ID NO: 28394 - DNA, 25 bp, Homo sapiens
atttccttatatctatccataacat

SEQ ID NO: 28395 - DNA, 25 bp, Homo sapiens
atgcacgtgaaacttaacactttat

SEQ ID NO: 28396 - DNA, 25 bp, Homo sapiens
ccaccagtgtatcaccagagtcctg

SEQ ID NO: 28397 - DNA, 25 bp, Homo sapiens
agcagtcttactatccacagcagta

SEQ ID NO: 28398 - DNA, 25 bp, Homo sapiens
ataccaaccctgcaataagtgtact

SEQ ID NO: 28399 - DNA, 25 bp, Homo sapiens
agtgtactaaactctacgctctggt

SEQ ID NO: 28400 - DNA, 25 bp, Homo sapiens
aatgtaatgtactctcctggactga

SEQ ID NO: 28401 - DNA, 25 bp, Homo sapiens
gcagtgtataatttctgtctacagc

SEQ ID NO: 28402 - DNA, 25 bp, Homo sapiens
acagctagaagctgtgccccagttc

SEQ ID NO: 28403 - DNA, 25 bp, Homo sapiens
gccccagttccacatttgattacac

SEQ ID NO: 28404 - DNA, 25 bp, Homo sapiens
cacatgtgagatttgctgctgttgc

SEQ ID NO: 28405 - DNA, 25 bp, Homo sapiens
gacatggttgggacatcagatactt

SEQ ID NO: 28406 - DNA, 25 bp, Homo sapiens
ctttctctttggtttattgatttgg

SEQ ID NO: 28407 - DNA, 25 bp, Homo sapiens
ggagtctccaaccttcaggaattcc

SEQ ID NO: 28408 - DNA, 25 bp, Homo sapiens
ctagaaggcgggctgtactgatgac

SEQ ID NO: 28409 - DNA, 25 bp, Homo sapiens
gaggaggaacttcccaagtgctttt

SEQ ID NO: 28410 - DNA, 25 bp, Homo sapiens
gagtctgagttgtctgtttctagaa

SEQ ID NO: 28411 - DNA, 25 bp, Homo sapiens
gggcaataaactttccatttccatt

SEQ ID NO: 28412 - DNA, 25 bp, Homo sapiens
gcatggtcaaacttagccatcccct

SEQ ID NO: 28413 - DNA, 25 bp, Homo sapiens
catgttgagattttaccctctcctc

SEQ ID NO: 28414 - DNA, 25 bp, Homo sapiens
catccttaactttgtatcctggctt

SEQ ID NO: 28415 - DNA, 25 bp, Homo sapiens
gcttataacaggccatccatttttg

SEQ ID NO: 28416 - DNA, 25 bp, Homo sapiens
aattatataccctggtcccatcttt

SEQ ID NO: 28417 - DNA, 25 bp, Homo sapiens
ccatctttctagggcctggatctgc

SEQ ID NO: 28418 - DNA, 25 bp, Homo sapiens
cggtgagctgtgaatgcaccacggc

SEQ ID NO: 28419 - DNA, 25 bp, Homo sapiens
ggacactgacgtaggagggttgctt

SEQ ID NO: 28420 - DNA, 25 bp, Homo sapiens
aaataagttctggttgtcattgaat

SEQ ID NO: 28421 - DNA, 25 bp, Homo sapiens
agagagcttgatgctttctgccttc

SEQ ID NO: 28422 - DNA, 25 bp, Homo sapiens
gatgcattgcacatttgggatattt

SEQ ID NO: 28423 - DNA, 25 bp, Homo sapiens
aagaaattagggcctcctctgatct

SEQ ID NO: 28424 - DNA, 25 bp, Homo sapiens
ttctcaagaccttcaccattactgg

SEQ ID NO: 28425 - DNA, 25 bp, Homo sapiens
ccattactggtgttttcctgtcttc

SEQ ID NO: 28426 - DNA, 25 bp, Homo sapiens
ctgtcttctctttagtatgatccct

SEQ ID NO: 28427 - DNA, 25 bp, Homo sapiens
tatgatccctcaaaacctcactaac

SEQ ID NO: 28428 - DNA, 25 bp, Homo sapiens
ctaactggaaggatgattttgtctc

SEQ ID NO: 28429 - DNA, 25 bp, Homo sapiens
tggaggagatcgagggcttccgcta

SEQ ID NO: 28430 - DNA, 25 bp, Homo sapiens
gctatcgctgcagggatgccatgcg

SEQ ID NO: 28431 - DNA, 25 bp, Homo sapiens
atgccatgcgctcagtgactaagca

SEQ ID NO: 28432 - DNA, 25 bp, Homo sapiens
gtgactaagcaggccattcgggagg

SEQ ID NO: 28433 - DNA, 25 bp, Homo sapiens
ttgaagacaaccctagggacctcca

SEQ ID NO: 28434 - DNA, 25 bp, Homo sapiens
ctttgcaccccgcagtggtgaagcc

SEQ ID NO: 28435 - DNA, 25 bp, Homo sapiens
ctggtacgccctcacaagaagcgga

SEQ ID NO: 28436 - DNA, 25 bp, Homo sapiens
aagaagctgtcttcctcttgtagga

SEQ ID NO: 28437 - DNA, 25 bp, Homo sapiens
gaaagaaattcagacccacagccaa

SEQ ID NO: 28438 - DNA, 25 bp, Homo sapiens
attgtggagcacaggcttacaccct

SEQ ID NO: 28439 - DNA, 25 bp, Homo sapiens
tccttggcacttccaagctggcatc

SEQ ID NO: 28440 - DNA, 25 bp, Homo sapiens
acaaccaccaccttcaagggagtcg

SEQ ID NO: 28441 - DNA, 25 bp, Homo sapiens
gaccccaacagcaggaatagctccc

SEQ ID NO: 28442 - DNA, 25 bp, Homo sapiens
ggaatagctcccgagttttgcggcc

SEQ ID NO: 28443 - DNA, 25 bp, Homo sapiens
gtggtggatccaatttttcattagg

SEQ ID NO: 28444 - DNA, 25 bp, Homo sapiens
ggcctctaatatctttgggacacct

SEQ ID NO: 28445 - DNA, 25 bp, Homo sapiens
gggccaagtcagcaggtgccaagtc

SEQ ID NO: 28446 - DNA, 25 bp, Homo sapiens
gacttggagtcatctggactgcaga

SEQ ID NO: 28447 - DNA, 25 bp, Homo sapiens
gaaggaactcctctgaagcaagctc

SEQ ID NO: 28448 - DNA, 25 bp, Homo sapiens
gcaagctccggagacttcttagatc

SEQ ID NO: 28449 - DNA, 25 bp, Homo sapiens
agagtgaagagaagcccgtgcctgc

SEQ ID NO: 28450 - DNA, 25 bp, Homo sapiens
catccagaagaaatccccctggcgg

SEQ ID NO: 28451 - DNA, 25 bp, Homo sapiens
cctccagacctccttgaaatacaat

SEQ ID NO: 28452 - DNA, 25 bp, Homo sapiens
agttcccctttgctttaggagtgca

SEQ ID NO: 28453 - DNA, 25 bp, Homo sapiens
actctgcctcaaacttgtgatgaac

SEQ ID NO: 28454 - DNA, 25 bp, Homo sapiens
tgtgatgaacccaaagcccacacca

SEQ ID NO: 28455 - DNA, 25 bp, Homo sapiens
ttcattcccctgaagccaacagtga

SEQ ID NO: 28456 - DNA, 25 bp, Homo sapiens
gatctaaccatgtgagccggacaga

SEQ ID NO: 28457 - DNA, 25 bp, Homo sapiens
agaagtcagcagcaaccatgtcttg

SEQ ID NO: 28458 - DNA, 25 bp, Homo sapiens
tcagacactgagcttgttcttcacg

SEQ ID NO: 28459 - DNA, 25 bp, Homo sapiens
tcttcacggttctgcaagatgtccc

SEQ ID NO: 28460 - DNA, 25 bp, Homo sapiens
gacggatgagtttgcaatcgctgag

SEQ ID NO: 28461 - DNA, 25 bp, Homo sapiens
atcgctgagtacaatgctccttgca

SEQ ID NO: 28462 - DNA, 25 bp, Homo sapiens
actgccttaatcttatactcatggc

SEQ ID NO: 28463 - DNA, 25 bp, Homo sapiens
tggcttggagttaccttatattcag

SEQ ID NO: 28464 - DNA, 25 bp, Homo sapiens
tatgtgatattttgcctggtttgtt

SEQ ID NO: 28465 - DNA, 25 bp, Homo sapiens
aaattgccccatttagattccttct

SEQ ID NO: 28466 - DNA, 25 bp, Homo sapiens
agtgtgagatctctggattctttca

SEQ ID NO: 28467 - DNA, 25 bp, Homo sapiens
aattttctactcaacaattccgaga

SEQ ID NO: 28468 - DNA, 25 bp, Homo sapiens
gattatgcctagtttgtcatatcac

SEQ ID NO: 28469 - DNA, 25 bp, Homo sapiens
catgttttggaagggcaggtcgttt

SEQ ID NO: 28470 - DNA, 25 bp, Homo sapiens
ttaatcacctccacactgtacagag

SEQ ID NO: 28471 - DNA, 25 bp, Homo sapiens
cccaccggtggtgtgatgatgccat

SEQ ID NO: 28472 - DNA, 25 bp, Homo sapiens
gatgccatataccgcagggcttgct

SEQ ID NO: 28473 - DNA, 25 bp, Homo sapiens
ctattaccattctaactttcataaa

SEQ ID NO: 28474 - DNA, 25 bp, Homo sapiens
atttcctgccagggcttatattagg

SEQ ID NO: 28475 - DNA, 25 bp, Homo sapiens
aggacattaggattggtgctcagaa

SEQ ID NO: 28476 - DNA, 25 bp, Homo sapiens
gaaatggttaatcatgctgtgtgct

SEQ ID NO: 28477 - DNA, 25 bp, Homo sapiens
agacctggcacttcagtaactcagc

SEQ ID NO: 28478 - DNA, 25 bp, Homo sapiens
gcttccacttcactcaacttaagag

SEQ ID NO: 28479 - DNA, 25 bp, Homo sapiens
gcttcaagagttccacttggctctc

SEQ ID NO: 28480 - DNA, 25 bp, Homo sapiens
tggctctcccaaataggtacctcaa

SEQ ID NO: 28481 - DNA, 25 bp, Homo sapiens
aactgttagcaagcggcatttggat

SEQ ID NO: 28482 - DNA, 25 bp, Homo sapiens
ttggatgtcttgacaggggctttgc

SEQ ID NO: 28483 - DNA, 25 bp, Homo sapiens
ggcatgattgtgcttgcaggccaag

SEQ ID NO: 28484 - DNA, 25 bp, Homo sapiens
aacattgtaatggccatcgctggaa

SEQ ID NO: 28485 - DNA, 25 bp, Homo sapiens
gaaacaagtgcgacctctcagatat

SEQ ID NO: 28486 - DNA, 25 bp, Homo sapiens
ggaggttcccctgaaggatgctaag

SEQ ID NO: 28487 - DNA, 25 bp, Homo sapiens
tacgctgaatccataggtgccatcg

SEQ ID NO: 28488 - DNA, 25 bp, Homo sapiens
gtgccatcgtggttgagacaagtgc

SEQ ID NO: 28489 - DNA, 25 bp, Homo sapiens
ttcaaggaatcagccgccagatccc

SEQ ID NO: 28490 - DNA, 25 bp, Homo sapiens
tgagaagccaaccatgcaagccagc

SEQ ID NO: 28491 - DNA, 25 bp, Homo sapiens
cgtggtccacggtacttgaagaagc

SEQ ID NO: 28492 - DNA, 25 bp, Homo sapiens
atcctgtgcactgctgaaggaccct

SEQ ID NO: 28493 - DNA, 25 bp, Homo sapiens
gagtgagcacactggctttgcatcc

SEQ ID NO: 28494 - DNA, 25 bp, Homo sapiens
accaccacaaaatggcctttagtgt

SEQ ID NO: 28495 - DNA, 25 bp, Homo sapiens
gaatatgacgttaccttgcagacta

SEQ ID NO: 28496 - DNA, 25 bp, Homo sapiens
ttttttgtgtgggctccagttctca

SEQ ID NO: 28497 - DNA, 25 bp, Homo sapiens
gttctgcaatgctcatggcaagttg

SEQ ID NO: 28498 - DNA, 25 bp, Homo sapiens
accgactgggtatctagcttactgt

SEQ ID NO: 28499 - DNA, 25 bp, Homo sapiens
atcattgttgaaaccagaccctgta

SEQ ID NO: 28500 - DNA, 25 bp, Homo sapiens
agaccctgtagtccagtggtgctgc

SEQ ID NO: 28501 - DNA, 25 bp, Homo sapiens
taaagagcttccatctgggctggac

SEQ ID NO: 28502 - DNA, 25 bp, Homo sapiens
tggacccagttcttgcacatacaag

SEQ ID NO: 28503 - DNA, 25 bp, Homo sapiens
gcacatacaagacaccgctgcagtc

SEQ ID NO: 28504 - DNA, 25 bp, Homo sapiens
accgctgcagtcagctaggaccttt

SEQ ID NO: 28505 - DNA, 25 bp, Homo sapiens
ggtttaacacacactgattcatact

SEQ ID NO: 28506 - DNA, 25 bp, Homo sapiens
ggtgcagctgggcttcattagtgag

SEQ ID NO: 28507 - DNA, 25 bp, Homo sapiens
gggcttcattagtgaggctgaccag

SEQ ID NO: 28508 - DNA, 25 bp, Homo sapiens
gaggctgaccagagccggttgactt

SEQ ID NO: 28509 - DNA, 25 bp, Homo sapiens
gccggttgacttctctgctagaaga

SEQ ID NO: 28510 - DNA, 25 bp, Homo sapiens
tgaacaagttcaattttgccaggaa

SEQ ID NO: 28511 - DNA, 25 bp, Homo sapiens
tgccaggaacagtaccctcaactca

SEQ ID NO: 28512 - DNA, 25 bp, Homo sapiens
cccccagtcagtattaccctgtgaa

SEQ ID NO: 28513 - DNA, 25 bp, Homo sapiens
cttgttttgcacagacgtgggcctg

SEQ ID NO: 28514 - DNA, 25 bp, Homo sapiens
ctagttgggggctagtcgctgatct

SEQ ID NO: 28515 - DNA, 25 bp, Homo sapiens
ggcactaggggagccgaattctaca

SEQ ID NO: 28516 - DNA, 25 bp, Homo sapiens
tggccctggggggccattcgattcg

SEQ ID NO: 28517 - DNA, 25 bp, Homo sapiens
attgcctggtgatcaagactctcct

SEQ ID NO: 28518 - DNA, 25 bp, Homo sapiens
gtcatcccacatgaactcctgatgt

SEQ ID NO: 28519 - DNA, 25 bp, Homo sapiens
ttagaggttgaagcccaccttctct

SEQ ID NO: 28520 - DNA, 25 bp, Homo sapiens
tcctcacggtcacagaactagtttt

SEQ ID NO: 28521 - DNA, 25 bp, Homo sapiens
gaactagttttttaatcctcaggca

SEQ ID NO: 28522 - DNA, 25 bp, Homo sapiens
ttttaatcctcaggcagtgcatccc

SEQ ID NO: 28523 - DNA, 25 bp, Homo sapiens
ctctttccccacagtgcaattcaga

SEQ ID NO: 28524 - DNA, 25 bp, Homo sapiens
atgccagccaccttgtaaaactgct

SEQ ID NO: 28525 - DNA, 25 bp, Homo sapiens
gaaaagcatgattcccacaaggact

SEQ ID NO: 28526 - DNA, 25 bp, Homo sapiens
gtattatctgctttgctgatgtaga

SEQ ID NO: 28527 - DNA, 25 bp, Homo sapiens
gagttaactgagtagcatgctttat

SEQ ID NO: 28528 - DNA, 25 bp, Homo sapiens
cagcatgccctacaacgtgatctgc

SEQ ID NO: 28529 - DNA, 25 bp, Homo sapiens
acaacgtgatctgcctcacgtgcac

SEQ ID NO: 28530 - DNA, 25 bp, Homo sapiens
actgtggtggccgtgtgctacggct

SEQ ID NO: 28531 - DNA, 25 bp, Homo sapiens
tggccaagcggctggccaaccttat

SEQ ID NO: 28532 - DNA, 25 bp, Homo sapiens
ctctcctcagagttggcttttgaac

SEQ ID NO: 28533 - DNA, 25 bp, Homo sapiens
ggcttttgaaccaaagtgccctgga

SEQ ID NO: 28534 - DNA, 25 bp, Homo sapiens
tccagtacaggagccacgagccaaa

SEQ ID NO: 28535 - DNA, 25 bp, Homo sapiens
cctgtagtggccacctctatattga

SEQ ID NO: 28536 - DNA, 25 bp, Homo sapiens
aaaagtggtcggtggctgctgtatt

SEQ ID NO: 28537 - DNA, 25 bp, Homo sapiens
agaaaggtcggctggcagcactggc

SEQ ID NO: 28538 - DNA, 25 bp, Homo sapiens
ggtgatggggtgtgctacacagtgt

SEQ ID NO: 28539 - DNA, 25 bp, Homo sapiens
aaataggctcttaccacttgcaaat

SEQ ID NO: 28540 - DNA, 25 bp, Homo sapiens
acttgcaaataactggccacatcat

SEQ ID NO: 28541 - DNA, 25 bp, Homo sapiens
tgacttcccagtaaggctctctaag

SEQ ID NO: 28542 - DNA, 25 bp, Homo sapiens
ggatttgagatgctaaggccccaga

SEQ ID NO: 28543 - DNA, 25 bp, Homo sapiens
taaggccccagagatcgtttgatcc

SEQ ID NO: 28544 - DNA, 25 bp, Homo sapiens
ttgatccaaccctcttattttcaga

SEQ ID NO: 28545 - DNA, 25 bp, Homo sapiens
tggggcctagaagttacagagcatc

SEQ ID NO: 28546 - DNA, 25 bp, Homo sapiens
acagagcatctagctggtgcgctgg

SEQ ID NO: 28547 - DNA, 25 bp, Homo sapiens
cacagtcactgaagcaggccctgtt

SEQ ID NO: 28548 - DNA, 25 bp, Homo sapiens
ggccctgtttgcaattcacgttgcc

SEQ ID NO: 28549 - DNA, 25 bp, Homo sapiens
gtactttcatactcttctaagtcct

SEQ ID NO: 28550 - DNA, 25 bp, Homo sapiens
atacagtgtggcgcgcttttttaat

SEQ ID NO: 28551 - DNA, 25 bp, Homo sapiens
gcattctaggatttttcgcgggtct

SEQ ID NO: 28552 - DNA, 25 bp, Homo sapiens
tgtggctgtgtaactcactggccta

SEQ ID NO: 28553 - DNA, 25 bp, Homo sapiens
cctcgtcaatacctatgcactggac

SEQ ID NO: 28554 - DNA, 25 bp, Homo sapiens
gcactggacagtggggtttctacca

SEQ ID NO: 28555 - DNA, 25 bp, Homo sapiens
gagttattctcaagctgtcacagga

SEQ ID NO: 28556 - DNA, 25 bp, Homo sapiens
ttgcgagtatgttgacctatccctt

SEQ ID NO: 28557 - DNA, 25 bp, Homo sapiens
gcttgtctccaatcttatggctgtc

SEQ ID NO: 28558 - DNA, 25 bp, Homo sapiens
aactgtggtcttgctggtggatgcc

SEQ ID NO: 28559 - DNA, 25 bp, Homo sapiens
ctccttactccccaatatatacgtc

SEQ ID NO: 28560 - DNA, 25 bp, Homo sapiens
gtggggcagggacagtgacatttct

SEQ ID NO: 28561 - DNA, 25 bp, Homo sapiens
cttcttgccagtttgagcctaatct

SEQ ID NO: 28562 - DNA, 25 bp, Homo sapiens
gagcctaatctgattcttacagttt

SEQ ID NO: 28563 - DNA, 25 bp, Homo sapiens
cagttttaccttcttgaaccaatgt

SEQ ID NO: 28564 - DNA, 25 bp, Homo sapiens
ctcagtgaggctatcttccttttcc

SEQ ID NO: 28565 - DNA, 25 bp, Homo sapiens
ttccccagtaacattcctgaattta

SEQ ID NO: 28566 - DNA, 25 bp, Homo sapiens
gcatgacatggattcctgatatctg

SEQ ID NO: 28567 - DNA, 25 bp, Homo sapiens
atgacaccaaaaggctcagcccacc

SEQ ID NO: 28568 - DNA, 25 bp, Homo sapiens
caaccctatctcatgttcagtctgt

SEQ ID NO: 28569 - DNA, 25 bp, Homo sapiens
gttcagtctgtctaatacatgccag

SEQ ID NO: 28570 - DNA, 25 bp, Homo sapiens
aaagtgctttatccctacaatgtac

SEQ ID NO: 28571 - DNA, 25 bp, Homo sapiens
gaggatttggttcttttcagctaat

SEQ ID NO: 28572 - DNA, 25 bp, Homo sapiens
tggaggggctgatcagtgcccgtgt

SEQ ID NO: 28573 - DNA, 25 bp, Homo sapiens
tgcccgtgtggactcacacagcaag

SEQ ID NO: 28574 - DNA, 25 bp, Homo sapiens
ctatacgcccgggacgtggatcagc

SEQ ID NO: 28575 - DNA, 25 bp, Homo sapiens
cgcagcaccacctttgagaagtctc

SEQ ID NO: 28576 - DNA, 25 bp, Homo sapiens
tgagaagtctctgttgatgggcaag

SEQ ID NO: 28577 - DNA, 25 bp, Homo sapiens
tgttgatgggcaaggagttccagcg

SEQ ID NO: 28578 - DNA, 25 bp, Homo sapiens
ccgcgccaaggccatgatgctgcgg

SEQ ID NO: 28579 - DNA, 25 bp, Homo sapiens
caaggccatgatgctgcgggcagct

SEQ ID NO: 28580 - DNA, 25 bp, Homo sapiens
ccccgcccagagaagggagccaggg

SEQ ID NO: 28581 - DNA, 25 bp, Homo sapiens
aacatgtgaggggtgaaccttggcc

SEQ ID NO: 28582 - DNA, 25 bp, Homo sapiens
tggaaggagaggcctgcagggctcg

SEQ ID NO: 28583 - DNA, 25 bp, Homo sapiens
gaccagagtctcagtggtcctgacc

SEQ ID NO: 28584 - DNA, 25 bp, Homo sapiens
ggggtctgctgtgggttcagaggac

SEQ ID NO: 28585 - DNA, 25 bp, Homo sapiens
gcccattttctctgggtactgctgg

SEQ ID NO: 28586 - DNA, 25 bp, Homo sapiens
tggccagaggactttagcctacccc

SEQ ID NO: 28587 - DNA, 25 bp, Homo sapiens
atgtcattttcctactgccatagat

SEQ ID NO: 28588 - DNA, 25 bp, Homo sapiens
tttcctactgccatagataccctaa

SEQ ID NO: 28589 - DNA, 25 bp, Homo sapiens
cactggtgccggagacggagtggag

SEQ ID NO: 28590 - DNA, 25 bp, Homo sapiens
ctggatccgagggatgctacctctc

SEQ ID NO: 28591 - DNA, 25 bp, Homo sapiens
ttcccacttgaggaccctggggaga

SEQ ID NO: 28592 - DNA, 25 bp, Homo sapiens
tggcttgactcaggccctgtgagat

SEQ ID NO: 28593 - DNA, 25 bp, Homo sapiens
cctgtgagatagagggcccagccca

SEQ ID NO: 28594 - DNA, 25 bp, Homo sapiens
ctttttccagagatccagcgttcag

SEQ ID NO: 28595 - DNA, 25 bp, Homo sapiens
gtggagcgctcatcgaaaggcacta

SEQ ID NO: 28596 - DNA, 25 bp, Homo sapiens
caagactatctgtgccacgtctacg

SEQ ID NO: 28597 - DNA, 25 bp, Homo sapiens
tgctgacaatgaatacccatcccgg

SEQ ID NO: 28598 - DNA, 25 bp, Homo sapiens
atagactggccagtaggatcccctg

SEQ ID NO: 28599 - DNA, 25 bp, Homo sapiens
cacgagaagctgatcccatgactaa

SEQ ID NO: 28600 - DNA, 25 bp, Homo sapiens
tctgcacaacaccatggagtctctg

SEQ ID NO: 28601 - DNA, 25 bp, Homo sapiens
cttggtgtccaaatccgaggtgctg

SEQ ID NO: 28602 - DNA, 25 bp, Homo sapiens
aacaaaactcatgctgtgccatcat

SEQ ID NO: 28603 - DNA, 25 bp, Homo sapiens
gaggcccaatgctggaatggcacca

SEQ ID NO: 28604 - DNA, 25 bp, Homo sapiens
atggcaccatcattcacatcagaac

SEQ ID NO: 28605 - DNA, 25 bp, Homo sapiens
tgtggtacggctgcacaacttccac

SEQ ID NO: 28606 - DNA, 25 bp, Homo sapiens
agccatcccaacagagatcctatga

SEQ ID NO: 28607 - DNA, 25 bp, Homo sapiens
acaaccgctattgcaccttggaatt

SEQ ID NO: 28608 - DNA, 25 bp, Homo sapiens
actacatggctttgcggtctacttt

SEQ ID NO: 28609 - DNA, 25 bp, Homo sapiens
gacatcactctgagtatccgtccag

SEQ ID NO: 28610 - DNA, 25 bp, Homo sapiens
cactctcctgggatgttctcatggt

SEQ ID NO: 28611 - DNA, 25 bp, Homo sapiens
tcttccctattaagcagcccataac

SEQ ID NO: 28612 - DNA, 25 bp, Homo sapiens
gccaaaccatctgtgtgcgtttctg

SEQ ID NO: 28613 - DNA, 25 bp, Homo sapiens
gcgtttctggcgatgcagcaattcc

SEQ ID NO: 28614 - DNA, 25 bp, Homo sapiens
agtctgttctgctattcataacccc

SEQ ID NO: 28615 - DNA, 25 bp, Homo sapiens
gctcatataccattggcctctagcc

SEQ ID NO: 28616 - DNA, 25 bp, Homo sapiens
cactcgcttttctgatggttaccgc

SEQ ID NO: 28617 - DNA, 25 bp, Homo sapiens
tcagtacatcgagaatccacgcccg

SEQ ID NO: 28618 - DNA, 25 bp, Homo sapiens
ggacttgagggactgcttactacta

SEQ ID NO: 28619 - DNA, 25 bp, Homo sapiens
gctgcgagggaaggaccacgtggtc

SEQ ID NO: 28620 - DNA, 25 bp, Homo sapiens
aacctccctattcctcagagaaaca

SEQ ID NO: 28621 - DNA, 25 bp, Homo sapiens
tcctggtagggtctgcctgttggaa

SEQ ID NO: 28622 - DNA, 25 bp, Homo sapiens
aaagtgtacctggatgcttctgggc

SEQ ID NO: 28623 - DNA, 25 bp, Homo sapiens
ttctgggctccgtttggcaatagca

SEQ ID NO: 28624 - DNA, 25 bp, Homo sapiens
ttggctgatgtgcacagtctggctc

SEQ ID NO: 28625 - DNA, 25 bp, Homo sapiens
gttgctaccgatagggactttgcca

SEQ ID NO: 28626 - DNA, 25 bp, Homo sapiens
aggcgaggaaaacccatggctgctt

SEQ ID NO: 28627 - DNA, 25 bp, Homo sapiens
ccttgtgcatttaatacctctgggc

SEQ ID NO: 28628 - DNA, 25 bp, Homo sapiens
gaatccaaatactgggttctcccgt

SEQ ID NO: 28629 - DNA, 25 bp, Homo sapiens
gggtgtaggacacattagccttctg

SEQ ID NO: 28630 - DNA, 25 bp, Homo sapiens
aagtagaagccatcacctggcccat

SEQ ID NO: 28631 - DNA, 25 bp, Homo sapiens
atgtccctacaaacccatgattgtc

SEQ ID NO: 28632 - DNA, 25 bp, Homo sapiens
ggtgattcagctacttgaggtcggt

SEQ ID NO: 28633 - DNA, 25 bp, Homo sapiens
ggtcggtaacagaccttccattcct

SEQ ID NO: 28634 - DNA, 25 bp, Homo sapiens
ccctgttactccactggtagtcatc

SEQ ID NO: 28635 - DNA, 25 bp, Homo sapiens
tgcacctcctttttttagtcgagat

SEQ ID NO: 28636 - DNA, 25 bp, Homo sapiens
tccctaatggccgctggggggtgag

SEQ ID NO: 28637 - DNA, 25 bp, Homo sapiens
gtgagggcggtgtgttgtatgtctt

SEQ ID NO: 28638 - DNA, 25 bp, Homo sapiens
gaaagcacttgctttcatcctctgg

SEQ ID NO: 28639 - DNA, 25 bp, Homo sapiens
ttcatcctctggcatcggaaactcc

SEQ ID NO: 28640 - DNA, 25 bp, Homo sapiens
aaactcccctatgcacttgaagatg

SEQ ID NO: 28641 - DNA, 25 bp, Homo sapiens
ccccgtcaaccacaatcaagaactg

SEQ ID NO: 28642 - DNA, 25 bp, Homo sapiens
tgaggctggttgtacaatgcccacg

SEQ ID NO: 28643 - DNA, 25 bp, Homo sapiens
acctgggagtgctttcgatgtgggc

SEQ ID NO: 28644 - DNA, 25 bp, Homo sapiens
cttcctagggctgcttctgagtggt

SEQ ID NO: 28645 - DNA, 25 bp, Homo sapiens
gtggttctttcacgtgttgtgtcca

SEQ ID NO: 28646 - DNA, 25 bp, Homo sapiens
gttgtgtccatagctttagtcttcc

SEQ ID NO: 28647 - DNA, 25 bp, Homo sapiens
cacccacacctaagtcacagaattt

SEQ ID NO: 28648 - DNA, 25 bp, Homo sapiens
actactctcacacccttttaaagat

SEQ ID NO: 28649 - DNA, 25 bp, Homo sapiens
aagaatcagagctgctccttcctgt

SEQ ID NO: 28650 - DNA, 25 bp, Homo sapiens
gaatcctaggtggccctatgtcttc

SEQ ID NO: 28651 - DNA, 25 bp, Homo sapiens
ttatatgtcagttgctgcccttcac

SEQ ID NO: 28652 - DNA, 25 bp, Homo sapiens
ccctgcagccacagtgttctgttgg

SEQ ID NO: 28653 - DNA, 25 bp, Homo sapiens
gtagagcgtgaaatccagacctgtt

SEQ ID NO: 28654 - DNA, 25 bp, Homo sapiens
aagtgactgggacgatgcttcctct

SEQ ID NO: 28655 - DNA, 25 bp, Homo sapiens
cttcctctcatccaaaacacatgca

SEQ ID NO: 28656 - DNA, 25 bp, Homo sapiens
acatgcagagtcacatcctcatcct

SEQ ID NO: 28657 - DNA, 25 bp, Homo sapiens
acatcctcatcctagtgtttggcag

SEQ ID NO: 28658 - DNA, 25 bp, Homo sapiens
tgtttggcagtttgagaccgctacc

SEQ ID NO: 28659 - DNA, 25 bp, Homo sapiens
gaccgctaccctgaacttaagagct

SEQ ID NO: 28660 - DNA, 25 bp, Homo sapiens
ccatatttgctgttcaagttaatct

SEQ ID NO: 28661 - DNA, 25 bp, Homo sapiens
aattctgtatgaacacctggaagca

SEQ ID NO: 28662 - DNA, 25 bp, Homo sapiens
tagcctgtattcacaattctgcggt

SEQ ID NO: 28663 - DNA, 25 bp, Homo sapiens
tattcacaattctgcggtaccttat

SEQ ID NO: 28664 - DNA, 25 bp, Homo sapiens
tctgcggtaccttattgtacctaag

SEQ ID NO: 28665 - DNA, 25 bp, Homo sapiens
gtaattcttgacactctttctataa

SEQ ID NO: 28666 - DNA, 25 bp, Homo sapiens
ttctataattagcgttcttcacccc

SEQ ID NO: 28667 - DNA, 25 bp, Homo sapiens
ggagaggattaggtacttaggagca

SEQ ID NO: 28668 - DNA, 25 bp, Homo sapiens
gagatgatccctaacatactgtact

SEQ ID NO: 28669 - DNA, 25 bp, Homo sapiens
actacttgcttttacaatgtgttag

SEQ ID NO: 28670 - DNA, 25 bp, Homo sapiens
gtggtaattcatcttggtttgctat

SEQ ID NO: 28671 - DNA, 25 bp, Homo sapiens
gcttgtgaccagtaccaatcttgag

SEQ ID NO: 28672 - DNA, 25 bp, Homo sapiens
gaccagtaccaatcttgagtttctt

SEQ ID NO: 28673 - DNA, 25 bp, Homo sapiens
ttatctactcacacattcttgggga

SEQ ID NO: 28674 - DNA, 25 bp, Homo sapiens
aaatgtcagtcctagcagatgttgc

SEQ ID NO: 28675 - DNA, 25 bp, Homo sapiens
attgtcagactataaacctttgctt

SEQ ID NO: 28676 - DNA, 25 bp, Homo sapiens
tatttttactatttctttatcactt

SEQ ID NO: 28677 - DNA, 25 bp, Homo sapiens
atcactttattgtatcatcaccatt

SEQ ID NO: 28678 - DNA, 25 bp, Homo sapiens
gtatcatcaccattggtttcataat

SEQ ID NO: 28679 - DNA, 25 bp, Homo sapiens
aattttttattaccatagtccatgt

SEQ ID NO: 28680 - DNA, 25 bp, Homo sapiens
aatagtggggctttcaggtgtttag

SEQ ID NO: 28681 - DNA, 25 bp, Homo sapiens
aagggattccctaatatgtatacta

SEQ ID NO: 28682 - DNA, 25 bp, Homo sapiens
aatcggacgctgctaccgtcaatga

SEQ ID NO: 28683 - DNA, 25 bp, Homo sapiens
tacatcctggaatcgcgagctagca

SEQ ID NO: 28684 - DNA, 25 bp, Homo sapiens
aaaactgaacagacgtacgagcttc

SEQ ID NO: 28685 - DNA, 25 bp, Homo sapiens
aagaaatccgggcagcagtgacact

SEQ ID NO: 28686 - DNA, 25 bp, Homo sapiens
caatctgttccgtagctcagagcct

SEQ ID NO: 28687 - DNA, 25 bp, Homo sapiens
ctaggagggagcgctggggacattg

SEQ ID NO: 28688 - DNA, 25 bp, Homo sapiens
ggggacattgccatgggacggaagt

SEQ ID NO: 28689 - DNA, 25 bp, Homo sapiens
atgggacggaagtctgcttggcagt

SEQ ID NO: 28690 - DNA, 25 bp, Homo sapiens
aagcgatgcttgggggtcagaccac

SEQ ID NO: 28691 - DNA, 25 bp, Homo sapiens
caccctgcccgaggatgtacagagc

SEQ ID NO: 28692 - DNA, 25 bp, Homo sapiens
ccacacatttccttgcaacttgatc

SEQ ID NO: 28693 - DNA, 25 bp, Homo sapiens
gcacaatacctaggttaccacacac

SEQ ID NO: 28694 - DNA, 25 bp, Homo sapiens
taccacacaccactttttgattggg

SEQ ID NO: 28695 - DNA, 25 bp, Homo sapiens
cttggcttctgttttcgcaaaggaa

SEQ ID NO: 28696 - DNA, 25 bp, Homo sapiens
ataggataggcttcccttgtgcaga

SEQ ID NO: 28697 - DNA, 25 bp, Homo sapiens
atggagccctgaggcatcagctatt

SEQ ID NO: 28698 - DNA, 25 bp, Homo sapiens
attatacttgggactctacctctca

SEQ ID NO: 28699 - DNA, 25 bp, Homo sapiens
tacctctcactcactatatgctaac

SEQ ID NO: 28700 - DNA, 25 bp, Homo sapiens
ttcaggtactgtgtggtgaccgccc

SEQ ID NO: 28701 - DNA, 25 bp, Homo sapiens
cccactggtgtctattacaggccac

SEQ ID NO: 28702 - DNA, 25 bp, Homo sapiens
caggccactttggtagttgtgtatc

SEQ ID NO: 28703 - DNA, 25 bp, Homo sapiens
gttgtgtatctgctcatgtatgtga

SEQ ID NO: 28704 - DNA, 25 bp, Homo sapiens
gaaccagtgtatgtcaacaggtgca

SEQ ID NO: 28705 - DNA, 25 bp, Homo sapiens
gatgtacctgtgtggtctaagctgg

SEQ ID NO: 28706 - DNA, 25 bp, Homo sapiens
aagctggaatctggtcaccttccat

SEQ ID NO: 28707 - DNA, 25 bp, Homo sapiens
ccttccatccatgcaacaacttgtt

SEQ ID NO: 28708 - DNA, 25 bp, Homo sapiens
tatggattcaatcccacaccatcga

SEQ ID NO: 28709 - DNA, 25 bp, Homo sapiens
tcgatcatagcaccacctatcagca

SEQ ID NO: 28710 - DNA, 25 bp, Homo sapiens
atcagcactgaaaactcttttgcat

SEQ ID NO: 28711 - DNA, 25 bp, Homo sapiens
gcagcgtgactgacattatgaaggc

SEQ ID NO: 28712 - DNA, 25 bp, Homo sapiens
gaccagatgctttcttggcaggctc

SEQ ID NO: 28713 - DNA, 25 bp, Homo sapiens
caggctcgttgtacctcttggaaaa

SEQ ID NO: 28714 - DNA, 25 bp, Homo sapiens
caagatagtgtttcagtgctggcat

SEQ ID NO: 28715 - DNA, 25 bp, Homo sapiens
ttttggctttggttgtgatttcaga

SEQ ID NO: 28716 - DNA, 25 bp, Homo sapiens
gtaagtgcatacagttttctctaat

SEQ ID NO: 28717 - DNA, 25 bp, Homo sapiens
gagttgtgaaggttttgggcatcca

SEQ ID NO: 28718 - DNA, 25 bp, Homo sapiens
tgggcatccaccccagaaagtggga

SEQ ID NO: 28719 - DNA, 25 bp, Homo sapiens
ttgattttatccttccgaactggaa

SEQ ID NO: 28720 - DNA, 25 bp, Homo sapiens
acagtgttacccaaggttgtgtctt

SEQ ID NO: 28721 - DNA, 25 bp, Homo sapiens
ggttgtgtctttaagggtggttcat

SEQ ID NO: 28722 - DNA, 25 bp, Homo sapiens
atgttctgttcttgtacattatact

SEQ ID NO: 28723 - DNA, 25 bp, Homo sapiens
gtgtcgtgaatgtttcttcagtttc

SEQ ID NO: 28724 - DNA, 25 bp, Homo sapiens
agtttcttgttcagccaatgaggaa

SEQ ID NO: 28725 - DNA, 25 bp, Homo sapiens
ctttttaccattaatcacttctcaa

SEQ ID NO: 28726 - DNA, 25 bp, Homo sapiens
ttctagattttgtacatctcagtcc

SEQ ID NO: 28727 - DNA, 25 bp, Homo sapiens
acatctcagtccataaagcaaagct

SEQ ID NO: 28728 - DNA, 25 bp, Homo sapiens
aagcttgttgatagtgtagttttct

SEQ ID NO: 28729 - DNA, 25 bp, Homo sapiens
gttttctaaacgctgcaaatttgca

SEQ ID NO: 28730 - DNA, 25 bp, Homo sapiens
aaatttgcagcctttaccactacaa

SEQ ID NO: 28731 - DNA, 25 bp, Homo sapiens
tctatcagatattcattgtcatgca

SEQ ID NO: 28732 - DNA, 25 bp, Homo sapiens
atataaacagttatgtcccctataa

SEQ ID NO: 28733 - DNA, 25 bp, Homo sapiens
gtcccctataaatctggtcagcaac

SEQ ID NO: 28734 - DNA, 25 bp, Homo sapiens
ggtcagcaacctcttttgattttgt

SEQ ID NO: 28735 - DNA, 25 bp, Homo sapiens
gtactgggtacaagtggtccaaact

SEQ ID NO: 28736 - DNA, 25 bp, Homo sapiens
cactaaacgttttgtgccttggtct

SEQ ID NO: 28737 - DNA, 25 bp, Homo sapiens
gtttcacctgtaactgtttaagcca

SEQ ID NO: 28738 - DNA, 25 bp, Homo sapiens
cactttacgttttcatgctgcttat

SEQ ID NO: 28739 - DNA, 25 bp, Homo sapiens
gaataagaactctttttgtcatttt

SEQ ID NO: 28740 - DNA, 25 bp, Homo sapiens
ttctggtcttttgagaccacccatt

SEQ ID NO: 28741 - DNA, 25 bp, Homo sapiens
actcacacatttggactcatttgaa

SEQ ID NO: 28742 - DNA, 25 bp, Homo sapiens
ttaaggttttatgggaggctgtgca

SEQ ID NO: 28743 - DNA, 25 bp, Homo sapiens
gaggctgtgcattgctcaaaagctg

SEQ ID NO: 28744 - DNA, 25 bp, Homo sapiens
aaaagctgttgggaacgccttctga

SEQ ID NO: 28745 - DNA, 25 bp, Homo sapiens
gggaacgccttctgaacagttgcct

SEQ ID NO: 28746 - DNA, 25 bp, Homo sapiens
gttgccttcagaactagtttgagct

SEQ ID NO: 28747 - DNA, 25 bp, Homo sapiens
tgagctgctcaataaaaccagtgac

SEQ ID NO: 28748 - DNA, 25 bp, Homo sapiens
gactgtgtctagcagttacgtcctg

SEQ ID NO: 28749 - DNA, 25 bp, Homo sapiens
gttacgtcctgcttaaagggactag

SEQ ID NO: 28750 - DNA, 25 bp, Homo sapiens
agaagtcaaagttccttgtctcact

SEQ ID NO: 28751 - DNA, 25 bp, Homo sapiens
tccttgtctcactatttgatctgct

SEQ ID NO: 28752 - DNA, 25 bp, Homo sapiens
aatactttcctatattgccctttga

SEQ ID NO: 28753 - DNA, 25 bp, Homo sapiens
gagtactctgtttctacgtatgtag

SEQ ID NO: 28754 - DNA, 25 bp, Homo sapiens
gtactggaattgctcattctgtgac

SEQ ID NO: 28755 - DNA, 25 bp, Homo sapiens
tatttgtgtcctaaacattcttcag

SEQ ID NO: 28756 - DNA, 25 bp, Homo sapiens
atctttgtcactggatgctacttga

SEQ ID NO: 28757 - DNA, 25 bp, Homo sapiens
gagggagtactttgtaaccactttg

SEQ ID NO: 28758 - DNA, 25 bp, Homo sapiens
tttgatatgctgttatcaccacccc

SEQ ID NO: 28759 - DNA, 25 bp, Homo sapiens
acccggtgtgttcttgtatagtcag

SEQ ID NO: 28760 - DNA, 25 bp, Homo sapiens
tatagtcagtggcatcagcacccgt

SEQ ID NO: 28761 - DNA, 25 bp, Homo sapiens
ttctcactgtgtctgggaagtagga

SEQ ID NO: 28762 - DNA, 25 bp, Homo sapiens
gtcatcttcatgacaggcggcatct

SEQ ID NO: 28763 - DNA, 25 bp, Homo sapiens
gcatctccactaagcctgtgtaact

SEQ ID NO: 28764 - DNA, 25 bp, Homo sapiens
agactcccattttaagaaccgtgca

SEQ ID NO: 28765 - DNA, 25 bp, Homo sapiens
gctaccaaaagtcttcaccactgtg

SEQ ID NO: 28766 - DNA, 25 bp, Homo sapiens
ttctgaggtttgggactttgtggtg

SEQ ID NO: 28767 - DNA, 25 bp, Homo sapiens
atgatcagagtgccatggccactac

SEQ ID NO: 28768 - DNA, 25 bp, Homo sapiens
tgctctcctgcaaatcaactgcttt

SEQ ID NO: 28769 - DNA, 25 bp, Homo sapiens
ttgagtgttagctactgcctttcta

SEQ ID NO: 28770 - DNA, 25 bp, Homo sapiens
agtgagtgtcactacttggctttgc

SEQ ID NO: 28771 - DNA, 25 bp, Homo sapiens
tcacacttgttctttgacctgctga

SEQ ID NO: 28772 - DNA, 25 bp, Homo sapiens
ccaccacccctataagtttgattgc

SEQ ID NO: 28773 - DNA, 25 bp, Homo sapiens
ggcctattgggctcttggatggaac

SEQ ID NO: 28774 - DNA, 25 bp, Homo sapiens
atcagtgctgactcaggatctcctg

SEQ ID NO: 28775 - DNA, 25 bp, Homo sapiens
ggaatcgtaatgtgcctcaatcctc

SEQ ID NO: 28776 - DNA, 25 bp, Homo sapiens
acactacatccacctagaactgcag

SEQ ID NO: 28777 - DNA, 25 bp, Homo sapiens
acttggcttggtgcttttgatccca

SEQ ID NO: 28778 - DNA, 25 bp, Homo sapiens
cagtggcctgctggggcaatggcat

SEQ ID NO: 28779 - DNA, 25 bp, Homo sapiens
caatggcatctgtcacggtgttttc

SEQ ID NO: 28780 - DNA, 25 bp, Homo sapiens
aactgtacactgttgtcaccttgac

SEQ ID NO: 28781 - DNA, 25 bp, Homo sapiens
cctcttttgccttgttcatggtcat

SEQ ID NO: 28782 - DNA, 25 bp, Homo sapiens
ggatcatcttttacactgccatcca

SEQ ID NO: 28783 - DNA, 25 bp, Homo sapiens
gactgatggtgtacagctcccaagt

SEQ ID NO: 28784 - DNA, 25 bp, Homo sapiens
aaaggaccctcttgattacagcaca

SEQ ID NO: 28785 - DNA, 25 bp, Homo sapiens
gaacttggaagacccgtgtttcctg

SEQ ID NO: 28786 - DNA, 25 bp, Homo sapiens
ggaccgcgaatcagtgtgttgggca

SEQ ID NO: 28787 - DNA, 25 bp, Homo sapiens
gaatttatccatcaccaaccatttc

SEQ ID NO: 28788 - DNA, 25 bp, Homo sapiens
atttgatgcacctctggattcagat

SEQ ID NO: 28789 - DNA, 25 bp, Homo sapiens
cattaaattgtcttcctcgattctc

SEQ ID NO: 28790 - DNA, 25 bp, Homo sapiens
agcatggctgtatgtgcgtggtcca

SEQ ID NO: 28791 - DNA, 25 bp, Homo sapiens
gcgtggtccatagcacagtacatgc

SEQ ID NO: 28792 - DNA, 25 bp, Homo sapiens
tgcacagagcataagagccatcaag

SEQ ID NO: 28793 - DNA, 25 bp, Homo sapiens
gccatcaagggccctcatttggcca

SEQ ID NO: 28794 - DNA, 25 bp, Homo sapiens
ttggccaatagcatccttttccagt

SEQ ID NO: 28795 - DNA, 25 bp, Homo sapiens
ttttccagtcttccggtctgacaaa

SEQ ID NO: 28796 - DNA, 25 bp, Homo sapiens
gaggatgacaaagacagtgaccagg

SEQ ID NO: 28797 - DNA, 25 bp, Homo sapiens
agctcaggcatgtttgctgcagaag

SEQ ID NO: 28798 - DNA, 25 bp, Homo sapiens
gagacaggggaggcacttctgagga

SEQ ID NO: 28799 - DNA, 25 bp, Homo sapiens
tgaggagactacagcaggtgaacag

SEQ ID NO: 28800 - DNA, 25 bp, Homo sapiens
ggtgaacagtctacaaggtctttta

SEQ ID NO: 28801 - DNA, 25 bp, Homo sapiens
ggatgatgcttatgacttcagtaca

SEQ ID NO: 28802 - DNA, 25 bp, Homo sapiens
ggtatgcatgagctgtgtaaatttt

SEQ ID NO: 28803 - DNA, 25 bp, Homo sapiens
aagacacattgaaagctctctttat

SEQ ID NO: 28804 - DNA, 25 bp, Homo sapiens
ccagcctgccattccatcaaatgga

SEQ ID NO: 28805 - DNA, 25 bp, Homo sapiens
gggaggagcttctaaagaggtgact

SEQ ID NO: 28806 - DNA, 25 bp, Homo sapiens
gaggtgactggtattttgtagcatt

SEQ ID NO: 28807 - DNA, 25 bp, Homo sapiens
ttttgtagcattccttgtcaagttc

SEQ ID NO: 28808 - DNA, 25 bp, Homo sapiens
tctaggctttccttcaagaacagtc

SEQ ID NO: 28809 - DNA, 25 bp, Homo sapiens
agaacagtcagatcacaaagtgtct

SEQ ID NO: 28810 - DNA, 25 bp, Homo sapiens
ttagcagatcagcaatccctctagg

SEQ ID NO: 28811 - DNA, 25 bp, Homo sapiens
actaggtcagctttggcgacactgt

SEQ ID NO: 28812 - DNA, 25 bp, Homo sapiens
gctttggcgacactgtgtcttctca

SEQ ID NO: 28813 - DNA, 25 bp, Homo sapiens
tcttctcacataaccacctgtagca

SEQ ID NO: 28814 - DNA, 25 bp, Homo sapiens
gtccacagctgaggttgcctctgac

SEQ ID NO: 28815 - DNA, 25 bp, Homo sapiens
aaaaggcttggctatggccctgtgt

SEQ ID NO: 28816 - DNA, 25 bp, Homo sapiens
cttcgtcatctgtggatccatccag

SEQ ID NO: 28817 - DNA, 25 bp, Homo sapiens
gaacagcggtatctgaagcccaggc

SEQ ID NO: 28818 - DNA, 25 bp, Homo sapiens
agaggctccagagttgagcttgtcc

SEQ ID NO: 28819 - DNA, 25 bp, Homo sapiens
gatgcccaagagcctggaggcactg

SEQ ID NO: 28820 - DNA, 25 bp, Homo sapiens
ctgcagaaacagtttctcctcctcc

SEQ ID NO: 28821 - DNA, 25 bp, Homo sapiens
acatgaagcccctggcatttgctgg

SEQ ID NO: 28822 - DNA, 25 bp, Homo sapiens
gatgggtagcactaagccagctggc

SEQ ID NO: 28823 - DNA, 25 bp, Homo sapiens
agccagctggcctaaagatgcaata

SEQ ID NO: 28824 - DNA, 25 bp, Homo sapiens
atgaacctcagcccattaggcagga

SEQ ID NO: 28825 - DNA, 25 bp, Homo sapiens
tcccctgcaagcatgttttccacaa

SEQ ID NO: 28826 - DNA, 25 bp, Homo sapiens
ccacaaatcctgcgtggatccctgg

SEQ ID NO: 28827 - DNA, 25 bp, Homo sapiens
ggatccctggcttagtgaacattgt

SEQ ID NO: 28828 - DNA, 25 bp, Homo sapiens
tgtacctgtcctatgtgcaaactta

SEQ ID NO: 28829 - DNA, 25 bp, Homo sapiens
gaaggccctgggaattgtgccgaat

SEQ ID NO: 28830 - DNA, 25 bp, Homo sapiens
tgtgccgaatttgccatgtactgat

SEQ ID NO: 28831 - DNA, 25 bp, Homo sapiens
caccagaacccaagctgttaaccga

SEQ ID NO: 28832 - DNA, 25 bp, Homo sapiens
gttaaccgaagatcagccctcggcg

SEQ ID NO: 28833 - DNA, 25 bp, Homo sapiens
gagccacttcgaacttcggggatct

SEQ ID NO: 28834 - DNA, 25 bp, Homo sapiens
acctcttcctcaggatggggagctc

SEQ ID NO: 28835 - DNA, 25 bp, Homo sapiens
acatgatcatcagagccacagctag

SEQ ID NO: 28836 - DNA, 25 bp, Homo sapiens
gacaaaaacccaactctttgtggat

SEQ ID NO: 28837 - DNA, 25 bp, Homo sapiens
tccaatgcaggtcacactccaatta

SEQ ID NO: 28838 - DNA, 25 bp, Homo sapiens
attgcagtagggactcattcccaga

SEQ ID NO: 28839 - DNA, 25 bp, Homo sapiens
ggactcattcccagacaaagcaata

SEQ ID NO: 28840 - DNA, 25 bp, Homo sapiens
tagtcacgacttcatggaaccaatc

SEQ ID NO: 28841 - DNA, 25 bp, Homo sapiens
aaagctgtccattcaattccaaata

SEQ ID NO: 28842 - DNA, 25 bp, Homo sapiens
ggtatagccactgatattctttcat

SEQ ID NO: 28843 - DNA, 25 bp, Homo sapiens
tgaattcatataaagctcccctagc

SEQ ID NO: 28844 - DNA, 25 bp, Homo sapiens
ataaagctcccctagcattttttat

SEQ ID NO: 28845 - DNA, 25 bp, Homo sapiens
ggcttcaggagtacccaaatagtag

SEQ ID NO: 28846 - DNA, 25 bp, Homo sapiens
ggggaccgccattctaaatatcatg

SEQ ID NO: 28847 - DNA, 25 bp, Homo sapiens
ggaatgagttcttatctagtgttgc

SEQ ID NO: 28848 - DNA, 25 bp, Homo sapiens
tcttatctagtgttgcaggccagca

SEQ ID NO: 28849 - DNA, 25 bp, Homo sapiens
ggtttcgagagcattcctactcaca

SEQ ID NO: 28850 - DNA, 25 bp, Homo sapiens
gagcattcctactcacataagtgaa

SEQ ID NO: 28851 - DNA, 25 bp, Homo sapiens
tgagactaggtgctttgcttccttt

SEQ ID NO: 28852 - DNA, 25 bp, Homo sapiens
gcttcctttcatcaggtatctttct

SEQ ID NO: 28853 - DNA, 25 bp, Homo sapiens
aggtatctttctgtggcatttgaga

SEQ ID NO: 28854 - DNA, 25 bp, Homo sapiens
ttactaaattatgaggctttgcttt

SEQ ID NO: 28855 - DNA, 25 bp, Homo sapiens
taactagttttgtcattccatttgt

SEQ ID NO: 28856 - DNA, 25 bp, Homo sapiens
gatacagtcaccaagaatgttttga

SEQ ID NO: 28857 - DNA, 25 bp, Homo sapiens
agaccccaatttaagccttgcttat

SEQ ID NO: 28858 - DNA, 25 bp, Homo sapiens
tctgccatcatgccgatgttcatcg

SEQ ID NO: 28859 - DNA, 25 bp, Homo sapiens
tgccatcatgccgatgttcatcgta

SEQ ID NO: 28860 - DNA, 25 bp, Homo sapiens
gccgatgttcatcgtaaacaccaac

SEQ ID NO: 28861 - DNA, 25 bp, Homo sapiens
ttcatcgtaaacaccaacgtgcccc

SEQ ID NO: 28862 - DNA, 25 bp, Homo sapiens
cctgcacagcatcggcaagatcggc

SEQ ID NO: 28863 - DNA, 25 bp, Homo sapiens
tgcacagcatcggcaagatcggcgg

SEQ ID NO: 28864 - DNA, 25 bp, Homo sapiens
ccgctcctacagcaagctgctgtgc

SEQ ID NO: 28865 - DNA, 25 bp, Homo sapiens
gctcctacagcaagctgctgtgcgg

SEQ ID NO: 28866 - DNA, 25 bp, Homo sapiens
cctacagcaagctgctgtgcggcct

SEQ ID NO: 28867 - DNA, 25 bp, Homo sapiens
atgtgggctggaacaactccacctt

SEQ ID NO: 28868 - DNA, 25 bp, Homo sapiens
cttctgccatcatgccgatgttcat

SEQ ID NO: 28869 - DNA, 25 bp, Homo sapiens
aaaccacgtttctttgttgagctgt

SEQ ID NO: 28870 - DNA, 25 bp, Homo sapiens
gttgagctgtgtcttgaaggcaaaa

SEQ ID NO: 28871 - DNA, 25 bp, Homo sapiens
ccccaaacagaaccatcttcgacag

SEQ ID NO: 28872 - DNA, 25 bp, Homo sapiens
atcttcgacagtgacctgatggata

SEQ ID NO: 28873 - DNA, 25 bp, Homo sapiens
gatggatagtgccaggctgggcggc

SEQ ID NO: 28874 - DNA, 25 bp, Homo sapiens
cggcgggcgcatggaggggccgccg

SEQ ID NO: 28875 - DNA, 25 bp, Homo sapiens
cctagagagcgcagccatctggagc

SEQ ID NO: 28876 - DNA, 25 bp, Homo sapiens
aacagaaaggacaccctctctaggg

SEQ ID NO: 28877 - DNA, 25 bp, Homo sapiens
ggctggggctgcgtaggtgaaaagg

SEQ ID NO: 28878 - DNA, 25 bp, Homo sapiens
tgaaaaggcagaacactccgcgctt

SEQ ID NO: 28879 - DNA, 25 bp, Homo sapiens
gtgagaggaaggcggggggcgcagc

SEQ ID NO: 28880 - DNA, 25 bp, Homo sapiens
agacagagctctagtgtgccagcct

SEQ ID NO: 28881 - DNA, 25 bp, Homo sapiens
gggtgggcagtgactaggggacgag

SEQ ID NO: 28882 - DNA, 25 bp, Homo sapiens
gtggtacttaacacttgtagccatc

SEQ ID NO: 28883 - DNA, 25 bp, Homo sapiens
atcaactgactgagaccttgggcta

SEQ ID NO: 28884 - DNA, 25 bp, Homo sapiens
atatgccaggtagacaccagcccaa

SEQ ID NO: 28885 - DNA, 25 bp, Homo sapiens
gactaccttgtcactactttaggcc

SEQ ID NO: 28886 - DNA, 25 bp, Homo sapiens
tactttaggcccattccacaaagcc

SEQ ID NO: 28887 - DNA, 25 bp, Homo sapiens
ccacaaagcccatctctggtttgag

SEQ ID NO: 28888 - DNA, 25 bp, Homo sapiens
tttgatctgtatctacaccacccaa

SEQ ID NO: 28889 - DNA, 25 bp, Homo sapiens
ttaggcctcctataatgtccaaaac

SEQ ID NO: 28890 - DNA, 25 bp, Homo sapiens
gataactacatgtctttgctcttag

SEQ ID NO: 28891 - DNA, 25 bp, Homo sapiens
atctgctgtctcccaaataagcttt

SEQ ID NO: 28892 - DNA, 25 bp, Homo sapiens
taagcttttgtatctgccagtgaat

SEQ ID NO: 28893 - DNA, 25 bp, Homo sapiens
tactccaaatgattgctttcttttc

SEQ ID NO: 28894 - DNA, 25 bp, Homo sapiens
taataccttcgggatcactgtcccc

SEQ ID NO: 28895 - DNA, 25 bp, Homo sapiens
ccccatcttccgtgttagagcaaag

SEQ ID NO: 28896 - DNA, 25 bp, Homo sapiens
agaactgtcttacaccacttgagct

SEQ ID NO: 28897 - DNA, 25 bp, Homo sapiens
acttgagctcagacctctaaaccct

SEQ ID NO: 28898 - DNA, 25 bp, Homo sapiens
aaccctgtatttcccttatgatgtc

SEQ ID NO: 28899 - DNA, 25 bp, Homo sapiens
atgatgtcccctttttgagacacta

SEQ ID NO: 28900 - DNA, 25 bp, Homo sapiens
aactataggcctttttcttgggatg

SEQ ID NO: 28901 - DNA, 25 bp, Homo sapiens
aacattctgctttcttagtcttacc

SEQ ID NO: 28902 - DNA, 25 bp, Homo sapiens
gcaggcagagcagctactgactttg

SEQ ID NO: 28903 - DNA, 25 bp, Homo sapiens
agtacagtgacactctggtgcccat

SEQ ID NO: 28904 - DNA, 25 bp, Homo sapiens
cattggcagatggcgacttccctgc

SEQ ID NO: 28905 - DNA, 25 bp, Homo sapiens
ttcctccttttcagaactactctgt

SEQ ID NO: 28906 - DNA, 25 bp, Homo sapiens
actactctgtgctaattgttctgcc

SEQ ID NO: 28907 - DNA, 25 bp, Homo sapiens
tgccagtatgggcgcatcagctcca

SEQ ID NO: 28908 - DNA, 25 bp, Homo sapiens
aaactttgtaggcaccttctgcttc

SEQ ID NO: 28909 - DNA, 25 bp, Homo sapiens
ctctgcttcattgttcctgtgatag

SEQ ID NO: 28910 - DNA, 25 bp, Homo sapiens
gttcctgtgatagtcctgttgttat

SEQ ID NO: 28911 - DNA, 25 bp, Homo sapiens
ggaggcaggccaggacatcaaagtc

SEQ ID NO: 28912 - DNA, 25 bp, Homo sapiens
gtatctcatggcctcttgatgtgga

SEQ ID NO: 28913 - DNA, 25 bp, Homo sapiens
cccctgcatatcttctcagcaataa

SEQ ID NO: 28914 - DNA, 25 bp, Homo sapiens
gcaataactccatgggctctgggac

SEQ ID NO: 28915 - DNA, 25 bp, Homo sapiens
ctgagacttcaatctacagcccagc

SEQ ID NO: 28916 - DNA, 25 bp, Homo sapiens
gcaattgggtctctggcaggcaata

SEQ ID NO: 28917 - DNA, 25 bp, Homo sapiens
ggccagcacaccgggatggatggag

SEQ ID NO: 28918 - DNA, 25 bp, Homo sapiens
cctacgtccccttagatgggcagca

SEQ ID NO: 28919 - DNA, 25 bp, Homo sapiens
tgcctgtcggtggtcagagcggtga

SEQ ID NO: 28920 - DNA, 25 bp, Homo sapiens
ggtgggttggagactcagcaggctc

SEQ ID NO: 28921 - DNA, 25 bp, Homo sapiens
cggaaaccaaccaaaccgtgcgctg

SEQ ID NO: 28922 - DNA, 25 bp, Homo sapiens
cattgctgttctctgtatcgtgatc

SEQ ID NO: 28923 - DNA, 25 bp, Homo sapiens
gtatcgtgatctatcctcaacaaca

SEQ ID NO: 28924 - DNA, 25 bp, Homo sapiens
ttattgatatttgtgcttctgccta

SEQ ID NO: 28925 - DNA, 25 bp, Homo sapiens
aacacaagtgatcctgacatgagac

SEQ ID NO: 28926 - DNA, 25 bp, Homo sapiens
aaccatgagttgcctgatgtttctg

SEQ ID NO: 28927 - DNA, 25 bp, Homo sapiens
agttcatgacaagactcttctcttc

SEQ ID NO: 28928 - DNA, 25 bp, Homo sapiens
tggcaaatctagcagcggcagcagt

SEQ ID NO: 28929 - DNA, 25 bp, Homo sapiens
gccgtccagagctggcatttgcaca

SEQ ID NO: 28930 - DNA, 25 bp, Homo sapiens
aacacggcaacactgggtggcatcc

SEQ ID NO: 28931 - DNA, 25 bp, Homo sapiens
cactgggtggcatccaagtcttgga

SEQ ID NO: 28932 - DNA, 25 bp, Homo sapiens
gaaaaccgtgtgaagcaactactat

SEQ ID NO: 28933 - DNA, 25 bp, Homo sapiens
taaacttgagtcatcccgacgttga

SEQ ID NO: 28934 - DNA, 25 bp, Homo sapiens
tcccgacgttgatctcttacaactg

SEQ ID NO: 28935 - DNA, 25 bp, Homo sapiens
aactcgaaacgaactcatgctggaa

SEQ ID NO: 28936 - DNA, 25 bp, Homo sapiens
aactagaaacaccattacagttcca

SEQ ID NO: 28937 - DNA, 25 bp, Homo sapiens
agttccagcctctttcatgttgagg

SEQ ID NO: 28938 - DNA, 25 bp, Homo sapiens
ttcatgttgaggatgttggcttcac

SEQ ID NO: 28939 - DNA, 25 bp, Homo sapiens
gcttcacttaatcatatccgagctg

SEQ ID NO: 28940 - DNA, 25 bp, Homo sapiens
atccgagctgaccggttggagggtg

SEQ ID NO: 28941 - DNA, 25 bp, Homo sapiens
tggagggtgacagatcagaaggctc

SEQ ID NO: 28942 - DNA, 25 bp, Homo sapiens
tggcaagcacttaaatgttctgaaa

SEQ ID NO: 28943 - DNA, 25 bp, Homo sapiens
agagctttagtgcaattttaaggtt

SEQ ID NO: 28944 - DNA, 25 bp, Homo sapiens
tgccgtgtatgaggagtgctagaaa

SEQ ID NO: 28945 - DNA, 25 bp, Homo sapiens
tgcaatattttccctaaccttcaaa

SEQ ID NO: 28946 - DNA, 25 bp, Homo sapiens
gaggacaagggctttctggccatct

SEQ ID NO: 28947 - DNA, 25 bp, Homo sapiens
tggccatctcagggagggggcacca

SEQ ID NO: 28948 - DNA, 25 bp, Homo sapiens
ggttcccacaggctatgatgctgca

SEQ ID NO: 28949 - DNA, 25 bp, Homo sapiens
tcaaaatcaccctttctgtcaagca

SEQ ID NO: 28950 - DNA, 25 bp, Homo sapiens
ctgtcaagcatatcttggcctctcc

SEQ ID NO: 28951 - DNA, 25 bp, Homo sapiens
ccatgtctcagtgttgcctgcattt

SEQ ID NO: 28952 - DNA, 25 bp, Homo sapiens
ggctcctggggtacacaagcccagc

SEQ ID NO: 28953 - DNA, 25 bp, Homo sapiens
gcaggtcctgagtgaagccgtgggc

SEQ ID NO: 28954 - DNA, 25 bp, Homo sapiens
tcgttttatagcaacctctctctac

SEQ ID NO: 28955 - DNA, 25 bp, Homo sapiens
taccctagttctccaaattcacttc

SEQ ID NO: 28956 - DNA, 25 bp, Homo sapiens
ttctgccttcctcaggtttgatatc

SEQ ID NO: 28957 - DNA, 25 bp, Homo sapiens
agaggagggtggcacggaggtcctg

SEQ ID NO: 28958 - DNA, 25 bp, Homo sapiens
gtgtgaccagtgtggaaacccaaag

SEQ ID NO: 28959 - DNA, 25 bp, Homo sapiens
gcggctgctgcaagaagcgagcctc

SEQ ID NO: 28960 - DNA, 25 bp, Homo sapiens
gaagcgagcctccaaagagactgca

SEQ ID NO: 28961 - DNA, 25 bp, Homo sapiens
acctggaacaccaggtggcttctcc

SEQ ID NO: 28962 - DNA, 25 bp, Homo sapiens
gcttctccgaagtcatgggcagtgc

SEQ ID NO: 28963 - DNA, 25 bp, Homo sapiens
gagcctggacacgtcctacttaaga

SEQ ID NO: 28964 - DNA, 25 bp, Homo sapiens
tactcagggaatctcctgctactta

SEQ ID NO: 28965 - DNA, 25 bp, Homo sapiens
atgtggaaagacacgcccatgtccc

SEQ ID NO: 28966 - DNA, 25 bp, Homo sapiens
aatgctgcagtggggagcaggcccc

SEQ ID NO: 28967 - DNA, 25 bp, Homo sapiens
ctgtcctcagcacgcgtgtgcaaaa

SEQ ID NO: 28968 - DNA, 25 bp, Homo sapiens
aagcatcttgaaacaccatggctgt

SEQ ID NO: 28969 - DNA, 25 bp, Homo sapiens
gtcataaatctacgtattctcctct

SEQ ID NO: 28970 - DNA, 25 bp, Homo sapiens
gtattctcctctaccagatgactat

SEQ ID NO: 28971 - DNA, 25 bp, Homo sapiens
aattgcaacgtagagcttgctctga

SEQ ID NO: 28972 - DNA, 25 bp, Homo sapiens
aggacaatagtatgctaccaccctt

SEQ ID NO: 28973 - DNA, 25 bp, Homo sapiens
cacccttctgtggacattccatatg

SEQ ID NO: 28974 - DNA, 25 bp, Homo sapiens
ctcggccagatcctgtgcataataa

SEQ ID NO: 28975 - DNA, 25 bp, Homo sapiens
aatgttctttactactaagcaccgt

SEQ ID NO: 28976 - DNA, 25 bp, Homo sapiens
taagcaccgttggtatcctcatgga

SEQ ID NO: 28977 - DNA, 25 bp, Homo sapiens
ggtatcctcatggacggtatcacag

SEQ ID NO: 28978 - DNA, 25 bp, Homo sapiens
gaaatgtgcctcatttgccatttga

SEQ ID NO: 28979 - DNA, 25 bp, Homo sapiens
gaggaggggaagcctgtattcagga

SEQ ID NO: 28980 - DNA, 25 bp, Homo sapiens
tactgtctctcttccacattataaa

SEQ ID NO: 28981 - DNA, 25 bp, Homo sapiens
taaatgaactgcctttccaggtcca

SEQ ID NO: 28982 - DNA, 25 bp, Homo sapiens
tccaggtccaacatgctgtcaggtt

SEQ ID NO: 28983 - DNA, 25 bp, Homo sapiens
ggttgcttcagctcggtgtgaatgt

SEQ ID NO: 28984 - DNA, 25 bp, Homo sapiens
gcaaatgtcttgtggctgttttatt

SEQ ID NO: 28985 - DNA, 25 bp, Homo sapiens
gataagctcagttcttcattgggaa

SEQ ID NO: 28986 - DNA, 25 bp, Homo sapiens
gccatccttcaatatcactggtctc

SEQ ID NO: 28987 - DNA, 25 bp, Homo sapiens
taatctcctaaattggtacccactg

SEQ ID NO: 28988 - DNA, 25 bp, Homo sapiens
gctgctcctaaactggtttccagtc

SEQ ID NO: 28989 - DNA, 25 bp, Homo sapiens
tccagtcatgtcctccagtatgtga

SEQ ID NO: 28990 - DNA, 25 bp, Homo sapiens
acaagaagcagtcagccttctctcc

SEQ ID NO: 28991 - DNA, 25 bp, Homo sapiens
tctcccccataaggactggctgtaa

SEQ ID NO: 28992 - DNA, 25 bp, Homo sapiens
gactggctgtaaccttaagcccatc

SEQ ID NO: 28993 - DNA, 25 bp, Homo sapiens
agcccatcaaagttacttccagcct

SEQ ID NO: 28994 - DNA, 25 bp, Homo sapiens
gagagaacctcaccaaacagctggt

SEQ ID NO: 28995 - DNA, 25 bp, Homo sapiens
acctccccaaattcaatctgagccc

SEQ ID NO: 28996 - DNA, 25 bp, Homo sapiens
gatggtagggttgccagggctcaga

SEQ ID NO: 28997 - DNA, 25 bp, Homo sapiens
cttcccacctggacagtggtgtgtg

SEQ ID NO: 28998 - DNA, 25 bp, Homo sapiens
cagctggatgtttgtggtggggcct

SEQ ID NO: 28999 - DNA, 25 bp, Homo sapiens
tggggcctcatggtgcctaggagga

SEQ ID NO: 29000 - DNA, 25 bp, Homo sapiens
gagacagaggggttcagacttggga

SEQ ID NO: 29001 - DNA, 25 bp, Homo sapiens
cagggaattattcttttttctgcaa

SEQ ID NO: 29002 - DNA, 25 bp, Homo sapiens
ctacgggtacgtggctgaacagttc

SEQ ID NO: 29003 - DNA, 25 bp, Homo sapiens
gttatggccggatttgctttttcat

SEQ ID NO: 29004 - DNA, 25 bp, Homo sapiens
tgctttttcatgtttgctgacactt

SEQ ID NO: 29005 - DNA, 25 bp, Homo sapiens
catcctctcaagtggttacctgttc

SEQ ID NO: 29006 - DNA, 25 bp, Homo sapiens
ttcagcacctgcttttgtttctgtg

SEQ ID NO: 29007 - DNA, 25 bp, Homo sapiens
tgagctaaattgctttcatacccca

SEQ ID NO: 29008 - DNA, 25 bp, Homo sapiens
gctaaaaccacctaatgctcttatg

SEQ ID NO: 29009 - DNA, 25 bp, Homo sapiens
aatgctcttatggcacagctgtgta

SEQ ID NO: 29010 - DNA, 25 bp, Homo sapiens
acttcatttctagcccagttgggtt

SEQ ID NO: 29011 - DNA, 25 bp, Homo sapiens
tagaccttctcttcataatcttgct

SEQ ID NO: 29012 - DNA, 25 bp, Homo sapiens
ccccaaggaatgctgtcccaacaag

SEQ ID NO: 29013 - DNA, 25 bp, Homo sapiens
tgtcccaacaagattcccgtgaaag

SEQ ID NO: 29014 - DNA, 25 bp, Homo sapiens
ttcggttcctggcggtccaggacgg

SEQ ID NO: 29015 - DNA, 25 bp, Homo sapiens
ggcatgatcaacctcgtcatgtcct

SEQ ID NO: 29016 - DNA, 25 bp, Homo sapiens
gtggtcctgatgccaacagtgtacc

SEQ ID NO: 29017 - DNA, 25 bp, Homo sapiens
agtgtaccagcagggcgttggctat

SEQ ID NO: 29018 - DNA, 25 bp, Homo sapiens
gctatgtgcccatcacagggatgcc

SEQ ID NO: 29019 - DNA, 25 bp, Homo sapiens
cagccccgctgtagcgaggaggacc

SEQ ID NO: 29020 - DNA, 25 bp, Homo sapiens
gaggacctgaaagccatccaggaca

SEQ ID NO: 29021 - DNA, 25 bp, Homo sapiens
atggaccaggaggtgatccgctccg

SEQ ID NO: 29022 - DNA, 25 bp, Homo sapiens
gagggaacaaggatgccgccatcaa

SEQ ID NO: 29023 - DNA, 25 bp, Homo sapiens
gcctggtgcagtgatggcgctaagg

SEQ ID NO: 29024 - DNA, 25 bp, Homo sapiens
cttaggaagcagcacagccgtgtcc

SEQ ID NO: 29025 - DNA, 25 bp, Homo sapiens
agccgtgtccttagggatgttcgcg

SEQ ID NO: 29026 - DNA, 25 bp, Homo sapiens
gacactggtaactgcggtttcagcc

SEQ ID NO: 29027 - DNA, 25 bp, Homo sapiens
ggtttcagccaacactcttcatggc

SEQ ID NO: 29028 - DNA, 25 bp, Homo sapiens
cctgacgttgacgtgttctctggtc

SEQ ID NO: 29029 - DNA, 25 bp, Homo sapiens
ggcatggtacggtttcgtgcctgac

SEQ ID NO: 29030 - DNA, 25 bp, Homo sapiens
ctgacgcgtgcattagggtgttctc

SEQ ID NO: 29031 - DNA, 25 bp, Homo sapiens
tagggtgttctcttatactttcagt

SEQ ID NO: 29032 - DNA, 25 bp, Homo sapiens
gactcttgagtgataccctgtgatg

SEQ ID NO: 29033 - DNA, 25 bp, Homo sapiens
gacatgccccagatggattctactt

SEQ ID NO: 29034 - DNA, 25 bp, Homo sapiens
tttccccacaagctggcatttcagt

SEQ ID NO: 29035 - DNA, 25 bp, Homo sapiens
ttccgggctgtgttcacatgactgc

SEQ ID NO: 29036 - DNA, 25 bp, Homo sapiens
acatgactgctgtctagctgatgca

SEQ ID NO: 29037 - DNA, 25 bp, Homo sapiens
gagtattctctaacctgatattttc

SEQ ID NO: 29038 - DNA, 25 bp, Homo sapiens
tactttctagattgtggggctcatt

SEQ ID NO: 29039 - DNA, 25 bp, Homo sapiens
cattttgccagggccaagctaccag

SEQ ID NO: 29040 - DNA, 25 bp, Homo sapiens
ttacctggtatgtatctctctgggt

SEQ ID NO: 29041 - DNA, 25 bp, Homo sapiens
ctctctgggtgccccagttagagct

SEQ ID NO: 29042 - DNA, 25 bp, Homo sapiens
aaccctgcattcaatgtagctgtca

SEQ ID NO: 29043 - DNA, 25 bp, Homo sapiens
tttaagtacacctgtcagctgtttc

SEQ ID NO: 29044 - DNA, 25 bp, Homo sapiens
agctgtttcttaccacttcgatggt

SEQ ID NO: 29045 - DNA, 25 bp, Homo sapiens
ttgtcaccttcttggacttattccc

SEQ ID NO: 29046 - DNA, 25 bp, Homo sapiens
tcaggtggagagtaggcccaggccc

SEQ ID NO: 29047 - DNA, 25 bp, Homo sapiens
acagctccaagttcagacaggtgcc

SEQ ID NO: 29048 - DNA, 25 bp, Homo sapiens
aatgcatttcctctggagtttgaga

SEQ ID NO: 29049 - DNA, 25 bp, Homo sapiens
tggtgtgctgttcttgagttttcgt

SEQ ID NO: 29050 - DNA, 25 bp, Homo sapiens
gatgttagggcgagaccctgcaagt

SEQ ID NO: 29051 - DNA, 25 bp, Homo sapiens
gagcttgtctttcaaggcaggttcc

SEQ ID NO: 29052 - DNA, 25 bp, Homo sapiens
ttttaacagaaccccagtcacatgc

SEQ ID NO: 29053 - DNA, 25 bp, Homo sapiens
atgcggctcaagtcactcagaggct

SEQ ID NO: 29054 - DNA, 25 bp, Homo sapiens
gaggctgttgcatttcagggctatg

SEQ ID NO: 29055 - DNA, 25 bp, Homo sapiens
tatgttggtcctttgtttacctcct

SEQ ID NO: 29056 - DNA, 25 bp, Homo sapiens
gctattgttaggttgcctgcggaca

SEQ ID NO: 29057 - DNA, 25 bp, Homo sapiens
tcttcgtgctctatgatttctgcat

SEQ ID NO: 29058 - DNA, 25 bp, Homo sapiens
tctgcattgtttgtatcaccaccta

SEQ ID NO: 29059 - DNA, 25 bp, Homo sapiens
accacctatgctatcaacgtgagcc

SEQ ID NO: 29060 - DNA, 25 bp, Homo sapiens
gtggctcagtttccggaaggtccaa

SEQ ID NO: 29061 - DNA, 25 bp, Homo sapiens
ggctaagaggcactgagccctcaac

SEQ ID NO: 29062 - DNA, 25 bp, Homo sapiens
gcatgtgagccttgcctaagggggc

SEQ ID NO: 29063 - DNA, 25 bp, Homo sapiens
gcctaagggggcatatctgggtccc

SEQ ID NO: 29064 - DNA, 25 bp, Homo sapiens
tctgggtccctagaaggccctagat

SEQ ID NO: 29065 - DNA, 25 bp, Homo sapiens
gatgtggggcttctagattaccccc

SEQ ID NO: 29066 - DNA, 25 bp, Homo sapiens
ctgccatacccgcacatgacaatgg

SEQ ID NO: 29067 - DNA, 25 bp, Homo sapiens
ccagatgatgtccaacctgggccca

SEQ ID NO: 29068 - DNA, 25 bp, Homo sapiens
ccagtgtgggtcctccaagtaagga

SEQ ID NO: 29069 - DNA, 25 bp, Homo sapiens
ggacaaggacaaagtgctgcccagc

SEQ ID NO: 29070 - DNA, 25 bp, Homo sapiens
tggtcaccctcgaatgcgtggagaa

SEQ ID NO: 29071 - DNA, 25 bp, Homo sapiens
catggtggaccctgtgactggagac

SEQ ID NO: 29072 - DNA, 25 bp, Homo sapiens
tggagacaaactcacagaccgcgac

SEQ ID NO: 29073 - DNA, 25 bp, Homo sapiens
ccgcgacatcatcgtgctgcagcgg

SEQ ID NO: 29074 - DNA, 25 bp, Homo sapiens
ggctccggagtgaagctgcaagcgg

SEQ ID NO: 29075 - DNA, 25 bp, Homo sapiens
agctgcaagcggagaaatcacggcc

SEQ ID NO: 29076 - DNA, 25 bp, Homo sapiens
aaatcacggccggtgatgcaggcct

SEQ ID NO: 29077 - DNA, 25 bp, Homo sapiens
gatgcaggcctgagtgtgtgcggga

SEQ ID NO: 29078 - DNA, 25 bp, Homo sapiens
cattgcccttgtgatttagaagatt

SEQ ID NO: 29079 - DNA, 25 bp, Homo sapiens
tatttcatatttgcctccttatata

SEQ ID NO: 29080 - DNA, 25 bp, Homo sapiens
gaccaaggtatttccttctgcttca

SEQ ID NO: 29081 - DNA, 25 bp, Homo sapiens
aactcacttgagtcttgatcaaaca

SEQ ID NO: 29082 - DNA, 25 bp, Homo sapiens
cccacagcaagcagttgccttacca

SEQ ID NO: 29083 - DNA, 25 bp, Homo sapiens
gcaagcagttgccttaccagtgaaa

SEQ ID NO: 29084 - DNA, 25 bp, Homo sapiens
aaaggtgcactgaggtaacatctaa

SEQ ID NO: 29085 - DNA, 25 bp, Homo sapiens
aacagaacagttctaatcctgccac

SEQ ID NO: 29086 - DNA, 25 bp, Homo sapiens
aatcctgccacgtgttatcattata

SEQ ID NO: 29087 - DNA, 25 bp, Homo sapiens
gagccctaatatgtaagattttcct

SEQ ID NO: 29088 - DNA, 25 bp, Homo sapiens
gcagtatttatcctggtttaattct

SEQ ID NO: 29089 - DNA, 25 bp, Homo sapiens
ggcgccactttgtatatttcaggac

SEQ ID NO: 29090 - DNA, 25 bp, Homo sapiens
tatttcaggactgggacctactccc

SEQ ID NO: 29091 - DNA, 25 bp, Homo sapiens
tgagaggagcttctgtttggcattc

SEQ ID NO: 29092 - DNA, 25 bp, Homo sapiens
gatggaaggacaggcagcacgggag

SEQ ID NO: 29093 - DNA, 25 bp, Homo sapiens
ggactcctactatgaggcattagcc

SEQ ID NO: 29094 - DNA, 25 bp, Homo sapiens
gaggcattagccaaggcccagaaaa

SEQ ID NO: 29095 - DNA, 25 bp, Homo sapiens
gacgggcaccaaaaaaggcaccacg

SEQ ID NO: 29096 - DNA, 25 bp, Homo sapiens
cagctgttgcagatgctcagaagag

SEQ ID NO: 29097 - DNA, 25 bp, Homo sapiens
attcggctatcccagtgacaacgat

SEQ ID NO: 29098 - DNA, 25 bp, Homo sapiens
tgctgtgggcaccattgtgaagaag

SEQ ID NO: 29099 - DNA, 25 bp, Homo sapiens
ggacttgaaaggaccgtgcagccca

SEQ ID NO: 29100 - DNA, 25 bp, Homo sapiens
taggtcatgaacagtcacccgtgct

SEQ ID NO: 29101 - DNA, 25 bp, Homo sapiens
cccccacagaggcaatcatgcccaa

SEQ ID NO: 29102 - DNA, 25 bp, Homo sapiens
gaaggtgtgatctgtgggactgtct

SEQ ID NO: 29103 - DNA, 25 bp, Homo sapiens
tactcatcctgctatcaatttctta

SEQ ID NO: 29104 - DNA, 25 bp, Homo sapiens
attggcctgggtaagactgaaagca

SEQ ID NO: 29105 - DNA, 25 bp, Homo sapiens
gcattccaaattaggcttagactgt

SEQ ID NO: 29106 - DNA, 25 bp, Homo sapiens
gttatcgagcttaaaacccgtcaat

SEQ ID NO: 29107 - DNA, 25 bp, Homo sapiens
tgaacagttactgcatgccacgcac

SEQ ID NO: 29108 - DNA, 25 bp, Homo sapiens
tgccacgcactgtgttgggcttagt

SEQ ID NO: 29109 - DNA, 25 bp, Homo sapiens
ctctttccattcaaatagtcctggt

SEQ ID NO: 29110 - DNA, 25 bp, Homo sapiens
agtcctggttcattcccagaagggc

SEQ ID NO: 29111 - DNA, 25 bp, Homo sapiens
ctcttttactactgacctttcacag

SEQ ID NO: 29112 - DNA, 25 bp, Homo sapiens
gagacataagtgccttgcattacac

SEQ ID NO: 29113 - DNA, 25 bp, Homo sapiens
gattccaacttgtccaaaagctttc

SEQ ID NO: 29114 - DNA, 25 bp, Homo sapiens
aaagctttctggccttacatatttt

SEQ ID NO: 29115 - DNA, 25 bp, Homo sapiens
ggtaatcttctatgtcagagctagt

SEQ ID NO: 29116 - DNA, 25 bp, Homo sapiens
gtttcacaattccccaagacaaaag

SEQ ID NO: 29117 - DNA, 25 bp, Homo sapiens
agtatcagtcggtgcaacagttggc

SEQ ID NO: 29118 - DNA, 25 bp, Homo sapiens
agttggcaacatgtgccttcacact

SEQ ID NO: 29119 - DNA, 25 bp, Homo sapiens
tgtgccttcacactttaccataaag

SEQ ID NO: 29120 - DNA, 25 bp, Homo sapiens
tgccttctaaagtctgcaacttcaa

SEQ ID NO: 29121 - DNA, 25 bp, Homo sapiens
gacactgtggattgactttcccggt

SEQ ID NO: 29122 - DNA, 25 bp, Homo sapiens
tgagctggagctggttggactaatg

SEQ ID NO: 29123 - DNA, 25 bp, Homo sapiens
ggaagcagcttttcctacgatctgc

SEQ ID NO: 29124 - DNA, 25 bp, Homo sapiens
gcttttcctacgatctgcattatgt

SEQ ID NO: 29125 - DNA, 25 bp, Homo sapiens
gcattatgtaatcacaggtccagag

SEQ ID NO: 29126 - DNA, 25 bp, Homo sapiens
gaggaggagcacttactcatgttgt

SEQ ID NO: 29127 - DNA, 25 bp, Homo sapiens
actagagtgcacttgttagatgcta

SEQ ID NO: 29128 - DNA, 25 bp, Homo sapiens
gagctttacacaaaatgtcttcatc

SEQ ID NO: 29129 - DNA, 25 bp, Homo sapiens
gatgtaatggcctgttatgtcttga

SEQ ID NO: 29130 - DNA, 25 bp, Homo sapiens
ggatcagtttgaacagcttctccac

SEQ ID NO: 29131 - DNA, 25 bp, Homo sapiens
gaactatttggggtctgtaggtaat

SEQ ID NO: 29132 - DNA, 25 bp, Homo sapiens
gatattttccgtgtcctaaataatt

SEQ ID NO: 29133 - DNA, 25 bp, Homo sapiens
ggaggcctttgacagatcctttgag

SEQ ID NO: 29134 - DNA, 25 bp, Homo sapiens
ttgaggtgaacctgcgtgcggtcat

SEQ ID NO: 29135 - DNA, 25 bp, Homo sapiens
caggtgtcgcagattgtggccaggg

SEQ ID NO: 29136 - DNA, 25 bp, Homo sapiens
gtgctcccagcgggcagtaactaac

SEQ ID NO: 29137 - DNA, 25 bp, Homo sapiens
aactaaccatagcgtctactgctcc

SEQ ID NO: 29138 - DNA, 25 bp, Homo sapiens
tgccctggacatgctgaccaaggtg

SEQ ID NO: 29139 - DNA, 25 bp, Homo sapiens
ggtgatggccctagagctcgggccc

SEQ ID NO: 29140 - DNA, 25 bp, Homo sapiens
aaccccacagtggtgatgacgtcca

SEQ ID NO: 29141 - DNA, 25 bp, Homo sapiens
gaaccgaatcccacttggcaagttt

SEQ ID NO: 29142 - DNA, 25 bp, Homo sapiens
atcctctttctgctgagtgaccgaa

SEQ ID NO: 29143 - DNA, 25 bp, Homo sapiens
tccaataaacctgattctgctgccc

SEQ ID NO: 29144 - DNA, 25 bp, Homo sapiens
gaaatacagccatgtgatcgatcat

SEQ ID NO: 29145 - DNA, 25 bp, Homo sapiens
gacttggaagtctaagcttatttta

SEQ ID NO: 29146 - DNA, 25 bp, Homo sapiens
aatttgttagttttgctgacagaga

SEQ ID NO: 29147 - DNA, 25 bp, Homo sapiens
cagagaaaaatcgtcagttgtcaga

SEQ ID NO: 29148 - DNA, 25 bp, Homo sapiens
gcacaccacaataaatgtaccacca

SEQ ID NO: 29149 - DNA, 25 bp, Homo sapiens
gtaccaccacacacggaatatgcta

SEQ ID NO: 29150 - DNA, 25 bp, Homo sapiens
gatagcgtttgatacactagtcatt

SEQ ID NO: 29151 - DNA, 25 bp, Homo sapiens
gtcattgtctcaatcactgatcctg

SEQ ID NO: 29152 - DNA, 25 bp, Homo sapiens
atcactgatcctgtaagttgtcatc

SEQ ID NO: 29153 - DNA, 25 bp, Homo sapiens
tattggccaaggtgttgctttaact

SEQ ID NO: 29154 - DNA, 25 bp, Homo sapiens
gaaagcacactgcctaaatgtgtaa

SEQ ID NO: 29155 - DNA, 25 bp, Homo sapiens
caagagcacagcagtcctacaagtc

SEQ ID NO: 29156 - DNA, 25 bp, Homo sapiens
agtccttggtgcagatccacgaaaa

SEQ ID NO: 29157 - DNA, 25 bp, Homo sapiens
tacacacccccaaaagaagacggct

SEQ ID NO: 29158 - DNA, 25 bp, Homo sapiens
agacggctaaccctggagtatcacc

SEQ ID NO: 29159 - DNA, 25 bp, Homo sapiens
aggcaccactggaccaattaccttt

SEQ ID NO: 29160 - DNA, 25 bp, Homo sapiens
ttttcctggacgtgatagctctgcc

SEQ ID NO: 29161 - DNA, 25 bp, Homo sapiens
gatagctctgcctattgcaggacaa

SEQ ID NO: 29162 - DNA, 25 bp, Homo sapiens
gaacccttgctagcaggcattctta

SEQ ID NO: 29163 - DNA, 25 bp, Homo sapiens
aactttcgagcctccttatattgct

SEQ ID NO: 29164 - DNA, 25 bp, Homo sapiens
ttgctggaaactcagctgtgctcca

SEQ ID NO: 29165 - DNA, 25 bp, Homo sapiens
ttctcttatttcatgtacactgctt

SEQ ID NO: 29166 - DNA, 25 bp, Homo sapiens
atggataatttacttgtgtctttta

SEQ ID NO: 29167 - DNA, 25 bp, Homo sapiens
tgtcttttatgattacaccaatgta

SEQ ID NO: 29168 - DNA, 25 bp, Homo sapiens
taataacatttaccttcagcctcca

SEQ ID NO: 29169 - DNA, 25 bp, Homo sapiens
ttcagcctccatcagaatggaacga

SEQ ID NO: 29170 - DNA, 25 bp, Homo sapiens
gttagtattaatgcgttggcccacg

SEQ ID NO: 29171 - DNA, 25 bp, Homo sapiens
tgcgttggcccacgtagcaaaaaga

SEQ ID NO: 29172 - DNA, 25 bp, Homo sapiens
ataccgttttcatgaaagttctcag

SEQ ID NO: 29173 - DNA, 25 bp, Homo sapiens
gttctcagtattgtaacagcaactt

SEQ ID NO: 29174 - DNA, 25 bp, Homo sapiens
acagcaacttgtcaaacctaagcat

SEQ ID NO: 29175 - DNA, 25 bp, Homo sapiens
gaaatcgtattgtgtggctctgtat

SEQ ID NO: 29176 - DNA, 25 bp, Homo sapiens
attgtgtggctctgtatattctgtt

SEQ ID NO: 29177 - DNA, 25 bp, Homo sapiens
gcactgcctccttgggaagttagtg

SEQ ID NO: 29178 - DNA, 25 bp, Homo sapiens
ttttggaacttcagccatttcccca

SEQ ID NO: 29179 - DNA, 25 bp, Homo sapiens
gtatgtacagtcttctcaggatgag

SEQ ID NO: 29180 - DNA, 25 bp, Homo sapiens
agctggggaccatattctgcaatgc

SEQ ID NO: 29181 - DNA, 25 bp, Homo sapiens
tctgcaatgcagccaaatccgagga

SEQ ID NO: 29182 - DNA, 25 bp, Homo sapiens
atcttcgggacttctttaatgctac

SEQ ID NO: 29183 - DNA, 25 bp, Homo sapiens
atgctacgttaatgtttcactgctc

SEQ ID NO: 29184 - DNA, 25 bp, Homo sapiens
ttcactgctcgtctagaaactccta

SEQ ID NO: 29185 - DNA, 25 bp, Homo sapiens
atgggagctctgtctagttgtcctt

SEQ ID NO: 29186 - DNA, 25 bp, Homo sapiens
gactgacttcagtggctcataaccg

SEQ ID NO: 29187 - DNA, 25 bp, Homo sapiens
acatgtctagagttctgctggatct

SEQ ID NO: 29188 - DNA, 25 bp, Homo sapiens
tgaggctttggcagtcttcatttac

SEQ ID NO: 29189 - DNA, 25 bp, Homo sapiens
tcttcatttactaccacttgttctt

SEQ ID NO: 29190 - DNA, 25 bp, Homo sapiens
tttccaagattatttgtggctcacc

SEQ ID NO: 29191 - DNA, 25 bp, Homo sapiens
gtggctcacctgaaggctttgcaaa

SEQ ID NO: 29192 - DNA, 25 bp, Homo sapiens
tgcaaaatttgtaccataaccgttt

SEQ ID NO: 29193 - DNA, 25 bp, Homo sapiens
gaaacttcaagctctctaaataaaa

SEQ ID NO: 29194 - DNA, 25 bp, Homo sapiens
gaactctcaatgggtaggtttcatc

SEQ ID NO: 29195 - DNA, 25 bp, Homo sapiens
ggtaggtttcatcctacccattgcc

SEQ ID NO: 29196 - DNA, 25 bp, Homo sapiens
tcctgagagatacctcacattccaa

SEQ ID NO: 29197 - DNA, 25 bp, Homo sapiens
aatgccaaacatttctgcacaggga

SEQ ID NO: 29198 - DNA, 25 bp, Homo sapiens
gaggtggatacacgtgttgcaagta

SEQ ID NO: 29199 - DNA, 25 bp, Homo sapiens
tacgtcaaagaccgctgctgcagta

SEQ ID NO: 29200 - DNA, 25 bp, Homo sapiens
gcagtagctgcccagtcaggaatac

SEQ ID NO: 29201 - DNA, 25 bp, Homo sapiens
gctacacatcatgtccactggtgac

SEQ ID NO: 29202 - DNA, 25 bp, Homo sapiens
cactggtgaccggctacaaccgtgt

SEQ ID NO: 29203 - DNA, 25 bp, Homo sapiens
acaaccgtgtgattcttgctgagtt

SEQ ID NO: 29204 - DNA, 25 bp, Homo sapiens
gcgcctttccatgtatctcatgaaa

SEQ ID NO: 29205 - DNA, 25 bp, Homo sapiens
gaccagcgtttctgcgcaagttgtt

SEQ ID NO: 29206 - DNA, 25 bp, Homo sapiens
taaggatggctcagcacttgctcat

SEQ ID NO: 29207 - DNA, 25 bp, Homo sapiens
ggcttctgggccaaaactgcagtca

SEQ ID NO: 29208 - DNA, 25 bp, Homo sapiens
gtaatggtgaccaaatgcctccctt

SEQ ID NO: 29209 - DNA, 25 bp, Homo sapiens
gtgggctactcatgatgggcttgat

SEQ ID NO: 29210 - DNA, 25 bp, Homo sapiens
gttacttactcagctgatgtcacag

SEQ ID NO: 29211 - DNA, 25 bp, Homo sapiens
aaccagtggctgagcggaccaacgt

SEQ ID NO: 29212 - DNA, 25 bp, Homo sapiens
gaccaacgttgccatgtgcgtttgc

SEQ ID NO: 29213 - DNA, 25 bp, Homo sapiens
gtgagcgacatgtgcagaacggccc

SEQ ID NO: 29214 - DNA, 25 bp, Homo sapiens
ccttggctgcagttaggacctcagt

SEQ ID NO: 29215 - DNA, 25 bp, Homo sapiens
ggctggtatggccaagctgctagaa

SEQ ID NO: 29216 - DNA, 25 bp, Homo sapiens
ttcttctcaatctaaatgcctttca

SEQ ID NO: 29217 - DNA, 25 bp, Homo sapiens
gacagccaggccagatgacctgatt

SEQ ID NO: 29218 - DNA, 25 bp, Homo sapiens
cctggggctgacatgagccattccc

SEQ ID NO: 29219 - DNA, 25 bp, Homo sapiens
agccaagcctgtctgagctgggagt

SEQ ID NO: 29220 - DNA, 25 bp, Homo sapiens
catcctcagtcgttgttacttactc

SEQ ID NO: 29221 - DNA, 25 bp, Homo sapiens
taattccacagctccttgttttttg

SEQ ID NO: 29222 - DNA, 25 bp, Homo sapiens
caataatgcacgtgctttgccctgg

SEQ ID NO: 29223 - DNA, 25 bp, Homo sapiens
gctttgccctgggtacagccagagc

SEQ ID NO: 29224 - DNA, 25 bp, Homo sapiens
gaggacctacctgatgggacgtttc

SEQ ID NO: 29225 - DNA, 25 bp, Homo sapiens
acgtttccacgtgtctctagagaag

SEQ ID NO: 29226 - DNA, 25 bp, Homo sapiens
gaaggattcctggatctagctggtc

SEQ ID NO: 29227 - DNA, 25 bp, Homo sapiens
gtcacgacgatgttttcaccaaggt

SEQ ID NO: 29228 - DNA, 25 bp, Homo sapiens
ggtcacaggagcattgcgtcgctga

SEQ ID NO: 29229 - DNA, 25 bp, Homo sapiens
ttggtttggttcttgtttcagccca

SEQ ID NO: 29230 - DNA, 25 bp, Homo sapiens
tgaaacagtctgcacctttgatacg

SEQ ID NO: 29231 - DNA, 25 bp, Homo sapiens
caataataccttttcctccattttg

SEQ ID NO: 29232 - DNA, 25 bp, Homo sapiens
acccagggattaatgctgccacagg

SEQ ID NO: 29233 - DNA, 25 bp, Homo sapiens
ggcaatctttatttgtcttacttcc

SEQ ID NO: 29234 - DNA, 25 bp, Homo sapiens
ctgttctgcctctttaactcagtta

SEQ ID NO: 29235 - DNA, 25 bp, Homo sapiens
taagttgttctgtttgggacctgga

SEQ ID NO: 29236 - DNA, 25 bp, Homo sapiens
tattctcaactagcattctttccat

SEQ ID NO: 29237 - DNA, 25 bp, Homo sapiens
agcaagtagcccacagttctggcct

SEQ ID NO: 29238 - DNA, 25 bp, Homo sapiens
gttctggcctaacagcagacttgct

SEQ ID NO: 29239 - DNA, 25 bp, Homo sapiens
gacttgctgttttcacttggtatcc

SEQ ID NO: 29240 - DNA, 25 bp, Homo sapiens
gtatcctggagttgggttgctaacc

SEQ ID NO: 29241 - DNA, 25 bp, Homo sapiens
tgataaagtagaccaccagctgcac

SEQ ID NO: 29242 - DNA, 25 bp, Homo sapiens
cagctgcaccgtgttttctgtaaaa

SEQ ID NO: 29243 - DNA, 25 bp, Homo sapiens
ggtacgccgaaacatgatccagtct

SEQ ID NO: 29244 - DNA, 25 bp, Homo sapiens
gatccagtctcggttgactcaagag

SEQ ID NO: 29245 - DNA, 25 bp, Homo sapiens
aagctatggtggcatgtggtacctt

SEQ ID NO: 29246 - DNA, 25 bp, Homo sapiens
agcaaactactaacccagcaaatct

SEQ ID NO: 29247 - DNA, 25 bp, Homo sapiens
gcggaaccagaagtagggcctcgac

SEQ ID NO: 29248 - DNA, 25 bp, Homo sapiens
cctcgacttgcttcagacgacacag

SEQ ID NO: 29249 - DNA, 25 bp, Homo sapiens
agaggaactgaccatctcatgacct

SEQ ID NO: 29250 - DNA, 25 bp, Homo sapiens
tgacctgtggcattgcacggtgcag

SEQ ID NO: 29251 - DNA, 25 bp, Homo sapiens
cagaagggattatcctcagccagtc

SEQ ID NO: 29252 - DNA, 25 bp, Homo sapiens
taagttagttagatcactcccagaa

SEQ ID NO: 29253 - DNA, 25 bp, Homo sapiens
tgggaccttctttgcagtacaattt

SEQ ID NO: 29254 - DNA, 25 bp, Homo sapiens
tgaaggcatttgcaaagcttccccc

SEQ ID NO: 29255 - DNA, 25 bp, Homo sapiens
tgctgtggtgaacttcttatccaga

SEQ ID NO: 29256 - DNA, 25 bp, Homo sapiens
tgctgttacctctgatttccagtac

SEQ ID NO: 29257 - DNA, 25 bp, Homo sapiens
ctccttgggctattcgatgccgtgt

SEQ ID NO: 29258 - DNA, 25 bp, Homo sapiens
gccgtgtatgcatctgacagggcaa

SEQ ID NO: 29259 - DNA, 25 bp, Homo sapiens
acagggcaacatttcatacaccatt

SEQ ID NO: 29260 - DNA, 25 bp, Homo sapiens
tacaccatttagtcacctaggccaa

SEQ ID NO: 29261 - DNA, 25 bp, Homo sapiens
gccaaagtccggaaggatgctcctc

SEQ ID NO: 29262 - DNA, 25 bp, Homo sapiens
ctcctcttacacttttccgaagata

SEQ ID NO: 29263 - DNA, 25 bp, Homo sapiens
gaagttttccctgatagcacttttc

SEQ ID NO: 29264 - DNA, 25 bp, Homo sapiens
aagtctggaccaggctgaaggcatt

SEQ ID NO: 29265 - DNA, 25 bp, Homo sapiens
tatattcccttattgcattttcctt

SEQ ID NO: 29266 - DNA, 25 bp, Homo sapiens
tggtggtgttgttactacagccttc

SEQ ID NO: 29267 - DNA, 25 bp, Homo sapiens
gttactacagccttctatgatccaa

SEQ ID NO: 29268 - DNA, 25 bp, Homo sapiens
tatgcaaacctgttccattctttct

SEQ ID NO: 29269 - DNA, 25 bp, Homo sapiens
attctttcttcgtggacaacccatt

SEQ ID NO: 29270 - DNA, 25 bp, Homo sapiens
gaactggtaccatattacactgatg

SEQ ID NO: 29271 - DNA, 25 bp, Homo sapiens
gcaaagaaccgtgggtacctggcgg

SEQ ID NO: 29272 - DNA, 25 bp, Homo sapiens
tggcggatcctgccaaatttcctga

SEQ ID NO: 29273 - DNA, 25 bp, Homo sapiens
tgaagcacgacttgaactcgccagg

SEQ ID NO: 29274 - DNA, 25 bp, Homo sapiens
aatgctctgtactaggaaggatcca

SEQ ID NO: 29275 - DNA, 25 bp, Homo sapiens
tacctcatgaattcccgtccaagga

SEQ ID NO: 29276 - DNA, 25 bp, Homo sapiens
aggacgtgcagactcgagtggctgg

SEQ ID NO: 29277 - DNA, 25 bp, Homo sapiens
ccgagggcattgagcccctggtgta

SEQ ID NO: 29278 - DNA, 25 bp, Homo sapiens
tggtgtacctctgccaaactgacac

SEQ ID NO: 29279 - DNA, 25 bp, Homo sapiens
tgtgagggaagctgcccggcaaagc

SEQ ID NO: 29280 - DNA, 25 bp, Homo sapiens
gaagagggacagtctgcccatcgac

SEQ ID NO: 29281 - DNA, 25 bp, Homo sapiens
gcacagcattctaaactattcaccc

SEQ ID NO: 29282 - DNA, 25 bp, Homo sapiens
ctattcacccatgggttcctggtgc

SEQ ID NO: 29283 - DNA, 25 bp, Homo sapiens
gggtaagggctggctccagataccc

SEQ ID NO: 29284 - DNA, 25 bp, Homo sapiens
tcccccacagattcctagcaatgaa

SEQ ID NO: 29285 - DNA, 25 bp, Homo sapiens
aatctaatatatccttctgttgccc

SEQ ID NO: 29286 - DNA, 25 bp, Homo sapiens
agccacatcccttggttttgtattt

SEQ ID NO: 29287 - DNA, 25 bp, Homo sapiens
ccctggtgccagggacgtacctggg

SEQ ID NO: 29288 - DNA, 25 bp, Homo sapiens
atcaggcccatttgagcgtggcagc

SEQ ID NO: 29289 - DNA, 25 bp, Homo sapiens
ggcagccgtgttgggtgaaggtccg

SEQ ID NO: 29290 - DNA, 25 bp, Homo sapiens
accacatcatagctctcactgtttt

SEQ ID NO: 29291 - DNA, 25 bp, Homo sapiens
agacaccagagccacactcaaatgg

SEQ ID NO: 29292 - DNA, 25 bp, Homo sapiens
ggttatgacctctctggattatttt

SEQ ID NO: 29293 - DNA, 25 bp, Homo sapiens
gaatgcccaactgttgcaattcaag

SEQ ID NO: 29294 - DNA, 25 bp, Homo sapiens
attcatccttcgtatcactgcagaa

SEQ ID NO: 29295 - DNA, 25 bp, Homo sapiens
agggaactcttgacactgagccact

SEQ ID NO: 29296 - DNA, 25 bp, Homo sapiens
ggactgtgctactgtatttgtctca

SEQ ID NO: 29297 - DNA, 25 bp, Homo sapiens
caagctgattttctagaccactgag

SEQ ID NO: 29298 - DNA, 25 bp, Homo sapiens
cctgctggtgcagtattcggccaag

SEQ ID NO: 29299 - DNA, 25 bp, Homo sapiens
agaaaggccaagctgatgactccca

SEQ ID NO: 29300 - DNA, 25 bp, Homo sapiens
gaagtccacggctgagccaggatgc

SEQ ID NO: 29301 - DNA, 25 bp, Homo sapiens
gccaggatgcaaggctcctggtcct

SEQ ID NO: 29302 - DNA, 25 bp, Homo sapiens
tcctgtttgcagccggccaagaggc

SEQ ID NO: 29303 - DNA, 25 bp, Homo sapiens
aaaaccatacggatgcgctgctgtc

SEQ ID NO: 29304 - DNA, 25 bp, Homo sapiens
agaggaagggctgacacttgctggc

SEQ ID NO: 29305 - DNA, 25 bp, Homo sapiens
gcttcgtcatcgcatgcactgatgc

SEQ ID NO: 29306 - DNA, 25 bp, Homo sapiens
ggctgcccattgcaggcactgggca

SEQ ID NO: 29307 - DNA, 25 bp, Homo sapiens
ccctgtagcgcttttgttacttgaa

SEQ ID NO: 29308 - DNA, 25 bp, Homo sapiens
tacttgaatgtctagctgagcctgt

SEQ ID NO: 29309 - DNA, 25 bp, Homo sapiens
ccaaggccgtagagctggtgcgtgc

SEQ ID NO: 29310 - DNA, 25 bp, Homo sapiens
taccgcattgtggctgctcacaaca

SEQ ID NO: 29311 - DNA, 25 bp, Homo sapiens
gctcacaacaagtgtcccagggatg

SEQ ID NO: 29312 - DNA, 25 bp, Homo sapiens
tggccgtttcgtagagcagctgggc

SEQ ID NO: 29313 - DNA, 25 bp, Homo sapiens
tgggctcctatgatccattgcccaa

SEQ ID NO: 29314 - DNA, 25 bp, Homo sapiens
tggagaaaaactcgttgccctcaac

SEQ ID NO: 29315 - DNA, 25 bp, Homo sapiens
ccctcaacctagacaggatccgtca

SEQ ID NO: 29316 - DNA, 25 bp, Homo sapiens
cgtcattggattggctgcggggccc

SEQ ID NO: 29317 - DNA, 25 bp, Homo sapiens
ttttccctctgcatcctatgatgat

SEQ ID NO: 29318 - DNA, 25 bp, Homo sapiens
aacgggcacgtgaagtcctgttagc

SEQ ID NO: 29319 - DNA, 25 bp, Homo sapiens
gaaacactgcagcgatcttaatttt

SEQ ID NO: 29320 - DNA, 25 bp, Homo sapiens
attcagcaacaaacaatcttccttt

SEQ ID NO: 29321 - DNA, 25 bp, Homo sapiens
gaaacctgttcattccaatcttcta

SEQ ID NO: 29322 - DNA, 25 bp, Homo sapiens
aattacagtggttcctatctcaggg

SEQ ID NO: 29323 - DNA, 25 bp, Homo sapiens
ttttccctctgtggcagttacgatt

SEQ ID NO: 29324 - DNA, 25 bp, Homo sapiens
agttacgattttgacttcagtcctg

SEQ ID NO: 29325 - DNA, 25 bp, Homo sapiens
atccaagtctgaaactctgcgctct

SEQ ID NO: 29326 - DNA, 25 bp, Homo sapiens
ctgcgctctagtactgctgttaaga

SEQ ID NO: 29327 - DNA, 25 bp, Homo sapiens
tataatctcgggatacacacacaca

SEQ ID NO: 29328 - DNA, 25 bp, Homo sapiens
tttcataaatattctgcctactgta

SEQ ID NO: 29329 - DNA, 25 bp, Homo sapiens
gtaaatatgggttcctctgagttgt

SEQ ID NO: 29330 - DNA, 25 bp, Homo sapiens
gaaatttcatggtcttacctacaat

SEQ ID NO: 29331 - DNA, 25 bp, Homo sapiens
gggaccacctctatagtgatctggc

SEQ ID NO: 29332 - DNA, 25 bp, Homo sapiens
agtgatctggcggatctcatgctgc

SEQ ID NO: 29333 - DNA, 25 bp, Homo sapiens
agctggagcgtgagatccgcatcat

SEQ ID NO: 29334 - DNA, 25 bp, Homo sapiens
gatccgcatcatcaacacggagcag

SEQ ID NO: 29335 - DNA, 25 bp, Homo sapiens
cacggagcagtacatgcactcgctg

SEQ ID NO: 29336 - DNA, 25 bp, Homo sapiens
tgcactcgctgacgtggcagcaggc

SEQ ID NO: 29337 - DNA, 25 bp, Homo sapiens
tgctggagcgcatgcagacctatca

SEQ ID NO: 29338 - DNA, 25 bp, Homo sapiens
aggacgcggagtcgaggcaggtgct

SEQ ID NO: 29339 - DNA, 25 bp, Homo sapiens
gcatcaccaaggccctgttcaatgc

SEQ ID NO: 29340 - DNA, 25 bp, Homo sapiens
caatgcgcagttcggcagcatcttc

SEQ ID NO: 29341 - DNA, 25 bp, Homo sapiens
tgagggcacctttattgtctgggac

SEQ ID NO: 29342 - DNA, 25 bp, Homo sapiens
gaccgtgggtgagggtgtgcggctc

SEQ ID NO: 29343 - DNA, 25 bp, Homo sapiens
catggagccactttgcaggagcaca

SEQ ID NO: 29344 - DNA, 25 bp, Homo sapiens
gagcccgcatggacagtgagagcct

SEQ ID NO: 29345 - DNA, 25 bp, Homo sapiens
cagtgagagcctcttcaaggacggg

SEQ ID NO: 29346 - DNA, 25 bp, Homo sapiens
gaactcgattgttctgccacacaag

SEQ ID NO: 29347 - DNA, 25 bp, Homo sapiens
caaggagctgagccgaagcttcacc

SEQ ID NO: 29348 - DNA, 25 bp, Homo sapiens
gatcatcctctgagtagggctgcca

SEQ ID NO: 29349 - DNA, 25 bp, Homo sapiens
tgagtagggctgccagaaggccccc

SEQ ID NO: 29350 - DNA, 25 bp, Homo sapiens
gaaagccaggctggatcgtcacatg

SEQ ID NO: 29351 - DNA, 25 bp, Homo sapiens
cggggagcaatgtggatggcctggg

SEQ ID NO: 29352 - DNA, 25 bp, Homo sapiens
gtctccatcgggaagggggtgaccg

SEQ ID NO: 29353 - DNA, 25 bp, Homo sapiens
gcacccaaggtttctgattctgacc

SEQ ID NO: 29354 - DNA, 25 bp, Homo sapiens
gattctgacccagcagtggtcctga

SEQ ID NO: 29355 - DNA, 25 bp, Homo sapiens
ggcaagtcttgtagtcattttgatt

SEQ ID NO: 29356 - DNA, 25 bp, Homo sapiens
gaaccagcactagcttgttccaagc

SEQ ID NO: 29357 - DNA, 25 bp, Homo sapiens
gctgagtttagagtactttctgctt

SEQ ID NO: 29358 - DNA, 25 bp, Homo sapiens
aattacaaattcattcccagcctag

SEQ ID NO: 29359 - DNA, 25 bp, Homo sapiens
cccagcctaggctctgggcacattt

SEQ ID NO: 29360 - DNA, 25 bp, Homo sapiens
atttcctgttcttgaattctgctcc

SEQ ID NO: 29361 - DNA, 25 bp, Homo sapiens
gaattctgctcctgaagagggtgaa

SEQ ID NO: 29362 - DNA, 25 bp, Homo sapiens
ggggcattcaagttgtgagctcaga

SEQ ID NO: 29363 - DNA, 25 bp, Homo sapiens
cagccagccattacacctaaattta

SEQ ID NO: 29364 - DNA, 25 bp, Homo sapiens
cagcatcgacgcacgcgagatcttc

SEQ ID NO: 29365 - DNA, 25 bp, Homo sapiens
cgatctgattcgctccatcaatgac

SEQ ID NO: 29366 - DNA, 25 bp, Homo sapiens
gagcatccactgacgctagaggagt

SEQ ID NO: 29367 - DNA, 25 bp, Homo sapiens
gcaggtgcgggttcaggttagcgac

SEQ ID NO: 29368 - DNA, 25 bp, Homo sapiens
agtacagtggctgtggctttcacac

SEQ ID NO: 29369 - DNA, 25 bp, Homo sapiens
gtccatcaaggtcaagcttctgcgc

SEQ ID NO: 29370 - DNA, 25 bp, Homo sapiens
aagatggacgtgcacattactccgg

SEQ ID NO: 29371 - DNA, 25 bp, Homo sapiens
ataaggagcgggtggcagctgccct

SEQ ID NO: 29372 - DNA, 25 bp, Homo sapiens
gaacacccacctcttggaggttgtg

SEQ ID NO: 29373 - DNA, 25 bp, Homo sapiens
ctcagcctgcatactggtatcctgg

SEQ ID NO: 29374 - DNA, 25 bp, Homo sapiens
gctgttaccgttgttttcttgaatc

SEQ ID NO: 29375 - DNA, 25 bp, Homo sapiens
ttttgagtttgaaatctctcccaga

SEQ ID NO: 29376 - DNA, 25 bp, Homo sapiens
ggcagagagttttcctttctgactt

SEQ ID NO: 29377 - DNA, 25 bp, Homo sapiens
cctttgctttcgtgtgaccacatgt

SEQ ID NO: 29378 - DNA, 25 bp, Homo sapiens
catgttttctgtaccagtcactggg

SEQ ID NO: 29379 - DNA, 25 bp, Homo sapiens
aagaagtgagtttatctcgtttgtt

SEQ ID NO: 29380 - DNA, 25 bp, Homo sapiens
ttagcattcctttttgggtctcaag

SEQ ID NO: 29381 - DNA, 25 bp, Homo sapiens
gtcatttaatgctgtgtgcttattt

SEQ ID NO: 29382 - DNA, 25 bp, Homo sapiens
gtgcttattttgaattcctcatcag

SEQ ID NO: 29383 - DNA, 25 bp, Homo sapiens
tcctcatcaggttttagaagcgggg

SEQ ID NO: 29384 - DNA, 25 bp, Homo sapiens
tatactgagtggcattgaacgtgag

SEQ ID NO: 29385 - DNA, 25 bp, Homo sapiens
tgaacgtgagtttgtcccagtgaaa

SEQ ID NO: 29386 - DNA, 25 bp, Homo sapiens
ccgaatctcgctgatttggcggtgt

SEQ ID NO: 29387 - DNA, 25 bp, Homo sapiens
gatttggcggtgtatggcgtgctgc

SEQ ID NO: 29388 - DNA, 25 bp, Homo sapiens
gtatggcgtgctgcgtgtgatggag

SEQ ID NO: 29389 - DNA, 25 bp, Homo sapiens
gaggggctggatgcattcgatgacc

SEQ ID NO: 29390 - DNA, 25 bp, Homo sapiens
atgacctgatgcagcacacgcacat

SEQ ID NO: 29391 - DNA, 25 bp, Homo sapiens
ggtggagagggccatcaccgaggcc

SEQ ID NO: 29392 - DNA, 25 bp, Homo sapiens
gggaaggcagcggaagacgccagct

SEQ ID NO: 29393 - DNA, 25 bp, Homo sapiens
gcgcctggcgatactggttgggggc

SEQ ID NO: 29394 - DNA, 25 bp, Homo sapiens
ggggcaggatcattctgccccttgt

SEQ ID NO: 29395 - DNA, 25 bp, Homo sapiens
agccctctcgcttctaacacagggc

SEQ ID NO: 29396 - DNA, 25 bp, Homo sapiens
gcctcccgggactgggacatgtttg

SEQ ID NO: 29397 - DNA, 25 bp, Homo sapiens
gttttgatgctgtgtgcttttggct

SEQ ID NO: 29398 - DNA, 25 bp, Homo sapiens
gggggcatggagaaccgtagagcgc

SEQ ID NO: 29399 - DNA, 25 bp, Homo sapiens
agagcgcaggaacgggtgggtaatt

SEQ ID NO: 29400 - DNA, 25 bp, Homo sapiens
ggcacagagcgcggagatgtaccac

SEQ ID NO: 29401 - DNA, 25 bp, Homo sapiens
ctaccagcaccaacggcaacagatg

SEQ ID NO: 29402 - DNA, 25 bp, Homo sapiens
gcaacagatgctgtgcctggagcgg

SEQ ID NO: 29403 - DNA, 25 bp, Homo sapiens
ggagcggcataaagagccacccaag

SEQ ID NO: 29404 - DNA, 25 bp, Homo sapiens
gacacggcctcctcggatgaggaga

SEQ ID NO: 29405 - DNA, 25 bp, Homo sapiens
tgaggacggagacttcacggtgtac

SEQ ID NO: 29406 - DNA, 25 bp, Homo sapiens
acttcacggtgtacgagtgcccggg

SEQ ID NO: 29407 - DNA, 25 bp, Homo sapiens
aaatggaggtgcgcaaccctctgtt

SEQ ID NO: 29408 - DNA, 25 bp, Homo sapiens
aactttgtatagcccatgtacctac

SEQ ID NO: 29409 - DNA, 25 bp, Homo sapiens
gcccatgtacctaccttgtatagaa

SEQ ID NO: 29410 - DNA, 25 bp, Homo sapiens
ggaattccaaataactcacctacag

SEQ ID NO: 29411 - DNA, 25 bp, Homo sapiens
aactcacctacagatttttagcaca

SEQ ID NO: 29412 - DNA, 25 bp, Homo sapiens
gaggaaaggtaactctgatctcagt

SEQ ID NO: 29413 - DNA, 25 bp, Homo sapiens
agtcctatttatctgcagtcgtatt

SEQ ID NO: 29414 - DNA, 25 bp, Homo sapiens
atctgcagtcgtattaagtcctatt

SEQ ID NO: 29415 - DNA, 25 bp, Homo sapiens
attgccatttaaattacacactgag

SEQ ID NO: 29416 - DNA, 25 bp, Homo sapiens
cacactgagagcatgtcctatgcag

SEQ ID NO: 29417 - DNA, 25 bp, Homo sapiens
gcagacatagatttttctgttcatt

SEQ ID NO: 29418 - DNA, 25 bp, Homo sapiens
gaattactacatttgctgtacatat

SEQ ID NO: 29419 - DNA, 25 bp, Homo sapiens
tgtccagaggcccagtgggtcatct

SEQ ID NO: 29420 - DNA, 25 bp, Homo sapiens
tcccaaggtgggtgtggaccctggc

SEQ ID NO: 29421 - DNA, 25 bp, Homo sapiens
gaggcctcacccagaagtgggaccc

SEQ ID NO: 29422 - DNA, 25 bp, Homo sapiens
ccgtgactgtttctgatgacctgga

SEQ ID NO: 29423 - DNA, 25 bp, Homo sapiens
aaggtttctgcccagagcaggcttc

SEQ ID NO: 29424 - DNA, 25 bp, Homo sapiens
cgaagttttgtgccttccaagtgct

SEQ ID NO: 29425 - DNA, 25 bp, Homo sapiens
aagacctggtcagcctaaatcttcc

SEQ ID NO: 29426 - DNA, 25 bp, Homo sapiens
ctgtggagctgtcagtcaccggagt

SEQ ID NO: 29427 - DNA, 25 bp, Homo sapiens
ggagtaatgagctcctggttcctcg

SEQ ID NO: 29428 - DNA, 25 bp, Homo sapiens
gttgtactatgatcacagtccctgt

SEQ ID NO: 29429 - DNA, 25 bp, Homo sapiens
gccatccttttccaagactggggct

SEQ ID NO: 29430 - DNA, 25 bp, Homo sapiens
tggagcctgcagctagcagtgggcc

SEQ ID NO: 29431 - DNA, 25 bp, Homo sapiens
tattctccacatgagaccacaggcc

SEQ ID NO: 29432 - DNA, 25 bp, Homo sapiens
gccagagcctgtcgggagaagacca

SEQ ID NO: 29433 - DNA, 25 bp, Homo sapiens
gtgggattgtgtacctttctaagaa

SEQ ID NO: 29434 - DNA, 25 bp, Homo sapiens
ttctaagaattaaccctctcctgct

SEQ ID NO: 29435 - DNA, 25 bp, Homo sapiens
tctcctgctttactgctaatttttt

SEQ ID NO: 29436 - DNA, 25 bp, Homo sapiens
accagtttttggcttactcctgaga

SEQ ID NO: 29437 - DNA, 25 bp, Homo sapiens
aggttggacaagatgccactgcttt

SEQ ID NO: 29438 - DNA, 25 bp, Homo sapiens
taaaccatcccgtagtcttctaata

SEQ ID NO: 29439 - DNA, 25 bp, Homo sapiens
atgtgaactccttaactcatcaagt

SEQ ID NO: 29440 - DNA, 25 bp, Homo sapiens
atacgcccttggcacagtcggatga

SEQ ID NO: 29441 - DNA, 25 bp, Homo sapiens
tttttcttttggtgcagaaccgttg

SEQ ID NO: 29442 - DNA, 25 bp, Homo sapiens
ggtgcagaaccgttgtgcagtgggg

SEQ ID NO: 29443 - DNA, 25 bp, Homo sapiens
gttgtgcagtggggtctaccatgca

SEQ ID NO: 29444 - DNA, 25 bp, Homo sapiens
gtggggtctaccatgcaattttctt

SEQ ID NO: 29445 - DNA, 25 bp, Homo sapiens
aaggaatacaaattttctccttcat

SEQ ID NO: 29446 - DNA, 25 bp, Homo sapiens
ttctccttcatcacttaggtgtttt

SEQ ID NO: 29447 - DNA, 25 bp, Homo sapiens
ttcttaaaacatttccctgagccag

SEQ ID NO: 29448 - DNA, 25 bp, Homo sapiens
tttccctgagccagtaaacagtagt

SEQ ID NO: 29449 - DNA, 25 bp, Homo sapiens
atcattggtcttttcaaaactaggt

SEQ ID NO: 29450 - DNA, 25 bp, Homo sapiens
gagacatatatgatattgctgttat

SEQ ID NO: 29451 - DNA, 25 bp, Homo sapiens
atatcaataacatggcacaacaaga

SEQ ID NO: 29452 - DNA, 25 bp, Homo sapiens
ctactcctttgctccatagtgttaa

SEQ ID NO: 29453 - DNA, 25 bp, Homo sapiens
atagtgttaacctactctcggagct

SEQ ID NO: 29454 - DNA, 25 bp, Homo sapiens
agctgcctccatgggcacagtaaag

SEQ ID NO: 29455 - DNA, 25 bp, Homo sapiens
tgagctgaagtccttcatcctgcag

SEQ ID NO: 29456 - DNA, 25 bp, Homo sapiens
cccccaagaagctgatccgatacat

SEQ ID NO: 29457 - DNA, 25 bp, Homo sapiens
atccgatacatcgacaaccaggtag

SEQ ID NO: 29458 - DNA, 25 bp, Homo sapiens
caaagatgtgcggaaccctgaggcc

SEQ ID NO: 29459 - DNA, 25 bp, Homo sapiens
gaaggccacatacatcaacctcaag

SEQ ID NO: 29460 - DNA, 25 bp, Homo sapiens
gccagaaagtaccgcttccattgag

SEQ ID NO: 29461 - DNA, 25 bp, Homo sapiens
tctgcccgagccttctaggctcaga

SEQ ID NO: 29462 - DNA, 25 bp, Homo sapiens
ccttctaggctcagatcccagaggg

SEQ ID NO: 29463 - DNA, 25 bp, Homo sapiens
ttacggtttctgccggatgaggccc

SEQ ID NO: 29464 - DNA, 25 bp, Homo sapiens
tcgtcgtggttttccttgtagttcg

SEQ ID NO: 29465 - DNA, 25 bp, Homo sapiens
gtttgcatcgccagcttctatatat

SEQ ID NO: 29466 - DNA, 25 bp, Homo sapiens
gcttctatatattacggcctttttt

SEQ ID NO: 29467 - DNA, 25 bp, Homo sapiens
tccttgtagttcgtggtctgagacc

SEQ ID NO: 29468 - DNA, 25 bp, Homo sapiens
aaaacgtgaagactacctgtatgct

SEQ ID NO: 29469 - DNA, 25 bp, Homo sapiens
acctgtatgctgtgagggaccgtga

SEQ ID NO: 29470 - DNA, 25 bp, Homo sapiens
ggtctgagaccaggcctcaagtgga

SEQ ID NO: 29471 - DNA, 25 bp, Homo sapiens
aattccatccaatacgttgaagtct

SEQ ID NO: 29472 - DNA, 25 bp, Homo sapiens
aaatgcttgctccagtttcactgat

SEQ ID NO: 29473 - DNA, 25 bp, Homo sapiens
tttcactgatacctgctgtttctga

SEQ ID NO: 29474 - DNA, 25 bp, Homo sapiens
ggcagacgtggaaggactttgaggt

SEQ ID NO: 29475 - DNA, 25 bp, Homo sapiens
actttgaggtccggcatggcaatga

SEQ ID NO: 29476 - DNA, 25 bp, Homo sapiens
aggtccggcatggcaatgaggacac

SEQ ID NO: 29477 - DNA, 25 bp, Homo sapiens
gacaccatcaaggaaatgctgcgta

SEQ ID NO: 29478 - DNA, 25 bp, Homo sapiens
aatgctgcgtatccggcgcagcgtg

SEQ ID NO: 29479 - DNA, 25 bp, Homo sapiens
agatgctcaaggtctcgggcatccc

SEQ ID NO: 29480 - DNA, 25 bp, Homo sapiens
tgggcagagtggcatggacgacatg

SEQ ID NO: 29481 - DNA, 25 bp, Homo sapiens
acctggagcccaacgaggttcggct

SEQ ID NO: 29482 - DNA, 25 bp, Homo sapiens
ccaacgaggttcggctggagcagca

SEQ ID NO: 29483 - DNA, 25 bp, Homo sapiens
cagccgcagtgtttgggagcctgaa

SEQ ID NO: 29484 - DNA, 25 bp, Homo sapiens
ccatccccaatacagctacgtttgt

SEQ ID NO: 29485 - DNA, 25 bp, Homo sapiens
atgtaccatgactggcggctggtgc

SEQ ID NO: 29486 - DNA, 25 bp, Homo sapiens
ctccgggccatgattatcgcagaac

SEQ ID NO: 29487 - DNA, 25 bp, Homo sapiens
tggagacacaagcaccgaggagccc

SEQ ID NO: 29488 - DNA, 25 bp, Homo sapiens
gcatggaaccctgggattaccctgc

SEQ ID NO: 29489 - DNA, 25 bp, Homo sapiens
gccagaaccagcgggtggccttagg

SEQ ID NO: 29490 - DNA, 25 bp, Homo sapiens
ggcagtggggaccttattgatgaaa

SEQ ID NO: 29491 - DNA, 25 bp, Homo sapiens
agtctgcctctcggagcagggagct

SEQ ID NO: 29492 - DNA, 25 bp, Homo sapiens
gacgtgttctgagggtctgcatctt

SEQ ID NO: 29493 - DNA, 25 bp, Homo sapiens
tctgcatcttaggggggagggctgg

SEQ ID NO: 29494 - DNA, 25 bp, Homo sapiens
tggggaaagcgggaagcgctcgctc

SEQ ID NO: 29495 - DNA, 25 bp, Homo sapiens
ctctctgcctggatcccggcagaag

SEQ ID NO: 29496 - DNA, 25 bp, Homo sapiens
aactcaccatgggcggataacactg

SEQ ID NO: 29497 - DNA, 25 bp, Homo sapiens
ttcaccagctgatgacacttccaaa

SEQ ID NO: 29498 - DNA, 25 bp, Homo sapiens
gtggaagccggtgtctgtgttacca

SEQ ID NO: 29499 - DNA, 25 bp, Homo sapiens
accagcttcgaggcgcggtgatgat

SEQ ID NO: 29500 - DNA, 25 bp, Homo sapiens
ggcgcggtgatgattgtttacccca

SEQ ID NO: 29501 - DNA, 25 bp, Homo sapiens
tgtttaccccatggggttgccaccg

SEQ ID NO: 29502 - DNA, 25 bp, Homo sapiens
gtatgatcccatccgcatggagttt

SEQ ID NO: 29503 - DNA, 25 bp, Homo sapiens
ggaagacttgtcgggaacacaggca

SEQ ID NO: 29504 - DNA, 25 bp, Homo sapiens
aacacaggcagggctcaacgtcatt

SEQ ID NO: 29505 - DNA, 25 bp, Homo sapiens
gaagaagctttcagactacgtgggg

SEQ ID NO: 29506 - DNA, 25 bp, Homo sapiens
tccagcccgagagcctattattagc

SEQ ID NO: 29507 - DNA, 25 bp, Homo sapiens
tgtctgccctgttaaacttggtgcc

SEQ ID NO: 29508 - DNA, 25 bp, Homo sapiens
ttggtgcccattaacagtgtttaca

SEQ ID NO: 29509 - DNA, 25 bp, Homo sapiens
gtgtttacactgttcatcgtgcctg

SEQ ID NO: 29510 - DNA, 25 bp, Homo sapiens
gttcatcgtgcctgttaatgtagtt

SEQ ID NO: 29511 - DNA, 25 bp, Homo sapiens
gtttaatgtagtcctagtgctcttg

SEQ ID NO: 29512 - DNA, 25 bp, Homo sapiens
tagtgctcttgaaatggtgcccctt

SEQ ID NO: 29513 - DNA, 25 bp, Homo sapiens
atgtcaagtttcctgttacactatg

SEQ ID NO: 29514 - DNA, 25 bp, Homo sapiens
gaaacatcagacatcattgcgtgta

SEQ ID NO: 29515 - DNA, 25 bp, Homo sapiens
gcgtgtacagaccttttgcatgggt

SEQ ID NO: 29516 - DNA, 25 bp, Homo sapiens
gagtgagtgctgtgaacggtgtgaa

SEQ ID NO: 29517 - DNA, 25 bp, Homo sapiens
gtcttcatctctgcaataaactaaa

SEQ ID NO: 29518 - DNA, 25 bp, Homo sapiens
tggtaaggtggtctacacctccctg

SEQ ID NO: 29519 - DNA, 25 bp, Homo sapiens
gtcggcagcaagagcctttctggat

SEQ ID NO: 29520 - DNA, 25 bp, Homo sapiens
gctcttctctgggagtctagaacat

SEQ ID NO: 29521 - DNA, 25 bp, Homo sapiens
gattccaggttttcgaacactacat

SEQ ID NO: 29522 - DNA, 25 bp, Homo sapiens
atgttcttccttgtttcaaagcact

SEQ ID NO: 29523 - DNA, 25 bp, Homo sapiens
ctattttcacactgtgagcttcccg

SEQ ID NO: 29524 - DNA, 25 bp, Homo sapiens
acagggtttaagtctcaggaggtct

SEQ ID NO: 29525 - DNA, 25 bp, Homo sapiens
ctcagtgcggctggcaagttcggag

SEQ ID NO: 29526 - DNA, 25 bp, Homo sapiens
ccattatatcgctcagtgctgggcc

SEQ ID NO: 29527 - DNA, 25 bp, Homo sapiens
aaccagcgtcagaaagaccctgctc

SEQ ID NO: 29528 - DNA, 25 bp, Homo sapiens
gttctccgcagcctgatggtaaggt

SEQ ID NO: 29529 - DNA, 25 bp, Homo sapiens
agttgcactatttccagttgcctct

SEQ ID NO: 29530 - DNA, 25 bp, Homo sapiens
tgtctagtcctttgcgaatttctct

SEQ ID NO: 29531 - DNA, 25 bp, Homo sapiens
ggcacagttatgaagtttccccaca

SEQ ID NO: 29532 - DNA, 25 bp, Homo sapiens
gtgggtctattcttcattagctcag

SEQ ID NO: 29533 - DNA, 25 bp, Homo sapiens
ttagctcagtgacttgtccacactc

SEQ ID NO: 29534 - DNA, 25 bp, Homo sapiens
ccacactcgtcttagcacttacgtt

SEQ ID NO: 29535 - DNA, 25 bp, Homo sapiens
gtcacaaacccttggagtcattccc

SEQ ID NO: 29536 - DNA, 25 bp, Homo sapiens
tggagatttaggtgctgctcttgct

SEQ ID NO: 29537 - DNA, 25 bp, Homo sapiens
tggatggcttgaaggctcctgggcc

SEQ ID NO: 29538 - DNA, 25 bp, Homo sapiens
gaagagctcctattttgtactcctg

SEQ ID NO: 29539 - DNA, 25 bp, Homo sapiens
gtactcctggctagaatgctggtgg

SEQ ID NO: 29540 - DNA, 25 bp, Homo sapiens
gagctgacaacacttttccatgacc

SEQ ID NO: 29541 - DNA, 25 bp, Homo sapiens
taggtcactgtctacactgggtaca

SEQ ID NO: 29542 - DNA, 25 bp, Homo sapiens
tgatgctggtgctcaggcacctctg

SEQ ID NO: 29543 - DNA, 25 bp, Homo sapiens
tgcctttgtatcttgtaccttttca

SEQ ID NO: 29544 - DNA, 25 bp, Homo sapiens
tggaatgagggtccaggcctgtcaa

SEQ ID NO: 29545 - DNA, 25 bp, Homo sapiens
attaggcagggtctgtcctgtggcc

SEQ ID NO: 29546 - DNA, 25 bp, Homo sapiens
cctgtggccacctggaaagtcccag

SEQ ID NO: 29547 - DNA, 25 bp, Homo sapiens
gactcttctggggacacttggggtc

SEQ ID NO: 29548 - DNA, 25 bp, Homo sapiens
acacttggggtccacaatcccaggt

SEQ ID NO: 29549 - DNA, 25 bp, Homo sapiens
aatcccaggtccatactctaggttt

SEQ ID NO: 29550 - DNA, 25 bp, Homo sapiens
gtatgtatgtttacctgtgcctaat

SEQ ID NO: 29551 - DNA, 25 bp, Homo sapiens
gtttattccagcgatgtgacttttt

SEQ ID NO: 29552 - DNA, 25 bp, Homo sapiens
agagtctggggctgtgtgttgagca

SEQ ID NO: 29553 - DNA, 25 bp, Homo sapiens
gatgctagacactcatttagtgccc

SEQ ID NO: 29554 - DNA, 25 bp, Homo sapiens
tttagtgcccagggagtccagcgaa

SEQ ID NO: 29555 - DNA, 25 bp, Homo sapiens
gtccagcgaatgacgtctgtggcca

SEQ ID NO: 29556 - DNA, 25 bp, Homo sapiens
ggccaagcgaggtctcaggtgcaaa

SEQ ID NO: 29557 - DNA, 25 bp, Homo sapiens
gagtgttttgagccatggccacgtt

SEQ ID NO: 29558 - DNA, 25 bp, Homo sapiens
ggccacgttgtcattgtgagtctat

SEQ ID NO: 29559 - DNA, 25 bp, Homo sapiens
gtctatagcttgactccttggagaa

SEQ ID NO: 29560 - DNA, 25 bp, Homo sapiens
atctgtcctgttactttctggtcat

SEQ ID NO: 29561 - DNA, 25 bp, Homo sapiens
catcccaggttctgacttttaccag

SEQ ID NO: 29562 - DNA, 25 bp, Homo sapiens
aatatccttcgttataaccacaatg

SEQ ID NO: 29563 - DNA, 25 bp, Homo sapiens
attagtgttcagtgccattttatac

SEQ ID NO: 29564 - DNA, 25 bp, Homo sapiens
ccattttatactttctctctgtgtt

SEQ ID NO: 29565 - DNA, 25 bp, Homo sapiens
ctctgtattgtactaaccaacctcc

SEQ ID NO: 29566 - DNA, 25 bp, Homo sapiens
agatgaagtctcaccttccagtttg

SEQ ID NO: 29567 - DNA, 25 bp, Homo sapiens
tttgctttctcattagttttttcca

SEQ ID NO: 29568 - DNA, 25 bp, Homo sapiens
ttctcataatgaatcctctcaggac

SEQ ID NO: 29569 - DNA, 25 bp, Homo sapiens
tcctctcaggacattgtgtagccta

SEQ ID NO: 29570 - DNA, 25 bp, Homo sapiens
gagctttattatcagtttaaccctc

SEQ ID NO: 29571 - DNA, 25 bp, Homo sapiens
cagtttaaccctccctagttgaatg

SEQ ID NO: 29572 - DNA, 25 bp, Homo sapiens
attttcttcttgttccattaagtca

SEQ ID NO: 29573 - DNA, 25 bp, Homo sapiens
gcgtgttctcctacgtgaaggtggc

SEQ ID NO: 29574 - DNA, 25 bp, Homo sapiens
ccggccggcattgctggcagccggc

SEQ ID NO: 29575 - DNA, 25 bp, Homo sapiens
catctatcacgtgttccacagcaga

SEQ ID NO: 29576 - DNA, 25 bp, Homo sapiens
cagaaaggactgtgcagacccctgt

SEQ ID NO: 29577 - DNA, 25 bp, Homo sapiens
actcctgagcctgggcaggtgggga

SEQ ID NO: 29578 - DNA, 25 bp, Homo sapiens
gacacctacacactccataggagat

SEQ ID NO: 29579 - DNA, 25 bp, Homo sapiens
gagatcctggctttccagggtgggc

SEQ ID NO: 29580 - DNA, 25 bp, Homo sapiens
ggagcaggcttggagccagggacca

SEQ ID NO: 29581 - DNA, 25 bp, Homo sapiens
ccagggaccagtgggggctgtaggg

SEQ ID NO: 29582 - DNA, 25 bp, Homo sapiens
ggctgtagggtaagcccctgagcct

SEQ ID NO: 29583 - DNA, 25 bp, Homo sapiens
gagcctgggacctacatgtggtttg

SEQ ID NO: 29584 - DNA, 25 bp, Homo sapiens
tgcggcccatcactatggagctcaa

SEQ ID NO: 29585 - DNA, 25 bp, Homo sapiens
caaggaatttatgctctgccgctgg

SEQ ID NO: 29586 - DNA, 25 bp, Homo sapiens
actggccagcagttatttcgtcact

SEQ ID NO: 29587 - DNA, 25 bp, Homo sapiens
cagatcgacctttaccggagaatcc

SEQ ID NO: 29588 - DNA, 25 bp, Homo sapiens
ggagaatccctatcactcaagacca

SEQ ID NO: 29589 - DNA, 25 bp, Homo sapiens
actcaagaccaagaccggatcccag

SEQ ID NO: 29590 - DNA, 25 bp, Homo sapiens
gatcgagggagatctgcagcctgcc

SEQ ID NO: 29591 - DNA, 25 bp, Homo sapiens
catggcagccgcttttatttctgga

SEQ ID NO: 29592 - DNA, 25 bp, Homo sapiens
taaagatgggtccgtggcccacact

SEQ ID NO: 29593 - DNA, 25 bp, Homo sapiens
acactcggtcatgtgctcagacaac

SEQ ID NO: 29594 - DNA, 25 bp, Homo sapiens
gaaaacgcccatgcggtttgcatcg

SEQ ID NO: 29595 - DNA, 25 bp, Homo sapiens
ggagctagccttgttttttgcatct

SEQ ID NO: 29596 - DNA, 25 bp, Homo sapiens
tttctcactcccatacatttatatt

SEQ ID NO: 29597 - DNA, 25 bp, Homo sapiens
tccccactaaatttcttgttcctca

SEQ ID NO: 29598 - DNA, 25 bp, Homo sapiens
ccagttgtggctcaaatcctctata

SEQ ID NO: 29599 - DNA, 25 bp, Homo sapiens
ctttcagctcctttgtttcatacgg

SEQ ID NO: 29600 - DNA, 25 bp, Homo sapiens
cctgagtaatccttttagagcccga

SEQ ID NO: 29601 - DNA, 25 bp, Homo sapiens
gagtcaaaaccctcaatgttccctc

SEQ ID NO: 29602 - DNA, 25 bp, Homo sapiens
tcctgccccatgtcaacaaatttca

SEQ ID NO: 29603 - DNA, 25 bp, Homo sapiens
ttcaggctaaggatgccccagaccc

SEQ ID NO: 29604 - DNA, 25 bp, Homo sapiens
ataggaggagacgtccagctctgtc

SEQ ID NO: 29605 - DNA, 25 bp, Homo sapiens
aggactttctccacattgttttgta

SEQ ID NO: 29606 - DNA, 25 bp, Homo sapiens
cttcacgggccacaaggactggatg

SEQ ID NO: 29607 - DNA, 25 bp, Homo sapiens
acaagtgtgtgtgcctattgaccgc

SEQ ID NO: 29608 - DNA, 25 bp, Homo sapiens
tgatctgtggagaccgtcaggccaa

SEQ ID NO: 29609 - DNA, 25 bp, Homo sapiens
gtgctgattctggctgatggggacc

SEQ ID NO: 29610 - DNA, 25 bp, Homo sapiens
tgagtaccctccgacggttggaaga

SEQ ID NO: 29611 - DNA, 25 bp, Homo sapiens
agaccaggccactgcatatgtgtgt

SEQ ID NO: 29612 - DNA, 25 bp, Homo sapiens
gtgagaatcaagcctgctcagtgcc

SEQ ID NO: 29613 - DNA, 25 bp, Homo sapiens
atcactgatccctgcgaattacgaa

SEQ ID NO: 29614 - DNA, 25 bp, Homo sapiens
aaaactactacatccatgactgccc

SEQ ID NO: 29615 - DNA, 25 bp, Homo sapiens
gaagcatcccaactgactagagact

SEQ ID NO: 29616 - DNA, 25 bp, Homo sapiens
cacccactcaccctagaataaactt

SEQ ID NO: 29617 - DNA, 25 bp, Homo sapiens
ttaatcccatgcatgccaaacactt

SEQ ID NO: 29618 - DNA, 25 bp, Homo sapiens
atcgtgtccctgccgcagaatatgt

SEQ ID NO: 29619 - DNA, 25 bp, Homo sapiens
ctaattgctgtggccaagcgcctgt

SEQ ID NO: 29620 - DNA, 25 bp, Homo sapiens
ccgctccgtgtaacctaagtgcgct

SEQ ID NO: 29621 - DNA, 25 bp, Homo sapiens
taagtgcgctgcaggcaaagcccag

SEQ ID NO: 29622 - DNA, 25 bp, Homo sapiens
gctgcgtcactactgatgttcacga

SEQ ID NO: 29623 - DNA, 25 bp, Homo sapiens
tgatgttcacgatgccacacagtca

SEQ ID NO: 29624 - DNA, 25 bp, Homo sapiens
gtcacacacctaattcattctcaag

SEQ ID NO: 29625 - DNA, 25 bp, Homo sapiens
aagtcggagcaacacataccaacct

SEQ ID NO: 29626 - DNA, 25 bp, Homo sapiens
agccgtgcgtgtatctcaaggaact

SEQ ID NO: 29627 - DNA, 25 bp, Homo sapiens
taagatgacgctactcctcatagca

SEQ ID NO: 29628 - DNA, 25 bp, Homo sapiens
ggctgcaggcagtctactggcagga

SEQ ID NO: 29629 - DNA, 25 bp, Homo sapiens
tcagtgctgatgccatgccaactgc

SEQ ID NO: 29630 - DNA, 25 bp, Homo sapiens
ggtgtagaccagccctgggatttcc

SEQ ID NO: 29631 - DNA, 25 bp, Homo sapiens
ctgtgactgggccagggcacacgtt

SEQ ID NO: 29632 - DNA, 25 bp, Homo sapiens
cggcagtggctgtaaggtcaccttc

SEQ ID NO: 29633 - DNA, 25 bp, Homo sapiens
atggcatccacgcatgggatctgca

SEQ ID NO: 29634 - DNA, 25 bp, Homo sapiens
atgggatctgcaagctggagccctc

SEQ ID NO: 29635 - DNA, 25 bp, Homo sapiens
gacagactgggctgaggctgacagg

SEQ ID NO: 29636 - DNA, 25 bp, Homo sapiens
tctgcacacgcaggttctgggcgac

SEQ ID NO: 29637 - DNA, 25 bp, Homo sapiens
catctctgcactaactcatctgaat

SEQ ID NO: 29638 - DNA, 25 bp, Homo sapiens
ggtggcagtcttggtcagtagttta

SEQ ID NO: 29639 - DNA, 25 bp, Homo sapiens
tcacctcggcgtactatcgtggtgc

SEQ ID NO: 29640 - DNA, 25 bp, Homo sapiens
tgaccatgctgaagccacgatcgtc

SEQ ID NO: 29641 - DNA, 25 bp, Homo sapiens
cacgatcgtcgtcatgctcgtgggt

SEQ ID NO: 29642 - DNA, 25 bp, Homo sapiens
aacaaaagtgacctcagccaggccc

SEQ ID NO: 29643 - DNA, 25 bp, Homo sapiens
cactgaggaggcccgaatgttcgct

SEQ ID NO: 29644 - DNA, 25 bp, Homo sapiens
agccctggactctaccaatgttgag

SEQ ID NO: 29645 - DNA, 25 bp, Homo sapiens
tgttgagctagcctttgagactgtc

SEQ ID NO: 29646 - DNA, 25 bp, Homo sapiens
agaacagcatccggaccaatgccat

SEQ ID NO: 29647 - DNA, 25 bp, Homo sapiens
caatgccatcactctgggcagtgcc

SEQ ID NO: 29648 - DNA, 25 bp, Homo sapiens
ggttccagatatcagactgttccct

SEQ ID NO: 29649 - DNA, 25 bp, Homo sapiens
gcaccctcagggtcttaaggtcttc

SEQ ID NO: 29650 - DNA, 25 bp, Homo sapiens
gatgcctgttgcaaagtggaccatg

SEQ ID NO: 29651 - DNA, 25 bp, Homo sapiens
tggaccatggtctagcagtagcatc

SEQ ID NO: 29652 - DNA, 25 bp, Homo sapiens
atggtctagcagtagcatcagtgtc

SEQ ID NO: 29653 - DNA, 25 bp, Homo sapiens
ctagcagtagcatcagtgtcaagga

SEQ ID NO: 29654 - DNA, 25 bp, Homo sapiens
aacacccactacttagcagactggg

SEQ ID NO: 29655 - DNA, 25 bp, Homo sapiens
ccactacttagcagactgggaaaag

SEQ ID NO: 29656 - DNA, 25 bp, Homo sapiens
gaaagtactaaatgtctgatatgca

SEQ ID NO: 29657 - DNA, 25 bp, Homo sapiens
ggacacatgacccatgtgaccttac

SEQ ID NO: 29658 - DNA, 25 bp, Homo sapiens
cacatgacccatgtgaccttaccta

SEQ ID NO: 29659 - DNA, 25 bp, Homo sapiens
catgtgaccttacctattattggag

SEQ ID NO: 29660 - DNA, 25 bp, Homo sapiens
attggagatggttcacattccttac

SEQ ID NO: 29661 - DNA, 25 bp, Homo sapiens
tccctggacaactccgagcagaagt

SEQ ID NO: 29662 - DNA, 25 bp, Homo sapiens
ggacaactccgagcagaagtgcatc

SEQ ID NO: 29663 - DNA, 25 bp, Homo sapiens
caactccgagcagaagtgcatcgcc

SEQ ID NO: 29664 - DNA, 25 bp, Homo sapiens
actccgagcagaagtgcatcgccat

SEQ ID NO: 29665 - DNA, 25 bp, Homo sapiens
gcccaagtcagcctcatattctggg

SEQ ID NO: 29666 - DNA, 25 bp, Homo sapiens
agcctcatattctgggcggacagct

SEQ ID NO: 29667 - DNA, 25 bp, Homo sapiens
cctcatattctgggcggacagcttg

SEQ ID NO: 29668 - DNA, 25 bp, Homo sapiens
tattctgggcggacagcttgtctgg

SEQ ID NO: 29669 - DNA, 25 bp, Homo sapiens
ttctgggcggacagcttgtctggac

SEQ ID NO: 29670 - DNA, 25 bp, Homo sapiens
ttgggggtggtcagacaccacagga

SEQ ID NO: 29671 - DNA, 25 bp, Homo sapiens
ggggtggtcagacaccacaggagct

SEQ ID NO: 29672 - DNA, 25 bp, Homo sapiens
aaggctatcctcctgaagacatctt

SEQ ID NO: 29673 - DNA, 25 bp, Homo sapiens
gaagacatctttaatctagtgggca

SEQ ID NO: 29674 - DNA, 25 bp, Homo sapiens
gtgggcaagaaggtcctggtcactg

SEQ ID NO: 29675 - DNA, 25 bp, Homo sapiens
gaaggtcctggtcactgttgaagag

SEQ ID NO: 29676 - DNA, 25 bp, Homo sapiens
ctttcctgacattcccatagggtat

SEQ ID NO: 29677 - DNA, 25 bp, Homo sapiens
agcgatatctgtggccgcagtggct

SEQ ID NO: 29678 - DNA, 25 bp, Homo sapiens
ggctctgggggccaaggtgttggaa

SEQ ID NO: 29679 - DNA, 25 bp, Homo sapiens
ggaacgtcacataactttggacaag

SEQ ID NO: 29680 - DNA, 25 bp, Homo sapiens
gagcctggagaactggccgagctgg

SEQ ID NO: 29681 - DNA, 25 bp, Homo sapiens
aattccggaaggcaccattctaaca

SEQ ID NO: 29682 - DNA, 25 bp, Homo sapiens
ttctaacaatggacatgctcaccgt

SEQ ID NO: 29683 - DNA, 25 bp, Homo sapiens
tggcaaggagcggcccgaagtggtc

SEQ ID NO: 29684 - DNA, 25 bp, Homo sapiens
agatgtgcgcatgatcgactttgca

SEQ ID NO: 29685 - DNA, 25 bp, Homo sapiens
accacctgcaggctgtatggcgagg

SEQ ID NO: 29686 - DNA, 25 bp, Homo sapiens
gtatggcgaggacaccgtggtgcat

SEQ ID NO: 29687 - DNA, 25 bp, Homo sapiens
caggatgctggctatatcttcgggc

SEQ ID NO: 29688 - DNA, 25 bp, Homo sapiens
agagtggggagtgagcttgctagct

SEQ ID NO: 29689 - DNA, 25 bp, Homo sapiens
ttgctagctgctccagtacttgaga

SEQ ID NO: 29690 - DNA, 25 bp, Homo sapiens
acttgagagcgactctgtgtcccag

SEQ ID NO: 29691 - DNA, 25 bp, Homo sapiens
gcggcagccacgaagccagtatggc

SEQ ID NO: 29692 - DNA, 25 bp, Homo sapiens
agctgtgcttggagtctttatttat

SEQ ID NO: 29693 - DNA, 25 bp, Homo sapiens
acctctttcttccctgagtgtatat

SEQ ID NO: 29694 - DNA, 25 bp, Homo sapiens
gagaagaccgtgagttgatgccagt

SEQ ID NO: 29695 - DNA, 25 bp, Homo sapiens
tgatgccagttatcatgctgccact

SEQ ID NO: 29696 - DNA, 25 bp, Homo sapiens
gctgccactacatcgttatctggag

SEQ ID NO: 29697 - DNA, 25 bp, Homo sapiens
ttatctggaggcaacttctggtggt

SEQ ID NO: 29698 - DNA, 25 bp, Homo sapiens
acgctgatggcttggcagagcacct

SEQ ID NO: 29699 - DNA, 25 bp, Homo sapiens
ggcagagcaccttcggttaacttgc

SEQ ID NO: 29700 - DNA, 25 bp, Homo sapiens
tcggttaacttgcatctccagattg

SEQ ID NO: 29701 - DNA, 25 bp, Homo sapiens
gattactcaagcagacagcacacga

SEQ ID NO: 29702 - DNA, 25 bp, Homo sapiens
tttttctcctaatatgctgtttcca

SEQ ID NO: 29703 - DNA, 25 bp, Homo sapiens
cacagcagctcctttgtaagtacca

SEQ ID NO: 29704 - DNA, 25 bp, Homo sapiens
tgtaagtaccaggtcatgtccatcc

SEQ ID NO: 29705 - DNA, 25 bp, Homo sapiens
ttcttttatgtttactgtttatgtg

SEQ ID NO: 29706 - DNA, 25 bp, Homo sapiens
ataaggctcttggatgtataacata

SEQ ID NO: 29707 - DNA, 25 bp, Homo sapiens
aaagctgttacactttctctgatct

SEQ ID NO: 29708 - DNA, 25 bp, Homo sapiens
tctctgatctgctgtgatccactga

SEQ ID NO: 29709 - DNA, 25 bp, Homo sapiens
gatccactgaaaatgtgctggggtt

SEQ ID NO: 29710 - DNA, 25 bp, Homo sapiens
gtttatgctgctggaacttagcact

SEQ ID NO: 29711 - DNA, 25 bp, Homo sapiens
ggaacttagcactgtcttgatttga

SEQ ID NO: 29712 - DNA, 25 bp, Homo sapiens
ttgagagccatttgaagcaatcttc

SEQ ID NO: 29713 - DNA, 25 bp, Homo sapiens
gacatgttcaattctgtaagtggtg

SEQ ID NO: 29714 - DNA, 25 bp, Homo sapiens
gtgactttttgagcacctttcagta

SEQ ID NO: 29715 - DNA, 25 bp, Homo sapiens
tgttgacacacagcttatatgtatt

SEQ ID NO: 29716 - DNA, 25 bp, Homo sapiens
gtgggtcctcttccataaattcagc

SEQ ID NO: 29717 - DNA, 25 bp, Homo sapiens
cagtaatctgcctcctagtgaaagt

SEQ ID NO: 29718 - DNA, 25 bp, Homo sapiens
gcaagtagtggatcacctatcccct

SEQ ID NO: 29719 - DNA, 25 bp, Homo sapiens
acctatcccctgtgtcaacaatgaa

SEQ ID NO: 29720 - DNA, 25 bp, Homo sapiens
gtgagacgtgccctgaaactgaaca

SEQ ID NO: 29721 - DNA, 25 bp, Homo sapiens
acagagatgcactctccagtgactc

SEQ ID NO: 29722 - DNA, 25 bp, Homo sapiens
tgactccccagcaaacacaaggtgc

SEQ ID NO: 29723 - DNA, 25 bp, Homo sapiens
ggtgcagcagggtcccaaaggtagc

SEQ ID NO: 29724 - DNA, 25 bp, Homo sapiens
atttcacatccacaggacggtcttg

SEQ ID NO: 29725 - DNA, 25 bp, Homo sapiens
taaattacgactccatgcttttctt

SEQ ID NO: 29726 - DNA, 25 bp, Homo sapiens
tgggacagaaccctactttttgtag

SEQ ID NO: 29727 - DNA, 25 bp, Homo sapiens
gttgtgttcttatgcttcagtgtca

SEQ ID NO: 29728 - DNA, 25 bp, Homo sapiens
ctaaatgatctacagccttggccta

SEQ ID NO: 29729 - DNA, 25 bp, Homo sapiens
atagcatgtggatctcgagctcatt

SEQ ID NO: 29730 - DNA, 25 bp, Homo sapiens
tcaattgctcagcgttcttacttcc

SEQ ID NO: 29731 - DNA, 25 bp, Homo sapiens
atgtatgggttccactttctggtgt

SEQ ID NO: 29732 - DNA, 25 bp, Homo sapiens
ttctggtgtggttcctttgtgtcaa

SEQ ID NO: 29733 - DNA, 25 bp, Homo sapiens
gagaagcagcttcacggacgttttc

SEQ ID NO: 29734 - DNA, 25 bp, Homo sapiens
ggacgttttcatctctacacgttga

SEQ ID NO: 29735 - DNA, 25 bp, Homo sapiens
gacctactttttatacgacttcgat

SEQ ID NO: 29736 - DNA, 25 bp, Homo sapiens
gacttcgatatttgactggtgcctg

SEQ ID NO: 29737 - DNA, 25 bp, Homo sapiens
gcctggaggcttgagcaaactcgga

SEQ ID NO: 29738 - DNA, 25 bp, Homo sapiens
agccattcgtgatgcttagaaccaa

SEQ ID NO: 29739 - DNA, 25 bp, Homo sapiens
gtacacaaagaccatcgagacggcc

SEQ ID NO: 29740 - DNA, 25 bp, Homo sapiens
tcgagacggccattcttgtttacaa

SEQ ID NO: 29741 - DNA, 25 bp, Homo sapiens
tttagtaagttcttctcatttcatt

SEQ ID NO: 29742 - DNA, 25 bp, Homo sapiens
ggtggctgcagagcaatacccaagc

SEQ ID NO: 29743 - DNA, 25 bp, Homo sapiens
gagcaatacccaagcctcatttgga

SEQ ID NO: 29744 - DNA, 25 bp, Homo sapiens
tgattaatcctcaattcatgtggcc

SEQ ID NO: 29745 - DNA, 25 bp, Homo sapiens
tgtggccttacgggatggtgggtct

SEQ ID NO: 29746 - DNA, 25 bp, Homo sapiens
ggtctgggaccccaattcattctta

SEQ ID NO: 29747 - DNA, 25 bp, Homo sapiens
gaagcacatcaaataccagcacccc

SEQ ID NO: 29748 - DNA, 25 bp, Homo sapiens
ggaaaacttttgtatccctaagcat

SEQ ID NO: 29749 - DNA, 25 bp, Homo sapiens
tgagcgtaactgtgtgggctcctcg

SEQ ID NO: 29750 - DNA, 25 bp, Homo sapiens
ctagactcggtcccgagacgttccg

SEQ ID NO: 29751 - DNA, 25 bp, Homo sapiens
gcagttccgctaccaggatgcggcg

SEQ ID NO: 29752 - DNA, 25 bp, Homo sapiens
cctgacatccgcaccaaggagcaga

SEQ ID NO: 29753 - DNA, 25 bp, Homo sapiens
atccgcaccaaggagcagatcgtgg

SEQ ID NO: 29754 - DNA, 25 bp, Homo sapiens
gcagatcgtggagatgctggtgcaa

SEQ ID NO: 29755 - DNA, 25 bp, Homo sapiens
tggtgcaagagcagctgctcgccat

SEQ ID NO: 29756 - DNA, 25 bp, Homo sapiens
gccgcacggatgtgcgcatcactgg

SEQ ID NO: 29757 - DNA, 25 bp, Homo sapiens
gcatcactggctgagcggtggagct

SEQ ID NO: 29758 - DNA, 25 bp, Homo sapiens
tgcggactggggccatgatcgggcc

SEQ ID NO: 29759 - DNA, 25 bp, Homo sapiens
ccaccccgtgttaatgaaaaatgag

SEQ ID NO: 29760 - DNA, 25 bp, Homo sapiens
gacattctaccaagaggacaacttt

SEQ ID NO: 29761 - DNA, 25 bp, Homo sapiens
gacaactttggttctggaactggtt

SEQ ID NO: 29762 - DNA, 25 bp, Homo sapiens
ggaactggtttctatttgtcaaatc

SEQ ID NO: 29763 - DNA, 25 bp, Homo sapiens
atacttttattattcccttgctcat

SEQ ID NO: 29764 - DNA, 25 bp, Homo sapiens
attcccttgctcatataactttaaa

SEQ ID NO: 29765 - DNA, 25 bp, Homo sapiens
gcagttaagcagtgccacactacag

SEQ ID NO: 29766 - DNA, 25 bp, Homo sapiens
atttctgaccctgtgtgttagagca

SEQ ID NO: 29767 - DNA, 25 bp, Homo sapiens
atgctctcctgctgttaaaaacaca

SEQ ID NO: 29768 - DNA, 25 bp, Homo sapiens
gttaagctgtggatttgtactcaat

SEQ ID NO: 29769 - DNA, 25 bp, Homo sapiens
attttcattcattgctttacatact

SEQ ID NO: 29770 - DNA, 25 bp, Homo sapiens
acatactagacatttttcttctctt

SEQ ID NO: 29771 - DNA, 25 bp, Homo sapiens
gccacaccttcgcgaaacctgtggt

SEQ ID NO: 29772 - DNA, 25 bp, Homo sapiens
gcccaccagtcctaacgggacagga

SEQ ID NO: 29773 - DNA, 25 bp, Homo sapiens
gctctgtgctttccactatacacag

SEQ ID NO: 29774 - DNA, 25 bp, Homo sapiens
acagtcaccgtcccaatgagaaaca

SEQ ID NO: 29775 - DNA, 25 bp, Homo sapiens
ggacagcgacattcagtcctgcact

SEQ ID NO: 29776 - DNA, 25 bp, Homo sapiens
cactgctcacctgggtttactgatg

SEQ ID NO: 29777 - DNA, 25 bp, Homo sapiens
caccatcctctctgatctgtgagaa

SEQ ID NO: 29778 - DNA, 25 bp, Homo sapiens
ctgctgtgacttccctttaggacaa

SEQ ID NO: 29779 - DNA, 25 bp, Homo sapiens
gacacaccgaagacctttatactgt

SEQ ID NO: 29780 - DNA, 25 bp, Homo sapiens
ttatactgtgatcttttaccccttt

SEQ ID NO: 29781 - DNA, 25 bp, Homo sapiens
ttcactcttggctttcttatgttgc

SEQ ID NO: 29782 - DNA, 25 bp, Homo sapiens
cagcagccctacgtggaggcgctgc

SEQ ID NO: 29783 - DNA, 25 bp, Homo sapiens
tcctacacgcgcatcaagaggccgc

SEQ ID NO: 29784 - DNA, 25 bp, Homo sapiens
cacgcgcatcaagaggccgcaggac

SEQ ID NO: 29785 - DNA, 25 bp, Homo sapiens
tcccgcgcatgctcatgaagctggt

SEQ ID NO: 29786 - DNA, 25 bp, Homo sapiens
cgcgcatgctcatgaagctggtgag

SEQ ID NO: 29787 - DNA, 25 bp, Homo sapiens
gatctgggacgtccacgagtgaggg

SEQ ID NO: 29788 - DNA, 25 bp, Homo sapiens
tcatcccttgggataagccccagtc

SEQ ID NO: 29789 - DNA, 25 bp, Homo sapiens
cttgggataagccccagtccaggtc

SEQ ID NO: 29790 - DNA, 25 bp, Homo sapiens
ctgcccagcgagtcttccagaaggg

SEQ ID NO: 29791 - DNA, 25 bp, Homo sapiens
cccagcgagtcttccagaaggggtg

SEQ ID NO: 29792 - DNA, 25 bp, Homo sapiens
cagaaggggtgaaagggttgcaggt

SEQ ID NO: 29793 - DNA, 25 bp, Homo sapiens
accagtggcaccgatcagctgggga

SEQ ID NO: 29794 - DNA, 25 bp, Homo sapiens
aggaagaggatggcccagtcctgac

SEQ ID NO: 29795 - DNA, 25 bp, Homo sapiens
atgagcagaagtcccgaatccaggc

SEQ ID NO: 29796 - DNA, 25 bp, Homo sapiens
aggccatgaagcccatgaccaagga

SEQ ID NO: 29797 - DNA, 25 bp, Homo sapiens
gtgggatgcccggcagagcatcatc

SEQ ID NO: 29798 - DNA, 25 bp, Homo sapiens
tcatccgcaaggtggtggaccctga

SEQ ID NO: 29799 - DNA, 25 bp, Homo sapiens
acaagcaagccacccgaggggactg

SEQ ID NO: 29800 - DNA, 25 bp, Homo sapiens
cgctggccaaggcctgtggacgacg

SEQ ID NO: 29801 - DNA, 25 bp, Homo sapiens
gcctgggcaggtttcagggtgccag

SEQ ID NO: 29802 - DNA, 25 bp, Homo sapiens
aagcctgatgggtgctggtggcctt

SEQ ID NO: 29803 - DNA, 25 bp, Homo sapiens
gcacccccatctgaaagagcagcac

SEQ ID NO: 29804 - DNA, 25 bp, Homo sapiens
ggagatgagctggtttggccttggg

SEQ ID NO: 29805 - DNA, 25 bp, Homo sapiens
ggccgctgaagctgtaggaagcgcc

SEQ ID NO: 29806 - DNA, 25 bp, Homo sapiens
ctgtaggaagcgccattcttccctg

SEQ ID NO: 29807 - DNA, 25 bp, Homo sapiens
ttcttccctgtatctaactggggct

SEQ ID NO: 29808 - DNA, 25 bp, Homo sapiens
actggggctgtgatcaagaaggttc

SEQ ID NO: 29809 - DNA, 25 bp, Homo sapiens
aagaaggttctgaccagcttctgca

SEQ ID NO: 29810 - DNA, 25 bp, Homo sapiens
aatcattgtctctggaggcaatttg

SEQ ID NO: 29811 - DNA, 25 bp, Homo sapiens
taaatcaacatctgtataccccctt

SEQ ID NO: 29812 - DNA, 25 bp, Homo sapiens
aagcactgttaccaatttagcatat

SEQ ID NO: 29813 - DNA, 25 bp, Homo sapiens
agcatatgtccttgcagaatttttt

SEQ ID NO: 29814 - DNA, 25 bp, Homo sapiens
gaatcattactctatgttgttttac

SEQ ID NO: 29815 - DNA, 25 bp, Homo sapiens
gaaggagagctacctcctaagggtt

SEQ ID NO: 29816 - DNA, 25 bp, Homo sapiens
ctaagggttttaacgtctctgacat

SEQ ID NO: 29817 - DNA, 25 bp, Homo sapiens
gtctctgacatacaggcacactgac

SEQ ID NO: 29818 - DNA, 25 bp, Homo sapiens
cactgacctgatttccgaaggctga

SEQ ID NO: 29819 - DNA, 25 bp, Homo sapiens
tgatgccttgatactgagacttggg

SEQ ID NO: 29820 - DNA, 25 bp, Homo sapiens
agaaatggttgacagcgttcccacc

SEQ ID NO: 29821 - DNA, 25 bp, Homo sapiens
ttcccacccatctacaatgttattt

SEQ ID NO: 29822 - DNA, 25 bp, Homo sapiens
aagtcttttttcttagattgcgcta

SEQ ID NO: 29823 - DNA, 25 bp, Homo sapiens
atttcttagattgttcagcgctcag

SEQ ID NO: 29824 - DNA, 25 bp, Homo sapiens
tgagctttaagtgcctgtcgttctg

SEQ ID NO: 29825 - DNA, 25 bp, Homo sapiens
agcactgctttgaggcccaagcact

SEQ ID NO: 29826 - DNA, 25 bp, Homo sapiens
tcatccacatgctcatgcaggcgta

SEQ ID NO: 29827 - DNA, 25 bp, Homo sapiens
gaggtttgctgcggaagggctacgg

SEQ ID NO: 29828 - DNA, 25 bp, Homo sapiens
cctttaccgtctcacgcaggataag

SEQ ID NO: 29829 - DNA, 25 bp, Homo sapiens
taagaagtacctctaccgagcttgc

SEQ ID NO: 29830 - DNA, 25 bp, Homo sapiens
attacggagcacacgggtgccgcat

SEQ ID NO: 29831 - DNA, 25 bp, Homo sapiens
cagaccctattcgctctttgaaggc

SEQ ID NO: 29832 - DNA, 25 bp, Homo sapiens
tgaaggcatggctggcgctattcac

SEQ ID NO: 29833 - DNA, 25 bp, Homo sapiens
agagacatcacggtttccagcattt

SEQ ID NO: 29834 - DNA, 25 bp, Homo sapiens
aagccgccagattgcttagtgcctg

SEQ ID NO: 29835 - DNA, 25 bp, Homo sapiens
agcatgagtgaccgaagccatccat

SEQ ID NO: 29836 - DNA, 25 bp, Homo sapiens
tcaacattttctaacagcaccctca

SEQ ID NO: 29837 - DNA, 25 bp, Homo sapiens
ggaccaggtcagtgggatccctggc

SEQ ID NO: 29838 - DNA, 25 bp, Homo sapiens
gtccatgcaagcggcttcattggcg

SEQ ID NO: 29839 - DNA, 25 bp, Homo sapiens
ccgacccgagagggtgccttgagca

SEQ ID NO: 29840 - DNA, 25 bp, Homo sapiens
cacgagttgctcgacttaatcctac

SEQ ID NO: 29841 - DNA, 25 bp, Homo sapiens
tcaagcgtgcaatggatctggttca

SEQ ID NO: 29842 - DNA, 25 bp, Homo sapiens
gattagatttctaccaacacagctg

SEQ ID NO: 29843 - DNA, 25 bp, Homo sapiens
cagcgattccaggtggacccaagtg

SEQ ID NO: 29844 - DNA, 25 bp, Homo sapiens
actggcgaaaggtgcatgtccctgg

SEQ ID NO: 29845 - DNA, 25 bp, Homo sapiens
atgtccctggaaggagcatctctac

SEQ ID NO: 29846 - DNA, 25 bp, Homo sapiens
catctctaccacctggaatctgggc

SEQ ID NO: 29847 - DNA, 25 bp, Homo sapiens
ccatcttctttgttatctacactga

SEQ ID NO: 29848 - DNA, 25 bp, Homo sapiens
tctccgccggattctgagtcagagc

SEQ ID NO: 29849 - DNA, 25 bp, Homo sapiens
gctgggagaggcatcatcgaattgg

SEQ ID NO: 29850 - DNA, 25 bp, Homo sapiens
gcatcatcgaattggagccaggcaa

SEQ ID NO: 29851 - DNA, 25 bp, Homo sapiens
ggagagcggactcagaccgcatcca

SEQ ID NO: 29852 - DNA, 25 bp, Homo sapiens
aggcacccaagaagttgacgcccac

SEQ ID NO: 29853 - DNA, 25 bp, Homo sapiens
gacgcccacagagaaaggccgctgc

SEQ ID NO: 29854 - DNA, 25 bp, Homo sapiens
ccctggaggagatcctatctcagcg

SEQ ID NO: 29855 - DNA, 25 bp, Homo sapiens
atcctatctcagcgggatgctgcct

SEQ ID NO: 29856 - DNA, 25 bp, Homo sapiens
gtcccggatccaggacctggtagca

SEQ ID NO: 29857 - DNA, 25 bp, Homo sapiens
ggagactcaggagcttctggcagag

SEQ ID NO: 29858 - DNA, 25 bp, Homo sapiens
gatgggaagcgaaaggccaaggacc

SEQ ID NO: 29859 - DNA, 25 bp, Homo sapiens
gcgggtcttgctggctaaaatgccc

SEQ ID NO: 29860 - DNA, 25 bp, Homo sapiens
aagggttggttggacacagcgctta

SEQ ID NO: 29861 - DNA, 25 bp, Homo sapiens
cagcgcttagtgcacgctgtcatca

SEQ ID NO: 29862 - DNA, 25 bp, Homo sapiens
gtcatcatggacatcataatcagtt

SEQ ID NO: 29863 - DNA, 25 bp, Homo sapiens
aacacgcgaacctatgacacttctt

SEQ ID NO: 29864 - DNA, 25 bp, Homo sapiens
cctggctcacaggaagtgttcagta

SEQ ID NO: 29865 - DNA, 25 bp, Homo sapiens
gtatgcactgttagattactgataa

SEQ ID NO: 29866 - DNA, 25 bp, Homo sapiens
aatactgcagttacggagctgtgta

SEQ ID NO: 29867 - DNA, 25 bp, Homo sapiens
ggagctgtgtaaaccagtttctcat

SEQ ID NO: 29868 - DNA, 25 bp, Homo sapiens
gatatgcacctgtacagtaattcac

SEQ ID NO: 29869 - DNA, 25 bp, Homo sapiens
atagttcttgttcatactgagtgtt

SEQ ID NO: 29870 - DNA, 25 bp, Homo sapiens
cgcaagccgagcggttggccataag

SEQ ID NO: 29871 - DNA, 25 bp, Homo sapiens
gagcccagctgaaacgagagtacct

SEQ ID NO: 29872 - DNA, 25 bp, Homo sapiens
gatgtcgttcccaaagtataagccg

SEQ ID NO: 29873 - DNA, 25 bp, Homo sapiens
tgcttcgttgggcctatgcaagaac

SEQ ID NO: 29874 - DNA, 25 bp, Homo sapiens
gtctatcctaatttcagacccactc

SEQ ID NO: 29875 - DNA, 25 bp, Homo sapiens
gggagctctgtgtggatttgggccc

SEQ ID NO: 29876 - DNA, 25 bp, Homo sapiens
caaagtataagccgtcgagcctgcg

SEQ ID NO: 29877 - DNA, 25 bp, Homo sapiens
ttggatcgaacatttcacctctcat

SEQ ID NO: 29878 - DNA, 25 bp, Homo sapiens
ttcacctctcatattaagtctggca

SEQ ID NO: 29879 - DNA, 25 bp, Homo sapiens
gacccagccgaatacaacatatctc

SEQ ID NO: 29880 - DNA, 25 bp, Homo sapiens
caacatatctccggaaacccggcgg

SEQ ID NO: 29881 - DNA, 25 bp, Homo sapiens
ggcaacgtggtcatcttcgacacgg

SEQ ID NO: 29882 - DNA, 25 bp, Homo sapiens
acacggtcatcaccaaccaggaaga

SEQ ID NO: 29883 - DNA, 25 bp, Homo sapiens
caggaagaaccgtaccagaaccact

SEQ ID NO: 29884 - DNA, 25 bp, Homo sapiens
tgtcccagtgggaaatctgcctgtc

SEQ ID NO: 29885 - DNA, 25 bp, Homo sapiens
ttctgtgacaccaccaacaaggggc

SEQ ID NO: 29886 - DNA, 25 bp, Homo sapiens
ccaacaaggggctcttccaggtggt

SEQ ID NO: 29887 - DNA, 25 bp, Homo sapiens
ctgcagcagggtgaccaggtctggg

SEQ ID NO: 29888 - DNA, 25 bp, Homo sapiens
aagggtcacatttaccagggctctg

SEQ ID NO: 29889 - DNA, 25 bp, Homo sapiens
tttaccagggctctgaggccgacag

SEQ ID NO: 29890 - DNA, 25 bp, Homo sapiens
ccccgtgacacatgctctaagaagc

SEQ ID NO: 29891 - DNA, 25 bp, Homo sapiens
aagaagctcgtttcttagacctctt

SEQ ID NO: 29892 - DNA, 25 bp, Homo sapiens
gcacgaggaagaccataccctagga

SEQ ID NO: 29893 - DNA, 25 bp, Homo sapiens
ggaaattctctacgttacatgatca

SEQ ID NO: 29894 - DNA, 25 bp, Homo sapiens
tttgtggttacactacgacccatcc

SEQ ID NO: 29895 - DNA, 25 bp, Homo sapiens
tacgcattcagactcgaggtaccct

SEQ ID NO: 29896 - DNA, 25 bp, Homo sapiens
gaatgagctcatgaatgtctgccaa

SEQ ID NO: 29897 - DNA, 25 bp, Homo sapiens
gaatgtctgccaacatgtgcttgac

SEQ ID NO: 29898 - DNA, 25 bp, Homo sapiens
gaatccacattctagtcctttatgc

SEQ ID NO: 29899 - DNA, 25 bp, Homo sapiens
gtcctgtaggatattctcttcctga

SEQ ID NO: 29900 - DNA, 25 bp, Homo sapiens
tctcttcctgatggtgcagaaccca

SEQ ID NO: 29901 - DNA, 25 bp, Homo sapiens
gtggttacagcatactctgtccttc

SEQ ID NO: 29902 - DNA, 25 bp, Homo sapiens
gaatctctgcaagaacctctgtatt

SEQ ID NO: 29903 - DNA, 25 bp, Homo sapiens
tttggcctccccagtgtggaaaagg

SEQ ID NO: 29904 - DNA, 25 bp, Homo sapiens
tcaagtttgagatcccctacttcac

SEQ ID NO: 29905 - DNA, 25 bp, Homo sapiens
tctgggatccaggtccgatacatga

SEQ ID NO: 29906 - DNA, 25 bp, Homo sapiens
cgctacatcacccagagtggcgatt

SEQ ID NO: 29907 - DNA, 25 bp, Homo sapiens
tggcgattaccaacttcgtaccagc

SEQ ID NO: 29908 - DNA, 25 bp, Homo sapiens
tgaacacggggcttccttacagccc

SEQ ID NO: 29909 - DNA, 25 bp, Homo sapiens
cttacagccccggatgcagatttta

SEQ ID NO: 29910 - DNA, 25 bp, Homo sapiens
ggcaggtcctggacttggcagtttc

SEQ ID NO: 29911 - DNA, 25 bp, Homo sapiens
cctcttccttattccataggctggg

SEQ ID NO: 29912 - DNA, 25 bp, Homo sapiens
cccatccccctgattttatatgaag

SEQ ID NO: 29913 - DNA, 25 bp, Homo sapiens
aattacctgccttagcgggtgttgc

SEQ ID NO: 29914 - DNA, 25 bp, Homo sapiens
gtggttcaagttatccggcagcgaa

SEQ ID NO: 29915 - DNA, 25 bp, Homo sapiens
gggagggctgaacacacattaccgc

SEQ ID NO: 29916 - DNA, 25 bp, Homo sapiens
acattaccgctacattggcaagacc

SEQ ID NO: 29917 - DNA, 25 bp, Homo sapiens
taccggggaaccatggtccctagtg

SEQ ID NO: 29918 - DNA, 25 bp, Homo sapiens
ctccaccgccatgtcaaacttgtgg

SEQ ID NO: 29919 - DNA, 25 bp, Homo sapiens
ggaaacccactgagatcgactggag

SEQ ID NO: 29920 - DNA, 25 bp, Homo sapiens
gacagcgggtaagagtctccacacg

SEQ ID NO: 29921 - DNA, 25 bp, Homo sapiens
atggcatcgtccctgaaacgtggat

SEQ ID NO: 29922 - DNA, 25 bp, Homo sapiens
aaagaacctatgtgccctgtctaaa

SEQ ID NO: 29923 - DNA, 25 bp, Homo sapiens
ggtctattggtattgagcctggggc

SEQ ID NO: 29924 - DNA, 25 bp, Homo sapiens
acttctgtcccagccttgaaggctg

SEQ ID NO: 29925 - DNA, 25 bp, Homo sapiens
tacagatcagcgcgcacatggggtc

SEQ ID NO: 29926 - DNA, 25 bp, Homo sapiens
tgtctctggggcgagtcttggagcc

SEQ ID NO: 29927 - DNA, 25 bp, Homo sapiens
ctgttggtgctgatttggacccgtt

SEQ ID NO: 29928 - DNA, 25 bp, Homo sapiens
gagctgctctgttgtggcaaaaccc

SEQ ID NO: 29929 - DNA, 25 bp, Homo sapiens
aagtgctgtgatgtgtggctgtgac

SEQ ID NO: 29930 - DNA, 25 bp, Homo sapiens
ggctgtgacaagcctggagcgggtc

SEQ ID NO: 29931 - DNA, 25 bp, Homo sapiens
cactgaacgcctgctgaatgtgccg

SEQ ID NO: 29932 - DNA, 25 bp, Homo sapiens
ctgaatgtgccgctgactcagctgt

SEQ ID NO: 29933 - DNA, 25 bp, Homo sapiens
gaagcaggcaggcctctcagaaggg

SEQ ID NO: 29934 - DNA, 25 bp, Homo sapiens
gaggcctccaaatctattgagtccc

SEQ ID NO: 29935 - DNA, 25 bp, Homo sapiens
ttgagtccccacagtttgctcaagc

SEQ ID NO: 29936 - DNA, 25 bp, Homo sapiens
agcactttccatcgaggacttgggt

SEQ ID NO: 29937 - DNA, 25 bp, Homo sapiens
aagtgctagctctgcacttcgtgtc

SEQ ID NO: 29938 - DNA, 25 bp, Homo sapiens
gggatgaacaagcaacgcagaccac

SEQ ID NO: 29939 - DNA, 25 bp, Homo sapiens
gaccacaagcgagtgcctgggaggg

SEQ ID NO: 29940 - DNA, 25 bp, Homo sapiens
cagggtggttctggagccattgtgg

SEQ ID NO: 29941 - DNA, 25 bp, Homo sapiens
tgccctgcagtggctttaacagtta

SEQ ID NO: 29942 - DNA, 25 bp, Homo sapiens
agttagttttgccaaagcctctcca

SEQ ID NO: 29943 - DNA, 25 bp, Homo sapiens
ggtctctgtcttcagggattgtgcc

SEQ ID NO: 29944 - DNA, 25 bp, Homo sapiens
tccctgggggaatggcccaggcggg

SEQ ID NO: 29945 - DNA, 25 bp, Homo sapiens
gctctgtgggggcttgcaatcaata

SEQ ID NO: 29946 - DNA, 25 bp, Homo sapiens
tcaataaatgccgggagcttgccac

SEQ ID NO: 29947 - DNA, 25 bp, Homo sapiens
ccttcagttcccggtagggcgagtg

SEQ ID NO: 29948 - DNA, 25 bp, Homo sapiens
gcatcgcttgctgcgcaaaggcaac

SEQ ID NO: 29949 - DNA, 25 bp, Homo sapiens
tcctcgagtatctgaccgccgagat

SEQ ID NO: 29950 - DNA, 25 bp, Homo sapiens
cgccgagatcctggagctggcgggc

SEQ ID NO: 29951 - DNA, 25 bp, Homo sapiens
caggcaggagtttctctcggtgact

SEQ ID NO: 29952 - DNA, 25 bp, Homo sapiens
aagctgctgggcaaagtcaccatcg

SEQ ID NO: 29953 - DNA, 25 bp, Homo sapiens
tcttgcctaacatccaggccgtact

SEQ ID NO: 29954 - DNA, 25 bp, Homo sapiens
aaagggcaagtgaggctgacgtccg

SEQ ID NO: 29955 - DNA, 25 bp, Homo sapiens
gcgtctcgaaggggcacctgtgaac

SEQ ID NO: 29956 - DNA, 25 bp, Homo sapiens
tactatcgctgtcatgtctggtcgt

SEQ ID NO: 29957 - DNA, 25 bp, Homo sapiens
gcaagcaaggaggcaaggcccgcgc

SEQ ID NO: 29958 - DNA, 25 bp, Homo sapiens
acaagggccgcgggaacgagtgcgt

SEQ ID NO: 29959 - DNA, 25 bp, Homo sapiens
acgagtgcgtgcagtaccagcatgt

SEQ ID NO: 29960 - DNA, 25 bp, Homo sapiens
ggctaccattgcagatgccagtcca

SEQ ID NO: 29961 - DNA, 25 bp, Homo sapiens
cagtccaaccagcacttcaaaagca

SEQ ID NO: 29962 - DNA, 25 bp, Homo sapiens
gacagggtctttaccaactcaactg

SEQ ID NO: 29963 - DNA, 25 bp, Homo sapiens
actaacttagctgtattctcatgta

SEQ ID NO: 29964 - DNA, 25 bp, Homo sapiens
tcaataagttgagcccaggtgtcct

SEQ ID NO: 29965 - DNA, 25 bp, Homo sapiens
agattcctgacttgataccttgcta

SEQ ID NO: 29966 - DNA, 25 bp, Homo sapiens
tgctccttcctatcagtttgtaaat

SEQ ID NO: 29967 - DNA, 25 bp, Homo sapiens
cagtttgtaaatgtggtccccctga

SEQ ID NO: 29968 - DNA, 25 bp, Homo sapiens
ccccctgactgctgttttcagattg

SEQ ID NO: 29969 - DNA, 25 bp, Homo sapiens
accaaggcagccgtgattggcctca

SEQ ID NO: 29970 - DNA, 25 bp, Homo sapiens
gtggctgcagatttcatccagcagg

SEQ ID NO: 29971 - DNA, 25 bp, Homo sapiens
atccagcagggcatcaggtgcaact

SEQ ID NO: 29972 - DNA, 25 bp, Homo sapiens
ggaacagttgatacgccatctctac

SEQ ID NO: 29973 - DNA, 25 bp, Homo sapiens
gacgggaagattcgcaactgcagaa

SEQ ID NO: 29974 - DNA, 25 bp, Homo sapiens
catgctctgcgtgtatttggcttct

SEQ ID NO: 29975 - DNA, 25 bp, Homo sapiens
aactggtaaccctgtcatcattgat

SEQ ID NO: 29976 - DNA, 25 bp, Homo sapiens
ggaggctggagcttgtgattttagg

SEQ ID NO: 29977 - DNA, 25 bp, Homo sapiens
tcctatccacagtgaacctggttac

SEQ ID NO: 29978 - DNA, 25 bp, Homo sapiens
tcatctccttcctgttaatcacatg

SEQ ID NO: 29979 - DNA, 25 bp, Homo sapiens
aatctctttgtaatctcttctgaaa

SEQ ID NO: 29980 - DNA, 25 bp, Homo sapiens
ttcttacctgaattgttatactttt

SEQ ID NO: 29981 - DNA, 25 bp, Homo sapiens
gaaaatcctgtgacttgcctgtttc

SEQ ID NO: 29982 - DNA, 25 bp, Homo sapiens
tccccgctccaacgaaatcattaac

SEQ ID NO: 29983 - DNA, 25 bp, Homo sapiens
ttaactctcctaaaatgtgtttcat

SEQ ID NO: 29984 - DNA, 25 bp, Homo sapiens
aggacaaatctgatcctgtaatctt

SEQ ID NO: 29985 - DNA, 25 bp, Homo sapiens
tctttccagtaatcccttgtgtctg

SEQ ID NO: 29986 - DNA, 25 bp, Homo sapiens
gtgtctgttgcatgaggacatggac

SEQ ID NO: 29987 - DNA, 25 bp, Homo sapiens
ggacaaggcatacagcttattgatt

SEQ ID NO: 29988 - DNA, 25 bp, Homo sapiens
gaaaattgcccactactactaactt

SEQ ID NO: 29989 - DNA, 25 bp, Homo sapiens
ataacatcctctcaaatgtttgctg

SEQ ID NO: 29990 - DNA, 25 bp, Homo sapiens
ggaaaagtctgtaacctgtggatca

SEQ ID NO: 29991 - DNA, 25 bp, Homo sapiens
agtgaccgccgtgaatgtagacgcc

SEQ ID NO: 29992 - DNA, 25 bp, Homo sapiens
gtagacgccctaggaggagaacttg

SEQ ID NO: 29993 - DNA, 25 bp, Homo sapiens
gttcctccagctttttatgtctgat

SEQ ID NO: 29994 - DNA, 25 bp, Homo sapiens
ttatgtctgatatgccaaagcctgc

SEQ ID NO: 29995 - DNA, 25 bp, Homo sapiens
aacgtaccacaacattgccttcata

SEQ ID NO: 29996 - DNA, 25 bp, Homo sapiens
cactcccatcatcaaagccttgaac

SEQ ID NO: 29997 - DNA, 25 bp, Homo sapiens
gaatatcagctctgcctgttgtgga

SEQ ID NO: 29998 - DNA, 25 bp, Homo sapiens
ctagatatcacggtgacccaggccc

SEQ ID NO: 29999 - DNA, 25 bp, Homo sapiens
cttcagcaccgttcacagtattttg

SEQ ID NO: 30000 - DNA, 25 bp, Homo sapiens
aatagtaagagctgaggtccatcgg

SEQ ID NO: 30001 - DNA, 25 bp, Homo sapiens
gtattatttccctgtcggacattct

SEQ ID NO: 30002 - DNA, 25 bp, Homo sapiens
ggcacaggtgtaaccgtccatgttc

SEQ ID NO: 30003 - DNA, 25 bp, Homo sapiens
gtccatgttccgtgtgagcagagtc

SEQ ID NO: 30004 - DNA, 25 bp, Homo sapiens
taccaacgggcaggtctgcatccgg

SEQ ID NO: 30005 - DNA, 25 bp, Homo sapiens
cttctggcgacaatcctgctagtaa

SEQ ID NO: 30006 - DNA, 25 bp, Homo sapiens
gcatgcccactttctgggaggggtt

SEQ ID NO: 30007 - DNA, 25 bp, Homo sapiens
gggttagtgcaggtgccgtggacaa

SEQ ID NO: 30008 - DNA, 25 bp, Homo sapiens
caaaggacaacatttctctggggct

SEQ ID NO: 30009 - DNA, 25 bp, Homo sapiens
gagaatcttctcgacagttacttat

SEQ ID NO: 30010 - DNA, 25 bp, Homo sapiens
taggatactccagactccagtcatc

SEQ ID NO: 30011 - DNA, 25 bp, Homo sapiens
cccatccatggtttctgttactcat

SEQ ID NO: 30012 - DNA, 25 bp, Homo sapiens
gttactcatagccaactgcagaccg

SEQ ID NO: 30013 - DNA, 25 bp, Homo sapiens
accaggtactgattccactgggcca

SEQ ID NO: 30014 - DNA, 25 bp, Homo sapiens
caacacccaggagctcagggggcac

SEQ ID NO: 30015 - DNA, 25 bp, Homo sapiens
agggggcactaagatgccagccacg

SEQ ID NO: 30016 - DNA, 25 bp, Homo sapiens
ccagcacccaaggccagtacatggt

SEQ ID NO: 30017 - DNA, 25 bp, Homo sapiens
ctcacccaggccgtggtagacaaaa

SEQ ID NO: 30018 - DNA, 25 bp, Homo sapiens
tactcggggtgacccttttcatcac

SEQ ID NO: 30019 - DNA, 25 bp, Homo sapiens
tgccctgcaggcctatgagagctac

SEQ ID NO: 30020 - DNA, 25 bp, Homo sapiens
acacccaggtggactacttaatcaa

SEQ ID NO: 30021 - DNA, 25 bp, Homo sapiens
tcaacgggatgtatgcggactcaga

SEQ ID NO: 30022 - DNA, 25 bp, Homo sapiens
tttgagaccaaaccaagtgcttcca

SEQ ID NO: 30023 - DNA, 25 bp, Homo sapiens
ttccacctcagggtggggcgggcag

SEQ ID NO: 30024 - DNA, 25 bp, Homo sapiens
tgcatctgttacttagggtcaaggc

SEQ ID NO: 30025 - DNA, 25 bp, Homo sapiens
tagggtcaaggcttgggtcttgccc

SEQ ID NO: 30026 - DNA, 25 bp, Homo sapiens
ccccagcgcagctatgaacctggag

SEQ ID NO: 30027 - DNA, 25 bp, Homo sapiens
gaacctggagcgagtgtccaatgag

SEQ ID NO: 30028 - DNA, 25 bp, Homo sapiens
aacctgtgccggaagtactacctgg

SEQ ID NO: 30029 - DNA, 25 bp, Homo sapiens
ccttttctctggttggtcaacatct

SEQ ID NO: 30030 - DNA, 25 bp, Homo sapiens
ttggtcaacatcttctggttcttcc

SEQ ID NO: 30031 - DNA, 25 bp, Homo sapiens
cagcctacacagaacagagccaaat

SEQ ID NO: 30032 - DNA, 25 bp, Homo sapiens
atcaaaggctatgtctggcgctcag

SEQ ID NO: 30033 - DNA, 25 bp, Homo sapiens
tctgggtgatagtgctcacctcctg

SEQ ID NO: 30034 - DNA, 25 bp, Homo sapiens
gccggaggaagtgagctctcctggg

SEQ ID NO: 30035 - DNA, 25 bp, Homo sapiens
gcatccgaggggagccgccggatgt

SEQ ID NO: 30036 - DNA, 25 bp, Homo sapiens
gtggaagaagactcggctttcctgc

SEQ ID NO: 30037 - DNA, 25 bp, Homo sapiens
cgccccatgctaggttatttgacat

SEQ ID NO: 30038 - DNA, 25 bp, Homo sapiens
taaagtgcgtgatctgccagtgctt

SEQ ID NO: 30039 - DNA, 25 bp, Homo sapiens
ctccccagggttgctcaagtggaaa

SEQ ID NO: 30040 - DNA, 25 bp, Homo sapiens
gtcagctgtttagccttttcgtact

SEQ ID NO: 30041 - DNA, 25 bp, Homo sapiens
cgtacttggcgtgatgtcaacttca

SEQ ID NO: 30042 - DNA, 25 bp, Homo sapiens
gtcaacttcacttctaatctgcaaa

SEQ ID NO: 30043 - DNA, 25 bp, Homo sapiens
cagaagctgtttcctagtttacctc

SEQ ID NO: 30044 - DNA, 25 bp, Homo sapiens
acctcgcgtgtgtttacctatatgg

SEQ ID NO: 30045 - DNA, 25 bp, Homo sapiens
aagtggtcaccagcattacacagca

SEQ ID NO: 30046 - DNA, 25 bp, Homo sapiens
gctactgatctgtgatcaaccattt

SEQ ID NO: 30047 - DNA, 25 bp, Homo sapiens
tcaaccattttaactttcatctcta

SEQ ID NO: 30048 - DNA, 25 bp, Homo sapiens
tgtgtgtttgcaaataggctccatt

SEQ ID NO: 30049 - DNA, 25 bp, Homo sapiens
taggctccattttccatgttgagta

SEQ ID NO: 30050 - DNA, 25 bp, Homo sapiens
aaggtggcaatgaactgtgcatgta

SEQ ID NO: 30051 - DNA, 25 bp, Homo sapiens
atgggtactttgtgcaattcgttaa

SEQ ID NO: 30052 - DNA, 25 bp, Homo sapiens
gaagctgctgccataatgactattt

SEQ ID NO: 30053 - DNA, 25 bp, Homo sapiens
ttttctactgtaggctgctttggaa

SEQ ID NO: 30054 - DNA, 25 bp, Homo sapiens
attcccatatccttgctttgtaagt

SEQ ID NO: 30055 - DNA, 25 bp, Homo sapiens
atcactatgcatttctacacatttt

SEQ ID NO: 30056 - DNA, 25 bp, Homo sapiens
gtatatcttaattctgggttgcttg

SEQ ID NO: 30057 - DNA, 25 bp, Homo sapiens
cccgtccgctgtggcgggaaagcgg

SEQ ID NO: 30058 - DNA, 25 bp, Homo sapiens
aaccgaccacaccgtggcaagagga

SEQ ID NO: 30059 - DNA, 25 bp, Homo sapiens
tggcaagaggacccagaacccgagg

SEQ ID NO: 30060 - DNA, 25 bp, Homo sapiens
gaagaacccagactcccatggttat

SEQ ID NO: 30061 - DNA, 25 bp, Homo sapiens
catggttatgacaaggaccccgttt

SEQ ID NO: 30062 - DNA, 25 bp, Homo sapiens
gaacatgcgacttgtcttcttcttt

SEQ ID NO: 30063 - DNA, 25 bp, Homo sapiens
cgccgcgaagctgagaggcttgtga

SEQ ID NO: 30064 - DNA, 25 bp, Homo sapiens
gtgaaataccgagaggccaatggcc

SEQ ID NO: 30065 - DNA, 25 bp, Homo sapiens
aatggccttcccatcatggaatcca

SEQ ID NO: 30066 - DNA, 25 bp, Homo sapiens
atcatggaatccaactgcttcgacc

SEQ ID NO: 30067 - DNA, 25 bp, Homo sapiens
gtgaccagttgctaagtggggctca

SEQ ID NO: 30068 - DNA, 25 bp, Homo sapiens
cttacgccacatgtgtcacttcatt

SEQ ID NO: 30069 - DNA, 25 bp, Homo sapiens
ttgaaattcaccatcaccttggctc

SEQ ID NO: 30070 - DNA, 25 bp, Homo sapiens
catcatagcctacctcatgcatagt

SEQ ID NO: 30071 - DNA, 25 bp, Homo sapiens
ggtcctgggcctatgtcaagaagtg

SEQ ID NO: 30072 - DNA, 25 bp, Homo sapiens
caaacatcatggatccgctctactg

SEQ ID NO: 30073 - DNA, 25 bp, Homo sapiens
aagagcctcacctgggggcattttg

SEQ ID NO: 30074 - DNA, 25 bp, Homo sapiens
cagagtgtgtatacccaggcttgtc

SEQ ID NO: 30075 - DNA, 25 bp, Homo sapiens
atttcagtcaagcctgtgaccccaa

SEQ ID NO: 30076 - DNA, 25 bp, Homo sapiens
tcaaagcccatgtcaatgtctccat

SEQ ID NO: 30077 - DNA, 25 bp, Homo sapiens
tacagggcccttttttgcaggcgat

SEQ ID NO: 30078 - DNA, 25 bp, Homo sapiens
ggcgatgctgacaagcttctgcaca

SEQ ID NO: 30079 - DNA, 25 bp, Homo sapiens
taagagcgtgtttggggggctggtc

SEQ ID NO: 30080 - DNA, 25 bp, Homo sapiens
ggggctggtcaattacttcaaatcc

SEQ ID NO: 30081 - DNA, 25 bp, Homo sapiens
caaatccaaaccagtagagacccca

SEQ ID NO: 30082 - DNA, 25 bp, Homo sapiens
ccagccacccaaaccttagaaagct

SEQ ID NO: 30083 - DNA, 25 bp, Homo sapiens
gccatgagtactgatgcttacccaa

SEQ ID NO: 30084 - DNA, 25 bp, Homo sapiens
caccttcgagcctatcaccagaaga

SEQ ID NO: 30085 - DNA, 25 bp, Homo sapiens
gagctgtccatgggactgggtcgtc

SEQ ID NO: 30086 - DNA, 25 bp, Homo sapiens
gggtcgtctgaaggacatagccctg

SEQ ID NO: 30087 - DNA, 25 bp, Homo sapiens
aagatgacattcttgaccggctgac

SEQ ID NO: 30088 - DNA, 25 bp, Homo sapiens
tgaccggctgacaaccaaagtggac

SEQ ID NO: 30089 - DNA, 25 bp, Homo sapiens
gacagacggatttccactctattgt

SEQ ID NO: 30090 - DNA, 25 bp, Homo sapiens
aacgggcgcagagcccattgtgtcc

SEQ ID NO: 30091 - DNA, 25 bp, Homo sapiens
caacctgtactatgagcggcgctgg

SEQ ID NO: 30092 - DNA, 25 bp, Homo sapiens
aggagctgggcattacagcaccacc

SEQ ID NO: 30093 - DNA, 25 bp, Homo sapiens
tcttctttgaacactgacccttgga

SEQ ID NO: 30094 - DNA, 25 bp, Homo sapiens
ctgagtggccttgaggacgaacccc

SEQ ID NO: 30095 - DNA, 25 bp, Homo sapiens
gcaagcagtacagtggcattcccag

SEQ ID NO: 30096 - DNA, 25 bp, Homo sapiens
gaacagtatcagtcgtctgggctca

SEQ ID NO: 30097 - DNA, 25 bp, Homo sapiens
attgtgcagtgctcctgttgcaact

SEQ ID NO: 30098 - DNA, 25 bp, Homo sapiens
ggagtgagggctacacccaattcca

SEQ ID NO: 30099 - DNA, 25 bp, Homo sapiens
aagtgctggtctcggagttgatccc

SEQ ID NO: 30100 - DNA, 25 bp, Homo sapiens
gttgatcccatgggccgttcagaac

SEQ ID NO: 30101 - DNA, 25 bp, Homo sapiens
tttcacgtaccttaatccaatcttt

SEQ ID NO: 30102 - DNA, 25 bp, Homo sapiens
agaactaggactgctcagccttatc

SEQ ID NO: 30103 - DNA, 25 bp, Homo sapiens
gcccaggtcttaattctccaagagg

SEQ ID NO: 30104 - DNA, 25 bp, Homo sapiens
ggtggaatgtcaggttgcctgccca

SEQ ID NO: 30105 - DNA, 25 bp, Homo sapiens
agggtttttctagcttgtgtgacag

SEQ ID NO: 30106 - DNA, 25 bp, Homo sapiens
ttgtcacttactcccttgtgattga

SEQ ID NO: 30107 - DNA, 25 bp, Homo sapiens
tgattgaattttttctcctgcatcc

SEQ ID NO: 30108 - DNA, 25 bp, Homo sapiens
agagacttggttggcatcttctgct

SEQ ID NO: 30109 - DNA, 25 bp, Homo sapiens
ggcacatgtggctgttgtcattctt

SEQ ID NO: 30110 - DNA, 25 bp, Homo sapiens
tgttcccctccaatttatgttattt

SEQ ID NO: 30111 - DNA, 25 bp, Homo sapiens
gtacctgccttaggcactattcctt

SEQ ID NO: 30112 - DNA, 25 bp, Homo sapiens
aaaccatggctttcatatggacaga

SEQ ID NO: 30113 - DNA, 25 bp, Homo sapiens
aaggcagtggtgtgtaggcaaatat

SEQ ID NO: 30114 - DNA, 25 bp, Homo sapiens
aaatatggtttggcattcgtctttt

SEQ ID NO: 30115 - DNA, 25 bp, Homo sapiens
ggcattcgtcttttaatgacacctg

SEQ ID NO: 30116 - DNA, 25 bp, Homo sapiens
tacatgggggcctgaatgtcagcca

SEQ ID NO: 30117 - DNA, 25 bp, Homo sapiens
gaatggtcatgctttggagatcaaa

SEQ ID NO: 30118 - DNA, 25 bp, Homo sapiens
tgaatgcctatgtatgtcaggccct

SEQ ID NO: 30119 - DNA, 25 bp, Homo sapiens
aaaccaagttattgctatcaaggaa

SEQ ID NO: 30120 - DNA, 25 bp, Homo sapiens
taatcttcagtctcgacacacagct

SEQ ID NO: 30121 - DNA, 25 bp, Homo sapiens
gtctcgacacacagcttttataggt

SEQ ID NO: 30122 - DNA, 25 bp, Homo sapiens
aaattgttcagggctcttagagatg

SEQ ID NO: 30123 - DNA, 25 bp, Homo sapiens
atatgttcagcaatgttgatctcat

SEQ ID NO: 30124 - DNA, 25 bp, Homo sapiens
tattgaggttctttatattcctgcc

SEQ ID NO: 30125 - DNA, 25 bp, Homo sapiens
ctgcctcttcatagtcaaggctctt

SEQ ID NO: 30126 - DNA, 25 bp, Homo sapiens
gtcaaggctcttagtacaggaatat

SEQ ID NO: 30127 - DNA, 25 bp, Homo sapiens
gagtgcaagaatagccagcatttcc

SEQ ID NO: 30128 - DNA, 25 bp, Homo sapiens
tagccagcatttccgattttgacat

SEQ ID NO: 30129 - DNA, 25 bp, Homo sapiens
aattatagctgcatatcccttcttt

SEQ ID NO: 30130 - DNA, 25 bp, Homo sapiens
gaatgtactgaacctactaaccctt

SEQ ID NO: 30131 - DNA, 25 bp, Homo sapiens
catacagtttagggtcctagcgcag

SEQ ID NO: 30132 - DNA, 25 bp, Homo sapiens
tcctagcgcagagtccttgtttaaa

SEQ ID NO: 30133 - DNA, 25 bp, Homo sapiens
aaaggtcattgactcatcatctgtc

SEQ ID NO: 30134 - DNA, 25 bp, Homo sapiens
taaactctcatgttattgttcccag

SEQ ID NO: 30135 - DNA, 25 bp, Homo sapiens
gatttccgatatggctactcttatt

SEQ ID NO: 30136 - DNA, 25 bp, Homo sapiens
cttattacaacagtgcctgccgcat

SEQ ID NO: 30137 - DNA, 25 bp, Homo sapiens
cgagtgactggaacactccagcccc

SEQ ID NO: 30138 - DNA, 25 bp, Homo sapiens
cagaaggctacacctatgtacctcc

SEQ ID NO: 30139 - DNA, 25 bp, Homo sapiens
tcaggccatgctcttgggtgtttgg

SEQ ID NO: 30140 - DNA, 25 bp, Homo sapiens
ctgtggctgtactgctggagaatgt

SEQ ID NO: 30141 - DNA, 25 bp, Homo sapiens
gtgagtggaatctagccatgcctct

SEQ ID NO: 30142 - DNA, 25 bp, Homo sapiens
atgcctctcctgattattagtgcct

SEQ ID NO: 30143 - DNA, 25 bp, Homo sapiens
gattattagtgcctggtgcttctgc

SEQ ID NO: 30144 - DNA, 25 bp, Homo sapiens
tccctgcatctgactgctggaagaa

SEQ ID NO: 30145 - DNA, 25 bp, Homo sapiens
catagaattcctactcacacagctc

SEQ ID NO: 30146 - DNA, 25 bp, Homo sapiens
acacagctcagcaacaaccattttg

SEQ ID NO: 30147 - DNA, 25 bp, Homo sapiens
gctggcgatcttttgatatgctgtt

SEQ ID NO: 30148 - DNA, 25 bp, Homo sapiens
gatatgctgtttcacaggatcctga

SEQ ID NO: 30149 - DNA, 25 bp, Homo sapiens
agggcagctgtcttgtgcattactt

SEQ ID NO: 30150 - DNA, 25 bp, Homo sapiens
tcttgtgcattacttgtgttcccag

SEQ ID NO: 30151 - DNA, 25 bp, Homo sapiens
gtgttcccagcaccaaagttgtggg

SEQ ID NO: 30152 - DNA, 25 bp, Homo sapiens
tgtgggacatgttgctgtagactgc

SEQ ID NO: 30153 - DNA, 25 bp, Homo sapiens
tagactgctgcgcagtcctgggtgc

SEQ ID NO: 30154 - DNA, 25 bp, Homo sapiens
ctggtccccactttaaaggctgtgc

SEQ ID NO: 30155 - DNA, 25 bp, Homo sapiens
ggctgtgcagctccttaaataataa

SEQ ID NO: 30156 - DNA, 25 bp, Homo sapiens
gacctgtaatgtgccggacttaccc

SEQ ID NO: 30157 - DNA, 25 bp, Homo sapiens
aaatgtggccctgaggatgccgtct

SEQ ID NO: 30158 - DNA, 25 bp, Homo sapiens
cctgctctctaacggttgattctca

SEQ ID NO: 30159 - DNA, 25 bp, Homo sapiens
ctcatttgtcccttaaacagctgca

SEQ ID NO: 30160 - DNA, 25 bp, Homo sapiens
gcggcgagtgtgaagtgggctgggt

SEQ ID NO: 30161 - DNA, 25 bp, Homo sapiens
tgcagcgctgcgcagttctgtaaga

SEQ ID NO: 30162 - DNA, 25 bp, Homo sapiens
ctgtaagaacgccaacggctcctac

SEQ ID NO: 30163 - DNA, 25 bp, Homo sapiens
acggctcctacacgtgcgaagatgt

SEQ ID NO: 30164 - DNA, 25 bp, Homo sapiens
actccagggagctacgtctgtgtgt

SEQ ID NO: 30165 - DNA, 25 bp, Homo sapiens
gtgtgtcctgacggcttcgaagaaa

SEQ ID NO: 30166 - DNA, 25 bp, Homo sapiens
aaacggaagatgcctgtgtgccgcc

SEQ ID NO: 30167 - DNA, 25 bp, Homo sapiens
gcgctgatccagtgacaatgtgccc

SEQ ID NO: 30168 - DNA, 25 bp, Homo sapiens
cattcatccattctagagccagtct

SEQ ID NO: 30169 - DNA, 25 bp, Homo sapiens
gctcctccaaccacaaggggggtgg

SEQ ID NO: 30170 - DNA, 25 bp, Homo sapiens
caggggaaccttccaaggtgtctgg

SEQ ID NO: 30171 - DNA, 25 bp, Homo sapiens
cctgcctctggctccagaacagaaa

SEQ ID NO: 30172 - DNA, 25 bp, Homo sapiens
agaaagggagcctcacgctggctca

SEQ ID NO: 30173 - DNA, 25 bp, Homo sapiens
gcagcatttgcacaggggagggggg

SEQ ID NO: 30174 - DNA, 25 bp, Homo sapiens
acttggggggcagacttgacactag

SEQ ID NO: 30175 - DNA, 25 bp, Homo sapiens
tcagatgtcctgaaattccaccacg

SEQ ID NO: 30176 - DNA, 25 bp, Homo sapiens
aacactaggggctggcccactagga

SEQ ID NO: 30177 - DNA, 25 bp, Homo sapiens
agggctggccctaagatacagaccc

SEQ ID NO: 30178 - DNA, 25 bp, Homo sapiens
gcataggttctaacagcagggtttg

SEQ ID NO: 30179 - DNA, 25 bp, Homo sapiens
agtaatgcattacttctgtcagaag

SEQ ID NO: 30180 - DNA, 25 bp, Homo sapiens
gggtggttatctagttcagtactcc

SEQ ID NO: 30181 - DNA, 25 bp, Homo sapiens
tattggggaccttgaggcttaagta

SEQ ID NO: 30182 - DNA, 25 bp, Homo sapiens
agcagacagaattcagcactactta

SEQ ID NO: 30183 - DNA, 25 bp, Homo sapiens
caggttccatagctcagcactttta

SEQ ID NO: 30184 - DNA, 25 bp, Homo sapiens
cagcctgcactgatttgtagcctgc

SEQ ID NO: 30185 - DNA, 25 bp, Homo sapiens
ctgatttgtagcctgcactgtctta

SEQ ID NO: 30186 - DNA, 25 bp, Homo sapiens
ctgcactgtcttactgatttacaaa

SEQ ID NO: 30187 - DNA, 25 bp, Homo sapiens
cacttgttcctagtgttgtgttgtt

SEQ ID NO: 30188 - DNA, 25 bp, Homo sapiens
aaagtgttacaacggcttctaatga

SEQ ID NO: 30189 - DNA, 25 bp, Homo sapiens
tgaagctttatgccagtcactctca

SEQ ID NO: 30190 - DNA, 25 bp, Homo sapiens
tgccagtcactctcaattcatcaaa

SEQ ID NO: 30191 - DNA, 25 bp, Homo sapiens
gatgcacactggagcgaggactctg

SEQ ID NO: 30192 - DNA, 25 bp, Homo sapiens
ctgaagctgactgccatgcgttgta

SEQ ID NO: 30193 - DNA, 25 bp, Homo sapiens
atgcgttgtagctgatggtctccgt

SEQ ID NO: 30194 - DNA, 25 bp, Homo sapiens
tggtctccgtgtaagccaaaggccc

SEQ ID NO: 30195 - DNA, 25 bp, Homo sapiens
gccaaaggcccacagaggagcatat

SEQ ID NO: 30196 - DNA, 25 bp, Homo sapiens
agggcagggtaggccacttggccta

SEQ ID NO: 30197 - DNA, 25 bp, Homo sapiens
gccacttggcctatttactttcaaa

SEQ ID NO: 30198 - DNA, 25 bp, Homo sapiens
gcatttagagtgtttcgcatcagaa

SEQ ID NO: 30199 - DNA, 25 bp, Homo sapiens
gaagctgtgaactaccatgacgaaa

SEQ ID NO: 30200 - DNA, 25 bp, Homo sapiens
gagctgtctcaccaggagaccacgt

SEQ ID NO: 30201 - DNA, 25 bp, Homo sapiens
cgtcctggaagtgtccgggactcgc

SEQ ID NO: 30202 - DNA, 25 bp, Homo sapiens
gactctaggatggcttcgttctggc

SEQ ID NO: 30203 - DNA, 25 bp, Homo sapiens
cacttctggagctgtgagacccaag

SEQ ID NO: 30204 - DNA, 25 bp, Homo sapiens
gagttcgtgcgggaaaaccacctga

SEQ ID NO: 30205 - DNA, 25 bp, Homo sapiens
ccacctgacccctagggatttgtca

SEQ ID NO: 30206 - DNA, 25 bp, Homo sapiens
ttggcaagatatttacccaccggcc

SEQ ID NO: 30207 - DNA, 25 bp, Homo sapiens
ttaaaacgcagcgctctaaccctgc

SEQ ID NO: 30208 - DNA, 25 bp, Homo sapiens
ctgtaattgtgatgcctctgatgga

SEQ ID NO: 30209 - DNA, 25 bp, Homo sapiens
tatctttttcagtctcctctaaaaa

SEQ ID NO: 30210 - DNA, 25 bp, Homo sapiens
tcgagactggtacccggaggagctg

SEQ ID NO: 30211 - DNA, 25 bp, Homo sapiens
cccttcgagaagcattccactttgt

SEQ ID NO: 30212 - DNA, 25 bp, Homo sapiens
gaagcattccactttgtagctggcc

SEQ ID NO: 30213 - DNA, 25 bp, Homo sapiens
gcattccactttgtagctggccaga

SEQ ID NO: 30214 - DNA, 25 bp, Homo sapiens
attccactttgtagctggccagagg

SEQ ID NO: 30215 - DNA, 25 bp, Homo sapiens
tccgggctctcctttcaaaaagcca

SEQ ID NO: 30216 - DNA, 25 bp, Homo sapiens
cgggctctcctttcaaaaagccacg

SEQ ID NO: 30217 - DNA, 25 bp, Homo sapiens
gctctcctttcaaaaagccacgtcg

SEQ ID NO: 30218 - DNA, 25 bp, Homo sapiens
tcctttcaaaaagccacgtcgtgct

SEQ ID NO: 30219 - DNA, 25 bp, Homo sapiens
caaaaagccacgtcgtgctgctgct

SEQ ID NO: 30220 - DNA, 25 bp, Homo sapiens
gggctcaacacacaggctgtggctc

SEQ ID NO: 30221 - DNA, 25 bp, Homo sapiens
ggctcaacacacaggctgtggctct

SEQ ID NO: 30222 - DNA, 25 bp, Homo sapiens
cctacaggagcgggagaagattgtg

SEQ ID NO: 30223 - DNA, 25 bp, Homo sapiens
gaagattgtggctcccatcagtgac

SEQ ID NO: 30224 - DNA, 25 bp, Homo sapiens
ctcacactacctgtcctgaatgcag

SEQ ID NO: 30225 - DNA, 25 bp, Homo sapiens
acctgtcctgaatgcagcacgaact

SEQ ID NO: 30226 - DNA, 25 bp, Homo sapiens
cagcacgaactgtcatctttgtggc

SEQ ID NO: 30227 - DNA, 25 bp, Homo sapiens
gtggcaactggagaaggcaaggcag

SEQ ID NO: 30228 - DNA, 25 bp, Homo sapiens
ggcaaggcagctgttctgaagcgca

SEQ ID NO: 30229 - DNA, 25 bp, Homo sapiens
ggcagctgttctgaagcgcattttg

SEQ ID NO: 30230 - DNA, 25 bp, Homo sapiens
aagcgcattttggaggaccaggagg

SEQ ID NO: 30231 - DNA, 25 bp, Homo sapiens
ccccacaccgggaaactgtgctggt

SEQ ID NO: 30232 - DNA, 25 bp, Homo sapiens
gaaactgtgctggttcttggacgag

SEQ ID NO: 30233 - DNA, 25 bp, Homo sapiens
atagatgagctctgagtttctcagt

SEQ ID NO: 30234 - DNA, 25 bp, Homo sapiens
ttctcagtactccctcaagactgga

SEQ ID NO: 30235 - DNA, 25 bp, Homo sapiens
ggacatcttggtctttttctcaggc

SEQ ID NO: 30236 - DNA, 25 bp, Homo sapiens
caggcctgagggggaaccatttttg

SEQ ID NO: 30237 - DNA, 25 bp, Homo sapiens
gaggtatattggaactcttctaacc

SEQ ID NO: 30238 - DNA, 25 bp, Homo sapiens
tcttctaacctccttgggctatatt

SEQ ID NO: 30239 - DNA, 25 bp, Homo sapiens
gtgcatgtttgggaactggcattac

SEQ ID NO: 30240 - DNA, 25 bp, Homo sapiens
actccagagctgcagtgccactgga

SEQ ID NO: 30241 - DNA, 25 bp, Homo sapiens
gtgccactggaggagtcagactacc

SEQ ID NO: 30242 - DNA, 25 bp, Homo sapiens
gtcagactaccatgacatcgtaggg

SEQ ID NO: 30243 - DNA, 25 bp, Homo sapiens
tgctgagggtggagtgtcccatcct

SEQ ID NO: 30244 - DNA, 25 bp, Homo sapiens
ggcttgatgtagactggcttgcttt

SEQ ID NO: 30245 - DNA, 25 bp, Homo sapiens
tgggtgtctgagggggaaggtcgca

SEQ ID NO: 30246 - DNA, 25 bp, Homo sapiens
gaagcggtacaagagctctgtgcct

SEQ ID NO: 30247 - DNA, 25 bp, Homo sapiens
agctcttagaagcaactccttggcc

SEQ ID NO: 30248 - DNA, 25 bp, Homo sapiens
caactccttggcccaggaatgcgtg

SEQ ID NO: 30249 - DNA, 25 bp, Homo sapiens
aggaatgcgtgacccctgagatggg

SEQ ID NO: 30250 - DNA, 25 bp, Homo sapiens
tgagatgggtccacgcatctctcta

SEQ ID NO: 30251 - DNA, 25 bp, Homo sapiens
tccttctctccgtgggatactggac

SEQ ID NO: 30252 - DNA, 25 bp, Homo sapiens
ttctcttctcacgcatatccatgag

SEQ ID NO: 30253 - DNA, 25 bp, Homo sapiens
taatttcactttctgatcacggtac

SEQ ID NO: 30254 - DNA, 25 bp, Homo sapiens
atcacggtacgtccataaagccagt

SEQ ID NO: 30255 - DNA, 25 bp, Homo sapiens
gaaacccagccattccgcatggctg

SEQ ID NO: 30256 - DNA, 25 bp, Homo sapiens
tggctctggtgatactctccagcca

SEQ ID NO: 30257 - DNA, 25 bp, Homo sapiens
cagccacctgctgacattcagaatc

SEQ ID NO: 30258 - DNA, 25 bp, Homo sapiens
tgttgcggtaccgtgtgtctgacac

SEQ ID NO: 30259 - DNA, 25 bp, Homo sapiens
cccagacattcccgctagataggct

SEQ ID NO: 30260 - DNA, 25 bp, Homo sapiens
tagataggctctgatttccggggca

SEQ ID NO: 30261 - DNA, 25 bp, Homo sapiens
gcagcctttcagatgcggcagacat

SEQ ID NO: 30262 - DNA, 25 bp, Homo sapiens
tagttttagcttcctttgtggctcc

SEQ ID NO: 30263 - DNA, 25 bp, Homo sapiens
tgaggccgagtttgacttcgttcct

SEQ ID NO: 30264 - DNA, 25 bp, Homo sapiens
gaaaggatggcctcattctctttct

SEQ ID NO: 30265 - DNA, 25 bp, Homo sapiens
tctctttctaatcttgctggtttca

SEQ ID NO: 30266 - DNA, 25 bp, Homo sapiens
aagggtggttctggaatcagtgttt

SEQ ID NO: 30267 - DNA, 25 bp, Homo sapiens
tcccatcccagaacatcagttgtaa

SEQ ID NO: 30268 - DNA, 25 bp, Homo sapiens
ggttgtccttgatttcataagtaga

SEQ ID NO: 30269 - DNA, 25 bp, Homo sapiens
gaacaaacactaaatgtgcctctga

SEQ ID NO: 30270 - DNA, 25 bp, Homo sapiens
gtcatggcctgagtgcgcaggggcc

SEQ ID NO: 30271 - DNA, 25 bp, Homo sapiens
ttccgtgctgtgaagctgtccagat

SEQ ID NO: 30272 - DNA, 25 bp, Homo sapiens
tccagatgtgcctctttggctgggg

SEQ ID NO: 30273 - DNA, 25 bp, Homo sapiens
ggttctggtggacgtttcaagtggc

SEQ ID NO: 30274 - DNA, 25 bp, Homo sapiens
gggacggcgacgagcactaaatgct

SEQ ID NO: 30275 - DNA, 25 bp, Homo sapiens
aatgcttttttgactattttcctat

SEQ ID NO: 30276 - DNA, 25 bp, Homo sapiens
ttcctcctgttccaattgatagctt

SEQ ID NO: 30277 - DNA, 25 bp, Homo sapiens
tcagcccagtagacaccatcctggt

SEQ ID NO: 30278 - DNA, 25 bp, Homo sapiens
catcctggtagcggcttcggtagtg

SEQ ID NO: 30279 - DNA, 25 bp, Homo sapiens
gtgccacacaccgttgaggttggag

SEQ ID NO: 30280 - DNA, 25 bp, Homo sapiens
gtgggcacaggcatggtaccaccag

SEQ ID NO: 30281 - DNA, 25 bp, Homo sapiens
tctacctgcacctcacagtgcaagg

SEQ ID NO: 30282 - DNA, 25 bp, Homo sapiens
tgaatacaagccctgatcttccatc

SEQ ID NO: 30283 - DNA, 25 bp, Homo sapiens
gagtaatagccttaattccttccct

SEQ ID NO: 30284 - DNA, 25 bp, Homo sapiens
ttccctatctccttaccaaagtaca

SEQ ID NO: 30285 - DNA, 25 bp, Homo sapiens
tttcccaccttttctgcaaactagg

SEQ ID NO: 30286 - DNA, 25 bp, Homo sapiens
taggagtctaccgttcattccttta

SEQ ID NO: 30287 - DNA, 25 bp, Homo sapiens
ataagagtactagctctcaccctct

SEQ ID NO: 30288 - DNA, 25 bp, Homo sapiens
ggatctctttattgcacagactgaa

SEQ ID NO: 30289 - DNA, 25 bp, Homo sapiens
tgtgaagcagtgggtgtccacccgt

SEQ ID NO: 30290 - DNA, 25 bp, Homo sapiens
tgtggtcaccgagtgaggaccctcc

SEQ ID NO: 30291 - DNA, 25 bp, Homo sapiens
ctgcctccacctgagagttgctagg

SEQ ID NO: 30292 - DNA, 25 bp, Homo sapiens
gttgctagggggttcttgtcgagat

SEQ ID NO: 30293 - DNA, 25 bp, Homo sapiens
tgtcgagatcatgtcatcagcaccc

SEQ ID NO: 30294 - DNA, 25 bp, Homo sapiens
cctaagtcaagtcacgggtttccat

SEQ ID NO: 30295 - DNA, 25 bp, Homo sapiens
gggtttccatagccaggcagttggt

SEQ ID NO: 30296 - DNA, 25 bp, Homo sapiens
tggtatgtacaattcagttcagcgt

SEQ ID NO: 30297 - DNA, 25 bp, Homo sapiens
tcagcgtatgaacttgtatctctaa

SEQ ID NO: 30298 - DNA, 25 bp, Homo sapiens
gtatctctaatctgatgtccatttt

SEQ ID NO: 30299 - DNA, 25 bp, Homo sapiens
tacgacctggtcacggagaagatgt

SEQ ID NO: 30300 - DNA, 25 bp, Homo sapiens
gctgagctgacccaggagatgtccc

SEQ ID NO: 30301 - DNA, 25 bp, Homo sapiens
acagggctggtgcgagatcacggcc

SEQ ID NO: 30302 - DNA, 25 bp, Homo sapiens
tgcccgagcatgatgcccgtgagaa

SEQ ID NO: 30303 - DNA, 25 bp, Homo sapiens
agaaggtgctgcagacactgggcgt

SEQ ID NO: 30304 - DNA, 25 bp, Homo sapiens
cagcctgcaggctgagtaccaggtg

SEQ ID NO: 30305 - DNA, 25 bp, Homo sapiens
tgaggacgagggctacttccaggag

SEQ ID NO: 30306 - DNA, 25 bp, Homo sapiens
tgggctctgtcaacagcttgctgaa

SEQ ID NO: 30307 - DNA, 25 bp, Homo sapiens
ggactgggatgccgctagtgaggct

SEQ ID NO: 30308 - DNA, 25 bp, Homo sapiens
caggcaggaggacatcttggcagtg

SEQ ID NO: 30309 - DNA, 25 bp, Homo sapiens
cttggcagtgctggcttggccatta

SEQ ID NO: 30310 - DNA, 25 bp, Homo sapiens
gtcaatacgtggtcttctatgggtc

SEQ ID NO: 30311 - DNA, 25 bp, Homo sapiens
gttccggcagagaattctggctccc

SEQ ID NO: 30312 - DNA, 25 bp, Homo sapiens
ctggctccctgtaagctagagaccg

SEQ ID NO: 30313 - DNA, 25 bp, Homo sapiens
gatggcagcttaaccttcagatggc

SEQ ID NO: 30314 - DNA, 25 bp, Homo sapiens
atggctcactctgctcaagcaaaac

SEQ ID NO: 30315 - DNA, 25 bp, Homo sapiens
ctcctcaagctgtgttacaactcgg

SEQ ID NO: 30316 - DNA, 25 bp, Homo sapiens
agcacagctggattcccttacatga

SEQ ID NO: 30317 - DNA, 25 bp, Homo sapiens
tcctgccacctcattattttgcatt

SEQ ID NO: 30318 - DNA, 25 bp, Homo sapiens
gatacattgccaggttgtgttttct

SEQ ID NO: 30319 - DNA, 25 bp, Homo sapiens
ggattcagtgacttgctttctgtaa

SEQ ID NO: 30320 - DNA, 25 bp, Homo sapiens
atatggcttatcacttcttagacaa

SEQ ID NO: 30321 - DNA, 25 bp, Homo sapiens
cccggtgtggccacgagtcgggttg

SEQ ID NO: 30322 - DNA, 25 bp, Homo sapiens
aaagatgcatcctgacttatctcca

SEQ ID NO: 30323 - DNA, 25 bp, Homo sapiens
aattgtattttcactcgatgccttg

SEQ ID NO: 30324 - DNA, 25 bp, Homo sapiens
gatgccttggctgagagaagaccta

SEQ ID NO: 30325 - DNA, 25 bp, Homo sapiens
cctaaagactctgggttgatacctg

SEQ ID NO: 30326 - DNA, 25 bp, Homo sapiens
tcctgtcttatttggtctccataat

SEQ ID NO: 30327 - DNA, 25 bp, Homo sapiens
gtgacctgtgagagattgaaccatg

SEQ ID NO: 30328 - DNA, 25 bp, Homo sapiens
tgagtatttgttgggcagggcgttt

SEQ ID NO: 30329 - DNA, 25 bp, Homo sapiens
ggcagggcgtttagtactgtctccc

SEQ ID NO: 30330 - DNA, 25 bp, Homo sapiens
ccctttaccagcaaacctgacttca

SEQ ID NO: 30331 - DNA, 25 bp, Homo sapiens
aacctgacttcaccatgtttattcc

SEQ ID NO: 30332 - DNA, 25 bp, Homo sapiens
gccgtctctttggcagtctgatgca

SEQ ID NO: 30333 - DNA, 25 bp, Homo sapiens
cactctggcactcgctgaagaatct

SEQ ID NO: 30334 - DNA, 25 bp, Homo sapiens
gaatctggaaggttgcggtttgctc

SEQ ID NO: 30335 - DNA, 25 bp, Homo sapiens
ggctgctgaaggattcggtctacca

SEQ ID NO: 30336 - DNA, 25 bp, Homo sapiens
tctaccacggagggctgtgctgtta

SEQ ID NO: 30337 - DNA, 25 bp, Homo sapiens
gattctgctttctgttagcttaggc

SEQ ID NO: 30338 - DNA, 25 bp, Homo sapiens
tgatttgttttccctttggtctggg

SEQ ID NO: 30339 - DNA, 25 bp, Homo sapiens
ggggatgcgtgtgagggggctatgt

SEQ ID NO: 30340 - DNA, 25 bp, Homo sapiens
gtaagagacttgttcctagtggatc

SEQ ID NO: 30341 - DNA, 25 bp, Homo sapiens
atgaaccatctcttctgggcagttt

SEQ ID NO: 30342 - DNA, 25 bp, Homo sapiens
tgcaaggaaagctgccgtctctttg

SEQ ID NO: 30343 - DNA, 25 bp, Homo sapiens
gtggctatccactgttagttcagaa

SEQ ID NO: 30344 - DNA, 25 bp, Homo sapiens
ctgggcttggactactcttatgatt

SEQ ID NO: 30345 - DNA, 25 bp, Homo sapiens
agctccacgagccaaaattttccgg

SEQ ID NO: 30346 - DNA, 25 bp, Homo sapiens
agaggtgacccctgtaataccatct

SEQ ID NO: 30347 - DNA, 25 bp, Homo sapiens
gctgccgtgaggacctgaactcacc

SEQ ID NO: 30348 - DNA, 25 bp, Homo sapiens
ctcacctaacccaagtcctggaggt

SEQ ID NO: 30349 - DNA, 25 bp, Homo sapiens
gtggcagatatctacctagcatctc

SEQ ID NO: 30350 - DNA, 25 bp, Homo sapiens
ctagcatctcagtacacatcctatg

SEQ ID NO: 30351 - DNA, 25 bp, Homo sapiens
atcctatgccataagtggtcccaca

SEQ ID NO: 30352 - DNA, 25 bp, Homo sapiens
ggcatgccagaggtctacaactttg

SEQ ID NO: 30353 - DNA, 25 bp, Homo sapiens
ttagctatgtttttcccatcagaat

SEQ ID NO: 30354 - DNA, 25 bp, Homo sapiens
acaccttgtacacctagtggatgct

SEQ ID NO: 30355 - DNA, 25 bp, Homo sapiens
agttgacttcagcatcagtccacct

SEQ ID NO: 30356 - DNA, 25 bp, Homo sapiens
caagaaatctgtctttccctagctt

SEQ ID NO: 30357 - DNA, 25 bp, Homo sapiens
catttttcatcccttaagccataga

SEQ ID NO: 30358 - DNA, 25 bp, Homo sapiens
atattgctgctgggcacatctgtgc

SEQ ID NO: 30359 - DNA, 25 bp, Homo sapiens
gtcagggactatgatgctctacatg

SEQ ID NO: 30360 - DNA, 25 bp, Homo sapiens
gacatttgagtcttcgtcttctgct

SEQ ID NO: 30361 - DNA, 25 bp, Homo sapiens
ggctggaccagcttctttaacagca

SEQ ID NO: 30362 - DNA, 25 bp, Homo sapiens
ggctatctcttcatattgactgcag

SEQ ID NO: 30363 - DNA, 25 bp, Homo sapiens
ttcttagagggcttgtctcctttct

SEQ ID NO: 30364 - DNA, 25 bp, Homo sapiens
ctgtgactccaccagttattctaat

SEQ ID NO: 30365 - DNA, 25 bp, Homo sapiens
gtgaaagttagctttgcaccttcaa

SEQ ID NO: 30366 - DNA, 25 bp, Homo sapiens
ggatatttcttgccttacatggtct

SEQ ID NO: 30367 - DNA, 25 bp, Homo sapiens
ttgccttacatggtcttttctttga

SEQ ID NO: 30368 - DNA, 25 bp, Homo sapiens
ggtcttttctttgacagtctgtaca

SEQ ID NO: 30369 - DNA, 25 bp, Homo sapiens
gacagtctgtacacctttattatta

SEQ ID NO: 30370 - DNA, 25 bp, Homo sapiens
gaactttgtttcctacttaagctca

SEQ ID NO: 30371 - DNA, 25 bp, Homo sapiens
ggactttttaccctctgaattgagt

SEQ ID NO: 30372 - DNA, 25 bp, Homo sapiens
gagtgcctttgagtgacacatgcta

SEQ ID NO: 30373 - DNA, 25 bp, Homo sapiens
tgagatgtacacttgtcatgattta

SEQ ID NO: 30374 - DNA, 25 bp, Homo sapiens
gttgaccttttgtgtttattactgt

SEQ ID NO: 30375 - DNA, 25 bp, Homo sapiens
aaatagccatgttcattttctttcc

SEQ ID NO: 30376 - DNA, 25 bp, Homo sapiens
ttaaaagtaagtcgcagccgctcct

SEQ ID NO: 30377 - DNA, 25 bp, Homo sapiens
gccacttcagcagcatcttagattt

SEQ ID NO: 30378 - DNA, 25 bp, Homo sapiens
tagattttaagcctcacgtgcgcag

SEQ ID NO: 30379 - DNA, 25 bp, Homo sapiens
gtgcgcagctggttcatgaactatt

SEQ ID NO: 30380 - DNA, 25 bp, Homo sapiens
tgaactattggctgcatcctgctta

SEQ ID NO: 30381 - DNA, 25 bp, Homo sapiens
atcctgcttaggtgcccaccaagaa

SEQ ID NO: 30382 - DNA, 25 bp, Homo sapiens
tctctttttgggttctgtctactga

SEQ ID NO: 30383 - DNA, 25 bp, Homo sapiens
cctaacaacttaccagatttctcct

SEQ ID NO: 30384 - DNA, 25 bp, Homo sapiens
aattgtggttgcccctataggtagc

SEQ ID NO: 30385 - DNA, 25 bp, Homo sapiens
ctcgcacattctacacccaagtgcc

SEQ ID NO: 30386 - DNA, 25 bp, Homo sapiens
accggaagccattgtgttcacacgg

SEQ ID NO: 30387 - DNA, 25 bp, Homo sapiens
ctgaaagaggccctttgtgacccta

SEQ ID NO: 30388 - DNA, 25 bp, Homo sapiens
aaccggatcgagctttctatggact

SEQ ID NO: 30389 - DNA, 25 bp, Homo sapiens
aattgacacattgctcatcagcgat

SEQ ID NO: 30390 - DNA, 25 bp, Homo sapiens
catcagcgatgagctcttcaggcat

SEQ ID NO: 30391 - DNA, 25 bp, Homo sapiens
gcatcaggatgtagccacacggagc

SEQ ID NO: 30392 - DNA, 25 bp, Homo sapiens
gccacacggagccggtatgtgaggc

SEQ ID NO: 30393 - DNA, 25 bp, Homo sapiens
tgcaggcaccgttaggatattctct

SEQ ID NO: 30394 - DNA, 25 bp, Homo sapiens
gatattctctagtcttcacgtttct

SEQ ID NO: 30395 - DNA, 25 bp, Homo sapiens
tggggaacagctcagccagttgact

SEQ ID NO: 30396 - DNA, 25 bp, Homo sapiens
gtacatttctcagcatccttgtgac

SEQ ID NO: 30397 - DNA, 25 bp, Homo sapiens
agggatttcttatgtctttggctac

SEQ ID NO: 30398 - DNA, 25 bp, Homo sapiens
gaacaagatcggttccttcacttct

SEQ ID NO: 30399 - DNA, 25 bp, Homo sapiens
ccttcacttcttcatgccacaagtg

SEQ ID NO: 30400 - DNA, 25 bp, Homo sapiens
cctcacagactcccagttgggttga

SEQ ID NO: 30401 - DNA, 25 bp, Homo sapiens
gactgagtttgattcttcctgtacc

SEQ ID NO: 30402 - DNA, 25 bp, Homo sapiens
tcggtcgtctgagctgtgtgcagac

SEQ ID NO: 30403 - DNA, 25 bp, Homo sapiens
caagagggagggtagctcttccgcc

SEQ ID NO: 30404 - DNA, 25 bp, Homo sapiens
catgttagcccccctggagggggcg

SEQ ID NO: 30405 - DNA, 25 bp, Homo sapiens
ccctggagggggcgccagttggaga

SEQ ID NO: 30406 - DNA, 25 bp, Homo sapiens
cagttggagacgggggctgggtgtc

SEQ ID NO: 30407 - DNA, 25 bp, Homo sapiens
tttaggggacccagctgcactgggg

SEQ ID NO: 30408 - DNA, 25 bp, Homo sapiens
gtaggacatttcccagcaagggctg

SEQ ID NO: 30409 - DNA, 25 bp, Homo sapiens
attcttagcacactgttatgtccta

SEQ ID NO: 30410 - DNA, 25 bp, Homo sapiens
ggttgcaggtttaagcctcatgatg

SEQ ID NO: 30411 - DNA, 25 bp, Homo sapiens
catgatgatcctgagacttgtcttg

SEQ ID NO: 30412 - DNA, 25 bp, Homo sapiens
acttgtcttgttgctgctctgagca

SEQ ID NO: 30413 - DNA, 25 bp, Homo sapiens
aactaagttcatgtcatcctgctgt

SEQ ID NO: 30414 - DNA, 25 bp, Homo sapiens
gtcatcctgctgtaatgggcagagc

SEQ ID NO: 30415 - DNA, 25 bp, Homo sapiens
aatagcactgtcacctctaatatga

SEQ ID NO: 30416 - DNA, 25 bp, Homo sapiens
aactgttttctaattgtcaagcact

SEQ ID NO: 30417 - DNA, 25 bp, Homo sapiens
aaattccaaatactcatgtctcaag

SEQ ID NO: 30418 - DNA, 25 bp, Homo sapiens
gtaagcttaaactacaacttgtcac

SEQ ID NO: 30419 - DNA, 25 bp, Homo sapiens
tattgctgccagtgctatttttttc

SEQ ID NO: 30420 - DNA, 25 bp, Homo sapiens
gaatgccgcctgcatggcattggtg

SEQ ID NO: 30421 - DNA, 25 bp, Homo sapiens
gcattggtggatgcaggtgtgccca

SEQ ID NO: 30422 - DNA, 25 bp, Homo sapiens
ctcgtgctggatcctacatccaagc

SEQ ID NO: 30423 - DNA, 25 bp, Homo sapiens
ctttgccctggacagcgtggaacgg

SEQ ID NO: 30424 - DNA, 25 bp, Homo sapiens
gtggaacggaagctgctgatgtcca

SEQ ID NO: 30425 - DNA, 25 bp, Homo sapiens
caaggggctctactcagacactgag

SEQ ID NO: 30426 - DNA, 25 bp, Homo sapiens
tttctaccgggaatcgctgcagagg

SEQ ID NO: 30427 - DNA, 25 bp, Homo sapiens
gctgcagaggcgttactccaagagc

SEQ ID NO: 30428 - DNA, 25 bp, Homo sapiens
cccctacagcctgaagcaaaccagc

SEQ ID NO: 30429 - DNA, 25 bp, Homo sapiens
tccttgagcctgcagctctgtaacc

SEQ ID NO: 30430 - DNA, 25 bp, Homo sapiens
cagatccccccagcaaggataacat

SEQ ID NO: 30431 - DNA, 25 bp, Homo sapiens
tgacatcatcatcacctactacaca

SEQ ID NO: 30432 - DNA, 25 bp, Homo sapiens
gacagtgccaggcccaagaactaga

SEQ ID NO: 30433 - DNA, 25 bp, Homo sapiens
gtagccccgtcggacatgatggatg

SEQ ID NO: 30434 - DNA, 25 bp, Homo sapiens
gaggccctgatggcacatggacttg

SEQ ID NO: 30435 - DNA, 25 bp, Homo sapiens
ggacttggcaacagggtatcggtga

SEQ ID NO: 30436 - DNA, 25 bp, Homo sapiens
cagtgccaaatttgcttcctgtttc

SEQ ID NO: 30437 - DNA, 25 bp, Homo sapiens
gcagctaagtcaagcccagcttttg

SEQ ID NO: 30438 - DNA, 25 bp, Homo sapiens
tggtgaagccgggaatgccctacct

SEQ ID NO: 30439 - DNA, 25 bp, Homo sapiens
gtaccacgtctctggagagtttgcc

SEQ ID NO: 30440 - DNA, 25 bp, Homo sapiens
agcccaggccggggcatttgatctc

SEQ ID NO: 30441 - DNA, 25 bp, Homo sapiens
caaggctgccgtactggaggccatg

SEQ ID NO: 30442 - DNA, 25 bp, Homo sapiens
tggaagaaagcctgccagcggttcc

SEQ ID NO: 30443 - DNA, 25 bp, Homo sapiens
cctgccagcggttcctggactaagt

SEQ ID NO: 30444 - DNA, 25 bp, Homo sapiens
tcctggactaagtccggctcgttca

SEQ ID NO: 30445 - DNA, 25 bp, Homo sapiens
cgttcaagaacataagctaccacct

SEQ ID NO: 30446 - DNA, 25 bp, Homo sapiens
ggggctgaaacagcccgaggacagc

SEQ ID NO: 30447 - DNA, 25 bp, Homo sapiens
ctgcagggtctgcttttacttgggg

SEQ ID NO: 30448 - DNA, 25 bp, Homo sapiens
cccaccactcaaagtgcctctaaag

SEQ ID NO: 30449 - DNA, 25 bp, Homo sapiens
aaagtgcctctaaagaaaccagctt

SEQ ID NO: 30450 - DNA, 25 bp, Homo sapiens
gaaaccagctttttgcactaaagcc

SEQ ID NO: 30451 - DNA, 25 bp, Homo sapiens
aagggtgttatgggcccagctttgg

SEQ ID NO: 30452 - DNA, 25 bp, Homo sapiens
ccagtcccgatgcactttgaggggt

SEQ ID NO: 30453 - DNA, 25 bp, Homo sapiens
tactgggttcaatactgtccttgct

SEQ ID NO: 30454 - DNA, 25 bp, Homo sapiens
atggcctaaaatgctgtggcttata

SEQ ID NO: 30455 - DNA, 25 bp, Homo sapiens
ttctgaaagcatccatttaccgtcc

SEQ ID NO: 30456 - DNA, 25 bp, Homo sapiens
tttaccgtccagttgacaggtttga

SEQ ID NO: 30457 - DNA, 25 bp, Homo sapiens
tataggtgacttgtgcccatgggta

SEQ ID NO: 30458 - DNA, 25 bp, Homo sapiens
taaaggaacatgctgcccagggcct

SEQ ID NO: 30459 - DNA, 25 bp, Homo sapiens
tgtgcctgcttgctgggcagttagt

SEQ ID NO: 30460 - DNA, 25 bp, Homo sapiens
agtatagggcaaagcctgcctgcgg

SEQ ID NO: 30461 - DNA, 25 bp, Homo sapiens
ctggctgctaggccattctctagga

SEQ ID NO: 30462 - DNA, 25 bp, Homo sapiens
attctctaggaacagctgcgactca

SEQ ID NO: 30463 - DNA, 25 bp, Homo sapiens
acagctgcgactcataaagaccaag

SEQ ID NO: 30464 - DNA, 25 bp, Homo sapiens
tgatgggcagatgcgtctttcacac

SEQ ID NO: 30465 - DNA, 25 bp, Homo sapiens
gcgtctttcacacggaatcaggcac

SEQ ID NO: 30466 - DNA, 25 bp, Homo sapiens
agtggccttctgtgacatgtgttta

SEQ ID NO: 30467 - DNA, 25 bp, Homo sapiens
tgtaggcattagacttcctgggcgg

SEQ ID NO: 30468 - DNA, 25 bp, Homo sapiens
acttcctgggcggcagacaaaccaa

SEQ ID NO: 30469 - DNA, 25 bp, Homo sapiens
agagcggaaattcatgcagcctgca

SEQ ID NO: 30470 - DNA, 25 bp, Homo sapiens
tttgtggcactggagaggcttaccc

SEQ ID NO: 30471 - DNA, 25 bp, Homo sapiens
atgcatgttcctggtcattcgggat

SEQ ID NO: 30472 - DNA, 25 bp, Homo sapiens
gagccatgtgactttagtccttggg

SEQ ID NO: 30473 - DNA, 25 bp, Homo sapiens
gaacttgagccagcggctgtcttgc

SEQ ID NO: 30474 - DNA, 25 bp, Homo sapiens
gctgcctgtacttactggtgtggaa

SEQ ID NO: 30475 - DNA, 25 bp, Homo sapiens
aatgtttaattgtttggatctgcac

SEQ ID NO: 30476 - DNA, 25 bp, Homo sapiens
ggatctgcacagtttggtttttgca

SEQ ID NO: 30477 - DNA, 25 bp, Homo sapiens
acagtttttagtcaaagtggccatt

SEQ ID NO: 30478 - DNA, 25 bp, Homo sapiens
aattctttttattggtgcctatatt

SEQ ID NO: 30479 - DNA, 25 bp, Homo sapiens
ttcagttaaatttttcacctgctgt

SEQ ID NO: 30480 - DNA, 25 bp, Homo sapiens
ggagataattttgcaactcatgtta

SEQ ID NO: 30481 - DNA, 25 bp, Homo sapiens
actttacaacacaattgcatcccaa

SEQ ID NO: 30482 - DNA, 25 bp, Homo sapiens
tattcattatagctattcgtcctgt

SEQ ID NO: 30483 - DNA, 25 bp, Homo sapiens
tattcgtcctgtaatctgtttctag

SEQ ID NO: 30484 - DNA, 25 bp, Homo sapiens
gtttctaggtgaagcatactccagt

SEQ ID NO: 30485 - DNA, 25 bp, Homo sapiens
gcatactccagtgttttaggggttt

SEQ ID NO: 30486 - DNA, 25 bp, Homo sapiens
tcctctgtcctctatattcagcatg

SEQ ID NO: 30487 - DNA, 25 bp, Homo sapiens
ctatattcagcatgttccttgtcag

SEQ ID NO: 30488 - DNA, 25 bp, Homo sapiens
cagcatgttccttgtcagctgctgg

SEQ ID NO: 30489 - DNA, 25 bp, Homo sapiens
cttctcaggtctccctaatggagac

SEQ ID NO: 30490 - DNA, 25 bp, Homo sapiens
ctccctaatggagacaccaggctac

SEQ ID NO: 30491 - DNA, 25 bp, Homo sapiens
gacaccaggctactaggacactggc

SEQ ID NO: 30492 - DNA, 25 bp, Homo sapiens
ggctactaggacactggctggggcc

SEQ ID NO: 30493 - DNA, 25 bp, Homo sapiens
gaatggcccagagtcaccaaggcaa

SEQ ID NO: 30494 - DNA, 25 bp, Homo sapiens
cagagagggggtgccccatctagct

SEQ ID NO: 30495 - DNA, 25 bp, Homo sapiens
cagagtcaagggctgcagcactgcc

SEQ ID NO: 30496 - DNA, 25 bp, Homo sapiens
aaagctgcaacctttctgttttatt

SEQ ID NO: 30497 - DNA, 25 bp, Homo sapiens
gagtgggtgggcatgattccagtca

SEQ ID NO: 30498 - DNA, 25 bp, Homo sapiens
tgattccagtcaatgggggaccgcc

SEQ ID NO: 30499 - DNA, 25 bp, Homo sapiens
cgcccgtgtctaagcatgtgcaaag

SEQ ID NO: 30500 - DNA, 25 bp, Homo sapiens
attgtttgtcattgagtcttctctc

SEQ ID NO: 30501 - DNA, 25 bp, Homo sapiens
gtcttctctcagaatcagcgagccc

SEQ ID NO: 30502 - DNA, 25 bp, Homo sapiens
cagcgagcccagctgtagggtgggg

SEQ ID NO: 30503 - DNA, 25 bp, Homo sapiens
taagtagggcttgccccacttcaga

SEQ ID NO: 30504 - DNA, 25 bp, Homo sapiens
cagaggttttggggttcagggtgct

SEQ ID NO: 30505 - DNA, 25 bp, Homo sapiens
ctcagcctcatacagatgtgccatc

SEQ ID NO: 30506 - DNA, 25 bp, Homo sapiens
gtgccatcatggggggcatgggtgg

SEQ ID NO: 30507 - DNA, 25 bp, Homo sapiens
accccgggcaggcaaaggcagtggg

SEQ ID NO: 30508 - DNA, 25 bp, Homo sapiens
ggtaatgccatcttaaaagccctag

SEQ ID NO: 30509 - DNA, 25 bp, Homo sapiens
gggggcatatgactaccctgagtgg

SEQ ID NO: 30510 - DNA, 25 bp, Homo sapiens
cagacggcattgaagggggactcct

SEQ ID NO: 30511 - DNA, 25 bp, Homo sapiens
gggactccttgctagcatcagaatg

SEQ ID NO: 30512 - DNA, 25 bp, Homo sapiens
catcagaatgaaccaccaggccctg

SEQ ID NO: 30513 - DNA, 25 bp, Homo sapiens
caggccctggtcagaaaactcccag

SEQ ID NO: 30514 - DNA, 25 bp, Homo sapiens
ttacagggtacagttcttcacagct

SEQ ID NO: 30515 - DNA, 25 bp, Homo sapiens
atggttagcctgagatgctggaagc

SEQ ID NO: 30516 - DNA, 25 bp, Homo sapiens
tgcatggttaaggccatcccgaact

SEQ ID NO: 30517 - DNA, 25 bp, Homo sapiens
tgaagcatcagagacttattttccc

SEQ ID NO: 30518 - DNA, 25 bp, Homo sapiens
gagactattttcatacagttgtcat

SEQ ID NO: 30519 - DNA, 25 bp, Homo sapiens
gaatccatcatgcagtgtacatttc

SEQ ID NO: 30520 - DNA, 25 bp, Homo sapiens
cagataatttccttcagtctccaga

SEQ ID NO: 30521 - DNA, 25 bp, Homo sapiens
ggagtgtatccaaacatctaatttt

SEQ ID NO: 30522 - DNA, 25 bp, Homo sapiens
gtgcactgtgtatcttatatgaatg

SEQ ID NO: 30523 - DNA, 25 bp, Homo sapiens
gtggtctgactggtttcattttaga

SEQ ID NO: 30524 - DNA, 25 bp, Homo sapiens
acagctgcttcaatatgttattcaa

SEQ ID NO: 30525 - DNA, 25 bp, Homo sapiens
gtggcatggcagcacttatgctctg

SEQ ID NO: 30526 - DNA, 25 bp, Homo sapiens
cagcacttatgctctgtgacagtat

SEQ ID NO: 30527 - DNA, 25 bp, Homo sapiens
gtgtgtcatagttgagcagtagctg

SEQ ID NO: 30528 - DNA, 25 bp, Homo sapiens
tatagatatatatgtccaccagtat

SEQ ID NO: 30529 - DNA, 25 bp, Homo sapiens
taatggcattgctgtgtctggcact

SEQ ID NO: 30530 - DNA, 25 bp, Homo sapiens
tgtaatgtgccacaacaccctcaat

SEQ ID NO: 30531 - DNA, 25 bp, Homo sapiens
cagggcaactggtggagcatggaag

SEQ ID NO: 30532 - DNA, 25 bp, Homo sapiens
gaagtcgaatttccttttctgttag

SEQ ID NO: 30533 - DNA, 25 bp, Homo sapiens
tcagggctgcagcttacaggtgggc

SEQ ID NO: 30534 - DNA, 25 bp, Homo sapiens
gtgattgcacaacttgaagggccat

SEQ ID NO: 30535 - DNA, 25 bp, Homo sapiens
gaagggccatcattcacatctattc

SEQ ID NO: 30536 - DNA, 25 bp, Homo sapiens
tggggtccctgggattgggcagtgt

SEQ ID NO: 30537 - DNA, 25 bp, Homo sapiens
aggtttacttccagcatctgagctc

SEQ ID NO: 30538 - DNA, 25 bp, Homo sapiens
ctctcacccctgaagctcagttata

SEQ ID NO: 30539 - DNA, 25 bp, Homo sapiens
cccattctggggttctctgatgcag

SEQ ID NO: 30540 - DNA, 25 bp, Homo sapiens
agatatggtaccttctcaagtgtag

SEQ ID NO: 30541 - DNA, 25 bp, Homo sapiens
gccctcagagacctgagctcttctg

SEQ ID NO: 30542 - DNA, 25 bp, Homo sapiens
gagattgagggtccctggacactcc

SEQ ID NO: 30543 - DNA, 25 bp, Homo sapiens
ggacactccctatggagatccgggg

SEQ ID NO: 30544 - DNA, 25 bp, Homo sapiens
ggagctaggatggggaacctgccac

SEQ ID NO: 30545 - DNA, 25 bp, Homo sapiens
tagaacggccctgtgcttaagacac

SEQ ID NO: 30546 - DNA, 25 bp, Homo sapiens
cctctgccggagaccagtctggaag

SEQ ID NO: 30547 - DNA, 25 bp, Homo sapiens
ggaagcccaactgcctatggggtta

SEQ ID NO: 30548 - DNA, 25 bp, Homo sapiens
ggtgctcagtgcaagcctggtcacc

SEQ ID NO: 30549 - DNA, 25 bp, Homo sapiens
gcccactggggttactggtggccat

SEQ ID NO: 30550 - DNA, 25 bp, Homo sapiens
gtcagaacagaagacctcgctgccc

SEQ ID NO: 30551 - DNA, 25 bp, Homo sapiens
ccctgaggacaagcacttgccacca

SEQ ID NO: 30552 - DNA, 25 bp, Homo sapiens
tggtcggcgtgggactggaggcgac

SEQ ID NO: 30553 - DNA, 25 bp, Homo sapiens
cttcctgttgttggtgcctggagtc

SEQ ID NO: 30554 - DNA, 25 bp, Homo sapiens
ggtgcctggagtctatcacgtgatc

SEQ ID NO: 30555 - DNA, 25 bp, Homo sapiens
tatcacgtgatcttcatctactgcg

SEQ ID NO: 30556 - DNA, 25 bp, Homo sapiens
tacttcgagaagtgatcgcggcgca

SEQ ID NO: 30557 - DNA, 25 bp, Homo sapiens
cgagaagtgatcgcggcgcagcgtg

SEQ ID NO: 30558 - DNA, 25 bp, Homo sapiens
gggagtttgctcaggaagttcgggg

SEQ ID NO: 30559 - DNA, 25 bp, Homo sapiens
tcaggaagttcggggcatgcaggcc

SEQ ID NO: 30560 - DNA, 25 bp, Homo sapiens
gtgccttaacttattctcgggccgt

SEQ ID NO: 30561 - DNA, 25 bp, Homo sapiens
tgcggctgctaggttgctgttattt

SEQ ID NO: 30562 - DNA, 25 bp, Homo sapiens
ggttgctgttattttgtgctaataa

SEQ ID NO: 30563 - DNA, 25 bp, Homo sapiens
gtgtgcaaagacgtgcgcatcggca

SEQ ID NO: 30564 - DNA, 25 bp, Homo sapiens
cgcggcggccatgatggcagtgcgc

SEQ ID NO: 30565 - DNA, 25 bp, Homo sapiens
tcctggaccacgacgtgcctgagga

SEQ ID NO: 30566 - DNA, 25 bp, Homo sapiens
tttgctgtcgctgctcatggcagag

SEQ ID NO: 30567 - DNA, 25 bp, Homo sapiens
agagatgggcgtgcactcagtggcc

SEQ ID NO: 30568 - DNA, 25 bp, Homo sapiens
gcctatgcatttccgcgagtgagaa

SEQ ID NO: 30569 - DNA, 25 bp, Homo sapiens
gagtgagaatcatcaccacggcggt

SEQ ID NO: 30570 - DNA, 25 bp, Homo sapiens
ccacggcggtggacaagcgggtcaa

SEQ ID NO: 30571 - DNA, 25 bp, Homo sapiens
gcgggtcaatgaccttttccgcatc

SEQ ID NO: 30572 - DNA, 25 bp, Homo sapiens
gcgaccgctactttgggacagacgc

SEQ ID NO: 30573 - DNA, 25 bp, Homo sapiens
tacacgggttagctgcccagtgagc

SEQ ID NO: 30574 - DNA, 25 bp, Homo sapiens
gcctctgcgcaagcagtttctgtct

SEQ ID NO: 30575 - DNA, 25 bp, Homo sapiens
gtctgaggagaacatggccacccac

SEQ ID NO: 30576 - DNA, 25 bp, Homo sapiens
tctctcaactcagcctgcacaatga

SEQ ID NO: 30577 - DNA, 25 bp, Homo sapiens
tcaactcagcctgcacaatgaccac

SEQ ID NO: 30578 - DNA, 25 bp, Homo sapiens
ccccagctggggacataatggagct

SEQ ID NO: 30579 - DNA, 25 bp, Homo sapiens
ggggacataatggagctctgagtgc

SEQ ID NO: 30580 - DNA, 25 bp, Homo sapiens
aatggagctctgagtgctggtggac

SEQ ID NO: 30581 - DNA, 25 bp, Homo sapiens
agctctgagtgctggtggacagtgc

SEQ ID NO: 30582 - DNA, 25 bp, Homo sapiens
tccctctcctgcagagtaggcatct

SEQ ID NO: 30583 - DNA, 25 bp, Homo sapiens
agtaggcatctgggcaccaagacct

SEQ ID NO: 30584 - DNA, 25 bp, Homo sapiens
catgggaagggaggcatcccacccc

SEQ ID NO: 30585 - DNA, 25 bp, Homo sapiens
ggcagcccacaagtttctcgtgggg

SEQ ID NO: 30586 - DNA, 25 bp, Homo sapiens
aaccgtacattcaagcctgtttggc

SEQ ID NO: 30587 - DNA, 25 bp, Homo sapiens
cctgtttggccctgaaattcttaag

SEQ ID NO: 30588 - DNA, 25 bp, Homo sapiens
tcaaaacctcctaggggttgtcctg

SEQ ID NO: 30589 - DNA, 25 bp, Homo sapiens
gggagtcaggttcacgggtacagaa

SEQ ID NO: 30590 - DNA, 25 bp, Homo sapiens
atgaatctcagatgtcactcaacct

SEQ ID NO: 30591 - DNA, 25 bp, Homo sapiens
tttctcttactcaatccctggagtg

SEQ ID NO: 30592 - DNA, 25 bp, Homo sapiens
tttcaatatcagtgcccacacctta

SEQ ID NO: 30593 - DNA, 25 bp, Homo sapiens
tgcccacaccttactgagtattgag

SEQ ID NO: 30594 - DNA, 25 bp, Homo sapiens
gagctttcgcttgatgtgcttgacc

SEQ ID NO: 30595 - DNA, 25 bp, Homo sapiens
agagacttcttttgtatccttttct

SEQ ID NO: 30596 - DNA, 25 bp, Homo sapiens
tgaggaactgagcagactctccagc

SEQ ID NO: 30597 - DNA, 25 bp, Homo sapiens
tcttcctccttcctctgggggagga

SEQ ID NO: 30598 - DNA, 25 bp, Homo sapiens
ggagccagggactattttctgcacc

SEQ ID NO: 30599 - DNA, 25 bp, Homo sapiens
gactcacagtggagcttccaggacc

SEQ ID NO: 30600 - DNA, 25 bp, Homo sapiens
aagcttggaagtgagccctggcagc

SEQ ID NO: 30601 - DNA, 25 bp, Homo sapiens
gcagccgggagacttcagctgccac

SEQ ID NO: 30602 - DNA, 25 bp, Homo sapiens
ctgggatgacggtgacacccgcagc

SEQ ID NO: 30603 - DNA, 25 bp, Homo sapiens
acagctacagcgagtcaggtgccag

SEQ ID NO: 30604 - DNA, 25 bp, Homo sapiens
ttaggggagtcacggctggaccctg

SEQ ID NO: 30605 - DNA, 25 bp, Homo sapiens
gggactaccaagtggctctgggagc

SEQ ID NO: 30606 - DNA, 25 bp, Homo sapiens
gggcaaggagtaacccatggcctgc

SEQ ID NO: 30607 - DNA, 25 bp, Homo sapiens
gaaccaaggtgctgatcctaccacc

SEQ ID NO: 30608 - DNA, 25 bp, Homo sapiens
ccttagcttcaccctggctagaaat

SEQ ID NO: 30609 - DNA, 25 bp, Homo sapiens
ttcacgggccgacgactgagtggaa

SEQ ID NO: 30610 - DNA, 25 bp, Homo sapiens
aactgaggcccacgtactggggctg

SEQ ID NO: 30611 - DNA, 25 bp, Homo sapiens
gggctggtgaatcacgctgtggccc

SEQ ID NO: 30612 - DNA, 25 bp, Homo sapiens
cggaggtggacattgcatctgggat

SEQ ID NO: 30613 - DNA, 25 bp, Homo sapiens
ctatgcccagaatattccaacccgg

SEQ ID NO: 30614 - DNA, 25 bp, Homo sapiens
acccccattttaaccttcagcatgg

SEQ ID NO: 30615 - DNA, 25 bp, Homo sapiens
gtggccagattgccttcatcatttc

SEQ ID NO: 30616 - DNA, 25 bp, Homo sapiens
ccagacttccatttcttcacaagga

SEQ ID NO: 30617 - DNA, 25 bp, Homo sapiens
gactggcgtgatgcctggaaccaag

SEQ ID NO: 30618 - DNA, 25 bp, Homo sapiens
gcagggtgtgctgcgtgaggagccc

SEQ ID NO: 30619 - DNA, 25 bp, Homo sapiens
cggcctcaggaccgggacaacatgg

SEQ ID NO: 30620 - DNA, 25 bp, Homo sapiens
gacagtgacgacgagagcgactccg

SEQ ID NO: 30621 - DNA, 25 bp, Homo sapiens
gcctcccaggccgaccagaaggagg

SEQ ID NO: 30622 - DNA, 25 bp, Homo sapiens
gctgctcttctggacgtacatccag

SEQ ID NO: 30623 - DNA, 25 bp, Homo sapiens
atccaggccatgctgaccaacctgg

SEQ ID NO: 30624 - DNA, 25 bp, Homo sapiens
ggatcgtatctacaacatgctccgc

SEQ ID NO: 30625 - DNA, 25 bp, Homo sapiens
atgctccgcatgtttgtggtgactg

SEQ ID NO: 30626 - DNA, 25 bp, Homo sapiens
tgcactggccgagattgacctgcag

SEQ ID NO: 30627 - DNA, 25 bp, Homo sapiens
caagaactgcagctgacacatcgcc

SEQ ID NO: 30628 - DNA, 25 bp, Homo sapiens
gtcccagaatgcactgctgaggagc

SEQ ID NO: 30629 - DNA, 25 bp, Homo sapiens
gagtccgggtgatagtttctccaca

SEQ ID NO: 30630 - DNA, 25 bp, Homo sapiens
gatactccttactgcagagtgggtc

SEQ ID NO: 30631 - DNA, 25 bp, Homo sapiens
gcatctgctacgacatgcggtttgc

SEQ ID NO: 30632 - DNA, 25 bp, Homo sapiens
gcagagcttgcacaaatctacgcac

SEQ ID NO: 30633 - DNA, 25 bp, Homo sapiens
gaggctgccagctgttggtatatcc

SEQ ID NO: 30634 - DNA, 25 bp, Homo sapiens
cagcccattgggagttacttcagcg

SEQ ID NO: 30635 - DNA, 25 bp, Homo sapiens
atcaggtgtatgtggccacagcctc

SEQ ID NO: 30636 - DNA, 25 bp, Homo sapiens
gatgacaaagcctcctatgttgcct

SEQ ID NO: 30637 - DNA, 25 bp, Homo sapiens
gacacagcaccgtggtgaacccttg

SEQ ID NO: 30638 - DNA, 25 bp, Homo sapiens
tgaaatacgccagcaaatccccgtt

SEQ ID NO: 30639 - DNA, 25 bp, Homo sapiens
agaagcgatcagacctctatgctgt

SEQ ID NO: 30640 - DNA, 25 bp, Homo sapiens
gggcgggggacactgtatttgatat

SEQ ID NO: 30641 - DNA, 25 bp, Homo sapiens
ttctttgtttcctgtcattgacatt

SEQ ID NO: 30642 - DNA, 25 bp, Homo sapiens
gaagtcgttccatcataatctatga

SEQ ID NO: 30643 - DNA, 25 bp, Homo sapiens
atctatgatcttgtacagcacttat

SEQ ID NO: 30644 - DNA, 25 bp, Homo sapiens
ggatttcttcatatctgacgtttct

SEQ ID NO: 30645 - DNA, 25 bp, Homo sapiens
gacgtttctgaaaccctttgtgtct

SEQ ID NO: 30646 - DNA, 25 bp, Homo sapiens
cctttgtgtctgctgttgtgtgaag

SEQ ID NO: 30647 - DNA, 25 bp, Homo sapiens
gattttccttagttacttgacgtct

SEQ ID NO: 30648 - DNA, 25 bp, Homo sapiens
ttccgccccttaagtagatctgagg

SEQ ID NO: 30649 - DNA, 25 bp, Homo sapiens
atctgaggcagacccttgggggtgt

SEQ ID NO: 30650 - DNA, 25 bp, Homo sapiens
aagagagtcacaggtaccccaagga

SEQ ID NO: 30651 - DNA, 25 bp, Homo sapiens
cttctgtgcccaacttgcagcaagt

SEQ ID NO: 30652 - DNA, 25 bp, Homo sapiens
caagtccaaacgctcctgaagggct

SEQ ID NO: 30653 - DNA, 25 bp, Homo sapiens
gatcccaccgagaaggagagccagg

SEQ ID NO: 30654 - DNA, 25 bp, Homo sapiens
tgccgagaccatcctaagggtccga

SEQ ID NO: 30655 - DNA, 25 bp, Homo sapiens
aagggtccgatgtgacagcaagcaa

SEQ ID NO: 30656 - DNA, 25 bp, Homo sapiens
gggtggtggtagatccttgagggtc

SEQ ID NO: 30657 - DNA, 25 bp, Homo sapiens
aggatggagttccttttctttctgt

SEQ ID NO: 30658 - DNA, 25 bp, Homo sapiens
ttctgttgttgtttcccagctacaa

SEQ ID NO: 30659 - DNA, 25 bp, Homo sapiens
gaatgtgcgtgcttttttgtggaca

SEQ ID NO: 30660 - DNA, 25 bp, Homo sapiens
agcaggctgggatcccaactatcgc

SEQ ID NO: 30661 - DNA, 25 bp, Homo sapiens
tcgcttgttgcctctttttcaagtg

SEQ ID NO: 30662 - DNA, 25 bp, Homo sapiens
ggagctggaggagatgctggtcccc

SEQ ID NO: 30663 - DNA, 25 bp, Homo sapiens
ctgcccagactggataccgggaccg

SEQ ID NO: 30664 - DNA, 25 bp, Homo sapiens
tgtccgcccagccagataggggaag

SEQ ID NO: 30665 - DNA, 25 bp, Homo sapiens
atgaaggcgtcgcggatgcgcctca

SEQ ID NO: 30666 - DNA, 25 bp, Homo sapiens
aaaaacgtgctgaagatccgccggc

SEQ ID NO: 30667 - DNA, 25 bp, Homo sapiens
tgaaccaccacaagtaccggaagct

SEQ ID NO: 30668 - DNA, 25 bp, Homo sapiens
gacgcggttcctgcggaggaaggtc

SEQ ID NO: 30669 - DNA, 25 bp, Homo sapiens
ggacgcctgagacgcaagcagatca

SEQ ID NO: 30670 - DNA, 25 bp, Homo sapiens
acctgaggcgcatctggctgaaggc

SEQ ID NO: 30671 - DNA, 25 bp, Homo sapiens
cccccaagatctacctgcggggcaa

SEQ ID NO: 30672 - DNA, 25 bp, Homo sapiens
cgttgctgctgtgatccgtagtaat

SEQ ID NO: 30673 - DNA, 25 bp, Homo sapiens
ccggctgcctaagctagggacactc

SEQ ID NO: 30674 - DNA, 25 bp, Homo sapiens
tagggacactcaagtgcttccttcc

SEQ ID NO: 30675 - DNA, 25 bp, Homo sapiens
gccctgaagccccatatgtagtata

SEQ ID NO: 30676 - DNA, 25 bp, Homo sapiens
aggtggctcctggtgaagagagggt

SEQ ID NO: 30677 - DNA, 25 bp, Homo sapiens
agccccagggccatgtctgggttct

SEQ ID NO: 30678 - DNA, 25 bp, Homo sapiens
cctgcccatggcccaatggggagcc

SEQ ID NO: 30679 - DNA, 25 bp, Homo sapiens
tgtccttatcagccactgggtggtt

SEQ ID NO: 30680 - DNA, 25 bp, Homo sapiens
tcagctttttcccagggagccgttt

SEQ ID NO: 30681 - DNA, 25 bp, Homo sapiens
aaccatccccttcaccagaatggta

SEQ ID NO: 30682 - DNA, 25 bp, Homo sapiens
ggtattaactcctggtgctttgtac

SEQ ID NO: 30683 - DNA, 25 bp, Homo sapiens
tgctttgtactactggtccagctgc

SEQ ID NO: 30684 - DNA, 25 bp, Homo sapiens
gggtggaattgcgtttgttgccata

SEQ ID NO: 30685 - DNA, 25 bp, Homo sapiens
tatttacgacaggcacaccgcaaaa

SEQ ID NO: 30686 - DNA, 25 bp, Homo sapiens
gcagttctctcatccttatgaatct

SEQ ID NO: 30687 - DNA, 25 bp, Homo sapiens
tctgttgtgttgttttgattccatc

SEQ ID NO: 30688 - DNA, 25 bp, Homo sapiens
gataagctgctgctcctatattttt

SEQ ID NO: 30689 - DNA, 25 bp, Homo sapiens
agggcaggggaaatcatctcggtaa

SEQ ID NO: 30690 - DNA, 25 bp, Homo sapiens
ttttgttcatattttctccagacag

SEQ ID NO: 30691 - DNA, 25 bp, Homo sapiens
ggccaatcctttagcagatcatgtc

SEQ ID NO: 30692 - DNA, 25 bp, Homo sapiens
cagatcatgtctctgctactcgaat

SEQ ID NO: 30693 - DNA, 25 bp, Homo sapiens
actcgaatcttgtgtggagcccttg

SEQ ID NO: 30694 - DNA, 25 bp, Homo sapiens
cttgtctttcctactattgctacaa

SEQ ID NO: 30695 - DNA, 25 bp, Homo sapiens
gttatgtcgtggggctcccattagc

SEQ ID NO: 30696 - DNA, 25 bp, Homo sapiens
ggattccagcctcataagggtggag

SEQ ID NO: 30697 - DNA, 25 bp, Homo sapiens
tcccgtgtcagctcgtagcacaaaa

SEQ ID NO: 30698 - DNA, 25 bp, Homo sapiens
aggtgaagagcctgctgtggggcca

SEQ ID NO: 30699 - DNA, 25 bp, Homo sapiens
cagggcttcccagattacgtggccc

SEQ ID NO: 30700 - DNA, 25 bp, Homo sapiens
cttcatcacccagtcattcaacagg

SEQ ID NO: 30701 - DNA, 25 bp, Homo sapiens
cagctcccaggggctttggttatag

SEQ ID NO: 30702 - DNA, 25 bp, Homo sapiens
aaatacggatccctgctgaatccac

SEQ ID NO: 30703 - DNA, 25 bp, Homo sapiens
aaggacgattcttatttccactgcg

SEQ ID NO: 30704 - DNA, 25 bp, Homo sapiens
ttatttccactgcggttacttttgt

SEQ ID NO: 30705 - DNA, 25 bp, Homo sapiens
ttcttcttcccgtttgtttgacaat

SEQ ID NO: 30706 - DNA, 25 bp, Homo sapiens
tttgacaatgaatctgctgcctgaa

SEQ ID NO: 30707 - DNA, 25 bp, Homo sapiens
gggtaacaatgcctcagaagcctgc

SEQ ID NO: 30708 - DNA, 25 bp, Homo sapiens
agaagcctgctttgaaaattttcca

SEQ ID NO: 30709 - DNA, 25 bp, Homo sapiens
gtaacttgttctagtatggtgctaa

SEQ ID NO: 30710 - DNA, 25 bp, Homo sapiens
ttgatcatattctgtttctgttttg

SEQ ID NO: 30711 - DNA, 25 bp, Homo sapiens
tctgttttgttccttacaatatcaa

SEQ ID NO: 30712 - DNA, 25 bp, Homo sapiens
tatcaatcttattttatattctctt

SEQ ID NO: 30713 - DNA, 25 bp, Homo sapiens
aaggacaatgtacccaatcactctc

SEQ ID NO: 30714 - DNA, 25 bp, Homo sapiens
acccaatcactctctgtattgctgt

SEQ ID NO: 30715 - DNA, 25 bp, Homo sapiens
ctgtattgctgtttccaactgttgt

SEQ ID NO: 30716 - DNA, 25 bp, Homo sapiens
gtttactactttacatcggacacaa

SEQ ID NO: 30717 - DNA, 25 bp, Homo sapiens
atgacgtgaatgaggctgtgcagct

SEQ ID NO: 30718 - DNA, 25 bp, Homo sapiens
tgagggcagtgcggtggaggtgagg

SEQ ID NO: 30719 - DNA, 25 bp, Homo sapiens
ctgatcactgggctcaggtcagggc

SEQ ID NO: 30720 - DNA, 25 bp, Homo sapiens
ttcttgctgccccatgagtgtggca

SEQ ID NO: 30721 - DNA, 25 bp, Homo sapiens
agaagacagtgactctttttccctg

SEQ ID NO: 30722 - DNA, 25 bp, Homo sapiens
tttcgtggcagtctaacctcaggcc

SEQ ID NO: 30723 - DNA, 25 bp, Homo sapiens
tcagtgtccttctcatttcagtagg

SEQ ID NO: 30724 - DNA, 25 bp, Homo sapiens
gtggaatactgtggatgtctgtgca

SEQ ID NO: 30725 - DNA, 25 bp, Homo sapiens
gcatgcagcctgtcggcagagtgtc

SEQ ID NO: 30726 - DNA, 25 bp, Homo sapiens
gtgtcttaacaccagatgctacttt

SEQ ID NO: 30727 - DNA, 25 bp, Homo sapiens
gtattgtagtttattgcccggagat

SEQ ID NO: 30728 - DNA, 25 bp, Homo sapiens
tgttccccttatggtgtctttagag

SEQ ID NO: 30729 - DNA, 25 bp, Homo sapiens
gtctttagagatctccctagaggca

SEQ ID NO: 30730 - DNA, 25 bp, Homo sapiens
gcctcatcccaccagaagaacggtg

SEQ ID NO: 30731 - DNA, 25 bp, Homo sapiens
aagaacggtgggcctggcctgaggt

SEQ ID NO: 30732 - DNA, 25 bp, Homo sapiens
gtgcccatggagatgcctttggtgc

SEQ ID NO: 30733 - DNA, 25 bp, Homo sapiens
ctcgagctgctctcactggaagcag

SEQ ID NO: 30734 - DNA, 25 bp, Homo sapiens
ggaagcagtgcacagggcagtggca

SEQ ID NO: 30735 - DNA, 25 bp, Homo sapiens
gctaacagggagcccgacttcagca

SEQ ID NO: 30736 - DNA, 25 bp, Homo sapiens
tgctctcagcgcaacagattcttca

SEQ ID NO: 30737 - DNA, 25 bp, Homo sapiens
aagaaaagccatatggtcgcctcct

SEQ ID NO: 30738 - DNA, 25 bp, Homo sapiens
tagtaaaccacgtcgtgcctcactg

SEQ ID NO: 30739 - DNA, 25 bp, Homo sapiens
ttaacatgcaccctcaagacttcaa

SEQ ID NO: 30740 - DNA, 25 bp, Homo sapiens
atggctgtatgatgaaaccctggaa

SEQ ID NO: 30741 - DNA, 25 bp, Homo sapiens
actagactgtcgtttttggtggagc

SEQ ID NO: 30742 - DNA, 25 bp, Homo sapiens
tggtggagcggttcatttatttgga

SEQ ID NO: 30743 - DNA, 25 bp, Homo sapiens
aaaactcacatcctttcagcagaag

SEQ ID NO: 30744 - DNA, 25 bp, Homo sapiens
aggtaactgttcttgtcttgcacaa

SEQ ID NO: 30745 - DNA, 25 bp, Homo sapiens
aagccaggcagatcatttctcctaa

SEQ ID NO: 30746 - DNA, 25 bp, Homo sapiens
atttctcctaagctgatatcattgg

SEQ ID NO: 30747 - DNA, 25 bp, Homo sapiens
attcgttttgtttcagattcctatt

SEQ ID NO: 30748 - DNA, 25 bp, Homo sapiens
atatttcacttgtactgttgctgat

SEQ ID NO: 30749 - DNA, 25 bp, Homo sapiens
ctgatttttgcatcttcttgaagag

SEQ ID NO: 30750 - DNA, 25 bp, Homo sapiens
gcagaaaagctcccaccattttctt

SEQ ID NO: 30751 - DNA, 25 bp, Homo sapiens
tggttttaaagtctcacgttctcta

SEQ ID NO: 30752 - DNA, 25 bp, Homo sapiens
agctccttgtgtggctgatgtgtct

SEQ ID NO: 30753 - DNA, 25 bp, Homo sapiens
ttaaaagcagcacagattccacatt

SEQ ID NO: 30754 - DNA, 25 bp, Homo sapiens
gaggatcttctttgtggtgaatacc

SEQ ID NO: 30755 - DNA, 25 bp, Homo sapiens
ataccaggattgactgcatcccttt

SEQ ID NO: 30756 - DNA, 25 bp, Homo sapiens
tatgtccctgactctggctaaaatt

SEQ ID NO: 30757 - DNA, 25 bp, Homo sapiens
gtgagccacatattgggagttctag

SEQ ID NO: 30758 - DNA, 25 bp, Homo sapiens
ggcaggaaagggccatctccattga

SEQ ID NO: 30759 - DNA, 25 bp, Homo sapiens
agactttgaaatttgcgagctgctc

SEQ ID NO: 30760 - DNA, 25 bp, Homo sapiens
cactgctgtctttctattgagttac

SEQ ID NO: 30761 - DNA, 25 bp, Homo sapiens
gagccaacgcctcaggaatcaggag

SEQ ID NO: 30762 - DNA, 25 bp, Homo sapiens
aggaggccagcctggtaccaaaagg

SEQ ID NO: 30763 - DNA, 25 bp, Homo sapiens
taccaaaaggagtacccagggcctg

SEQ ID NO: 30764 - DNA, 25 bp, Homo sapiens
tccagaatggccttggactcacctt

SEQ ID NO: 30765 - DNA, 25 bp, Homo sapiens
gggagctgctgggcctaaagcccac

SEQ ID NO: 30766 - DNA, 25 bp, Homo sapiens
tgctgcttaggtccttttgggaccc

SEQ ID NO: 30767 - DNA, 25 bp, Homo sapiens
ggccattagcatttcatgtctttcc

SEQ ID NO: 30768 - DNA, 25 bp, Homo sapiens
ggaggagggcagaaggctacgcagg

SEQ ID NO: 30769 - DNA, 25 bp, Homo sapiens
ggatggtcccagactctcaggacat

SEQ ID NO: 30770 - DNA, 25 bp, Homo sapiens
tcaggacatgcccagctcaggggct

SEQ ID NO: 30771 - DNA, 25 bp, Homo sapiens
acaggcctggcctcatatggcatga

SEQ ID NO: 30772 - DNA, 25 bp, Homo sapiens
cctagggtggatggctgctggtgtg

SEQ ID NO: 30773 - DNA, 25 bp, Homo sapiens
gggacttcgggtgggcagaggcacc

SEQ ID NO: 30774 - DNA, 25 bp, Homo sapiens
ccaagtggcccaggctctgaactgg

SEQ ID NO: 30775 - DNA, 25 bp, Homo sapiens
ctcctcgtctctgctttaatcagga

SEQ ID NO: 30776 - DNA, 25 bp, Homo sapiens
gaggacaagtgaggccgtcagtctt

SEQ ID NO: 30777 - DNA, 25 bp, Homo sapiens
catgactcacgattgctgaagcctg

SEQ ID NO: 30778 - DNA, 25 bp, Homo sapiens
gaagcctgagcaggtctctgtgggc

SEQ ID NO: 30779 - DNA, 25 bp, Homo sapiens
tggtccctggtactggggtgaccga

SEQ ID NO: 30780 - DNA, 25 bp, Homo sapiens
tgtccccaatccaagggtctggagg

SEQ ID NO: 30781 - DNA, 25 bp, Homo sapiens
ggctggctctggtgtttacaagctg

SEQ ID NO: 30782 - DNA, 25 bp, Homo sapiens
gctggacggcaagtccgtctagctc

SEQ ID NO: 30783 - DNA, 25 bp, Homo sapiens
gtgaccaaaggctcctgaagctaga

SEQ ID NO: 30784 - DNA, 25 bp, Homo sapiens
ttgaagagccacaggccactcttcc

SEQ ID NO: 30785 - DNA, 25 bp, Homo sapiens
ccctctgagccattgggcctagtgg

SEQ ID NO: 30786 - DNA, 25 bp, Homo sapiens
gggcctagtggtgtcatgtattgta

SEQ ID NO: 30787 - DNA, 25 bp, Homo sapiens
ggagagcagtctttttggtgtaata

SEQ ID NO: 30788 - DNA, 25 bp, Homo sapiens
gtgggatgtctgcttagttggcagg

SEQ ID NO: 30789 - DNA, 25 bp, Homo sapiens
taaacctccactatcctttatagcc

SEQ ID NO: 30790 - DNA, 25 bp, Homo sapiens
tatcctttatagccagggacttttt

SEQ ID NO: 30791 - DNA, 25 bp, Homo sapiens
taattatacccataacacctttatt

SEQ ID NO: 30792 - DNA, 25 bp, Homo sapiens
gtctatttatatgtgtaccaagtgt

SEQ ID NO: 30793 - DNA, 25 bp, Homo sapiens
caacatagcaatactccgtctcata

SEQ ID NO: 30794 - DNA, 25 bp, Homo sapiens
ccagttgtggtcctcagcatttgaa

SEQ ID NO: 30795 - DNA, 25 bp, Homo sapiens
gaaatcgaccattgtactactctca

SEQ ID NO: 30796 - DNA, 25 bp, Homo sapiens
gtactactctcacttacagcagtta

SEQ ID NO: 30797 - DNA, 25 bp, Homo sapiens
aaaacctgtctgcatttccattttt

SEQ ID NO: 30798 - DNA, 25 bp, Homo sapiens
gagctggtgttgtatcttcaagtcc

SEQ ID NO: 30799 - DNA, 25 bp, Homo sapiens
tatgcgtatttgcagacctttcctg

SEQ ID NO: 30800 - DNA, 25 bp, Homo sapiens
ctcttgttggctcttctgatttatg

SEQ ID NO: 30801 - DNA, 25 bp, Homo sapiens
gatttatgcacagatggttcccagc

SEQ ID NO: 30802 - DNA, 25 bp, Homo sapiens
cccagcatgtgtccagtgcttcatg

SEQ ID NO: 30803 - DNA, 25 bp, Homo sapiens
actaatcagacttcctgccagtgtc

SEQ ID NO: 30804 - DNA, 25 bp, Homo sapiens
ggcaccctgttcaaccatatttaaa

SEQ ID NO: 30805 - DNA, 25 bp, Homo sapiens
cgtaggggtgctgaggttgcccagg

SEQ ID NO: 30806 - DNA, 25 bp, Homo sapiens
aggggtcctgacaacaccagaggat

SEQ ID NO: 30807 - DNA, 25 bp, Homo sapiens
atacaagctccactgaaaaccacct

SEQ ID NO: 30808 - DNA, 25 bp, Homo sapiens
gttctgacaaacacctggcatgaca

SEQ ID NO: 30809 - DNA, 25 bp, Homo sapiens
tggaattcgttcccctttgagagat

SEQ ID NO: 30810 - DNA, 25 bp, Homo sapiens
aaatcggtacgccatggtttgaaga

SEQ ID NO: 30811 - DNA, 25 bp, Homo sapiens
aagaccaccttctagttcaggactc

SEQ ID NO: 30812 - DNA, 25 bp, Homo sapiens
ttcccagcatggccactattttgat

SEQ ID NO: 30813 - DNA, 25 bp, Homo sapiens
gaatttttcccttcagtgactgagc

SEQ ID NO: 30814 - DNA, 25 bp, Homo sapiens
gataggccatgcaagggcttcctga

SEQ ID NO: 30815 - DNA, 25 bp, Homo sapiens
ggaaagttctcttgtgcaacagcaa

SEQ ID NO: 30816 - DNA, 25 bp, Homo sapiens
agcactgagtcatgcttgcttctgc

SEQ ID NO: 30817 - DNA, 25 bp, Homo sapiens
ttctgctacgcactgatttgttcta

SEQ ID NO: 30818 - DNA, 25 bp, Homo sapiens
ctattccagttttcacgtacatcgt

SEQ ID NO: 30819 - DNA, 25 bp, Homo sapiens
gtacatcgttttggtgacatctctg

SEQ ID NO: 30820 - DNA, 25 bp, Homo sapiens
gacatctctgcgttatcatttattt

SEQ ID NO: 30821 - DNA, 25 bp, Homo sapiens
ttctccaaaacttctctacgaggga

SEQ ID NO: 30822 - DNA, 25 bp, Homo sapiens
ctacgagggaatgcacctgctcatt

SEQ ID NO: 30823 - DNA, 25 bp, Homo sapiens
cctgctcattacagctgctgtctgt

SEQ ID NO: 30824 - DNA, 25 bp, Homo sapiens
tgctgtctgtgtattcttcacggca

SEQ ID NO: 30825 - DNA, 25 bp, Homo sapiens
catgcttaaagtctgctgttattct

SEQ ID NO: 30826 - DNA, 25 bp, Homo sapiens
ctttgactgctctacctgaatttag

SEQ ID NO: 30827 - DNA, 25 bp, Homo sapiens
aagctttttgctgtccatgaatcct

SEQ ID NO: 30828 - DNA, 25 bp, Homo sapiens
catgaatcctctgtggcaactgtaa

SEQ ID NO: 30829 - DNA, 25 bp, Homo sapiens
gtcatgtctcttgtgccatggagct

SEQ ID NO: 30830 - DNA, 25 bp, Homo sapiens
gctactgagtggtgctttatctgaa

SEQ ID NO: 30831 - DNA, 25 bp, Homo sapiens
atgggactggctttccacaggaagt

SEQ ID NO: 30832 - DNA, 25 bp, Homo sapiens
gtaaactgcttcagagcccacagtc

SEQ ID NO: 30833 - DNA, 25 bp, Homo sapiens
ccctgctcagtgtccggaaagaagt

SEQ ID NO: 30834 - DNA, 25 bp, Homo sapiens
ggaaagaagtcagtcatccctgttg

SEQ ID NO: 30835 - DNA, 25 bp, Homo sapiens
ccctgttggcagtaaatcttcccac

SEQ ID NO: 30836 - DNA, 25 bp, Homo sapiens
tcccacaggccgtccattagagatt

SEQ ID NO: 30837 - DNA, 25 bp, Homo sapiens
gtgctatttcatatctgtactccag

SEQ ID NO: 30838 - DNA, 25 bp, Homo sapiens
tcagaatatgccttccgcatgtctc

SEQ ID NO: 30839 - DNA, 25 bp, Homo sapiens
cagtgcccggctatttggtgaagtc

SEQ ID NO: 30840 - DNA, 25 bp, Homo sapiens
tgaagtcaccaggcctactaattcc

SEQ ID NO: 30841 - DNA, 25 bp, Homo sapiens
aactgtttagtgaactgcccttggc

SEQ ID NO: 30842 - DNA, 25 bp, Homo sapiens
aaatcaccacacttacgctgaactc

SEQ ID NO: 30843 - DNA, 25 bp, Homo sapiens
tacgctgaactcatgcagacgctcc

SEQ ID NO: 30844 - DNA, 25 bp, Homo sapiens
ctccgatttcttggactctacagag

SEQ ID NO: 30845 - DNA, 25 bp, Homo sapiens
gaaatagtgttggtccctcaagagg

SEQ ID NO: 30846 - DNA, 25 bp, Homo sapiens
agagggagactttcttcctcagtgg

SEQ ID NO: 30847 - DNA, 25 bp, Homo sapiens
atctaatccggttacattgtggctg

SEQ ID NO: 30848 - DNA, 25 bp, Homo sapiens
ttggccttggccgtgtaatgtgagg

SEQ ID NO: 30849 - DNA, 25 bp, Homo sapiens
agacggggtctcagggacctgtgtc

SEQ ID NO: 30850 - DNA, 25 bp, Homo sapiens
ggccaggggccctcagaatgaaggc

SEQ ID NO: 30851 - DNA, 25 bp, Homo sapiens
ccctccttgacggtgctggcaggag

SEQ ID NO: 30852 - DNA, 25 bp, Homo sapiens
tgacagtgctggcgggagggccgca

SEQ ID NO: 30853 - DNA, 25 bp, Homo sapiens
gactgcctgaatctctgctgaggct

SEQ ID NO: 30854 - DNA, 25 bp, Homo sapiens
actgcgaatcagtggcgatcatgtg

SEQ ID NO: 30855 - DNA, 25 bp, Homo sapiens
gccccacagggtaagggacgagtct

SEQ ID NO: 30856 - DNA, 25 bp, Homo sapiens
gacgagtcttctggaaggctctgcc

SEQ ID NO: 30857 - DNA, 25 bp, Homo sapiens
aggctctgccatggacatttgtcct

SEQ ID NO: 30858 - DNA, 25 bp, Homo sapiens
catggacatttgtcctcgggctcag

SEQ ID NO: 30859 - DNA, 25 bp, Homo sapiens
tgtccagcccagtgttgaacagatt

SEQ ID NO: 30860 - DNA, 25 bp, Homo sapiens
caccactatttccacaagccgtgtg

SEQ ID NO: 30861 - DNA, 25 bp, Homo sapiens
aagccgtgtgtgtccatctggcttc

SEQ ID NO: 30862 - DNA, 25 bp, Homo sapiens
tggcttcagaagtcaggcacctgcc

SEQ ID NO: 30863 - DNA, 25 bp, Homo sapiens
gaccaaggccgtttactcctggtct

SEQ ID NO: 30864 - DNA, 25 bp, Homo sapiens
gaaatccacaatactgcaggagccc

SEQ ID NO: 30865 - DNA, 25 bp, Homo sapiens
agcctaaacctattgattcctcgtg

SEQ ID NO: 30866 - DNA, 25 bp, Homo sapiens
gattcctcgtgattatttccaatgt

SEQ ID NO: 30867 - DNA, 25 bp, Homo sapiens
gcatgttatgggtcgatgttcctgt

SEQ ID NO: 30868 - DNA, 25 bp, Homo sapiens
gatgttcctgtaattgcagtgccgt

SEQ ID NO: 30869 - DNA, 25 bp, Homo sapiens
tgccccatctgctgtagcgaatatg

SEQ ID NO: 30870 - DNA, 25 bp, Homo sapiens
ggtggcaactgagctgccgtgccac

SEQ ID NO: 30871 - DNA, 25 bp, Homo sapiens
ggcttcggctcggatcagtccgaga

SEQ ID NO: 30872 - DNA, 25 bp, Homo sapiens
agtccgagaatgtcgaccggggcgc

SEQ ID NO: 30873 - DNA, 25 bp, Homo sapiens
gctccatccgggaagccggtggggc

SEQ ID NO: 30874 - DNA, 25 bp, Homo sapiens
gccggtggggccttcggaaagagag

SEQ ID NO: 30875 - DNA, 25 bp, Homo sapiens
gagtagagaacaactggcagctttg

SEQ ID NO: 30876 - DNA, 25 bp, Homo sapiens
ggcagctttgaaaaaacaccatgaa

SEQ ID NO: 30877 - DNA, 25 bp, Homo sapiens
gaaggagattgagcgtctgcagaaa

SEQ ID NO: 30878 - DNA, 25 bp, Homo sapiens
gagcgccataagcagaagatcaaaa

SEQ ID NO: 30879 - DNA, 25 bp, Homo sapiens
caatggcagtgacggcgttggcggc

SEQ ID NO: 30880 - DNA, 25 bp, Homo sapiens
acatgatgattaagtgcacaccgtg

SEQ ID NO: 30881 - DNA, 25 bp, Homo sapiens
gtggggcgtgaggaccatgcaagcc

SEQ ID NO: 30882 - DNA, 25 bp, Homo sapiens
actgcccaccgtgcaggcaagaaac

SEQ ID NO: 30883 - DNA, 25 bp, Homo sapiens
caaagctgaggctcctctgctaact

SEQ ID NO: 30884 - DNA, 25 bp, Homo sapiens
acacgacttatcacccagagtgctc

SEQ ID NO: 30885 - DNA, 25 bp, Homo sapiens
agagctccccactataacagttgct

SEQ ID NO: 30886 - DNA, 25 bp, Homo sapiens
gttgctgccgccggaagtacagacc

SEQ ID NO: 30887 - DNA, 25 bp, Homo sapiens
cagtagggaacctgaacctgcggct

SEQ ID NO: 30888 - DNA, 25 bp, Homo sapiens
gccgaggagtcagcaactgtctcag

SEQ ID NO: 30889 - DNA, 25 bp, Homo sapiens
cccatgagccccacaagaagacgag

SEQ ID NO: 30890 - DNA, 25 bp, Homo sapiens
agaagacgagccctggaccattatc

SEQ ID NO: 30891 - DNA, 25 bp, Homo sapiens
acccttcgaagctctggatggatcc

SEQ ID NO: 30892 - DNA, 25 bp, Homo sapiens
tgaggaggaaccacctgatctcccc

SEQ ID NO: 30893 - DNA, 25 bp, Homo sapiens
aatggatgatttctcttttccatat

SEQ ID NO: 30894 - DNA, 25 bp, Homo sapiens
gtacctctcaagctttgcattttac

SEQ ID NO: 30895 - DNA, 25 bp, Homo sapiens
tgaggcgtcaagatggctgtggcag

SEQ ID NO: 30896 - DNA, 25 bp, Homo sapiens
ggctgtggcagctagcaaaagcaaa

SEQ ID NO: 30897 - DNA, 25 bp, Homo sapiens
gctttgtgcatagccttgtgaaaaa

SEQ ID NO: 30898 - DNA, 25 bp, Homo sapiens
tgaattttcctcccagaatatttag

SEQ ID NO: 30899 - DNA, 25 bp, Homo sapiens
gggataacagttcacagccaggtaa

SEQ ID NO: 30900 - DNA, 25 bp, Homo sapiens
ggtggcttaatgactctgcaccttt

SEQ ID NO: 30901 - DNA, 25 bp, Homo sapiens
cctttttctcaggaattctgcctaa

SEQ ID NO: 30902 - DNA, 25 bp, Homo sapiens
ggaattctgcctaagttgtctgcct

SEQ ID NO: 30903 - DNA, 25 bp, Homo sapiens
atgctttctcctgaattttggtagg

SEQ ID NO: 30904 - DNA, 25 bp, Homo sapiens
gcagcactcttaacttacgatctct

SEQ ID NO: 30905 - DNA, 25 bp, Homo sapiens
gatctcttgacatacggtttctggc

SEQ ID NO: 30906 - DNA, 25 bp, Homo sapiens
ggcctggcccgctaaggtgaaaagg

SEQ ID NO: 30907 - DNA, 25 bp, Homo sapiens
gctgtaggaatataacctcccaccc

SEQ ID NO: 30908 - DNA, 25 bp, Homo sapiens
tgcaaagggaatctcttgcctgctc

SEQ ID NO: 30909 - DNA, 25 bp, Homo sapiens
ttgcctgctccatctcataggctaa

SEQ ID NO: 30910 - DNA, 25 bp, Homo sapiens
tgaatcccgatagtactaggtcccc

SEQ ID NO: 30911 - DNA, 25 bp, Homo sapiens
cacctcactgcagtagtgcaccatc

SEQ ID NO: 30912 - DNA, 25 bp, Homo sapiens
gtgcaccatctcactgcagtagcac

SEQ ID NO: 30913 - DNA, 25 bp, Homo sapiens
aatggaggtgacggcactcccatgt

SEQ ID NO: 30914 - DNA, 25 bp, Homo sapiens
ctggctagtccctgcctgaataaag

SEQ ID NO: 30915 - DNA, 25 bp, Homo sapiens
tgaccggcgtagaggcgtcggacga

SEQ ID NO: 30916 - DNA, 25 bp, Homo sapiens
aatagctactggcggatccgcggcg

SEQ ID NO: 30917 - DNA, 25 bp, Homo sapiens
aggcggtgaggctcacgcatgtgct

SEQ ID NO: 30918 - DNA, 25 bp, Homo sapiens
ttacgggcaagaacctgcacacgca

SEQ ID NO: 30919 - DNA, 25 bp, Homo sapiens
gacgacctggacctatggacagtgc

SEQ ID NO: 30920 - DNA, 25 bp, Homo sapiens
cagtgcgctgctctggacagcactg

SEQ ID NO: 30921 - DNA, 25 bp, Homo sapiens
cactgggagcgtgaggctgctgtgc

SEQ ID NO: 30922 - DNA, 25 bp, Homo sapiens
gttcctgtcagtcacgggtgagcag

SEQ ID NO: 30923 - DNA, 25 bp, Homo sapiens
cagtatggaagccccatccgtgggc

SEQ ID NO: 30924 - DNA, 25 bp, Homo sapiens
gcatcttcatcaagcctagtgtgga

SEQ ID NO: 30925 - DNA, 25 bp, Homo sapiens
tctgcagggccactcttggcagaga

SEQ ID NO: 30926 - DNA, 25 bp, Homo sapiens
ctgggacagaactgcatcacctcac

SEQ ID NO: 30927 - DNA, 25 bp, Homo sapiens
agagaaagttggtcagctctcccag

SEQ ID NO: 30928 - DNA, 25 bp, Homo sapiens
tgaaggggaactgcttggaccgcct

SEQ ID NO: 30929 - DNA, 25 bp, Homo sapiens
ggccagtgtcggatgctcaagaaaa

SEQ ID NO: 30930 - DNA, 25 bp, Homo sapiens
gcgggcttgttgtggaagatcacct

SEQ ID NO: 30931 - DNA, 25 bp, Homo sapiens
taccctgccactcgaagtcaaagag

SEQ ID NO: 30932 - DNA, 25 bp, Homo sapiens
gcaagtgctcacgtacaagttatta

SEQ ID NO: 30933 - DNA, 25 bp, Homo sapiens
ataatcactaatcttggttcttttt

SEQ ID NO: 30934 - DNA, 25 bp, Homo sapiens
gtttgtaacttggatgctgccgcta

SEQ ID NO: 30935 - DNA, 25 bp, Homo sapiens
atgctgccgctactgaatgtttaca

SEQ ID NO: 30936 - DNA, 25 bp, Homo sapiens
gaatgtttacaaattgcttgcctgc

SEQ ID NO: 30937 - DNA, 25 bp, Homo sapiens
caccctggtcgctgggaaacgtatt

SEQ ID NO: 30938 - DNA, 25 bp, Homo sapiens
ctttgatctgttgaactgtcttcca

SEQ ID NO: 30939 - DNA, 25 bp, Homo sapiens
gccatggcagttttgacactactcc

SEQ ID NO: 30940 - DNA, 25 bp, Homo sapiens
gggaccccactttgtagggaatctg

SEQ ID NO: 30941 - DNA, 25 bp, Homo sapiens
gtgcttttgcacttgcagactgctc

SEQ ID NO: 30942 - DNA, 25 bp, Homo sapiens
tattcagctgagagtgccctagaca

SEQ ID NO: 30943 - DNA, 25 bp, Homo sapiens
aaggtcacgtttactatttcagagg

SEQ ID NO: 30944 - DNA, 25 bp, Homo sapiens
aatatcttgccaggatacctaccca

SEQ ID NO: 30945 - DNA, 25 bp, Homo sapiens
gatacctacccatccttatagaaca

SEQ ID NO: 30946 - DNA, 25 bp, Homo sapiens
cctttcctcacagggaccaagacaa

SEQ ID NO: 30947 - DNA, 25 bp, Homo sapiens
agacctcgaagtcattcttggccaa

SEQ ID NO: 30948 - DNA, 25 bp, Homo sapiens
tatagttcagcgaccttcagcacag

SEQ ID NO: 30949 - DNA, 25 bp, Homo sapiens
gcacaggtgagcgcaagcgacggcc

SEQ ID NO: 30950 - DNA, 25 bp, Homo sapiens
gaccgtaagtcctgtgagatgggcc

SEQ ID NO: 30951 - DNA, 25 bp, Homo sapiens
cccacgctcccagattgatatctat

SEQ ID NO: 30952 - DNA, 25 bp, Homo sapiens
gggacctatgcagcttgtgtgaatg

SEQ ID NO: 30953 - DNA, 25 bp, Homo sapiens
tgaatgcagccacgctggcagtgct

SEQ ID NO: 30954 - DNA, 25 bp, Homo sapiens
gtgctggatgccgggatacccatga

SEQ ID NO: 30955 - DNA, 25 bp, Homo sapiens
agcctcaggacagattgcgctgctt

SEQ ID NO: 30956 - DNA, 25 bp, Homo sapiens
ttgcgctgcttgagatggatgcccg

SEQ ID NO: 30957 - DNA, 25 bp, Homo sapiens
gcacaccctcttagatcgagtggtc

SEQ ID NO: 30958 - DNA, 25 bp, Homo sapiens
tgctgggggactgaccacccagcca

SEQ ID NO: 30959 - DNA, 25 bp, Homo sapiens
ttatactctatgtttctgtttattt

SEQ ID NO: 30960 - DNA, 25 bp, Homo sapiens
tatactctcgagagaattcctctta

SEQ ID NO: 30961 - DNA, 25 bp, Homo sapiens
ggaatgagcattctcttgttttaat

SEQ ID NO: 30962 - DNA, 25 bp, Homo sapiens
tacccagactcctgtgcagtactgg

SEQ ID NO: 30963 - DNA, 25 bp, Homo sapiens
gcagtactggtcagacgtcatggag

SEQ ID NO: 30964 - DNA, 25 bp, Homo sapiens
ggccaaaaccatgtgtgagtgttat

SEQ ID NO: 30965 - DNA, 25 bp, Homo sapiens
agtaggacttgatccttcacagctc

SEQ ID NO: 30966 - DNA, 25 bp, Homo sapiens
atccttcacagctcccagttggaga

SEQ ID NO: 30967 - DNA, 25 bp, Homo sapiens
atgatgctactaatttgccactaaa

SEQ ID NO: 30968 - DNA, 25 bp, Homo sapiens
ccctgaatctcttctgacattggat

SEQ ID NO: 30969 - DNA, 25 bp, Homo sapiens
ttggatgttatttgcttatattctt

SEQ ID NO: 30970 - DNA, 25 bp, Homo sapiens
gctcatccagcctcagtttgagacg

SEQ ID NO: 30971 - DNA, 25 bp, Homo sapiens
tcctcctctggagctatttgattta

SEQ ID NO: 30972 - DNA, 25 bp, Homo sapiens
ttagatgaaacgttctcctctgaga

SEQ ID NO: 30973 - DNA, 25 bp, Homo sapiens
agaaggcacggctggctcagattac

SEQ ID NO: 30974 - DNA, 25 bp, Homo sapiens
actaccaaaggaccaacaggatgcc

SEQ ID NO: 30975 - DNA, 25 bp, Homo sapiens
aaacatatccttgagcacgtcttct

SEQ ID NO: 30976 - DNA, 25 bp, Homo sapiens
gcacgtcttcttccaagtggtggag

SEQ ID NO: 30977 - DNA, 25 bp, Homo sapiens
aagaccatgcctcttgaagcttttt

SEQ ID NO: 30978 - DNA, 25 bp, Homo sapiens
ctcctgattctctctttgtaaacta

SEQ ID NO: 30979 - DNA, 25 bp, Homo sapiens
ctctttcctccatgagctctggaag

SEQ ID NO: 30980 - DNA, 25 bp, Homo sapiens
ggtatatgcatcttctgtaatactc

SEQ ID NO: 30981 - DNA, 25 bp, Homo sapiens
ggcgacctccagggggagtaactcg

SEQ ID NO: 30982 - DNA, 25 bp, Homo sapiens
gagtaactcggggatggacagcaac

SEQ ID NO: 30983 - DNA, 25 bp, Homo sapiens
ggacagcaacatcgacttgactatt

SEQ ID NO: 30984 - DNA, 25 bp, Homo sapiens
aggagtcagtggccctggaacaggc

SEQ ID NO: 30985 - DNA, 25 bp, Homo sapiens
gaacaggcacagaaggtacgctatg

SEQ ID NO: 30986 - DNA, 25 bp, Homo sapiens
acgctatgagggtagctacgcgcta

SEQ ID NO: 30987 - DNA, 25 bp, Homo sapiens
tacgcgctaacatccgaggaggcgg

SEQ ID NO: 30988 - DNA, 25 bp, Homo sapiens
cacacgagaccaggctttaccatga

SEQ ID NO: 30989 - DNA, 25 bp, Homo sapiens
catgaaagcgacctgtcacggactc

SEQ ID NO: 30990 - DNA, 25 bp, Homo sapiens
actccacttttaatttgctcttagg

SEQ ID NO: 30991 - DNA, 25 bp, Homo sapiens
ttgctcttaggttctatctctgtag

SEQ ID NO: 30992 - DNA, 25 bp, Homo sapiens
gtatttcattctcgtatggtgctag

SEQ ID NO: 30993 - DNA, 25 bp, Homo sapiens
aattatcatatcttccattcctgtt

SEQ ID NO: 30994 - DNA, 25 bp, Homo sapiens
aagtagacattcagatccagccatt

SEQ ID NO: 30995 - DNA, 25 bp, Homo sapiens
agatccagccattactaacctattc

SEQ ID NO: 30996 - DNA, 25 bp, Homo sapiens
gaaaaagacttggcagcttcctgat

SEQ ID NO: 30997 - DNA, 25 bp, Homo sapiens
gataaagcgtgctgtgctgtgcagt

SEQ ID NO: 30998 - DNA, 25 bp, Homo sapiens
taaactctgttccatacacttgtat

SEQ ID NO: 30999 - DNA, 25 bp, Homo sapiens
cagaagtatgtctcttaaccagttc

SEQ ID NO: 31000 - DNA, 25 bp, Homo sapiens
taaccagttcacttattgtactctg

SEQ ID NO: 31001 - DNA, 25 bp, Homo sapiens
aaatgcttaatatcgtgcctaggtt

SEQ ID NO: 31002 - DNA, 25 bp, Homo sapiens
atcgtgcctaggttatgtggtgact

SEQ ID NO: 31003 - DNA, 25 bp, Homo sapiens
cgcttcttctgctatgagggctttg

SEQ ID NO: 31004 - DNA, 25 bp, Homo sapiens
tgagcttatcggcgaggtcaccatc

SEQ ID NO: 31005 - DNA, 25 bp, Homo sapiens
gaggagctcctggacaaccgaaaac

SEQ ID NO: 31006 - DNA, 25 bp, Homo sapiens
gctgcctctaggcttggtcattgtc

SEQ ID NO: 31007 - DNA, 25 bp, Homo sapiens
gcgtttacatctactacaccaagct

SEQ ID NO: 31008 - DNA, 25 bp, Homo sapiens
ggacttcagcaacccgctgtatgaa

SEQ ID NO: 31009 - DNA, 25 bp, Homo sapiens
gtatgaagtttccatctgaacccca

SEQ ID NO: 31010 - DNA, 25 bp, Homo sapiens
ctgaaccccaagactacagctgcag

SEQ ID NO: 31011 - DNA, 25 bp, Homo sapiens
tcccctcctcattcgggcagaggga

SEQ ID NO: 31012 - DNA, 25 bp, Homo sapiens
ctcctccctggctgtgtaaatagtc

SEQ ID NO: 31013 - DNA, 25 bp, Homo sapiens
tgatggccctggagatcctacagta

SEQ ID NO: 31014 - DNA, 25 bp, Homo sapiens
gaacaccatctatagcaccctggtc

SEQ ID NO: 31015 - DNA, 25 bp, Homo sapiens
gcaccctggtcacctgtgtgacatt

SEQ ID NO: 31016 - DNA, 25 bp, Homo sapiens
tgtgacatttgtggccacactgcct

SEQ ID NO: 31017 - DNA, 25 bp, Homo sapiens
gctattcaaagccagctaacccctg

SEQ ID NO: 31018 - DNA, 25 bp, Homo sapiens
gaagcgagcctttgggggcatgtac

SEQ ID NO: 31019 - DNA, 25 bp, Homo sapiens
gggcatgtacaacctcaatctgaag

SEQ ID NO: 31020 - DNA, 25 bp, Homo sapiens
ggagcagtatctgtgtggctcacca

SEQ ID NO: 31021 - DNA, 25 bp, Homo sapiens
agcaggcatgcttcgctttgtagac

SEQ ID NO: 31022 - DNA, 25 bp, Homo sapiens
agatgtagatgtcctttcagctgcc

SEQ ID NO: 31023 - DNA, 25 bp, Homo sapiens
agtcattccaggcaagtccattcat

SEQ ID NO: 31024 - DNA, 25 bp, Homo sapiens
cagcagacggggctatgcccagctt

SEQ ID NO: 31025 - DNA, 25 bp, Homo sapiens
gacttaagtccatgaaggaaccgct

SEQ ID NO: 31026 - DNA, 25 bp, Homo sapiens
gtatctccagaaatgacgctcgttc

SEQ ID NO: 31027 - DNA, 25 bp, Homo sapiens
acgctcgttctacatttagcctggg

SEQ ID NO: 31028 - DNA, 25 bp, Homo sapiens
gggttgcctgtggttatataatatg

SEQ ID NO: 31029 - DNA, 25 bp, Homo sapiens
ggagattattccctggcaaatgcaa

SEQ ID NO: 31030 - DNA, 25 bp, Homo sapiens
gcaaatgcaagttctctggcatcca

SEQ ID NO: 31031 - DNA, 25 bp, Homo sapiens
tctggcatccacaatacggcactaa

SEQ ID NO: 31032 - DNA, 25 bp, Homo sapiens
agtaaaacataatagccgtctgcca

SEQ ID NO: 31033 - DNA, 25 bp, Homo sapiens
agccgtctgccaaaggaagtacaac

SEQ ID NO: 31034 - DNA, 25 bp, Homo sapiens
ttgatgtgtatgccaatttcactgg

SEQ ID NO: 31035 - DNA, 25 bp, Homo sapiens
tcactggcatctagcttatgaggcc

SEQ ID NO: 31036 - DNA, 25 bp, Homo sapiens
ctttgttttcctcctatcaaggcag

SEQ ID NO: 31037 - DNA, 25 bp, Homo sapiens
ttcctcctatcaaggcagctatttt

SEQ ID NO: 31038 - DNA, 25 bp, Homo sapiens
attaaatttttcacttagtctgaga

SEQ ID NO: 31039 - DNA, 25 bp, Homo sapiens
tagcagatagtctcatatttaggaa

SEQ ID NO: 31040 - DNA, 25 bp, Homo sapiens
tttactttctggtaatgtcttcagt

SEQ ID NO: 31041 - DNA, 25 bp, Homo sapiens
atattaacattctaagtctaccaaa

SEQ ID NO: 31042 - DNA, 25 bp, Homo sapiens
aaactcaagcaggccaaaaccaata

SEQ ID NO: 31043 - DNA, 25 bp, Homo sapiens
gataaagttctctatggcaaagtct

SEQ ID NO: 31044 - DNA, 25 bp, Homo sapiens
tctgtggtgccagtgcacactacct

SEQ ID NO: 31045 - DNA, 25 bp, Homo sapiens
cacccatacacatccatgttcactg

SEQ ID NO: 31046 - DNA, 25 bp, Homo sapiens
acatccatgttcactgtaacaaact

SEQ ID NO: 31047 - DNA, 25 bp, Homo sapiens
tcgagtatgctttgggatgctcccc

SEQ ID NO: 31048 - DNA, 25 bp, Homo sapiens
aagggaaagtggctgcccagtgctc

SEQ ID NO: 31049 - DNA, 25 bp, Homo sapiens
tgggaatactgtggccagcccaagg

SEQ ID NO: 31050 - DNA, 25 bp, Homo sapiens
aaggtggtggtcaaagctcctgatg

SEQ ID NO: 31051 - DNA, 25 bp, Homo sapiens
aaccctgattgcattattggcccat

SEQ ID NO: 31052 - DNA, 25 bp, Homo sapiens
gatgctggacgtactcagattgcac

SEQ ID NO: 31053 - DNA, 25 bp, Homo sapiens
cagattgcaccaggctctcaaactg

SEQ ID NO: 31054 - DNA, 25 bp, Homo sapiens
ggctctcaaactgtcctagggattg

SEQ ID NO: 31055 - DNA, 25 bp, Homo sapiens
tcactggtcacctaaaactttacta

SEQ ID NO: 31056 - DNA, 25 bp, Homo sapiens
caacccctccatcacaagtgtttga

SEQ ID NO: 31057 - DNA, 25 bp, Homo sapiens
gaatttcttcacccaacttaaatgt

SEQ ID NO: 31058 - DNA, 25 bp, Homo sapiens
ggtactcggaccatggagccataca

SEQ ID NO: 31059 - DNA, 25 bp, Homo sapiens
gaagccatcccgtcagaggggttca

SEQ ID NO: 31060 - DNA, 25 bp, Homo sapiens
gacgccaacatcagagcatcctaag

SEQ ID NO: 31061 - DNA, 25 bp, Homo sapiens
aatacggcgtgtgtctttgttgaat

SEQ ID NO: 31062 - DNA, 25 bp, Homo sapiens
gtcacacactctatgctttgttagc

SEQ ID NO: 31063 - DNA, 25 bp, Homo sapiens
gaaattctgttccgtgtttgtgtag

SEQ ID NO: 31064 - DNA, 25 bp, Homo sapiens
agcaattctgaacggcttcccgata

SEQ ID NO: 31065 - DNA, 25 bp, Homo sapiens
cttcccgatatcaacatctaccagc

SEQ ID NO: 31066 - DNA, 25 bp, Homo sapiens
taccagctgaaggtgctcgactgcg

SEQ ID NO: 31067 - DNA, 25 bp, Homo sapiens
tgcgccatggatgcctgcatcaacc

SEQ ID NO: 31068 - DNA, 25 bp, Homo sapiens
gaagccttgttctatggtactcgga

SEQ ID NO: 31069 - DNA, 25 bp, Homo sapiens
actccaatctcagtcgcactaaaaa

SEQ ID NO: 31070 - DNA, 25 bp, Homo sapiens
ttactatttgcattcagtcccagcg

SEQ ID NO: 31071 - DNA, 25 bp, Homo sapiens
agtcccagcgcattaatctgaatct

SEQ ID NO: 31072 - DNA, 25 bp, Homo sapiens
atctgaatctgctgtcctaaaatac

SEQ ID NO: 31073 - DNA, 25 bp, Homo sapiens
aacattacttgtacaatctcctatc

SEQ ID NO: 31074 - DNA, 25 bp, Homo sapiens
gaaaactgttcatctactcactgta

SEQ ID NO: 31075 - DNA, 25 bp, Homo sapiens
ggggatccctgtagtaaacactgta

SEQ ID NO: 31076 - DNA, 25 bp, Homo sapiens
gaattttacacagtctggccatcaa

SEQ ID NO: 31077 - DNA, 25 bp, Homo sapiens
ccacgctgggctgtttattaggtac

SEQ ID NO: 31078 - DNA, 25 bp, Homo sapiens
attacactgatttatccttccatct

SEQ ID NO: 31079 - DNA, 25 bp, Homo sapiens
cttccatcttttccttggcatttac

SEQ ID NO: 31080 - DNA, 25 bp, Homo sapiens
ctggagaagcactgccattcagcct

SEQ ID NO: 31081 - DNA, 25 bp, Homo sapiens
gcagaaatgctctcttcacaggcag

SEQ ID NO: 31082 - DNA, 25 bp, Homo sapiens
tccacatcccattaactcagtgctt

SEQ ID NO: 31083 - DNA, 25 bp, Homo sapiens
gagcaacctgaaaggctgctcctgg

SEQ ID NO: 31084 - DNA, 25 bp, Homo sapiens
ccagcctgtgcccactgataatagc

SEQ ID NO: 31085 - DNA, 25 bp, Homo sapiens
agagcagctgataagtttccctacc

SEQ ID NO: 31086 - DNA, 25 bp, Homo sapiens
tgataagtttccctacctgatggcc

SEQ ID NO: 31087 - DNA, 25 bp, Homo sapiens
ccctctgacataaactgcacacctg

SEQ ID NO: 31088 - DNA, 25 bp, Homo sapiens
acacctggggtgatggcttaaagcc

SEQ ID NO: 31089 - DNA, 25 bp, Homo sapiens
aagagggccaaccttagggcacgtg

SEQ ID NO: 31090 - DNA, 25 bp, Homo sapiens
gggcacgtgggcattattaaaggtc

SEQ ID NO: 31091 - DNA, 25 bp, Homo sapiens
caagctgccccatgctgaagagatt

SEQ ID NO: 31092 - DNA, 25 bp, Homo sapiens
tcagatggcagtaggcccattcctc

SEQ ID NO: 31093 - DNA, 25 bp, Homo sapiens
gaaagctgtatctctatgcggctca

SEQ ID NO: 31094 - DNA, 25 bp, Homo sapiens
tatgcggctcatgatgtgaccttca

SEQ ID NO: 31095 - DNA, 25 bp, Homo sapiens
tgaccttcataccgctcttaatgac

SEQ ID NO: 31096 - DNA, 25 bp, Homo sapiens
caaatggccaccgtttgctgttgac

SEQ ID NO: 31097 - DNA, 25 bp, Homo sapiens
ttgtgcagctctattaccacgggaa

SEQ ID NO: 31098 - DNA, 25 bp, Homo sapiens
gagaggttgccctgatgggctctgc

SEQ ID NO: 31099 - DNA, 25 bp, Homo sapiens
gcccgctggacatgttcttgaatgc

SEQ ID NO: 31100 - DNA, 25 bp, Homo sapiens
gaatgccatgtcagtttatacctta

SEQ ID NO: 31101 - DNA, 25 bp, Homo sapiens
aaaaataccatgcactctgctctca

SEQ ID NO: 31102 - DNA, 25 bp, Homo sapiens
aaagccacatgagccacagttgaga

SEQ ID NO: 31103 - DNA, 25 bp, Homo sapiens
tgagaagcggaggggccagctgtgc

SEQ ID NO: 31104 - DNA, 25 bp, Homo sapiens
ggagccatttggatggcggcgggcg

SEQ ID NO: 31105 - DNA, 25 bp, Homo sapiens
atcaggagtgactttgttgccccac

SEQ ID NO: 31106 - DNA, 25 bp, Homo sapiens
ttcactccgaatcgctggcgacaca

SEQ ID NO: 31107 - DNA, 25 bp, Homo sapiens
cacattctcctttccagctaggaaa

SEQ ID NO: 31108 - DNA, 25 bp, Homo sapiens
agctaggaaagggttcctcgcggct

SEQ ID NO: 31109 - DNA, 25 bp, Homo sapiens
ttttgtgtttgctgtctacgctgga

SEQ ID NO: 31110 - DNA, 25 bp, Homo sapiens
gtctacgctggagtcctgaactgtg

SEQ ID NO: 31111 - DNA, 25 bp, Homo sapiens
gaaaacacgacctggctttgtagaa

SEQ ID NO: 31112 - DNA, 25 bp, Homo sapiens
ctcaggtggcggctctcacagagcc

SEQ ID NO: 31113 - DNA, 25 bp, Homo sapiens
gcccctcaccaatgcatatgaagag

SEQ ID NO: 31114 - DNA, 25 bp, Homo sapiens
gaatggggtgggcatgggactgctg

SEQ ID NO: 31115 - DNA, 25 bp, Homo sapiens
gggactgctgggtagcagcctttga

SEQ ID NO: 31116 - DNA, 25 bp, Homo sapiens
tgagcaaatctgcatcttctcttat

SEQ ID NO: 31117 - DNA, 25 bp, Homo sapiens
cagtcctatttctgccagttgaagg

SEQ ID NO: 31118 - DNA, 25 bp, Homo sapiens
aacttgctactctccagataccaat

SEQ ID NO: 31119 - DNA, 25 bp, Homo sapiens
gataccaattcttcatgccgagagc

SEQ ID NO: 31120 - DNA, 25 bp, Homo sapiens
ctattcttggagtcctttgctaccc

SEQ ID NO: 31121 - DNA, 25 bp, Homo sapiens
catgcgatcactgacttctctacag

SEQ ID NO: 31122 - DNA, 25 bp, Homo sapiens
taggatttcgctgtgctcttttgat

SEQ ID NO: 31123 - DNA, 25 bp, Homo sapiens
atctcactttgttagcgttgctgct

SEQ ID NO: 31124 - DNA, 25 bp, Homo sapiens
gcattgccacagggaagtaccacgc

SEQ ID NO: 31125 - DNA, 25 bp, Homo sapiens
tgctcaccaacagcgctgagtggga

SEQ ID NO: 31126 - DNA, 25 bp, Homo sapiens
gtgggaggccgcctgtgtgaaggcg

SEQ ID NO: 31127 - DNA, 25 bp, Homo sapiens
cttcagcgagttcacctcagctgtg

SEQ ID NO: 31128 - DNA, 25 bp, Homo sapiens
cagtggcggaccgagacaacagccc

SEQ ID NO: 31129 - DNA, 25 bp, Homo sapiens
tgggtccacctggacattgctgcac

SEQ ID NO: 31130 - DNA, 25 bp, Homo sapiens
gctgcaccggtgcatgctggtgagc

SEQ ID NO: 31131 - DNA, 25 bp, Homo sapiens
cgagccacaggcttcggtgtggccc

SEQ ID NO: 31132 - DNA, 25 bp, Homo sapiens
gagggactccaagagacgcaggctt

SEQ ID NO: 31133 - DNA, 25 bp, Homo sapiens
acgcaggcttgtgtgagcctcctgc

SEQ ID NO: 31134 - DNA, 25 bp, Homo sapiens
cctcggccctgacaaacggggatct

SEQ ID NO: 31135 - DNA, 25 bp, Homo sapiens
aattcctgtgcatgttctataatct

SEQ ID NO: 31136 - DNA, 25 bp, Homo sapiens
tctataatctgacaccctgaaagca

SEQ ID NO: 31137 - DNA, 25 bp, Homo sapiens
gttctgccgtgactgttcaggtgta

SEQ ID NO: 31138 - DNA, 25 bp, Homo sapiens
gagtattagcccttgcaagttttca

SEQ ID NO: 31139 - DNA, 25 bp, Homo sapiens
agatgttctcagtgattcaacttta

SEQ ID NO: 31140 - DNA, 25 bp, Homo sapiens
aacaaatttctcgtgatgattcatt

SEQ ID NO: 31141 - DNA, 25 bp, Homo sapiens
aaatcctgagtgagtctgactgaaa

SEQ ID NO: 31142 - DNA, 25 bp, Homo sapiens
gggtgtgtgccaagcgaaacccagg

SEQ ID NO: 31143 - DNA, 25 bp, Homo sapiens
gagaccaaagcctgtaactgtccag

SEQ ID NO: 31144 - DNA, 25 bp, Homo sapiens
gcctgtaactgtccagcttctaatt

SEQ ID NO: 31145 - DNA, 25 bp, Homo sapiens
ggtccattagggcttcgttgtgtta

SEQ ID NO: 31146 - DNA, 25 bp, Homo sapiens
agctggaatctccagccaagtcctc

SEQ ID NO: 31147 - DNA, 25 bp, Homo sapiens
tccgtgctcgtggtgggaatcgtca

SEQ ID NO: 31148 - DNA, 25 bp, Homo sapiens
gctactcacggcagcggctgtagga

SEQ ID NO: 31149 - DNA, 25 bp, Homo sapiens
gctgtaggaggagctctgttgtgga

SEQ ID NO: 31150 - DNA, 25 bp, Homo sapiens
ggatctcccttcgtggagacgacac

SEQ ID NO: 31151 - DNA, 25 bp, Homo sapiens
gggaggcccaggatgctgatttgaa

SEQ ID NO: 31152 - DNA, 25 bp, Homo sapiens
tccgccattccgactgctaaaagcg

SEQ ID NO: 31153 - DNA, 25 bp, Homo sapiens
gtttcccctcctaatacatatggct

SEQ ID NO: 31154 - DNA, 25 bp, Homo sapiens
cctcgtcgtcactaacagtcaaaag

SEQ ID NO: 31155 - DNA, 25 bp, Homo sapiens
gagcaccactactgctgcattgtgc

SEQ ID NO: 31156 - DNA, 25 bp, Homo sapiens
gctgcattgtgcagcacgcggggct

SEQ ID NO: 31157 - DNA, 25 bp, Homo sapiens
ggggcggcggaagcgagtagagttt

SEQ ID NO: 31158 - DNA, 25 bp, Homo sapiens
cccagtcacctgaggagcctgtagg

SEQ ID NO: 31159 - DNA, 25 bp, Homo sapiens
gtccatccttgtggcaggcgaggag

SEQ ID NO: 31160 - DNA, 25 bp, Homo sapiens
gctgaaggaccctgaggagcttcgc

SEQ ID NO: 31161 - DNA, 25 bp, Homo sapiens
ggagcttcgcaactacatggagagg

SEQ ID NO: 31162 - DNA, 25 bp, Homo sapiens
atggagaggatccggggcagctcct

SEQ ID NO: 31163 - DNA, 25 bp, Homo sapiens
tcagccaccagctggggcaacgagg

SEQ ID NO: 31164 - DNA, 25 bp, Homo sapiens
aacgagggtggaggtcccactgagc

SEQ ID NO: 31165 - DNA, 25 bp, Homo sapiens
actcgtctggtgcttgttgatccaa

SEQ ID NO: 31166 - DNA, 25 bp, Homo sapiens
tgccccttgtcatggaccatggtcg

SEQ ID NO: 31167 - DNA, 25 bp, Homo sapiens
ggaccatggtcgtgaggaagggctc

SEQ ID NO: 31168 - DNA, 25 bp, Homo sapiens
ttctctgttctcctggaagtccagg

SEQ ID NO: 31169 - DNA, 25 bp, Homo sapiens
aatttagtaatctgccttagccttg

SEQ ID NO: 31170 - DNA, 25 bp, Homo sapiens
agtaatctgccttagccttgggagg

SEQ ID NO: 31171 - DNA, 25 bp, Homo sapiens
aatctgccttagccttgggaggtct

SEQ ID NO: 31172 - DNA, 25 bp, Homo sapiens
ctcccagcagtcttggggtctgggt

SEQ ID NO: 31173 - DNA, 25 bp, Homo sapiens
gggtctgggtgggaaacattggtct

SEQ ID NO: 31174 - DNA, 25 bp, Homo sapiens
gggtgggaaacattggtctctacca

SEQ ID NO: 31175 - DNA, 25 bp, Homo sapiens
aacattggtctctaccaggatccct

SEQ ID NO: 31176 - DNA, 25 bp, Homo sapiens
ctccccaattaagtgccttcacaca

SEQ ID NO: 31177 - DNA, 25 bp, Homo sapiens
gtgccttcacacagcactggtttaa

SEQ ID NO: 31178 - DNA, 25 bp, Homo sapiens
cttcacacagcactggtttaatgtt

SEQ ID NO: 31179 - DNA, 25 bp, Homo sapiens
tacctggatgacatcgcttccatgc

SEQ ID NO: 31180 - DNA, 25 bp, Homo sapiens
agcatcaacagcacagacagcgagc

SEQ ID NO: 31181 - DNA, 25 bp, Homo sapiens
aacagcacagacagcgagcgctgga

SEQ ID NO: 31182 - DNA, 25 bp, Homo sapiens
gcgagcgctggaaggccatcaatgc

SEQ ID NO: 31183 - DNA, 25 bp, Homo sapiens
ggaaggccatcaatgcctgagggca

SEQ ID NO: 31184 - DNA, 25 bp, Homo sapiens
gaggaccaggtcaagggacgttctg

SEQ ID NO: 31185 - DNA, 25 bp, Homo sapiens
agggacgttctgtgggcagtagccc

SEQ ID NO: 31186 - DNA, 25 bp, Homo sapiens
tctgtgggcagtagccctgtgtggc

SEQ ID NO: 31187 - DNA, 25 bp, Homo sapiens
tgttcccaccatgagtctggaggcc

SEQ ID NO: 31188 - DNA, 25 bp, Homo sapiens
ctctcatactgctcagtgacatggc

SEQ ID NO: 31189 - DNA, 25 bp, Homo sapiens
atactgctcagtgacatggcccagg

SEQ ID NO: 31190 - DNA, 25 bp, Homo sapiens
cagggtccctgtgttggaattctcc

SEQ ID NO: 31191 - DNA, 25 bp, Homo sapiens
tggaattctccctggggaacctact

SEQ ID NO: 31192 - DNA, 25 bp, Homo sapiens
gaacctactttctgctcagtgaggc

SEQ ID NO: 31193 - DNA, 25 bp, Homo sapiens
ccagaaacctggagtccttatcctc

SEQ ID NO: 31194 - DNA, 25 bp, Homo sapiens
tcctcccctctgtaagtgttttagg

SEQ ID NO: 31195 - DNA, 25 bp, Homo sapiens
cctacctacaatgccaaagcctcag

SEQ ID NO: 31196 - DNA, 25 bp, Homo sapiens
ccacgctgcccatgcagcagagggc

SEQ ID NO: 31197 - DNA, 25 bp, Homo sapiens
ggcagaaggcttgcacttgggccaa

SEQ ID NO: 31198 - DNA, 25 bp, Homo sapiens
aaagggcctaaggtccactggacag

SEQ ID NO: 31199 - DNA, 25 bp, Homo sapiens
acacctgaccaccatttaaggactc

SEQ ID NO: 31200 - DNA, 25 bp, Homo sapiens
gactccattcttaagcctatgcgag

SEQ ID NO: 31201 - DNA, 25 bp, Homo sapiens
ctagaatgtgttattgcccctgttc

SEQ ID NO: 31202 - DNA, 25 bp, Homo sapiens
aaattgcaccccaaatatggctgga

SEQ ID NO: 31203 - DNA, 25 bp, Homo sapiens
tatggctggaatgccacttcccttt

SEQ ID NO: 31204 - DNA, 25 bp, Homo sapiens
tcaagccccgggctagcttttgaaa

SEQ ID NO: 31205 - DNA, 25 bp, Homo sapiens
ccatagatctggatctggccctgct

SEQ ID NO: 31206 - DNA, 25 bp, Homo sapiens
ccctgctgcttctcagacagcattg

SEQ ID NO: 31207 - DNA, 25 bp, Homo sapiens
ggtgctcaggaggatggttgtgtag

SEQ ID NO: 31208 - DNA, 25 bp, Homo sapiens
tagtcatggaggacccctggatcct

SEQ ID NO: 31209 - DNA, 25 bp, Homo sapiens
cattcccctcagctaatgacggagt

SEQ ID NO: 31210 - DNA, 25 bp, Homo sapiens
taatgacggagtgctccttctccag

SEQ ID NO: 31211 - DNA, 25 bp, Homo sapiens
ttgccattttgtcctttgattatat

SEQ ID NO: 31212 - DNA, 25 bp, Homo sapiens
gtgggaggacatccacgttgtcacc

SEQ ID NO: 31213 - DNA, 25 bp, Homo sapiens
acgttgtcaccggagcactgaagat

SEQ ID NO: 31214 - DNA, 25 bp, Homo sapiens
gaagatgtttttccgggagctgcct

SEQ ID NO: 31215 - DNA, 25 bp, Homo sapiens
tcttcccttacagtttctttgagca

SEQ ID NO: 31216 - DNA, 25 bp, Homo sapiens
atctcttgtacaaaaactccctccg

SEQ ID NO: 31217 - DNA, 25 bp, Homo sapiens
ctccgccaaatcgtgacaccatgaa

SEQ ID NO: 31218 - DNA, 25 bp, Homo sapiens
acctcatgtccacgcaaagcttggg

SEQ ID NO: 31219 - DNA, 25 bp, Homo sapiens
cctacccttctgcgagctgaaaatg

SEQ ID NO: 31220 - DNA, 25 bp, Homo sapiens
tggcgatccacatggtctaccagaa

SEQ ID NO: 31221 - DNA, 25 bp, Homo sapiens
acgttcacatctgtcttgatgccta

SEQ ID NO: 31222 - DNA, 25 bp, Homo sapiens
gcctttcaagcgacagatgcctcat

SEQ ID NO: 31223 - DNA, 25 bp, Homo sapiens
agggtatggtatgtgggacttcgct

SEQ ID NO: 31224 - DNA, 25 bp, Homo sapiens
catgtacgactcggacagcgacggc

SEQ ID NO: 31225 - DNA, 25 bp, Homo sapiens
cggccgcatcactctggaagaatat

SEQ ID NO: 31226 - DNA, 25 bp, Homo sapiens
gtaaagtggtcgaggagctgctgtc

SEQ ID NO: 31227 - DNA, 25 bp, Homo sapiens
ctgtcgggaaaccctcacatctaga

SEQ ID NO: 31228 - DNA, 25 bp, Homo sapiens
atctagaaggagtccgctcgctcca

SEQ ID NO: 31229 - DNA, 25 bp, Homo sapiens
ccatcgccgacggggccatgatgga

SEQ ID NO: 31230 - DNA, 25 bp, Homo sapiens
catgatggaggcggccagcgtgtgc

SEQ ID NO: 31231 - DNA, 25 bp, Homo sapiens
ccgcggagagactgcactttgcaat

SEQ ID NO: 31232 - DNA, 25 bp, Homo sapiens
gcagcgccggtacatagccaaggct

SEQ ID NO: 31233 - DNA, 25 bp, Homo sapiens
tgcgcaccttgtgtcttgtagggta

SEQ ID NO: 31234 - DNA, 25 bp, Homo sapiens
agagccagccaatgtgggcgtcact

SEQ ID NO: 31235 - DNA, 25 bp, Homo sapiens
gtgctgtagaccggctgacggacac

SEQ ID NO: 31236 - DNA, 25 bp, Homo sapiens
ggagcgcttcgatgagagcggcaag

SEQ ID NO: 31237 - DNA, 25 bp, Homo sapiens
ttgcgggacggcaggacatcctgga

SEQ ID NO: 31238 - DNA, 25 bp, Homo sapiens
gacatcctggacgacagtggctacg

SEQ ID NO: 31239 - DNA, 25 bp, Homo sapiens
gtggctacgtgagcgcctacaagaa

SEQ ID NO: 31240 - DNA, 25 bp, Homo sapiens
agtgaggcttgggaagaccgccctg

SEQ ID NO: 31241 - DNA, 25 bp, Homo sapiens
gctcaggcctgggtctaaggggcac

SEQ ID NO: 31242 - DNA, 25 bp, Homo sapiens
tgtccacctggggacagtctgtgcc

SEQ ID NO: 31243 - DNA, 25 bp, Homo sapiens
tgcctcatatttaagctgctgctct

SEQ ID NO: 31244 - DNA, 25 bp, Homo sapiens
ggccaagtgcctaattttaacccag

SEQ ID NO: 31245 - DNA, 25 bp, Homo sapiens
actgcctattgagacaaccaggtgc

SEQ ID NO: 31246 - DNA, 25 bp, Homo sapiens
gtgcataattgattgccctttggcc

SEQ ID NO: 31247 - DNA, 25 bp, Homo sapiens
tgcagtgtcatggatcttagagcta

SEQ ID NO: 31248 - DNA, 25 bp, Homo sapiens
agaacagcgtcctcagacttaacct

SEQ ID NO: 31249 - DNA, 25 bp, Homo sapiens
cgtcctcagacttaaccttctgcaa

SEQ ID NO: 31250 - DNA, 25 bp, Homo sapiens
accttctgcaagttatgtctgtata

SEQ ID NO: 31251 - DNA, 25 bp, Homo sapiens
caagctaagatgcctggctgggctt

SEQ ID NO: 31252 - DNA, 25 bp, Homo sapiens
gcaggtggtaggggcactgacccac

SEQ ID NO: 31253 - DNA, 25 bp, Homo sapiens
cgccccgcacagtcaaaaatctgca

SEQ ID NO: 31254 - DNA, 25 bp, Homo sapiens
ctgcatataacttttgattccccaa

SEQ ID NO: 31255 - DNA, 25 bp, Homo sapiens
gtactagtagcctgttattgactgg

SEQ ID NO: 31256 - DNA, 25 bp, Homo sapiens
ggcagacatgaaaagccttcctcca

SEQ ID NO: 31257 - DNA, 25 bp, Homo sapiens
agtaaagaacagtccaaaattggca

SEQ ID NO: 31258 - DNA, 25 bp, Homo sapiens
ggcaaaaaggagcctggtgacacag

SEQ ID NO: 31259 - DNA, 25 bp, Homo sapiens
ggtgacacagtgcacaaagaagaaa

SEQ ID NO: 31260 - DNA, 25 bp, Homo sapiens
tcaaaacctaacacaaagaaacgcg

SEQ ID NO: 31261 - DNA, 25 bp, Homo sapiens
gaaacgcggtttaacaggtgacagt

SEQ ID NO: 31262 - DNA, 25 bp, Homo sapiens
gaaagtggcctgatatcaaccaaga

SEQ ID NO: 31263 - DNA, 25 bp, Homo sapiens
gcagtgaatcacagatgtctcctga

SEQ ID NO: 31264 - DNA, 25 bp, Homo sapiens
agatgtctcctgaaagaactctttt

SEQ ID NO: 31265 - DNA, 25 bp, Homo sapiens
attacttttggcagacagtgtttta

SEQ ID NO: 31266 - DNA, 25 bp, Homo sapiens
gtgtggctagacaaagtggcagaca

SEQ ID NO: 31267 - DNA, 25 bp, Homo sapiens
gaatcatttcattcactttgggaga

SEQ ID NO: 31268 - DNA, 25 bp, Homo sapiens
tatttgcaatgtttctcttcgctag

SEQ ID NO: 31269 - DNA, 25 bp, Homo sapiens
gtttctcttcgctagattgttacat

SEQ ID NO: 31270 - DNA, 25 bp, Homo sapiens
gttacatagctcccattctgttggt

SEQ ID NO: 31271 - DNA, 25 bp, Homo sapiens
ggatgagccttgagattgcttctta

SEQ ID NO: 31272 - DNA, 25 bp, Homo sapiens
gattgcttcttaactgggacatgac

SEQ ID NO: 31273 - DNA, 25 bp, Homo sapiens
gggacatgacatttttctagctctt

SEQ ID NO: 31274 - DNA, 25 bp, Homo sapiens
tcagtgttcacatcagtggctttgt

SEQ ID NO: 31275 - DNA, 25 bp, Homo sapiens
tatgctgtgttggacctggacgcta

SEQ ID NO: 31276 - DNA, 25 bp, Homo sapiens
ggacctggacgctataacttattgt

SEQ ID NO: 31277 - DNA, 25 bp, Homo sapiens
atgtggacataagctctttctttcc

SEQ ID NO: 31278 - DNA, 25 bp, Homo sapiens
tgtctcaccatttggggtggcccag

SEQ ID NO: 31279 - DNA, 25 bp, Homo sapiens
tggagccacctgatgacacggagct

SEQ ID NO: 31280 - DNA, 25 bp, Homo sapiens
gacacggagctgcacatctagctgt

SEQ ID NO: 31281 - DNA, 25 bp, Homo sapiens
acggagctgcacatctagctgtggc

SEQ ID NO: 31282 - DNA, 25 bp, Homo sapiens
gcagcctcggactatgactggctac

SEQ ID NO: 31283 - DNA, 25 bp, Homo sapiens
atgactggctacggggaggccacca

SEQ ID NO: 31284 - DNA, 25 bp, Homo sapiens
gagtactaggaccacagaagccctg

SEQ ID NO: 31285 - DNA, 25 bp, Homo sapiens
tgctcactgacctgtgaccaggtcc

SEQ ID NO: 31286 - DNA, 25 bp, Homo sapiens
ctgtgaccaggtccaatgtggggag

SEQ ID NO: 31287 - DNA, 25 bp, Homo sapiens
tgaaggaggtagcagccctgggttc

SEQ ID NO: 31288 - DNA, 25 bp, Homo sapiens
gggttctcctcagtgagggatccct

SEQ ID NO: 31289 - DNA, 25 bp, Homo sapiens
ctgggtgggaattggctgagccaag

SEQ ID NO: 31290 - DNA, 25 bp, Homo sapiens
tcagactgtgggacacggactcgca

SEQ ID NO: 31291 - DNA, 25 bp, Homo sapiens
ggctgcaggtccatgtggtggtgga

SEQ ID NO: 31292 - DNA, 25 bp, Homo sapiens
tggctctggcccgcatgagacagag

SEQ ID NO: 31293 - DNA, 25 bp, Homo sapiens
atgagacagagtggtgccttcctct

SEQ ID NO: 31294 - DNA, 25 bp, Homo sapiens
accagcgaagggctcattctgcagc

SEQ ID NO: 31295 - DNA, 25 bp, Homo sapiens
cattctgcagcttgtgggcgatgcc

SEQ ID NO: 31296 - DNA, 25 bp, Homo sapiens
cttgagggaagaccaccctcctgtc

SEQ ID NO: 31297 - DNA, 25 bp, Homo sapiens
gatcccaagagtggtgcgatccacc

SEQ ID NO: 31298 - DNA, 25 bp, Homo sapiens
agtggtgcgatccaccaggagtgcc

SEQ ID NO: 31299 - DNA, 25 bp, Homo sapiens
gacagctgctcccggaaatgcaaat

SEQ ID NO: 31300 - DNA, 25 bp, Homo sapiens
ggctcatcacaaggacacttccagc

SEQ ID NO: 31301 - DNA, 25 bp, Homo sapiens
cctgccattgagtctggagggccct

SEQ ID NO: 31302 - DNA, 25 bp, Homo sapiens
gagcctttggacctatagctcaagg

SEQ ID NO: 31303 - DNA, 25 bp, Homo sapiens
taaccactacttatgaactcaggga

SEQ ID NO: 31304 - DNA, 25 bp, Homo sapiens
gagcctttgtttcttgaactgtaaa

SEQ ID NO: 31305 - DNA, 25 bp, Homo sapiens
ggagatgatgtaaaccgccttgcaa

SEQ ID NO: 31306 - DNA, 25 bp, Homo sapiens
atgcctgtggtggagtggagttcta

SEQ ID NO: 31307 - DNA, 25 bp, Homo sapiens
tatgagaagcttctgtcgggcaacc

SEQ ID NO: 31308 - DNA, 25 bp, Homo sapiens
gaagctgtatacacccagcgggaac

SEQ ID NO: 31309 - DNA, 25 bp, Homo sapiens
cccagacacttgttccgaatcaaac

SEQ ID NO: 31310 - DNA, 25 bp, Homo sapiens
cgaatcaaacatttaccctacacca

SEQ ID NO: 31311 - DNA, 25 bp, Homo sapiens
acttgtgagcttactgcagtcagtc

SEQ ID NO: 31312 - DNA, 25 bp, Homo sapiens
cacagaggctgttctttttcacaca

SEQ ID NO: 31313 - DNA, 25 bp, Homo sapiens
atatccacatgcagagggcgagctc

SEQ ID NO: 31314 - DNA, 25 bp, Homo sapiens
ccactgtgacactgtccttttcatg

SEQ ID NO: 31315 - DNA, 25 bp, Homo sapiens
cagagtacttgagtgctttgcctcc

SEQ ID NO: 31316 - DNA, 25 bp, Homo sapiens
cctcccgatatgccagagcttgtgg

SEQ ID NO: 31317 - DNA, 25 bp, Homo sapiens
agagcttgtggtccaaagcccattc

SEQ ID NO: 31318 - DNA, 25 bp, Homo sapiens
cgtcctgccatttagccacagaagg

SEQ ID NO: 31319 - DNA, 25 bp, Homo sapiens
tttctggtgccaacactcattcatc

SEQ ID NO: 31320 - DNA, 25 bp, Homo sapiens
ctcattcatcattcccgatcaacta

SEQ ID NO: 31321 - DNA, 25 bp, Homo sapiens
ctgtgctaccatgtgttctcaagtg

SEQ ID NO: 31322 - DNA, 25 bp, Homo sapiens
cggaaggtgcggtacaggccggtgg

SEQ ID NO: 31323 - DNA, 25 bp, Homo sapiens
cgcagctgcaggacgacaaggaccc

SEQ ID NO: 31324 - DNA, 25 bp, Homo sapiens
catgctgattcttcgaggccgagtc

SEQ ID NO: 31325 - DNA, 25 bp, Homo sapiens
gggcctgtttttggagagccatcag

SEQ ID NO: 31326 - DNA, 25 bp, Homo sapiens
gtctcgctgggagagagccggagca

SEQ ID NO: 31327 - DNA, 25 bp, Homo sapiens
gagccggagcagcgaagtggacgtc

SEQ ID NO: 31328 - DNA, 25 bp, Homo sapiens
cagcgaagtggacgtctcggatctc

SEQ ID NO: 31329 - DNA, 25 bp, Homo sapiens
atctcggctcgcgaaactacagtgc

SEQ ID NO: 31330 - DNA, 25 bp, Homo sapiens
aaactacagtgcccgcacagacttc

SEQ ID NO: 31331 - DNA, 25 bp, Homo sapiens
tcccaccccagagtgcaggatcata

SEQ ID NO: 31332 - DNA, 25 bp, Homo sapiens
aggatcatagggacagcgggggcca

SEQ ID NO: 31333 - DNA, 25 bp, Homo sapiens
agaagaatcagactccagtgaggag

SEQ ID NO: 31334 - DNA, 25 bp, Homo sapiens
cccaggaacctctgcagctaaagaa

SEQ ID NO: 31335 - DNA, 25 bp, Homo sapiens
ggaacctctgcagctaaagaacggg

SEQ ID NO: 31336 - DNA, 25 bp, Homo sapiens
ggccacctttctggagacagggagg

SEQ ID NO: 31337 - DNA, 25 bp, Homo sapiens
gggtgggtgggaaggctgatgatct

SEQ ID NO: 31338 - DNA, 25 bp, Homo sapiens
ggtgggaaggctgatgatctgtctc

SEQ ID NO: 31339 - DNA, 25 bp, Homo sapiens
tgggcaactggacagatctgggagc

SEQ ID NO: 31340 - DNA, 25 bp, Homo sapiens
caactggacagatctgggagccagc

SEQ ID NO: 31341 - DNA, 25 bp, Homo sapiens
ccagcagctggatgctgtggctggc

SEQ ID NO: 31342 - DNA, 25 bp, Homo sapiens
ggatgctgtggctggccagagacac

SEQ ID NO: 31343 - DNA, 25 bp, Homo sapiens
tgctgtggctggccagagacacctc

SEQ ID NO: 31344 - DNA, 25 bp, Homo sapiens
aactatcgcttacggggcattggca

SEQ ID NO: 31345 - DNA, 25 bp, Homo sapiens
gcaaactgtcttgactactctggag

SEQ ID NO: 31346 - DNA, 25 bp, Homo sapiens
tactctggagatgctgtagccaaac

SEQ ID NO: 31347 - DNA, 25 bp, Homo sapiens
gagatgaacatcttttgtcaaacca

SEQ ID NO: 31348 - DNA, 25 bp, Homo sapiens
aacagatctagtttcttgcattttt

SEQ ID NO: 31349 - DNA, 25 bp, Homo sapiens
tacacacgaatgtcctcagtatcca

SEQ ID NO: 31350 - DNA, 25 bp, Homo sapiens
gaagcaagtcaacttacctattaaa

SEQ ID NO: 31351 - DNA, 25 bp, Homo sapiens
ttcctctattagatgtttcaacact

SEQ ID NO: 31352 - DNA, 25 bp, Homo sapiens
attatgccatatttcccttcattat

SEQ ID NO: 31353 - DNA, 25 bp, Homo sapiens
atatgctcacgaatcaatgctgatt

SEQ ID NO: 31354 - DNA, 25 bp, Homo sapiens
agcagtttgtgctatacttttcccc

SEQ ID NO: 31355 - DNA, 25 bp, Homo sapiens
gagccctagatgttcctggaagttg

SEQ ID NO: 31356 - DNA, 25 bp, Homo sapiens
gaggaagatctggcgtcacatggct

SEQ ID NO: 31357 - DNA, 25 bp, Homo sapiens
tggctcccaggaaagtgctgtgccc

SEQ ID NO: 31358 - DNA, 25 bp, Homo sapiens
tatccccactgataccatctgattc

SEQ ID NO: 31359 - DNA, 25 bp, Homo sapiens
cccgcagcacagcgacggtgggaag

SEQ ID NO: 31360 - DNA, 25 bp, Homo sapiens
gtgggaagatgccttacgtctgatc

SEQ ID NO: 31361 - DNA, 25 bp, Homo sapiens
gtctgatcttgatgggggcactggc

SEQ ID NO: 31362 - DNA, 25 bp, Homo sapiens
gactgtggggtgggcccaggatttc

SEQ ID NO: 31363 - DNA, 25 bp, Homo sapiens
gcccaggatttccacatcttggtga

SEQ ID NO: 31364 - DNA, 25 bp, Homo sapiens
ggtgaagctgagtttctgtccaatg

SEQ ID NO: 31365 - DNA, 25 bp, Homo sapiens
aagattctgagacatttcgcctgag

SEQ ID NO: 31366 - DNA, 25 bp, Homo sapiens
aatactcagcattaccattggttga

SEQ ID NO: 31367 - DNA, 25 bp, Homo sapiens
ggttgaggccaaattcagagctttc

SEQ ID NO: 31368 - DNA, 25 bp, Homo sapiens
acggggaaacatccccgagccactg

SEQ ID NO: 31369 - DNA, 25 bp, Homo sapiens
gctgtgctttgtcactgaaggttag

SEQ ID NO: 31370 - DNA, 25 bp, Homo sapiens
tgaacccagggtgtcaacagctgct

SEQ ID NO: 31371 - DNA, 25 bp, Homo sapiens
cccacctctgggcactgaggagtat

SEQ ID NO: 31372 - DNA, 25 bp, Homo sapiens
cactgaggagtatttcccctcattc

SEQ ID NO: 31373 - DNA, 25 bp, Homo sapiens
tctacctctctaaggctatgcaccc

SEQ ID NO: 31374 - DNA, 25 bp, Homo sapiens
ggagtcataggaaaagcccccatct

SEQ ID NO: 31375 - DNA, 25 bp, Homo sapiens
ctgggatagggaccttccatcagcc

SEQ ID NO: 31376 - DNA, 25 bp, Homo sapiens
tttcgtctcccacatacagaagcag

SEQ ID NO: 31377 - DNA, 25 bp, Homo sapiens
tctggccatctgtcacgtcacagaa

SEQ ID NO: 31378 - DNA, 25 bp, Homo sapiens
acgtcacagaagcaaaccgtgcctt

SEQ ID NO: 31379 - DNA, 25 bp, Homo sapiens
attcccagcatcatagacatccaac

SEQ ID NO: 31380 - DNA, 25 bp, Homo sapiens
gcagccactgtctcttgtcaagtgg

SEQ ID NO: 31381 - DNA, 25 bp, Homo sapiens
aagtgggacctcatactattctcag

SEQ ID NO: 31382 - DNA, 25 bp, Homo sapiens
ggactctgcagtgtccttggcaaat

SEQ ID NO: 31383 - DNA, 25 bp, Homo sapiens
tcatggccactgaaccaatcacttt

SEQ ID NO: 31384 - DNA, 25 bp, Homo sapiens
caatcactttgtatgctatgctcct

SEQ ID NO: 31385 - DNA, 25 bp, Homo sapiens
ttgtatgctatgctcctactgtgat

SEQ ID NO: 31386 - DNA, 25 bp, Homo sapiens
atattctatgcatctatgacgtgct

SEQ ID NO: 31387 - DNA, 25 bp, Homo sapiens
gacgtgcttactactgcagtgcatt

SEQ ID NO: 31388 - DNA, 25 bp, Homo sapiens
ctctgatggcaagacttggcccctc

SEQ ID NO: 31389 - DNA, 25 bp, Homo sapiens
cacctgtccctaacggacggcaggt

SEQ ID NO: 31390 - DNA, 25 bp, Homo sapiens
gcaaacccccaggattgaaggctag

SEQ ID NO: 31391 - DNA, 25 bp, Homo sapiens
gaaggctagggttctagggcctttg

SEQ ID NO: 31392 - DNA, 25 bp, Homo sapiens
cctgtgcgcctgagcagatcaatcc

SEQ ID NO: 31393 - DNA, 25 bp, Homo sapiens
gagcagatcaatccaccagtgcaaa

SEQ ID NO: 31394 - DNA, 25 bp, Homo sapiens
gcaaaacagggctaacggcacctgc

SEQ ID NO: 31395 - DNA, 25 bp, Homo sapiens
tcccagggcaggctgactcagttga

SEQ ID NO: 31396 - DNA, 25 bp, Homo sapiens
actcagttgactgcttggtccaagc

SEQ ID NO: 31397 - DNA, 25 bp, Homo sapiens
ctggccctggcacttgtcagggtca

SEQ ID NO: 31398 - DNA, 25 bp, Homo sapiens
gcacttgtcagggtcagcctaagga

SEQ ID NO: 31399 - DNA, 25 bp, Homo sapiens
ttctcaagaagcacctcgtgtcggc

SEQ ID NO: 31400 - DNA, 25 bp, Homo sapiens
tcggccggatatgtccacgtgaaca

SEQ ID NO: 31401 - DNA, 25 bp, Homo sapiens
tgaacagggacacgctaggctcctg

SEQ ID NO: 31402 - DNA, 25 bp, Homo sapiens
gtgtgaccacgtgtgagacagccct

SEQ ID NO: 31403 - DNA, 25 bp, Homo sapiens
agcaagggaaacgggtcgccatcga

SEQ ID NO: 31404 - DNA, 25 bp, Homo sapiens
ccatcgacaacacaaacccagacgc

SEQ ID NO: 31405 - DNA, 25 bp, Homo sapiens
cgccacaacaaccggtttcgagaga

SEQ ID NO: 31406 - DNA, 25 bp, Homo sapiens
atatccccgtgtcagacatggtcat

SEQ ID NO: 31407 - DNA, 25 bp, Homo sapiens
gctacaggaagcagttcgaggcccc

SEQ ID NO: 31408 - DNA, 25 bp, Homo sapiens
tcccgttccggctatgggtggagcc

SEQ ID NO: 31409 - DNA, 25 bp, Homo sapiens
cccctccacaataaacgctgtttct

SEQ ID NO: 31410 - DNA, 25 bp, Homo sapiens
gatccccattgagttaatgctctgc

SEQ ID NO: 31411 - DNA, 25 bp, Homo sapiens
attatttttctgatccttgttagtg

SEQ ID NO: 31412 - DNA, 25 bp, Homo sapiens
atttctcttctggtatacatgtaat

SEQ ID NO: 31413 - DNA, 25 bp, Homo sapiens
gcaggcactgatcagggtatctcct

SEQ ID NO: 31414 - DNA, 25 bp, Homo sapiens
gaggtaattcacttcttattccttt

SEQ ID NO: 31415 - DNA, 25 bp, Homo sapiens
ttgtttaaatggtttgccttctcac

SEQ ID NO: 31416 - DNA, 25 bp, Homo sapiens
gccttctcaccattgaagccatttt

SEQ ID NO: 31417 - DNA, 25 bp, Homo sapiens
agaggaaataatgcctccaccattt

SEQ ID NO: 31418 - DNA, 25 bp, Homo sapiens
cctccaccattttctacctggtgac

SEQ ID NO: 31419 - DNA, 25 bp, Homo sapiens
gtcagggaacttgtataccactatc

SEQ ID NO: 31420 - DNA, 25 bp, Homo sapiens
atagtctgattatttctgtgttttg

SEQ ID NO: 31421 - DNA, 25 bp, Homo sapiens
tcttacctgccaacatattcaccat

SEQ ID NO: 31422 - DNA, 25 bp, Homo sapiens
gcaacctaaattactttcgctctct

SEQ ID NO: 31423 - DNA, 25 bp, Homo sapiens
actttcgctctctaatcagcatttc

SEQ ID NO: 31424 - DNA, 25 bp, Homo sapiens
attgtgtcggaccctacttttgaga

SEQ ID NO: 31425 - DNA, 25 bp, Homo sapiens
tgggaactggctattccttgtcccg

SEQ ID NO: 31426 - DNA, 25 bp, Homo sapiens
ttgataagcactcctagtctctggc

SEQ ID NO: 31427 - DNA, 25 bp, Homo sapiens
tagtctctggcctgtggatccagtg

SEQ ID NO: 31428 - DNA, 25 bp, Homo sapiens
tggatccagtgctattctgtcacca

SEQ ID NO: 31429 - DNA, 25 bp, Homo sapiens
aagaatcccaattgcaccttctgtt

SEQ ID NO: 31430 - DNA, 25 bp, Homo sapiens
gcaccttctgtttctgacagtcaca

SEQ ID NO: 31431 - DNA, 25 bp, Homo sapiens
gcatcaccctgctaatacataataa

SEQ ID NO: 31432 - DNA, 25 bp, Homo sapiens
ggtaatttccttctaatatgttggt

SEQ ID NO: 31433 - DNA, 25 bp, Homo sapiens
atgttggtactgtctatggccatac

SEQ ID NO: 31434 - DNA, 25 bp, Homo sapiens
ccctgaacatgcctgagcttgtcat

SEQ ID NO: 31435 - DNA, 25 bp, Homo sapiens
atgcctgagcttgtcataatatgtt

SEQ ID NO: 31436 - DNA, 25 bp, Homo sapiens
gtagatcagaacatcaggctttcag

SEQ ID NO: 31437 - DNA, 25 bp, Homo sapiens
gcatttatctatgtctttaggtgtc

SEQ ID NO: 31438 - DNA, 25 bp, Homo sapiens
ttaggtgtcattgttccctttctga

SEQ ID NO: 31439 - DNA, 25 bp, Homo sapiens
tccctttctgaattagctgtacata

SEQ ID NO: 31440 - DNA, 25 bp, Homo sapiens
gctgtacatataagccttcctttgg

SEQ ID NO: 31441 - DNA, 25 bp, Homo sapiens
agagggactgtttaccattcttcca

SEQ ID NO: 31442 - DNA, 25 bp, Homo sapiens
taccattcttccactgtgctgttat

SEQ ID NO: 31443 - DNA, 25 bp, Homo sapiens
gcacctcggagttgcagctgtgaca

SEQ ID NO: 31444 - DNA, 25 bp, Homo sapiens
ctgtgacactcataggttactccca

SEQ ID NO: 31445 - DNA, 25 bp, Homo sapiens
cttgctggatgaaacccctccaggt

SEQ ID NO: 31446 - DNA, 25 bp, Homo sapiens
ggagacttgatattcacatccaaca

SEQ ID NO: 31447 - DNA, 25 bp, Homo sapiens
aagggagagctcaattcccagcgtc

SEQ ID NO: 31448 - DNA, 25 bp, Homo sapiens
tgcctgctacgcattgacttggatc

SEQ ID NO: 31449 - DNA, 25 bp, Homo sapiens
tcgtgtcagctgtgtttctcttgat

SEQ ID NO: 31450 - DNA, 25 bp, Homo sapiens
cttgattccgtgacacccggtttat

SEQ ID NO: 31451 - DNA, 25 bp, Homo sapiens
aaagtgtgacaccttttctgggcaa

SEQ ID NO: 31452 - DNA, 25 bp, Homo sapiens
tgggcaaggaacagcccctttaagg

SEQ ID NO: 31453 - DNA, 25 bp, Homo sapiens
tcacagactgagtctccacaacacc

SEQ ID NO: 31454 - DNA, 25 bp, Homo sapiens
tgaccaggcttgttctggatcccta

SEQ ID NO: 31455 - DNA, 25 bp, Homo sapiens
agcggaaaacctactttgctcacga

SEQ ID NO: 31456 - DNA, 25 bp, Homo sapiens
cagttggggatattgtgcttctcag

SEQ ID NO: 31457 - DNA, 25 bp, Homo sapiens
tattgtgcttctcagagctttacct

SEQ ID NO: 31458 - DNA, 25 bp, Homo sapiens
ttacctgttccacgagcaaagcatg

SEQ ID NO: 31459 - DNA, 25 bp, Homo sapiens
gaactggctgagatcgttttcaaag

SEQ ID NO: 31460 - DNA, 25 bp, Homo sapiens
aggaaagccctgtgctggaactacc

SEQ ID NO: 31461 - DNA, 25 bp, Homo sapiens
gaactacctacctggagagtccgtt

SEQ ID NO: 31462 - DNA, 25 bp, Homo sapiens
gccacgtaatgtccgtagttcgctc

SEQ ID NO: 31463 - DNA, 25 bp, Homo sapiens
tccgttgagttcggaaaccacccag

SEQ ID NO: 31464 - DNA, 25 bp, Homo sapiens
ctcatccgtccatgccagatggatt

SEQ ID NO: 31465 - DNA, 25 bp, Homo sapiens
ggcggcgccagcgggaattaaatcg

SEQ ID NO: 31466 - DNA, 25 bp, Homo sapiens
aaagtaccaggcactaggtcggcgc

SEQ ID NO: 31467 - DNA, 25 bp, Homo sapiens
gcgctgccgggagatcgagcaggtg

SEQ ID NO: 31468 - DNA, 25 bp, Homo sapiens
aacgagcgggtcctgaacaggctcc

SEQ ID NO: 31469 - DNA, 25 bp, Homo sapiens
ggttcctcatgagagtgctggactc

SEQ ID NO: 31470 - DNA, 25 bp, Homo sapiens
gctggactcctacggggatgactac

SEQ ID NO: 31471 - DNA, 25 bp, Homo sapiens
cagccagttcaccattgtgctggag

SEQ ID NO: 31472 - DNA, 25 bp, Homo sapiens
gccgagcaggaaatgcgctgactcc

SEQ ID NO: 31473 - DNA, 25 bp, Homo sapiens
tggccccggtgcagattaaggttga

SEQ ID NO: 31474 - DNA, 25 bp, Homo sapiens
cctggattccagttgggtttctcgg

SEQ ID NO: 31475 - DNA, 25 bp, Homo sapiens
tcggggtccagacaaactgctgccc

SEQ ID NO: 31476 - DNA, 25 bp, Homo sapiens
gtggccgccggcagtgaagaagatc

SEQ ID NO: 31477 - DNA, 25 bp, Homo sapiens
agaagatcacaaactgggcaccctg

SEQ ID NO: 31478 - DNA, 25 bp, Homo sapiens
acctcagaccgcctggcaaagcgga

SEQ ID NO: 31479 - DNA, 25 bp, Homo sapiens
aagcggaggaagattacctagacgc

SEQ ID NO: 31480 - DNA, 25 bp, Homo sapiens
tacctagacgcatgctttccagaca

SEQ ID NO: 31481 - DNA, 25 bp, Homo sapiens
cagacagggcgttttggctgcatca

SEQ ID NO: 31482 - DNA, 25 bp, Homo sapiens
gctgcatcacagccactggctggtc

SEQ ID NO: 31483 - DNA, 25 bp, Homo sapiens
cacagccactggctggtcctattca

SEQ ID NO: 31484 - DNA, 25 bp, Homo sapiens
ggcaggacgattacttgagcttggg

SEQ ID NO: 31485 - DNA, 25 bp, Homo sapiens
aagccagaagccagcatctcaactg

SEQ ID NO: 31486 - DNA, 25 bp, Homo sapiens
gcatctcaactgtgcttgtcttatg

SEQ ID NO: 31487 - DNA, 25 bp, Homo sapiens
aaatcgagagccttggttacaaccg

SEQ ID NO: 31488 - DNA, 25 bp, Homo sapiens
gttacaaccgacttatcctgcaaat

SEQ ID NO: 31489 - DNA, 25 bp, Homo sapiens
ggtacctgaacccttcagtactgag

SEQ ID NO: 31490 - DNA, 25 bp, Homo sapiens
gtactgagtcgtttactctggatgt

SEQ ID NO: 31491 - DNA, 25 bp, Homo sapiens
gcagatcttgttattagtcacgcag

SEQ ID NO: 31492 - DNA, 25 bp, Homo sapiens
gaacaatcatcagctggaactggca

SEQ ID NO: 31493 - DNA, 25 bp, Homo sapiens
ggaactggcaaagcagctacacaaa

SEQ ID NO: 31494 - DNA, 25 bp, Homo sapiens
caaagagggtcatctcttctattgt

SEQ ID NO: 31495 - DNA, 25 bp, Homo sapiens
actgaaatgttatcctcctggccag

SEQ ID NO: 31496 - DNA, 25 bp, Homo sapiens
aataaacactaaactctcaacactt

SEQ ID NO: 31497 - DNA, 25 bp, Homo sapiens
ttgacgacctcattgcgtgtgtgtc

SEQ ID NO: 31498 - DNA, 25 bp, Homo sapiens
ccagagggatgaccggtggctgctg

SEQ ID NO: 31499 - DNA, 25 bp, Homo sapiens
caacgtgtgtctttttggtggtcct

SEQ ID NO: 31500 - DNA, 25 bp, Homo sapiens
ttgcactgggcatcgtgtactgcac

SEQ ID NO: 31501 - DNA, 25 bp, Homo sapiens
caagcgcatcactgactgctatcgc

SEQ ID NO: 31502 - DNA, 25 bp, Homo sapiens
gcctcacaggggtgcagacctgcag

SEQ ID NO: 31503 - DNA, 25 bp, Homo sapiens
cgtgtgatggggtgcagacccccct

SEQ ID NO: 31504 - DNA, 25 bp, Homo sapiens
agacccccctcatggagtatggggc

SEQ ID NO: 31505 - DNA, 25 bp, Homo sapiens
ctcaaccactagacttggctctcag

SEQ ID NO: 31506 - DNA, 25 bp, Homo sapiens
cagcgctcgtgaccaaggatacacc

SEQ ID NO: 31507 - DNA, 25 bp, Homo sapiens
tacaccaaagcccttaagacctcag

SEQ ID NO: 31508 - DNA, 25 bp, Homo sapiens
gtgctggggtcttctccaataaatg

SEQ ID NO: 31509 - DNA, 25 bp, Homo sapiens
tcagctgggctttatcacacatccc

SEQ ID NO: 31510 - DNA, 25 bp, Homo sapiens
attgaagtcagcctgtttgcgccat

SEQ ID NO: 31511 - DNA, 25 bp, Homo sapiens
atcagccactgctgtcttgggagga

SEQ ID NO: 31512 - DNA, 25 bp, Homo sapiens
tgggaggacacttatcctgttctct

SEQ ID NO: 31513 - DNA, 25 bp, Homo sapiens
gaaacttctgtcctctttggatgag

SEQ ID NO: 31514 - DNA, 25 bp, Homo sapiens
gatcagtgtccacaagtggccgaca

SEQ ID NO: 31515 - DNA, 25 bp, Homo sapiens
gcagtggctcctctgaatgttcact

SEQ ID NO: 31516 - DNA, 25 bp, Homo sapiens
gtttccacattgttgctgtttctgc

SEQ ID NO: 31517 - DNA, 25 bp, Homo sapiens
gaacaactgacattctctagtcgac

SEQ ID NO: 31518 - DNA, 25 bp, Homo sapiens
agcaagggctgcatctagcttcttt

SEQ ID NO: 31519 - DNA, 25 bp, Homo sapiens
agtgctacccgctagctgattttaa

SEQ ID NO: 31520 - DNA, 25 bp, Homo sapiens
aggtgaagcgaagccactcttacct

SEQ ID NO: 31521 - DNA, 25 bp, Homo sapiens
gcaaggactgccgcattggtgatgg

SEQ ID NO: 31522 - DNA, 25 bp, Homo sapiens
gatggagggccagctgaggggaagt

SEQ ID NO: 31523 - DNA, 25 bp, Homo sapiens
gctgaggggaagttgctggtgagtt

SEQ ID NO: 31524 - DNA, 25 bp, Homo sapiens
gcacttaggtgacaggaacttccgc

SEQ ID NO: 31525 - DNA, 25 bp, Homo sapiens
aggtgacaggaacttccgcacctcc

SEQ ID NO: 31526 - DNA, 25 bp, Homo sapiens
ctcctgaggccctggatgattctaa

SEQ ID NO: 31527 - DNA, 25 bp, Homo sapiens
gaggccctggatgattctaattgtt

SEQ ID NO: 31528 - DNA, 25 bp, Homo sapiens
gttagaaatccttccttataatgaa

SEQ ID NO: 31529 - DNA, 25 bp, Homo sapiens
cctataatttctacctattgggcct

SEQ ID NO: 31530 - DNA, 25 bp, Homo sapiens
gccttgttctgttctctggaactaa

SEQ ID NO: 31531 - DNA, 25 bp, Homo sapiens
gctgcactgaggggctgggtgctgg

SEQ ID NO: 31532 - DNA, 25 bp, Homo sapiens
tgctggggaggggctggtaggaggg

SEQ ID NO: 31533 - DNA, 25 bp, Homo sapiens
tggtaggagggagggtgggcccact

SEQ ID NO: 31534 - DNA, 25 bp, Homo sapiens
ggcccactgctttggaggtgatggg

SEQ ID NO: 31535 - DNA, 25 bp, Homo sapiens
cgctttgagctgcgcgaggacgggc

SEQ ID NO: 31536 - DNA, 25 bp, Homo sapiens
gcaccagcgacttcgtaattcacgg

SEQ ID NO: 31537 - DNA, 25 bp, Homo sapiens
cagcgacttcgtaattcacgggatc

SEQ ID NO: 31538 - DNA, 25 bp, Homo sapiens
tcacgggatcatccatggggtcacc

SEQ ID NO: 31539 - DNA, 25 bp, Homo sapiens
tcacccatgacgtggagctgcagga

SEQ ID NO: 31540 - DNA, 25 bp, Homo sapiens
gctgcaggagtctgtcatcactgtg

SEQ ID NO: 31541 - DNA, 25 bp, Homo sapiens
tcatgggctggagccgctttgggga

SEQ ID NO: 31542 - DNA, 25 bp, Homo sapiens
tgacatcccccgatctaggattact

SEQ ID NO: 31543 - DNA, 25 bp, Homo sapiens
tactctggacctcattcgggtgtta

SEQ ID NO: 31544 - DNA, 25 bp, Homo sapiens
tatgagtatcccacgaaggccagac

SEQ ID NO: 31545 - DNA, 25 bp, Homo sapiens
aggccagacgctgattttattttct

SEQ ID NO: 31546 - DNA, 25 bp, Homo sapiens
atttatctttaactccttttgcatt

SEQ ID NO: 31547 - DNA, 25 bp, Homo sapiens
gattgcttaacttctacttgccaac

SEQ ID NO: 31548 - DNA, 25 bp, Homo sapiens
gtatgggattgtcttcttgatttga

SEQ ID NO: 31549 - DNA, 25 bp, Homo sapiens
attgtaccgtctttgttgacacagt

SEQ ID NO: 31550 - DNA, 25 bp, Homo sapiens
gggctgggcagtgtttaatccttcc

SEQ ID NO: 31551 - DNA, 25 bp, Homo sapiens
taatcaggccttttggacttcattc

SEQ ID NO: 31552 - DNA, 25 bp, Homo sapiens
taattttgcaataatctcttttccc

SEQ ID NO: 31553 - DNA, 25 bp, Homo sapiens
cgggcaggcgagactggcggagccc

SEQ ID NO: 31554 - DNA, 25 bp, Homo sapiens
gcctggcctgggaagagcacagctg

SEQ ID NO: 31555 - DNA, 25 bp, Homo sapiens
cccactcaagactaccaaagccagg

SEQ ID NO: 31556 - DNA, 25 bp, Homo sapiens
accaaagccaggacacctcaagtct

SEQ ID NO: 31557 - DNA, 25 bp, Homo sapiens
tttagacagggtcttgctccgttgc

SEQ ID NO: 31558 - DNA, 25 bp, Homo sapiens
ggagtgcagtggcccatcagggctc

SEQ ID NO: 31559 - DNA, 25 bp, Homo sapiens
tggcccatcagggctcactgtaacc

SEQ ID NO: 31560 - DNA, 25 bp, Homo sapiens
aaagaggggggtctcactgtgttgc

SEQ ID NO: 31561 - DNA, 25 bp, Homo sapiens
attgcaggcatgagccactgcaccc

SEQ ID NO: 31562 - DNA, 25 bp, Homo sapiens
ccagccctgtattcttattcttcag

SEQ ID NO: 31563 - DNA, 25 bp, Homo sapiens
gatatttatttttcttttcactgtt

SEQ ID NO: 31564 - DNA, 25 bp, Homo sapiens
ccccttggaggcggaaatcgcccat

SEQ ID NO: 31565 - DNA, 25 bp, Homo sapiens
ggaggcggaaatcgcccatgggtcc

SEQ ID NO: 31566 - DNA, 25 bp, Homo sapiens
gtgagtggcaggatcctggtcgtcc

SEQ ID NO: 31567 - DNA, 25 bp, Homo sapiens
tccgaatttccgtcatcaactttct

SEQ ID NO: 31568 - DNA, 25 bp, Homo sapiens
gaatttccgtcatcaactttcttga

SEQ ID NO: 31569 - DNA, 25 bp, Homo sapiens
tccgtcatcaactttcttgaccagc

SEQ ID NO: 31570 - DNA, 25 bp, Homo sapiens
catcaactttcttgaccagctttcc

SEQ ID NO: 31571 - DNA, 25 bp, Homo sapiens
gcctggcctgggcaaatggagcgag

SEQ ID NO: 31572 - DNA, 25 bp, Homo sapiens
caaatggagcgaggtcccactttgc

SEQ ID NO: 31573 - DNA, 25 bp, Homo sapiens
actttcctgggagggcctcatgttt

SEQ ID NO: 31574 - DNA, 25 bp, Homo sapiens
ctgggagggcctcatgttttatctg

SEQ ID NO: 31575 - DNA, 25 bp, Homo sapiens
agcctgtggggctaaagacttgaca

SEQ ID NO: 31576 - DNA, 25 bp, Homo sapiens
gacagctagctctggagcagccggc

SEQ ID NO: 31577 - DNA, 25 bp, Homo sapiens
aggtttcgcataccagggatggccc

SEQ ID NO: 31578 - DNA, 25 bp, Homo sapiens
ggtgaacctgcccagatttatcagt

SEQ ID NO: 31579 - DNA, 25 bp, Homo sapiens
tgcagcagccatgggcctatgagcg

SEQ ID NO: 31580 - DNA, 25 bp, Homo sapiens
caaagagcacaggcggccagctgag

SEQ ID NO: 31581 - DNA, 25 bp, Homo sapiens
ccaactccccctgctgtaagaggag

SEQ ID NO: 31582 - DNA, 25 bp, Homo sapiens
agaggaggaagcggggacacagtgg

SEQ ID NO: 31583 - DNA, 25 bp, Homo sapiens
ccgtctcgcaggtggcatgacagag

SEQ ID NO: 31584 - DNA, 25 bp, Homo sapiens
ggctctgaggcctgatggctggacc

SEQ ID NO: 31585 - DNA, 25 bp, Homo sapiens
cggaagctccttgggtgtgggtgaa

SEQ ID NO: 31586 - DNA, 25 bp, Homo sapiens
gctcctggcaattagctggactcca

SEQ ID NO: 31587 - DNA, 25 bp, Homo sapiens
gcagcatagatccgacgtctgtctg

SEQ ID NO: 31588 - DNA, 25 bp, Homo sapiens
acgtctgtctgggcgaagggtaggg

SEQ ID NO: 31589 - DNA, 25 bp, Homo sapiens
gggcgggaagcctgagtgcaaatgt

SEQ ID NO: 31590 - DNA, 25 bp, Homo sapiens
acaaagtctgtatcttgtcccaacc

SEQ ID NO: 31591 - DNA, 25 bp, Homo sapiens
atggccaagtttaggcactctgctt

SEQ ID NO: 31592 - DNA, 25 bp, Homo sapiens
aaagctgtcttttcagtggtgttgc

SEQ ID NO: 31593 - DNA, 25 bp, Homo sapiens
tggccaacctctgctgcaaaggaat

SEQ ID NO: 31594 - DNA, 25 bp, Homo sapiens
agtccaggccaccaatcaggcaaat

SEQ ID NO: 31595 - DNA, 25 bp, Homo sapiens
cttgcaagacgtttttcttctgctg

SEQ ID NO: 31596 - DNA, 25 bp, Homo sapiens
ctgtggtatcttgcccttaaaaatt

SEQ ID NO: 31597 - DNA, 25 bp, Homo sapiens
tcacggtccactgaagctctgaatc

SEQ ID NO: 31598 - DNA, 25 bp, Homo sapiens
gcctagcctttaccacgatactggt

SEQ ID NO: 31599 - DNA, 25 bp, Homo sapiens
tctagtaggtgtagtccttccttaa

SEQ ID NO: 31600 - DNA, 25 bp, Homo sapiens
caatgtaaaggctcagttgtggcag

SEQ ID NO: 31601 - DNA, 25 bp, Homo sapiens
taccatatcctaaatttgcactctt

SEQ ID NO: 31602 - DNA, 25 bp, Homo sapiens
gcactctttgcagacttgtgcacat

SEQ ID NO: 31603 - DNA, 25 bp, Homo sapiens
tgtgcacatatattccgctttcaga

SEQ ID NO: 31604 - DNA, 25 bp, Homo sapiens
taaatctccagttatagtcaattac

SEQ ID NO: 31605 - DNA, 25 bp, Homo sapiens
agtcaattactacccatgttgtaca

SEQ ID NO: 31606 - DNA, 25 bp, Homo sapiens
gttgtacaacagataccttctattt

SEQ ID NO: 31607 - DNA, 25 bp, Homo sapiens
gttcagtgagttatgcagctggagc

SEQ ID NO: 31608 - DNA, 25 bp, Homo sapiens
cactatgatgtccaggaccgcttcc

SEQ ID NO: 31609 - DNA, 25 bp, Homo sapiens
gcttccgcattgagctgtctgagga

SEQ ID NO: 31610 - DNA, 25 bp, Homo sapiens
ggaaggagctgagggccgagtggtg

SEQ ID NO: 31611 - DNA, 25 bp, Homo sapiens
gccgagtggtgggacgcaaggacat

SEQ ID NO: 31612 - DNA, 25 bp, Homo sapiens
ggacattacctccattctgagagcc

SEQ ID NO: 31613 - DNA, 25 bp, Homo sapiens
ctcctcttcttgctgacggggattg

SEQ ID NO: 31614 - DNA, 25 bp, Homo sapiens
ctgacggggattgtgtctgtggcct

SEQ ID NO: 31615 - DNA, 25 bp, Homo sapiens
tgggacaaaagttggtggccgccta

SEQ ID NO: 31616 - DNA, 25 bp, Homo sapiens
agccactgtgatgctcataccttac

SEQ ID NO: 31617 - DNA, 25 bp, Homo sapiens
ctcctccctgacaaaaaacacccag

SEQ ID NO: 31618 - DNA, 25 bp, Homo sapiens
cacccagggatttgtactcattttc

SEQ ID NO: 31619 - DNA, 25 bp, Homo sapiens
cttcctgcggtggcgcaagggtgtc

SEQ ID NO: 31620 - DNA, 25 bp, Homo sapiens
tcctgcggtggcgcaagggtgtcca

SEQ ID NO: 31621 - DNA, 25 bp, Homo sapiens
gtggcgcaagggtgtccaggagcgc

SEQ ID NO: 31622 - DNA, 25 bp, Homo sapiens
cgcaagggtgtccaggagcgcatgg

SEQ ID NO: 31623 - DNA, 25 bp, Homo sapiens
cccgtggtccgtgaggacaccaggc

SEQ ID NO: 31624 - DNA, 25 bp, Homo sapiens
cgtggtccgtgaggacaccaggctg

SEQ ID NO: 31625 - DNA, 25 bp, Homo sapiens
gtccgtgaggacaccaggctggtgg

SEQ ID NO: 31626 - DNA, 25 bp, Homo sapiens
gaggacaccaggctggtggccacag

SEQ ID NO: 31627 - DNA, 25 bp, Homo sapiens
ctggccatgggctgtaagttgtact

SEQ ID NO: 31628 - DNA, 25 bp, Homo sapiens
gggctgtaagttgtacttcttccag

SEQ ID NO: 31629 - DNA, 25 bp, Homo sapiens
tgtaagttgtacttcttccagtcgc

SEQ ID NO: 31630 - DNA, 25 bp, Homo sapiens
gtggcactactcttagcacaaggag

SEQ ID NO: 31631 - DNA, 25 bp, Homo sapiens
tgctcttactttggcttgctgtgga

SEQ ID NO: 31632 - DNA, 25 bp, Homo sapiens
gggctgatatagaacttggctgctc

SEQ ID NO: 31633 - DNA, 25 bp, Homo sapiens
ctgctccacacctctgatggaggca

SEQ ID NO: 31634 - DNA, 25 bp, Homo sapiens
aggcatctcaggagggacacctgga

SEQ ID NO: 31635 - DNA, 25 bp, Homo sapiens
taaatatttgctggcttctggcgct

SEQ ID NO: 31636 - DNA, 25 bp, Homo sapiens
gcttctggcgctaatgtgcatgcta

SEQ ID NO: 31637 - DNA, 25 bp, Homo sapiens
gagacacagccttaacctatgcttg

SEQ ID NO: 31638 - DNA, 25 bp, Homo sapiens
gagggcatagatccggccaagcatc

SEQ ID NO: 31639 - DNA, 25 bp, Homo sapiens
tgagggtggcctttgatgcttgtaa

SEQ ID NO: 31640 - DNA, 25 bp, Homo sapiens
agccaagaagttccaggaccctgct

SEQ ID NO: 31641 - DNA, 25 bp, Homo sapiens
cctcccttcctggagggatggccag

SEQ ID NO: 31642 - DNA, 25 bp, Homo sapiens
gagaactgacacctttgaaaccaca

SEQ ID NO: 31643 - DNA, 25 bp, Homo sapiens
gttacatgcagactcgctcaagggc

SEQ ID NO: 31644 - DNA, 25 bp, Homo sapiens
taattccacccagttgagacacacc

SEQ ID NO: 31645 - DNA, 25 bp, Homo sapiens
ttgagacacaccatgcttgttcact

SEQ ID NO: 31646 - DNA, 25 bp, Homo sapiens
gtgctgtcccttgtatttactttaa

SEQ ID NO: 31647 - DNA, 25 bp, Homo sapiens
attcattcggtatggttttccctgt

SEQ ID NO: 31648 - DNA, 25 bp, Homo sapiens
tgtcccttgtacacattctggtatg

SEQ ID NO: 31649 - DNA, 25 bp, Homo sapiens
atgtttctgtctgtggtgcgaacca

SEQ ID NO: 31650 - DNA, 25 bp, Homo sapiens
gggctctcagagctaagacacactt

SEQ ID NO: 31651 - DNA, 25 bp, Homo sapiens
atggcgattgttttcttggacggat

SEQ ID NO: 31652 - DNA, 25 bp, Homo sapiens
tagagacccatgtcatcttaaccta

SEQ ID NO: 31653 - DNA, 25 bp, Homo sapiens
ggaagctctcactaaaacaatcctg

SEQ ID NO: 31654 - DNA, 25 bp, Homo sapiens
gatttcttaatttcatggttcttta

SEQ ID NO: 31655 - DNA, 25 bp, Homo sapiens
agagcagatgactacttttcgaagt

SEQ ID NO: 31656 - DNA, 25 bp, Homo sapiens
tcgaagtaatgctgctccttcctaa

SEQ ID NO: 31657 - DNA, 25 bp, Homo sapiens
aaagtctgttttcaatcctggtaat

SEQ ID NO: 31658 - DNA, 25 bp, Homo sapiens
gcactgcggcacctaagaagcctta

SEQ ID NO: 31659 - DNA, 25 bp, Homo sapiens
gagcgatggtgtcagcatttcggtc

SEQ ID NO: 31660 - DNA, 25 bp, Homo sapiens
gtcagcatttcggtctgcatatctg

SEQ ID NO: 31661 - DNA, 25 bp, Homo sapiens
ggcccagttttcaggcatgtagaat

SEQ ID NO: 31662 - DNA, 25 bp, Homo sapiens
tgaggaggactcacttcttgaagat

SEQ ID NO: 31663 - DNA, 25 bp, Homo sapiens
ggcccgcacaatgaccggaggaggg

SEQ ID NO: 31664 - DNA, 25 bp, Homo sapiens
agaggcagatgcagtcccaggcatc

SEQ ID NO: 31665 - DNA, 25 bp, Homo sapiens
agggaggggctgtcatagtcccaga

SEQ ID NO: 31666 - DNA, 25 bp, Homo sapiens
aatacctatttctgactgagtctcc

SEQ ID NO: 31667 - DNA, 25 bp, Homo sapiens
ccaagctcagctttaagaaccgccc

SEQ ID NO: 31668 - DNA, 25 bp, Homo sapiens
acctcctctctgccaggaggcaata

SEQ ID NO: 31669 - DNA, 25 bp, Homo sapiens
gagagcgacacggacaaggacgggc

SEQ ID NO: 31670 - DNA, 25 bp, Homo sapiens
gacaaggacgggcggctgagcaaag

SEQ ID NO: 31671 - DNA, 25 bp, Homo sapiens
ggcggctgagcaaagcggaaatcct

SEQ ID NO: 31672 - DNA, 25 bp, Homo sapiens
gtttgtgggcagtcaggccaccaac

SEQ ID NO: 31673 - DNA, 25 bp, Homo sapiens
aactatggtgaggacctgacccggc

SEQ ID NO: 31674 - DNA, 25 bp, Homo sapiens
tcacaggctgcaggctagagggggc

SEQ ID NO: 31675 - DNA, 25 bp, Homo sapiens
ttagtctatgtttgaattccccacc

SEQ ID NO: 31676 - DNA, 25 bp, Homo sapiens
ccacctccatcccatctatgggaag

SEQ ID NO: 31677 - DNA, 25 bp, Homo sapiens
tggcctctccataagccttggaggg

SEQ ID NO: 31678 - DNA, 25 bp, Homo sapiens
gggtcctggcaagccattgggcaga

SEQ ID NO: 31679 - DNA, 25 bp, Homo sapiens
gcagggcatttttttacgctgggca

SEQ ID NO: 31680 - DNA, 25 bp, Homo sapiens
ggggtagtgtatgcagaccttccac

SEQ ID NO: 31681 - DNA, 25 bp, Homo sapiens
agcccccatggggaaggttctggat

SEQ ID NO: 31682 - DNA, 25 bp, Homo sapiens
tattccctcctctaaatgctataaa

SEQ ID NO: 31683 - DNA, 25 bp, Homo sapiens
gcacttgagtcgactggaggctgcc

SEQ ID NO: 31684 - DNA, 25 bp, Homo sapiens
gtaatttaacccagagcagctccac

SEQ ID NO: 31685 - DNA, 25 bp, Homo sapiens
tgcagtggtgcagtatgacgtggag

SEQ ID NO: 31686 - DNA, 25 bp, Homo sapiens
ggtgcagtatgacgtggagctgatt

SEQ ID NO: 31687 - DNA, 25 bp, Homo sapiens
ggagctgattgcactaatccgagcc

SEQ ID NO: 31688 - DNA, 25 bp, Homo sapiens
gattgcactaatccgagccaactac

SEQ ID NO: 31689 - DNA, 25 bp, Homo sapiens
gcactaatccgagccaactactggc

SEQ ID NO: 31690 - DNA, 25 bp, Homo sapiens
gagccaactactggctaaagctggt

SEQ ID NO: 31691 - DNA, 25 bp, Homo sapiens
ttgcctctggtagggatggccatgg

SEQ ID NO: 31692 - DNA, 25 bp, Homo sapiens
ggtagggatggccatggtgccagcc

SEQ ID NO: 31693 - DNA, 25 bp, Homo sapiens
tgggcctcattgggtatcacctata

SEQ ID NO: 31694 - DNA, 25 bp, Homo sapiens
gggtatcacctatacagaaaggcca

SEQ ID NO: 31695 - DNA, 25 bp, Homo sapiens
aggccaatagacccaaagtctccaa

SEQ ID NO: 31696 - DNA, 25 bp, Homo sapiens
gctgggctcgaaaccgaaagtcccg

SEQ ID NO: 31697 - DNA, 25 bp, Homo sapiens
gcttttggagacacgcttcacatac

SEQ ID NO: 31698 - DNA, 25 bp, Homo sapiens
tcacatacactacacgggaagcttg

SEQ ID NO: 31699 - DNA, 25 bp, Homo sapiens
gggaagcttggtagatggacgtatt

SEQ ID NO: 31700 - DNA, 25 bp, Homo sapiens
tggacgtattattgacacctccctg

SEQ ID NO: 31701 - DNA, 25 bp, Homo sapiens
gaccctctggttatagaacttggcc

SEQ ID NO: 31702 - DNA, 25 bp, Homo sapiens
ggccaaaagcaggtgattccaggtc

SEQ ID NO: 31703 - DNA, 25 bp, Homo sapiens
attccaggtctggagcagagtcttc

SEQ ID NO: 31704 - DNA, 25 bp, Homo sapiens
gagtcttctcgacatgtgtgtggga

SEQ ID NO: 31705 - DNA, 25 bp, Homo sapiens
gaagggcaatcattccttctcactt

SEQ ID NO: 31706 - DNA, 25 bp, Homo sapiens
tccttctcacttggcctatggaaaa

SEQ ID NO: 31707 - DNA, 25 bp, Homo sapiens
acatcaaccgaactgttgccgttat

SEQ ID NO: 31708 - DNA, 25 bp, Homo sapiens
gttgccgttattacatcagatggga

SEQ ID NO: 31709 - DNA, 25 bp, Homo sapiens
ttgaccagaccattaatttgatttt

SEQ ID NO: 31710 - DNA, 25 bp, Homo sapiens
agtattcagctcttcacagggggta

SEQ ID NO: 31711 - DNA, 25 bp, Homo sapiens
gaggtgacaacgttgcagtcattgg

SEQ ID NO: 31712 - DNA, 25 bp, Homo sapiens
aacagattctgcgcttgatttgggg

SEQ ID NO: 31713 - DNA, 25 bp, Homo sapiens
ggggaatattcgagcagaaccttta

SEQ ID NO: 31714 - DNA, 25 bp, Homo sapiens
ggagtttttatgagtgtgtctctgg

SEQ ID NO: 31715 - DNA, 25 bp, Homo sapiens
ctggattttgaccccttattgattc

SEQ ID NO: 31716 - DNA, 25 bp, Homo sapiens
acagcatgacgtccgctttggagaa

SEQ ID NO: 31717 - DNA, 25 bp, Homo sapiens
gacgtccgctttggagaactacatc

SEQ ID NO: 31718 - DNA, 25 bp, Homo sapiens
gtatggtgatcttgaaacctccaga

SEQ ID NO: 31719 - DNA, 25 bp, Homo sapiens
ttgtctacactcaggctgcagtatt

SEQ ID NO: 31720 - DNA, 25 bp, Homo sapiens
tgattggacaaacgggcctgtgcct

SEQ ID NO: 31721 - DNA, 25 bp, Homo sapiens
gcctgtgccttatcttttggtggag

SEQ ID NO: 31722 - DNA, 25 bp, Homo sapiens
gtgaagccaaatcgtaacttacagc

SEQ ID NO: 31723 - DNA, 25 bp, Homo sapiens
tacagcaagcagcatgcagcatacc

SEQ ID NO: 31724 - DNA, 25 bp, Homo sapiens
gcagcatacctggctctttgctgat

SEQ ID NO: 31725 - DNA, 25 bp, Homo sapiens
gaatcagatgtctccattacttcca

SEQ ID NO: 31726 - DNA, 25 bp, Homo sapiens
catctccaccatgaactctgttaag

SEQ ID NO: 31727 - DNA, 25 bp, Homo sapiens
ccctgtcttctgcataatcatgcct

SEQ ID NO: 31728 - DNA, 25 bp, Homo sapiens
tcatgccttcttgctaagtaattca

SEQ ID NO: 31729 - DNA, 25 bp, Homo sapiens
agtccacccaactgattctgaatgg

SEQ ID NO: 31730 - DNA, 25 bp, Homo sapiens
tagacatttttgcatcgacacttca

SEQ ID NO: 31731 - DNA, 25 bp, Homo sapiens
gcatcgacacttcaacattaacact

SEQ ID NO: 31732 - DNA, 25 bp, Homo sapiens
taagaaactcgaaccacctaatatt

SEQ ID NO: 31733 - DNA, 25 bp, Homo sapiens
aatatttcataaccttcttcattag

SEQ ID NO: 31734 - DNA, 25 bp, Homo sapiens
tagttttgcacttggttttctataa

SEQ ID NO: 31735 - DNA, 25 bp, Homo sapiens
gtacgtttttactcagttcatgcgt

SEQ ID NO: 31736 - DNA, 25 bp, Homo sapiens
tgtcactcagctgtattcacgtctg

SEQ ID NO: 31737 - DNA, 25 bp, Homo sapiens
attcacgtctgagcagttctgcagt

SEQ ID NO: 31738 - DNA, 25 bp, Homo sapiens
gcagttctgcagtaacacctgctta

SEQ ID NO: 31739 - DNA, 25 bp, Homo sapiens
aaattctccctttgcatgttttgta

SEQ ID NO: 31740 - DNA, 25 bp, Homo sapiens
actgggacgtgtgcgcagacatggt

SEQ ID NO: 31741 - DNA, 25 bp, Homo sapiens
gacatggtgggcaccttcacagaca

SEQ ID NO: 31742 - DNA, 25 bp, Homo sapiens
gaccactggatcgtcgacacagact

SEQ ID NO: 31743 - DNA, 25 bp, Homo sapiens
gacacagactacgacacgtatgccg

SEQ ID NO: 31744 - DNA, 25 bp, Homo sapiens
gcccccagaagcgcagaagattgta

SEQ ID NO: 31745 - DNA, 25 bp, Homo sapiens
gaagattgtaaggcagcggcaggag

SEQ ID NO: 31746 - DNA, 25 bp, Homo sapiens
gccaggcagtacaggctgatcgtcc

SEQ ID NO: 31747 - DNA, 25 bp, Homo sapiens
tgatcgtccacaacggttactgcga

SEQ ID NO: 31748 - DNA, 25 bp, Homo sapiens
gaatctagtttcatctgagaacttc

SEQ ID NO: 31749 - DNA, 25 bp, Homo sapiens
aacttctgattagctctcagtcttc

SEQ ID NO: 31750 - DNA, 25 bp, Homo sapiens
ctcagtcttcagctctatttatctt

SEQ ID NO: 31751 - DNA, 25 bp, Homo sapiens
cgctggacgtggccagcgacagcca

SEQ ID NO: 31752 - DNA, 25 bp, Homo sapiens
tggccagcgacagccagtcggagat

SEQ ID NO: 31753 - DNA, 25 bp, Homo sapiens
gccagcgacagccagtcggagatgc

SEQ ID NO: 31754 - DNA, 25 bp, Homo sapiens
ggcgctcatggggggcaagcgggac

SEQ ID NO: 31755 - DNA, 25 bp, Homo sapiens
tcatggggggcaagcgggaccccga

SEQ ID NO: 31756 - DNA, 25 bp, Homo sapiens
gaccccgaggactcggacgtgttcg

SEQ ID NO: 31757 - DNA, 25 bp, Homo sapiens
ggactcggacgtgttcgaggaggac

SEQ ID NO: 31758 - DNA, 25 bp, Homo sapiens
ttcgaggaggacacgcacctgtgag

SEQ ID NO: 31759 - DNA, 25 bp, Homo sapiens
cacctgtgagcgcagcgaggcgcag

SEQ ID NO: 31760 - DNA, 25 bp, Homo sapiens
cctgtgagcgcagcgaggcgcaggc

SEQ ID NO: 31761 - DNA, 25 bp, Homo sapiens
cgccaggaccaagcgaggtggaccc

SEQ ID NO: 31762 - DNA, 25 bp, Homo sapiens
tgaagatgcgcgggcacttctgggt

SEQ ID NO: 31763 - DNA, 25 bp, Homo sapiens
gtgggtgacgagctgtactgtgaga

SEQ ID NO: 31764 - DNA, 25 bp, Homo sapiens
gggccagggtcatgcctatataagt

SEQ ID NO: 31765 - DNA, 25 bp, Homo sapiens
atggcagggacaatggtgggcagtt

SEQ ID NO: 31766 - DNA, 25 bp, Homo sapiens
tggtgggcagttgctcttacatgag

SEQ ID NO: 31767 - DNA, 25 bp, Homo sapiens
gagctaagtttggagacctgaggcc

SEQ ID NO: 31768 - DNA, 25 bp, Homo sapiens
tgtcttggactgtgggagactcacc

SEQ ID NO: 31769 - DNA, 25 bp, Homo sapiens
gcaggactggcattgcactagtctg

SEQ ID NO: 31770 - DNA, 25 bp, Homo sapiens
ttgcactagtctgaggtggccactg

SEQ ID NO: 31771 - DNA, 25 bp, Homo sapiens
gtttttgacatactagctctataaa

SEQ ID NO: 31772 - DNA, 25 bp, Homo sapiens
gtaccagcatcgcgaaccaggctgt

SEQ ID NO: 31773 - DNA, 25 bp, Homo sapiens
gtgtcaccgcagcttataccaagac

SEQ ID NO: 31774 - DNA, 25 bp, Homo sapiens
tcaggacacacctttgagatcccac

SEQ ID NO: 31775 - DNA, 25 bp, Homo sapiens
aaggctgtccaaggcaggcagtgtg

SEQ ID NO: 31776 - DNA, 25 bp, Homo sapiens
gtctgattttgtttaccacacgcca

SEQ ID NO: 31777 - DNA, 25 bp, Homo sapiens
acgccaggtcccagggaagtcttgc

SEQ ID NO: 31778 - DNA, 25 bp, Homo sapiens
gaaggggattctgggcctggaagcc

SEQ ID NO: 31779 - DNA, 25 bp, Homo sapiens
agccgtctcaggactactgttggat

SEQ ID NO: 31780 - DNA, 25 bp, Homo sapiens
gattgcaaacagcatctctgaccca

SEQ ID NO: 31781 - DNA, 25 bp, Homo sapiens
cccagtcttcggactcattctgtaa

SEQ ID NO: 31782 - DNA, 25 bp, Homo sapiens
caagaccacatgcttgcagtcctac

SEQ ID NO: 31783 - DNA, 25 bp, Homo sapiens
aggccagctacggattttgcacttt

SEQ ID NO: 31784 - DNA, 25 bp, Homo sapiens
tggtatctaaccagtgccaacatcc

SEQ ID NO: 31785 - DNA, 25 bp, Homo sapiens
tgccaacatccccagtgaaacttta

SEQ ID NO: 31786 - DNA, 25 bp, Homo sapiens
gaggagccagtgtattccaggttaa

SEQ ID NO: 31787 - DNA, 25 bp, Homo sapiens
gagtttcagagggagttcacacaag

SEQ ID NO: 31788 - DNA, 25 bp, Homo sapiens
gagtaaagcctgactggaccattgc

SEQ ID NO: 31789 - DNA, 25 bp, Homo sapiens
ggaccattgcacggattgaacactc

SEQ ID NO: 31790 - DNA, 25 bp, Homo sapiens
ggggtcatttgatcttcacttaatc

SEQ ID NO: 31791 - DNA, 25 bp, Homo sapiens
tactccttgcagtatattggcatga

SEQ ID NO: 31792 - DNA, 25 bp, Homo sapiens
tccacagattgttatcaccttcttt

SEQ ID NO: 31793 - DNA, 25 bp, Homo sapiens
caacaggaggcatctccatttacta

SEQ ID NO: 31794 - DNA, 25 bp, Homo sapiens
aacatcctgatgtgcttttggtatc

SEQ ID NO: 31795 - DNA, 25 bp, Homo sapiens
ttttgccacacttggtgcctaggcc

SEQ ID NO: 31796 - DNA, 25 bp, Homo sapiens
cttctagggccgtttatccaacatt

SEQ ID NO: 31797 - DNA, 25 bp, Homo sapiens
tccaacatttagatgccttcttttc

SEQ ID NO: 31798 - DNA, 25 bp, Homo sapiens
taatttgtagccagtccaacctttc

SEQ ID NO: 31799 - DNA, 25 bp, Homo sapiens
aaattttggtccttgggcacagaga

SEQ ID NO: 31800 - DNA, 25 bp, Homo sapiens
gtaacccttgggcatgactccaatc

SEQ ID NO: 31801 - DNA, 25 bp, Homo sapiens
tgactccaatcccagaattgctcac

SEQ ID NO: 31802 - DNA, 25 bp, Homo sapiens
aattgctcactgagcgctatgccac

SEQ ID NO: 31803 - DNA, 25 bp, Homo sapiens
ccaccgaagcgttgacctgaacata

SEQ ID NO: 31804 - DNA, 25 bp, Homo sapiens
gtccagattggacctttgatcctat

SEQ ID NO: 31805 - DNA, 25 bp, Homo sapiens
tacttgtgttgatactcctgttgat

SEQ ID NO: 31806 - DNA, 25 bp, Homo sapiens
ctcaccaagctcattacatctgcca

SEQ ID NO: 31807 - DNA, 25 bp, Homo sapiens
gtgaaatcccatccatgaactcgat

SEQ ID NO: 31808 - DNA, 25 bp, Homo sapiens
cacactgccttcacgacgtgactgc

SEQ ID NO: 31809 - DNA, 25 bp, Homo sapiens
tggacctggccgagcttgaggccac

SEQ ID NO: 31810 - DNA, 25 bp, Homo sapiens
tgtgaagggtcctgctgtggtcatc

SEQ ID NO: 31811 - DNA, 25 bp, Homo sapiens
gtggtcatcttggtgactcggtcac

SEQ ID NO: 31812 - DNA, 25 bp, Homo sapiens
gtcacagcagctactggccaagatc

SEQ ID NO: 31813 - DNA, 25 bp, Homo sapiens
atcagacgtcgctgaggggctgttc

SEQ ID NO: 31814 - DNA, 25 bp, Homo sapiens
atcctcgttctccagggtcaaggaa

SEQ ID NO: 31815 - DNA, 25 bp, Homo sapiens
tgttttcgacttgaccttgtggtat

SEQ ID NO: 31816 - DNA, 25 bp, Homo sapiens
cttgtggtatttttcttggcctagt

SEQ ID NO: 31817 - DNA, 25 bp, Homo sapiens
tcccagctctgagaggtcgccaaag

SEQ ID NO: 31818 - DNA, 25 bp, Homo sapiens
tctgagaggtcgccaaagcctgcag

SEQ ID NO: 31819 - DNA, 25 bp, Homo sapiens
gcccccgaggagcctaataaagatc

SEQ ID NO: 31820 - DNA, 25 bp, Homo sapiens
aataaagatctcgttgtggcaaaaa

SEQ ID NO: 31821 - DNA, 25 bp, Homo sapiens
gtaagactggcaaggccaagatcac

SEQ ID NO: 31822 - DNA, 25 bp, Homo sapiens
agtacgtcatccacacagtggggcc

SEQ ID NO: 31823 - DNA, 25 bp, Homo sapiens
tgctggccacgctgcgagagtggct

SEQ ID NO: 31824 - DNA, 25 bp, Homo sapiens
gccacgctgcgagagtggctggagc

SEQ ID NO: 31825 - DNA, 25 bp, Homo sapiens
acaaggtggaccggctgatcatctg

SEQ ID NO: 31826 - DNA, 25 bp, Homo sapiens
tcatctgcgtgttcctcgagaagga

SEQ ID NO: 31827 - DNA, 25 bp, Homo sapiens
aaggacgaggacatctaccggagcc

SEQ ID NO: 31828 - DNA, 25 bp, Homo sapiens
gtgacttcaggtaccagcttaaaga

SEQ ID NO: 31829 - DNA, 25 bp, Homo sapiens
agagcactagggatggggaacgaat

SEQ ID NO: 31830 - DNA, 25 bp, Homo sapiens
aacgaatgccaaatcagactccacc

SEQ ID NO: 31831 - DNA, 25 bp, Homo sapiens
gagcaccaggaaacagcttgtaccc

SEQ ID NO: 31832 - DNA, 25 bp, Homo sapiens
gaaacagcttgtaccctggtaggga

SEQ ID NO: 31833 - DNA, 25 bp, Homo sapiens
gaggctgagccagtgcgagactgaa

SEQ ID NO: 31834 - DNA, 25 bp, Homo sapiens
gagactgaacttgtgcagccttagc

SEQ ID NO: 31835 - DNA, 25 bp, Homo sapiens
gcagccttagccaagacaaagcagt

SEQ ID NO: 31836 - DNA, 25 bp, Homo sapiens
gactcgtatgaacaggacagggtga

SEQ ID NO: 31837 - DNA, 25 bp, Homo sapiens
gtataatcatatcgtcggaggttaa

SEQ ID NO: 31838 - DNA, 25 bp, Homo sapiens
atgttcactccaaatacactacaga

SEQ ID NO: 31839 - DNA, 25 bp, Homo sapiens
cctgtccgtcatgttggaggtcgcc

SEQ ID NO: 31840 - DNA, 25 bp, Homo sapiens
tcgccctcaaccaggtggatgtgtg

SEQ ID NO: 31841 - DNA, 25 bp, Homo sapiens
gtctggtggtggctggttactacca

SEQ ID NO: 31842 - DNA, 25 bp, Homo sapiens
gttactaccatgccaatgcagctgt

SEQ ID NO: 31843 - DNA, 25 bp, Homo sapiens
gcagctgtgaacgatcagagccctg

SEQ ID NO: 31844 - DNA, 25 bp, Homo sapiens
gaattcttccctgatgcagtactta

SEQ ID NO: 31845 - DNA, 25 bp, Homo sapiens
tctccgctgggtccctaaggataag

SEQ ID NO: 31846 - DNA, 25 bp, Homo sapiens
ggcagatggtgggagctctactgga

SEQ ID NO: 31847 - DNA, 25 bp, Homo sapiens
tactggaagatcgggcccaccagca

SEQ ID NO: 31848 - DNA, 25 bp, Homo sapiens
cagcaccttgtggactttgactgcc

SEQ ID NO: 31849 - DNA, 25 bp, Homo sapiens
tgccaccttgatgacatccggcagg

SEQ ID NO: 31850 - DNA, 25 bp, Homo sapiens
ccctatatgatcactctgggcgacg

SEQ ID NO: 31851 - DNA, 25 bp, Homo sapiens
tggcactcgcggttggagtcagcga

SEQ ID NO: 31852 - DNA, 25 bp, Homo sapiens
gagtcagcgaggagagcgaggcctg

SEQ ID NO: 31853 - DNA, 25 bp, Homo sapiens
acatgctcccggcgatgttgaaagt

SEQ ID NO: 31854 - DNA, 25 bp, Homo sapiens
gatgttgaaagtacgggacccgcgg

SEQ ID NO: 31855 - DNA, 25 bp, Homo sapiens
ctgctgtccctgtacgaggatgaca

SEQ ID NO: 31856 - DNA, 25 bp, Homo sapiens
gtccctgtacgaggatgacatcacc

SEQ ID NO: 31857 - DNA, 25 bp, Homo sapiens
aggatgacatcaccttctgataccc

SEQ ID NO: 31858 - DNA, 25 bp, Homo sapiens
cccacctttgacttaagatcccaca

SEQ ID NO: 31859 - DNA, 25 bp, Homo sapiens
acctttgacttaagatcccacacct

SEQ ID NO: 31860 - DNA, 25 bp, Homo sapiens
agtcccaactccagtaaagacactc

SEQ ID NO: 31861 - DNA, 25 bp, Homo sapiens
atttgaacgctacctgcagtgcatc

SEQ ID NO: 31862 - DNA, 25 bp, Homo sapiens
gcagtgcatcttgggtgttgacaat

SEQ ID NO: 31863 - DNA, 25 bp, Homo sapiens
caaagatgttatccctttcccaagg

SEQ ID NO: 31864 - DNA, 25 bp, Homo sapiens
ctcattcatgccttttatagctgga

SEQ ID NO: 31865 - DNA, 25 bp, Homo sapiens
tggttaaggaaaagcaccccccatg

SEQ ID NO: 31866 - DNA, 25 bp, Homo sapiens
ttcacgtaaggatgagctcccgcaa

SEQ ID NO: 31867 - DNA, 25 bp, Homo sapiens
gagctcccgcaagaagaggtactta

SEQ ID NO: 31868 - DNA, 25 bp, Homo sapiens
gggactctcaaatccattacctcaa

SEQ ID NO: 31869 - DNA, 25 bp, Homo sapiens
atcattaaatcactccctgtgtaat

SEQ ID NO: 31870 - DNA, 25 bp, Homo sapiens
accaatggtatctggaccttcgtcg

SEQ ID NO: 31871 - DNA, 25 bp, Homo sapiens
gaccttcgtcgatttggatctgtgc

SEQ ID NO: 31872 - DNA, 25 bp, Homo sapiens
gctgctcctggctaatgcttattag

SEQ ID NO: 31873 - DNA, 25 bp, Homo sapiens
agtcatcctcaagcttcaatttatt

SEQ ID NO: 31874 - DNA, 25 bp, Homo sapiens
tttaactggcctcacggtgggcagc

SEQ ID NO: 31875 - DNA, 25 bp, Homo sapiens
gaggctgcattagtgctcttgaaaa

SEQ ID NO: 31876 - DNA, 25 bp, Homo sapiens
aaaggggctgccaggtggtaatcat

SEQ ID NO: 31877 - DNA, 25 bp, Homo sapiens
ggataccacgggtgctggtgacagc

SEQ ID NO: 31878 - DNA, 25 bp, Homo sapiens
ccttctacctggcttactatccaaa

SEQ ID NO: 31879 - DNA, 25 bp, Homo sapiens
gacatgctcaacagatccaatttca

SEQ ID NO: 31880 - DNA, 25 bp, Homo sapiens
tccaggctgcaggaacacagtcatc

SEQ ID NO: 31881 - DNA, 25 bp, Homo sapiens
cacagtcatcttacccttacaaaaa

SEQ ID NO: 31882 - DNA, 25 bp, Homo sapiens
caaaaaagaccttccgcttactctg

SEQ ID NO: 31883 - DNA, 25 bp, Homo sapiens
agtgctgggttcaaagggctgtgtg

SEQ ID NO: 31884 - DNA, 25 bp, Homo sapiens
gtgtgtgggtgcacacatctgtccc

SEQ ID NO: 31885 - DNA, 25 bp, Homo sapiens
tatgcagtgagacctgtctacctcc

SEQ ID NO: 31886 - DNA, 25 bp, Homo sapiens
gtctacctcccacaaggagcaaggg

SEQ ID NO: 31887 - DNA, 25 bp, Homo sapiens
ctgctcattcctacccaggtagtgg

SEQ ID NO: 31888 - DNA, 25 bp, Homo sapiens
ttccagaggggtctcactgacagcc

SEQ ID NO: 31889 - DNA, 25 bp, Homo sapiens
gctgtggatcaaggaaggctgcccc

SEQ ID NO: 31890 - DNA, 25 bp, Homo sapiens
gatgcagaggtggaaggccctgggc

SEQ ID NO: 31891 - DNA, 25 bp, Homo sapiens
cacaggcgagagtgggcgtgtcacc

SEQ ID NO: 31892 - DNA, 25 bp, Homo sapiens
gttcccagcaagtctgcagctgtgc

SEQ ID NO: 31893 - DNA, 25 bp, Homo sapiens
ccttgcaaggaacgtctcttccggc

SEQ ID NO: 31894 - DNA, 25 bp, Homo sapiens
ggggttcgagcctcgttaagcacga

SEQ ID NO: 31895 - DNA, 25 bp, Homo sapiens
tcaattgtggctatcacctcactca

SEQ ID NO: 31896 - DNA, 25 bp, Homo sapiens
cacctcactcagcacgagagaatcc

SEQ ID NO: 31897 - DNA, 25 bp, Homo sapiens
cacacaggcgaaaccccgtataaat

SEQ ID NO: 31898 - DNA, 25 bp, Homo sapiens
ttcatttatggatcgagcctcgtga

SEQ ID NO: 31899 - DNA, 25 bp, Homo sapiens
gccatcagcttacacaacatcagaa

SEQ ID NO: 31900 - DNA, 25 bp, Homo sapiens
gcacagtggggcgaaatcctacgaa

SEQ ID NO: 31901 - DNA, 25 bp, Homo sapiens
cacctaaaccatctccgagaacatc

SEQ ID NO: 31902 - DNA, 25 bp, Homo sapiens
agagccttttgaacgcagtagcccg

SEQ ID NO: 31903 - DNA, 25 bp, Homo sapiens
cgctcgtatctatggtttcgctttc

SEQ ID NO: 31904 - DNA, 25 bp, Homo sapiens
cgctttccacagtttgttacctgca

SEQ ID NO: 31905 - DNA, 25 bp, Homo sapiens
tgattcactggcgtctgttttcatt

SEQ ID NO: 31906 - DNA, 25 bp, Homo sapiens
tcatcactggtggtactttatcttg

SEQ ID NO: 31907 - DNA, 25 bp, Homo sapiens
cattggacagtgttagccagttgta

SEQ ID NO: 31908 - DNA, 25 bp, Homo sapiens
tacttattgctgctaaaacttctta

SEQ ID NO: 31909 - DNA, 25 bp, Homo sapiens
ggttgtttctgctatagttatttct

SEQ ID NO: 31910 - DNA, 25 bp, Homo sapiens
tagttatttctattgcagttccaaa

SEQ ID NO: 31911 - DNA, 25 bp, Homo sapiens
tgcagttccaaattgccatcttccc

SEQ ID NO: 31912 - DNA, 25 bp, Homo sapiens
atcttcccttgtctcatttgcaagt

SEQ ID NO: 31913 - DNA, 25 bp, Homo sapiens
ctctcaaatggacaggttccttctt

SEQ ID NO: 31914 - DNA, 25 bp, Homo sapiens
aattctaaaggatttctgtgctatt

SEQ ID NO: 31915 - DNA, 25 bp, Homo sapiens
gaaatcaacgtctttggtcaggaac

SEQ ID NO: 31916 - DNA, 25 bp, Homo sapiens
taagcaatgaacccatctcgaagga

SEQ ID NO: 31917 - DNA, 25 bp, Homo sapiens
taatacacaccatatttcctcctaa

SEQ ID NO: 31918 - DNA, 25 bp, Homo sapiens
tattccagactcagatcactcacac

SEQ ID NO: 31919 - DNA, 25 bp, Homo sapiens
agatcactcacactcatgatgctga

SEQ ID NO: 31920 - DNA, 25 bp, Homo sapiens
ggaggtgatggtaggaaccctgttc

SEQ ID NO: 31921 - DNA, 25 bp, Homo sapiens
ggaaccctgttctactgcaaaacac

SEQ ID NO: 31922 - DNA, 25 bp, Homo sapiens
tcaggttactgctgcgattgatgta

SEQ ID NO: 31923 - DNA, 25 bp, Homo sapiens
gtggagatgcctgaacacaattcta

SEQ ID NO: 31924 - DNA, 25 bp, Homo sapiens
tttgtactgtattttccttgcaaat

SEQ ID NO: 31925 - DNA, 25 bp, Homo sapiens
aattttcttgctgtgtcgaacaatc

SEQ ID NO: 31926 - DNA, 25 bp, Homo sapiens
gtcgaacaatcaggactgcattcat

SEQ ID NO: 31927 - DNA, 25 bp, Homo sapiens
acaggggtatcctggaagcctcctt

SEQ ID NO: 31928 - DNA, 25 bp, Homo sapiens
agctcttcaaattcaccatcggcat

SEQ ID NO: 31929 - DNA, 25 bp, Homo sapiens
tcatcgccctcatgagcgagaccgt

SEQ ID NO: 31930 - DNA, 25 bp, Homo sapiens
gagcgagaccgtcaacagtgtcgcc

SEQ ID NO: 31931 - DNA, 25 bp, Homo sapiens
acagtgtcgccactgacagctggag

SEQ ID NO: 31932 - DNA, 25 bp, Homo sapiens
ggagaatggctattggtggtgcagg

SEQ ID NO: 31933 - DNA, 25 bp, Homo sapiens
agcgggcaggtgtgatgctgaccgt

SEQ ID NO: 31934 - DNA, 25 bp, Homo sapiens
tgatgctgaccgttggcactaagcc

SEQ ID NO: 31935 - DNA, 25 bp, Homo sapiens
gaggaggtgaactgggcttcatggg

SEQ ID NO: 31936 - DNA, 25 bp, Homo sapiens
tccctcgaactctcgagaaccctgt

SEQ ID NO: 31937 - DNA, 25 bp, Homo sapiens
tgaggaaaactatgtgcccgtccag

SEQ ID NO: 31938 - DNA, 25 bp, Homo sapiens
ccaaatctgttgggctttctattaa

SEQ ID NO: 31939 - DNA, 25 bp, Homo sapiens
aagaggcaatgacttatcaccccaa

SEQ ID NO: 31940 - DNA, 25 bp, Homo sapiens
tatcaccccaaccaggtagtagaag

SEQ ID NO: 31941 - DNA, 25 bp, Homo sapiens
aaggctgttgttcagatatggctgt

SEQ ID NO: 31942 - DNA, 25 bp, Homo sapiens
gtatggggtataccgccttagggca

SEQ ID NO: 31943 - DNA, 25 bp, Homo sapiens
ataccgccttagggcatttgggcat

SEQ ID NO: 31944 - DNA, 25 bp, Homo sapiens
gcattggttttcttacctccaaatg

SEQ ID NO: 31945 - DNA, 25 bp, Homo sapiens
gtaactacatatccaatacagctgt

SEQ ID NO: 31946 - DNA, 25 bp, Homo sapiens
tcttttctaatttggtggcactggt

SEQ ID NO: 31947 - DNA, 25 bp, Homo sapiens
gtggcactggtataaccacccatta

SEQ ID NO: 31948 - DNA, 25 bp, Homo sapiens
aacagctagcagtttgcctgaaata

SEQ ID NO: 31949 - DNA, 25 bp, Homo sapiens
gaagatgggcgaggcaaaatcatgc

SEQ ID NO: 31950 - DNA, 25 bp, Homo sapiens
gccaaacagctttatcatgatgttc

SEQ ID NO: 31951 - DNA, 25 bp, Homo sapiens
gtgaactgtgtccatttaagctgta

SEQ ID NO: 31952 - DNA, 25 bp, Homo sapiens
tgaaagatctatgttctctcagtag

SEQ ID NO: 31953 - DNA, 25 bp, Homo sapiens
agatgggactggttgactcttcaca

SEQ ID NO: 31954 - DNA, 25 bp, Homo sapiens
gactggttgactcttcacatgatgg

SEQ ID NO: 31955 - DNA, 25 bp, Homo sapiens
ggagcagctatctgattggaaacct

SEQ ID NO: 31956 - DNA, 25 bp, Homo sapiens
ccgacttagtgcggtgataggaagc

SEQ ID NO: 31957 - DNA, 25 bp, Homo sapiens
gaagcgtttatttatacatctctgt

SEQ ID NO: 31958 - DNA, 25 bp, Homo sapiens
ttcaagcctttgccctgaggtgtta

SEQ ID NO: 31959 - DNA, 25 bp, Homo sapiens
aatcttgtcttgcgttttctaaatc

SEQ ID NO: 31960 - DNA, 25 bp, Homo sapiens
aatgatgtttctgcttggataaatc

SEQ ID NO: 31961 - DNA, 25 bp, Homo sapiens
acagttacatggttagatgcatctt

SEQ ID NO: 31962 - DNA, 25 bp, Homo sapiens
tgcatcttttgtcatctatattgta

SEQ ID NO: 31963 - DNA, 25 bp, Homo sapiens
gtttctacataactgtaaacctgac

SEQ ID NO: 31964 - DNA, 25 bp, Homo sapiens
gagtacttcttaatgttctagacaa

SEQ ID NO: 31965 - DNA, 25 bp, Homo sapiens
gtttacaattggtagatctgtctat

SEQ ID NO: 31966 - DNA, 25 bp, Homo sapiens
aaaatcacctaaatctgctttatta

SEQ ID NO: 31967 - DNA, 25 bp, Homo sapiens
tagactacagttcacttattgcata

SEQ ID NO: 31968 - DNA, 25 bp, Homo sapiens
attgcatagaaactggacttggctt

SEQ ID NO: 31969 - DNA, 25 bp, Homo sapiens
ggacttggctttacattcttaatgt

SEQ ID NO: 31970 - DNA, 25 bp, Homo sapiens
gaacttactctcttgaagctgaatt

SEQ ID NO: 31971 - DNA, 25 bp, Homo sapiens
gaatccttaccacagagtccagatt

SEQ ID NO: 31972 - DNA, 25 bp, Homo sapiens
cagtattctatcagtacagctctct

SEQ ID NO: 31973 - DNA, 25 bp, Homo sapiens
gctctctgcagcttaaactcggtgg

SEQ ID NO: 31974 - DNA, 25 bp, Homo sapiens
aagactgctgaggccaagtgctatt

SEQ ID NO: 31975 - DNA, 25 bp, Homo sapiens
aacttggctattttcttgacacttt

SEQ ID NO: 31976 - DNA, 25 bp, Homo sapiens
taatgtgctgctaggttttttgttt

SEQ ID NO: 31977 - DNA, 25 bp, Homo sapiens
atttgcctttaatcttattgttctc

SEQ ID NO: 31978 - DNA, 25 bp, Homo sapiens
gaactggttgattctgggaggcatc

SEQ ID NO: 31979 - DNA, 25 bp, Homo sapiens
tggatatgtacatgtcctattctac

SEQ ID NO: 31980 - DNA, 25 bp, Homo sapiens
gacagttcagaatcatgttccccat

SEQ ID NO: 31981 - DNA, 25 bp, Homo sapiens
tccccattctggtgttggatctata

SEQ ID NO: 31982 - DNA, 25 bp, Homo sapiens
caagcgggagagcgactccgagcgt

SEQ ID NO: 31983 - DNA, 25 bp, Homo sapiens
agcgcacgtcccagaaggtggactt

SEQ ID NO: 31984 - DNA, 25 bp, Homo sapiens
ggtggacttggcactgaaacagctg

SEQ ID NO: 31985 - DNA, 25 bp, Homo sapiens
tgaaacagctgggacacatccgcga

SEQ ID NO: 31986 - DNA, 25 bp, Homo sapiens
catccgcgagtacgaacagcgcctg

SEQ ID NO: 31987 - DNA, 25 bp, Homo sapiens
tggagcgggaggtccagcagtgtag

SEQ ID NO: 31988 - DNA, 25 bp, Homo sapiens
gaagcccccacaggggattttgctc

SEQ ID NO: 31989 - DNA, 25 bp, Homo sapiens
accacctttgggagtgtcatcctta

SEQ ID NO: 31990 - DNA, 25 bp, Homo sapiens
gtgtcatccttacaaaccacagcat

SEQ ID NO: 31991 - DNA, 25 bp, Homo sapiens
ggaggatcaaggcctggatcccggg

SEQ ID NO: 31992 - DNA, 25 bp, Homo sapiens
ctcacagattcctcacactggggaa

SEQ ID NO: 31993 - DNA, 25 bp, Homo sapiens
gaacctgagcaaccaagtacctcca

SEQ ID NO: 31994 - DNA, 25 bp, Homo sapiens
ggttgccttctaacggcaggtgggc

SEQ ID NO: 31995 - DNA, 25 bp, Homo sapiens
gcaggtgggcataaggctgtccttc

SEQ ID NO: 31996 - DNA, 25 bp, Homo sapiens
aggctgtccttcaggaccagccagt

SEQ ID NO: 31997 - DNA, 25 bp, Homo sapiens
accagccagtttacaagcatgtctc

SEQ ID NO: 31998 - DNA, 25 bp, Homo sapiens
gcatgtctcaagctagtgtgttcca

SEQ ID NO: 31999 - DNA, 25 bp, Homo sapiens
gtgtgttccattatgctcacagcag

SEQ ID NO: 32000 - DNA, 25 bp, Homo sapiens
cctacctctgtgtttgacatctgaa

SEQ ID NO: 32001 - DNA, 25 bp, Homo sapiens
gaagcagcttgttgcatttgttttt

SEQ ID NO: 32002 - DNA, 25 bp, Homo sapiens
gcaggagatagactctggcccttgt

SEQ ID NO: 32003 - DNA, 25 bp, Homo sapiens
aacatcttaccagatcagacgtctc

SEQ ID NO: 32004 - DNA, 25 bp, Homo sapiens
gtctcagcctcgggagcatttattt

SEQ ID NO: 32005 - DNA, 25 bp, Homo sapiens
gactttcagcattctttcacgatat

SEQ ID NO: 32006 - DNA, 25 bp, Homo sapiens
aactttctcatctggttcgtttcat

SEQ ID NO: 32007 - DNA, 25 bp, Homo sapiens
tcccgaaagaacggtgctctcccac

SEQ ID NO: 32008 - DNA, 25 bp, Homo sapiens
ctcccactcttactctatttcaaag

SEQ ID NO: 32009 - DNA, 25 bp, Homo sapiens
gagcatgtgctaccttgagatttca

SEQ ID NO: 32010 - DNA, 25 bp, Homo sapiens
tcaagaagtgtcctacctcagctga

SEQ ID NO: 32011 - DNA, 25 bp, Homo sapiens
tcagcccagggtaccatgtgatgac

SEQ ID NO: 32012 - DNA, 25 bp, Homo sapiens
cattaagggcttttacctcggctgt

SEQ ID NO: 32013 - DNA, 25 bp, Homo sapiens
ctgtccacatccagtcatgcatttg

SEQ ID NO: 32014 - DNA, 25 bp, Homo sapiens
attcctgtaggtgccccatagaggt

SEQ ID NO: 32015 - DNA, 25 bp, Homo sapiens
tggagagccttacttgggtttgcac

SEQ ID NO: 32016 - DNA, 25 bp, Homo sapiens
agtgcttgtcaatgatcaactcttg

SEQ ID NO: 32017 - DNA, 25 bp, Homo sapiens
gatcaactcttgtggtacatcaggg

SEQ ID NO: 32018 - DNA, 25 bp, Homo sapiens
ggtacatcagggaactcacataggt

SEQ ID NO: 32019 - DNA, 25 bp, Homo sapiens
aaacccatacttaccttgagtctga

SEQ ID NO: 32020 - DNA, 25 bp, Homo sapiens
gaaaacctttggtagaagctcctgt

SEQ ID NO: 32021 - DNA, 25 bp, Homo sapiens
tagaagctcctgtcttatcaggccc

SEQ ID NO: 32022 - DNA, 25 bp, Homo sapiens
aggccccaaaaaacctgttctgcag

SEQ ID NO: 32023 - DNA, 25 bp, Homo sapiens
actgttctcatagttagttgactca

SEQ ID NO: 32024 - DNA, 25 bp, Homo sapiens
gttttttagatacccagaagcttgt

SEQ ID NO: 32025 - DNA, 25 bp, Homo sapiens
ggagaagctagggcgggtcagagta

SEQ ID NO: 32026 - DNA, 25 bp, Homo sapiens
tgccaggggtggtcccacctaaaga

SEQ ID NO: 32027 - DNA, 25 bp, Homo sapiens
gatggactgtgctgcagtatcacca

SEQ ID NO: 32028 - DNA, 25 bp, Homo sapiens
gtatcaccagaagacattagggggc

SEQ ID NO: 32029 - DNA, 25 bp, Homo sapiens
tagggggcagtaggcccccacacaa

SEQ ID NO: 32030 - DNA, 25 bp, Homo sapiens
taaaggggaggactttctgccaact

SEQ ID NO: 32031 - DNA, 25 bp, Homo sapiens
gccttgggaaagccagttgccctga

SEQ ID NO: 32032 - DNA, 25 bp, Homo sapiens
acaccatggaatgtcctttgcacgc

SEQ ID NO: 32033 - DNA, 25 bp, Homo sapiens
gtcctttgcacgcattaaatggtac

SEQ ID NO: 32034 - DNA, 25 bp, Homo sapiens
ggtacagaactgaagcctcggaagc

SEQ ID NO: 32035 - DNA, 25 bp, Homo sapiens
gaagcctcggaagcaatttggaact

SEQ ID NO: 32036 - DNA, 25 bp, Homo sapiens
tttgccccaaagtgaggggctccac

SEQ ID NO: 32037 - DNA, 25 bp, Homo sapiens
gacaaactcacttcgcaggtcacat

SEQ ID NO: 32038 - DNA, 25 bp, Homo sapiens
ggtcacatgcctatacatcacttat

SEQ ID NO: 32039 - DNA, 25 bp, Homo sapiens
ttgggtctgaaacttctcacatgtt

SEQ ID NO: 32040 - DNA, 25 bp, Homo sapiens
aaaacctcatatgattgtcctgcct

SEQ ID NO: 32041 - DNA, 25 bp, Homo sapiens
ggagctgttgtatagatcccagatc

SEQ ID NO: 32042 - DNA, 25 bp, Homo sapiens
cagatccatcccatgatttgttcct

SEQ ID NO: 32043 - DNA, 25 bp, Homo sapiens
gaggcaggcaagccgtggattttgc

SEQ ID NO: 32044 - DNA, 25 bp, Homo sapiens
ggattttgcacatggtgactttccc

SEQ ID NO: 32045 - DNA, 25 bp, Homo sapiens
actttcccactgtgccatgatacag

SEQ ID NO: 32046 - DNA, 25 bp, Homo sapiens
tatagcagtgcctttgtctcagggc

SEQ ID NO: 32047 - DNA, 25 bp, Homo sapiens
gctggcagtctagaccttttgggca

SEQ ID NO: 32048 - DNA, 25 bp, Homo sapiens
tccccaagggggctcctttggagtg

SEQ ID NO: 32049 - DNA, 25 bp, Homo sapiens
caaccccttgcaacagggcagctct

SEQ ID NO: 32050 - DNA, 25 bp, Homo sapiens
cctctttgcatgggcagccagctgg

SEQ ID NO: 32051 - DNA, 25 bp, Homo sapiens
ggcagccagctggactaggagtggg

SEQ ID NO: 32052 - DNA, 25 bp, Homo sapiens
cacactggcagagaggggcgctggg

SEQ ID NO: 32053 - DNA, 25 bp, Homo sapiens
caccccacagggtggaggtctcctg

SEQ ID NO: 32054 - DNA, 25 bp, Homo sapiens
tctcctgttggctacactctaaagc

SEQ ID NO: 32055 - DNA, 25 bp, Homo sapiens
gctacactctaaagctgctttgcct

SEQ ID NO: 32056 - DNA, 25 bp, Homo sapiens
agggcatagatttgtctccttccca

SEQ ID NO: 32057 - DNA, 25 bp, Homo sapiens
actgtcctggatgtgcaactggttt

SEQ ID NO: 32058 - DNA, 25 bp, Homo sapiens
gtaactctcctgtccacatatgata

SEQ ID NO: 32059 - DNA, 25 bp, Homo sapiens
ggagcaggacagctccctcaagagt

SEQ ID NO: 32060 - DNA, 25 bp, Homo sapiens
gtgccccggagtacgaatgctatgc

SEQ ID NO: 32061 - DNA, 25 bp, Homo sapiens
ctatgccccggacacagaggagttg

SEQ ID NO: 32062 - DNA, 25 bp, Homo sapiens
aacagaggatggccacagctgcgga

SEQ ID NO: 32063 - DNA, 25 bp, Homo sapiens
tagatggagaggctctgcccatccc

SEQ ID NO: 32064 - DNA, 25 bp, Homo sapiens
gaaaagcattggcacgcaacgcagc

SEQ ID NO: 32065 - DNA, 25 bp, Homo sapiens
gcaacgcagcatgtggcttcattga

SEQ ID NO: 32066 - DNA, 25 bp, Homo sapiens
cattttctagcttttccgtgtatct

SEQ ID NO: 32067 - DNA, 25 bp, Homo sapiens
caagctccagtctgtgtgggatcga

SEQ ID NO: 32068 - DNA, 25 bp, Homo sapiens
gtgggatcgatcatgaggcgctcaa

SEQ ID NO: 32069 - DNA, 25 bp, Homo sapiens
gtggctgagctgacaacgcagatgc

SEQ ID NO: 32070 - DNA, 25 bp, Homo sapiens
aaaacttctggatccttgagcaaat

SEQ ID NO: 32071 - DNA, 25 bp, Homo sapiens
agcaaatgattatagtctcctgact

SEQ ID NO: 32072 - DNA, 25 bp, Homo sapiens
gtctcctgactttcatgaggcttcc

SEQ ID NO: 32073 - DNA, 25 bp, Homo sapiens
aatgattgcatgttgtccccagaac

SEQ ID NO: 32074 - DNA, 25 bp, Homo sapiens
actgccaccttgctatgcgaatgat

SEQ ID NO: 32075 - DNA, 25 bp, Homo sapiens
atgatgttctcaggcagcacttcta

SEQ ID NO: 32076 - DNA, 25 bp, Homo sapiens
ggcagcacttctaagaaacactctt

SEQ ID NO: 32077 - DNA, 25 bp, Homo sapiens
taacatttactctaagtacccagtt

SEQ ID NO: 32078 - DNA, 25 bp, Homo sapiens
tcaacacttactttgtcattttgta

SEQ ID NO: 32079 - DNA, 25 bp, Homo sapiens
tgatactgatattttcctatgctga

SEQ ID NO: 32080 - DNA, 25 bp, Homo sapiens
aacatactgtatgctttctacttgt

SEQ ID NO: 32081 - DNA, 25 bp, Homo sapiens
tactgcaggccacatatatccactc

SEQ ID NO: 32082 - DNA, 25 bp, Homo sapiens
tgccctgcagtcctacatacaaggc

SEQ ID NO: 32083 - DNA, 25 bp, Homo sapiens
tacatccctgaacccaggtgggacc

SEQ ID NO: 32084 - DNA, 25 bp, Homo sapiens
gtggctctttgagtatcaccgatcc

SEQ ID NO: 32085 - DNA, 25 bp, Homo sapiens
tcctccatgacctacctctatgagg

SEQ ID NO: 32086 - DNA, 25 bp, Homo sapiens
tgtatggcacgacatctcagacttc

SEQ ID NO: 32087 - DNA, 25 bp, Homo sapiens
agccctgaggtgtctggctgtggct

SEQ ID NO: 32088 - DNA, 25 bp, Homo sapiens
ggctgtggctcaagatttggcccca

SEQ ID NO: 32089 - DNA, 25 bp, Homo sapiens
aggatactgccttctcaagatcata

SEQ ID NO: 32090 - DNA, 25 bp, Homo sapiens
caagatcataggcctcagactccaa

SEQ ID NO: 32091 - DNA, 25 bp, Homo sapiens
ttatcccagggttccgtttgctgaa

SEQ ID NO: 32092 - DNA, 25 bp, Homo sapiens
actgcctggtgcgtccatagagaga

SEQ ID NO: 32093 - DNA, 25 bp, Homo sapiens
gaactggggggcacccagatggtgc

SEQ ID NO: 32094 - DNA, 25 bp, Homo sapiens
tgcagatggtttgcacacctgagcc

SEQ ID NO: 32095 - DNA, 25 bp, Homo sapiens
cattccctactctctaaggccaaaa

SEQ ID NO: 32096 - DNA, 25 bp, Homo sapiens
caccatcccaaatgcaagcagccag

SEQ ID NO: 32097 - DNA, 25 bp, Homo sapiens
ggtgggtacagcttgagaggggggc

SEQ ID NO: 32098 - DNA, 25 bp, Homo sapiens
gcttgagaggggggcagctccctca

SEQ ID NO: 32099 - DNA, 25 bp, Homo sapiens
actcaacgggtgtagccactggtgc

SEQ ID NO: 32100 - DNA, 25 bp, Homo sapiens
gccactggtgctttgaagccttttg

SEQ ID NO: 32101 - DNA, 25 bp, Homo sapiens
gaccaggttctcttttcactgggac

SEQ ID NO: 32102 - DNA, 25 bp, Homo sapiens
ctcttttcactgggaccttgcaagg

SEQ ID NO: 32103 - DNA, 25 bp, Homo sapiens
agagaagactccgtgcttcagggct

SEQ ID NO: 32104 - DNA, 25 bp, Homo sapiens
gtgcttcagggctatgacatcaaca

SEQ ID NO: 32105 - DNA, 25 bp, Homo sapiens
atgcagagccccttaggaaacccat

SEQ ID NO: 32106 - DNA, 25 bp, Homo sapiens
gaaacccatcaaaaaccggagcata

SEQ ID NO: 32107 - DNA, 25 bp, Homo sapiens
gaaatacacatgctcccaatcaaaa

SEQ ID NO: 32108 - DNA, 25 bp, Homo sapiens
atcaaaaaacaacggctggccacct

SEQ ID NO: 32109 - DNA, 25 bp, Homo sapiens
ggtgaattggctctagaggccctgt

SEQ ID NO: 32110 - DNA, 25 bp, Homo sapiens
gaggccctgtatgctagtatcattt

SEQ ID NO: 32111 - DNA, 25 bp, Homo sapiens
gagcaacctatttttcaagcagatt

SEQ ID NO: 32112 - DNA, 25 bp, Homo sapiens
aaagctattttcattgccacaaagt

SEQ ID NO: 32113 - DNA, 25 bp, Homo sapiens
aagtgctttgatgatgtaataccta

SEQ ID NO: 32114 - DNA, 25 bp, Homo sapiens
attccctaatgtacctgaacactag

SEQ ID NO: 32115 - DNA, 25 bp, Homo sapiens
tgaaccaccatctgtatcagcgcat

SEQ ID NO: 32116 - DNA, 25 bp, Homo sapiens
gtatcagcgcatggggagtgtgcat

SEQ ID NO: 32117 - DNA, 25 bp, Homo sapiens
gagtgtgcattctgaggtctaaccc

SEQ ID NO: 32118 - DNA, 25 bp, Homo sapiens
tctgaggtctaacccggggtgccag

SEQ ID NO: 32119 - DNA, 25 bp, Homo sapiens
gaatggggactccctgagtaatggg

SEQ ID NO: 32120 - DNA, 25 bp, Homo sapiens
tcagcagcacccatttgtacatata

SEQ ID NO: 32121 - DNA, 25 bp, Homo sapiens
gtgtgagttctacgtttctaccata

SEQ ID NO: 32122 - DNA, 25 bp, Homo sapiens
gagtcatgcactagacagtgggcct

SEQ ID NO: 32123 - DNA, 25 bp, Homo sapiens
tgggcctagctcatcagtggctaaa

SEQ ID NO: 32124 - DNA, 25 bp, Homo sapiens
ggttggtttcctgtatatatatgta

SEQ ID NO: 32125 - DNA, 25 bp, Homo sapiens
gagccacttaacagctctgggtccc

SEQ ID NO: 32126 - DNA, 25 bp, Homo sapiens
gtccctgttttaccatcctgggagc

SEQ ID NO: 32127 - DNA, 25 bp, Homo sapiens
gaaagcatttctgaagcccctttct

SEQ ID NO: 32128 - DNA, 25 bp, Homo sapiens
atttttgacagattcctcccaagtc

SEQ ID NO: 32129 - DNA, 25 bp, Homo sapiens
tgtacccatctcaaatgttcccaag

SEQ ID NO: 32130 - DNA, 25 bp, Homo sapiens
gtgtgattcctagttgtagccaccg

SEQ ID NO: 32131 - DNA, 25 bp, Homo sapiens
tagccaccggatgtgctgaggccta

SEQ ID NO: 32132 - DNA, 25 bp, Homo sapiens
aggttgcaagaacattcctctactt

SEQ ID NO: 32133 - DNA, 25 bp, Homo sapiens
cctctactttctgctaagccttgga

SEQ ID NO: 32134 - DNA, 25 bp, Homo sapiens
aaagtagtttgaccctcacagttca

SEQ ID NO: 32135 - DNA, 25 bp, Homo sapiens
acagttcacattcagctcagcagag

SEQ ID NO: 32136 - DNA, 25 bp, Homo sapiens
ttatacagtcacccccagttatgat

SEQ ID NO: 32137 - DNA, 25 bp, Homo sapiens
gcagatttcaccattgattactcca

SEQ ID NO: 32138 - DNA, 25 bp, Homo sapiens
tgaaacagcacgtgcagaccatccg

SEQ ID NO: 32139 - DNA, 25 bp, Homo sapiens
gcagaccatccgaagcctgtaactg

SEQ ID NO: 32140 - DNA, 25 bp, Homo sapiens
aacggaacctagtccagatctgaac

SEQ ID NO: 32141 - DNA, 25 bp, Homo sapiens
gatctgaacgatgccgtgtccagtt

SEQ ID NO: 32142 - DNA, 25 bp, Homo sapiens
gtgtccagtttgcgaagtcctattc

SEQ ID NO: 32143 - DNA, 25 bp, Homo sapiens
gcgtgcctttgttcaggtggggatg

SEQ ID NO: 32144 - DNA, 25 bp, Homo sapiens
aggctgctatgactctttggatggg

SEQ ID NO: 32145 - DNA, 25 bp, Homo sapiens
tttgtagccatctttgctgtgccac

SEQ ID NO: 32146 - DNA, 25 bp, Homo sapiens
ctgtgccacttatcctgggacaaga

SEQ ID NO: 32147 - DNA, 25 bp, Homo sapiens
gcacattgctgagccagagtcaaaa

SEQ ID NO: 32148 - DNA, 25 bp, Homo sapiens
tctctcactgatgccctttggaaat

SEQ ID NO: 32149 - DNA, 25 bp, Homo sapiens
gaaatttctggactatcctctttgg

SEQ ID NO: 32150 - DNA, 25 bp, Homo sapiens
gaaaacaatgcctcaccagcagaag

SEQ ID NO: 32151 - DNA, 25 bp, Homo sapiens
gagtagattgattcaccctacccac

SEQ ID NO: 32152 - DNA, 25 bp, Homo sapiens
caccaagccactgataccattttat

SEQ ID NO: 32153 - DNA, 25 bp, Homo sapiens
taatgttgattgaacctccctttcc

SEQ ID NO: 32154 - DNA, 25 bp, Homo sapiens
tccctttccccataatgtgggcaga

SEQ ID NO: 32155 - DNA, 25 bp, Homo sapiens
aatgtgggcagatttggctcagctc

SEQ ID NO: 32156 - DNA, 25 bp, Homo sapiens
agctccttcatgagatcaggtcagt

SEQ ID NO: 32157 - DNA, 25 bp, Homo sapiens
caggtcagtggtattgtttctgtca

SEQ ID NO: 32158 - DNA, 25 bp, Homo sapiens
ggatggctctgttaacttcttcagg

SEQ ID NO: 32159 - DNA, 25 bp, Homo sapiens
ggaacattgatggcgaatactggct

SEQ ID NO: 32160 - DNA, 25 bp, Homo sapiens
gaaccaaggcaactacaaactcctg

SEQ ID NO: 32161 - DNA, 25 bp, Homo sapiens
ggtccggccgcaaagtctttgcaga

SEQ ID NO: 32162 - DNA, 25 bp, Homo sapiens
tttccgcctggaacctgagagcgag

SEQ ID NO: 32163 - DNA, 25 bp, Homo sapiens
ttataagctgcggctggggcgctac

SEQ ID NO: 32164 - DNA, 25 bp, Homo sapiens
caatgcgggtgactcctttacatgg

SEQ ID NO: 32165 - DNA, 25 bp, Homo sapiens
gctaccaggacggagtctactgggc

SEQ ID NO: 32166 - DNA, 25 bp, Homo sapiens
aaccgcctcatgcaggtgtggtgcg

SEQ ID NO: 32167 - DNA, 25 bp, Homo sapiens
ggtgtggtgcgaccagagacacgac

SEQ ID NO: 32168 - DNA, 25 bp, Homo sapiens
ctggaccgtcatccagagacgcctg

SEQ ID NO: 32169 - DNA, 25 bp, Homo sapiens
tcgctgtgagtaccttcaccagaaa

SEQ ID NO: 32170 - DNA, 25 bp, Homo sapiens
cacattaaaggtctcatcctggagt

SEQ ID NO: 32171 - DNA, 25 bp, Homo sapiens
gggaatttttgagcctctgcttagt

SEQ ID NO: 32172 - DNA, 25 bp, Homo sapiens
atctgcttttcttatgctgaccact

SEQ ID NO: 32173 - DNA, 25 bp, Homo sapiens
cactggagtccatggtggcaagtag

SEQ ID NO: 32174 - DNA, 25 bp, Homo sapiens
gagctgctctaggttcttgaggttt

SEQ ID NO: 32175 - DNA, 25 bp, Homo sapiens
gggcactgtgcaaagactccatagc

SEQ ID NO: 32176 - DNA, 25 bp, Homo sapiens
tccatagctgtgcctaggagtctag

SEQ ID NO: 32177 - DNA, 25 bp, Homo sapiens
aagtgacagaggcttggctttttta

SEQ ID NO: 32178 - DNA, 25 bp, Homo sapiens
ttttacctttagttcagccaagtca

SEQ ID NO: 32179 - DNA, 25 bp, Homo sapiens
agccaagtcattttcaagtcctgag

SEQ ID NO: 32180 - DNA, 25 bp, Homo sapiens
cttacaccctggatgtcactttgga

SEQ ID NO: 32181 - DNA, 25 bp, Homo sapiens
gtgtgggcattttactgcctcacag

SEQ ID NO: 32182 - DNA, 25 bp, Homo sapiens
agaagccagccaagtgccaaggtca

SEQ ID NO: 32183 - DNA, 25 bp, Homo sapiens
aggtcagcttggctggtctgaggcc

SEQ ID NO: 32184 - DNA, 25 bp, Homo sapiens
gtctgaggccacctttttagccaaa

SEQ ID NO: 32185 - DNA, 25 bp, Homo sapiens
ggcagatgctaggtcagttgttttc

SEQ ID NO: 32186 - DNA, 25 bp, Homo sapiens
agttgttttcacctaatatcctctt

SEQ ID NO: 32187 - DNA, 25 bp, Homo sapiens
actgcagccttcatctttattggga

SEQ ID NO: 32188 - DNA, 25 bp, Homo sapiens
gtccatgatgaccactgttttccaa

SEQ ID NO: 32189 - DNA, 25 bp, Homo sapiens
ccccaccacacaggagtgaggccag

SEQ ID NO: 32190 - DNA, 25 bp, Homo sapiens
gaggccaggggctaggagttctaag

SEQ ID NO: 32191 - DNA, 25 bp, Homo sapiens
aacaatcctgaaggcctgggatttt

SEQ ID NO: 32192 - DNA, 25 bp, Homo sapiens
aactgcagactgtaaatttccgaca

SEQ ID NO: 32193 - DNA, 25 bp, Homo sapiens
gttcagcacttgatccatctgtgtg

SEQ ID NO: 32194 - DNA, 25 bp, Homo sapiens
gcaagtatcagtgatgctgccctgt

SEQ ID NO: 32195 - DNA, 25 bp, Homo sapiens
atgctgccctgttagacatcattta

SEQ ID NO: 32196 - DNA, 25 bp, Homo sapiens
atgtgacagtcagcttcagagaaac

SEQ ID NO: 32197 - DNA, 25 bp, Homo sapiens
agtctggattcgaattgcctgggga

SEQ ID NO: 32198 - DNA, 25 bp, Homo sapiens
cacaaagccaaaccagtacaaacct

SEQ ID NO: 32199 - DNA, 25 bp, Homo sapiens
ccagtacaaacctacctacgtggtg

SEQ ID NO: 32200 - DNA, 25 bp, Homo sapiens
tacctacgtggtgtactactcccag

SEQ ID NO: 32201 - DNA, 25 bp, Homo sapiens
atgctgaggcgcaatacaccgcttc

SEQ ID NO: 32202 - DNA, 25 bp, Homo sapiens
aagaacagcattgacctcttcctat

SEQ ID NO: 32203 - DNA, 25 bp, Homo sapiens
tatacgtggtgggctcatcctacga

SEQ ID NO: 32204 - DNA, 25 bp, Homo sapiens
acctgcctgtttgagtctctgaacc

SEQ ID NO: 32205 - DNA, 25 bp, Homo sapiens
tgtggatggcggtgtgattctggag

SEQ ID NO: 32206 - DNA, 25 bp, Homo sapiens
tagggcagatgatggcggcttgact

SEQ ID NO: 32207 - DNA, 25 bp, Homo sapiens
gaacagagtgtggcccaggttcttc

SEQ ID NO: 32208 - DNA, 25 bp, Homo sapiens
ccaggttcttcagtctgccaaggaa

SEQ ID NO: 32209 - DNA, 25 bp, Homo sapiens
ccatttccccaatcctggcaaaagc

SEQ ID NO: 32210 - DNA, 25 bp, Homo sapiens
agcccaaagatcccagggtcaggag

SEQ ID NO: 32211 - DNA, 25 bp, Homo sapiens
cccagaactgactcctaaggtctcc

SEQ ID NO: 32212 - DNA, 25 bp, Homo sapiens
tcatatcttaggcattcctggcccc

SEQ ID NO: 32213 - DNA, 25 bp, Homo sapiens
aaggtggggtaattgcattcgtctg

SEQ ID NO: 32214 - DNA, 25 bp, Homo sapiens
tctgcagtagacacgagttcctcgg

SEQ ID NO: 32215 - DNA, 25 bp, Homo sapiens
tcctcggacctgtataatctcccaa

SEQ ID NO: 32216 - DNA, 25 bp, Homo sapiens
gggctggaccccaatggagaacagg

SEQ ID NO: 32217 - DNA, 25 bp, Homo sapiens
tccagcacgagatggaccacctgca

SEQ ID NO: 32218 - DNA, 25 bp, Homo sapiens
atggacagcaggacgttcacaaacg

SEQ ID NO: 32219 - DNA, 25 bp, Homo sapiens
gctttgctactggggctgaggattc

SEQ ID NO: 32220 - DNA, 25 bp, Homo sapiens
gaggattccggataccaagacgcaa

SEQ ID NO: 32221 - DNA, 25 bp, Homo sapiens
aaacactttcactttgagctgggca

SEQ ID NO: 32222 - DNA, 25 bp, Homo sapiens
gagctgggcaaatcttacttggcat

SEQ ID NO: 32223 - DNA, 25 bp, Homo sapiens
tcaacttggatggctcgcatatgac

SEQ ID NO: 32224 - DNA, 25 bp, Homo sapiens
agtatcccattggttctggtcgtgt

SEQ ID NO: 32225 - DNA, 25 bp, Homo sapiens
agaaggttcagattgacccctacct

SEQ ID NO: 32226 - DNA, 25 bp, Homo sapiens
gaagattctctgtgtcatatctgca

SEQ ID NO: 32227 - DNA, 25 bp, Homo sapiens
gtcctttcttctgtcgagatcaggt

SEQ ID NO: 32228 - DNA, 25 bp, Homo sapiens
aggtctgcttcaaatacttctgccg

SEQ ID NO: 32229 - DNA, 25 bp, Homo sapiens
gccccctgatgcggaaccagaagaa

SEQ ID NO: 32230 - DNA, 25 bp, Homo sapiens
cgcccaaagctggcaggtcaggcaa

SEQ ID NO: 32231 - DNA, 25 bp, Homo sapiens
aattgtagtcacctttgcacttgct

SEQ ID NO: 32232 - DNA, 25 bp, Homo sapiens
tttgcacttgctgaatctgtctttg

SEQ ID NO: 32233 - DNA, 25 bp, Homo sapiens
accaagggcaaggaccctctggctt

SEQ ID NO: 32234 - DNA, 25 bp, Homo sapiens
tccaagcgactctgtagttttccca

SEQ ID NO: 32235 - DNA, 25 bp, Homo sapiens
ggaaaggaatcatagcccatgccac

SEQ ID NO: 32236 - DNA, 25 bp, Homo sapiens
caccccacaatgccagataaaccaa

SEQ ID NO: 32237 - DNA, 25 bp, Homo sapiens
tcaagtttcagtcttccaaccgagt

SEQ ID NO: 32238 - DNA, 25 bp, Homo sapiens
gatggtctgcttacctgaaccagtg

SEQ ID NO: 32239 - DNA, 25 bp, Homo sapiens
agcaagtgtgactgtttcctgtgac

SEQ ID NO: 32240 - DNA, 25 bp, Homo sapiens
tcctgtgacctgaagatagcctgtg

SEQ ID NO: 32241 - DNA, 25 bp, Homo sapiens
tagcctgtgtgtagtttaacctggg

SEQ ID NO: 32242 - DNA, 25 bp, Homo sapiens
gtgcagcttattgtagaccattact

SEQ ID NO: 32243 - DNA, 25 bp, Homo sapiens
cctttgccgatcttatgtacatacc

SEQ ID NO: 32244 - DNA, 25 bp, Homo sapiens
ttaactgcacttgctttatctcctt

SEQ ID NO: 32245 - DNA, 25 bp, Homo sapiens
ttatctccttgggcattcgtactta

SEQ ID NO: 32246 - DNA, 25 bp, Homo sapiens
gatggagcgcttacactacatccac

SEQ ID NO: 32247 - DNA, 25 bp, Homo sapiens
gtgtcccagcagattggggaggtcc

SEQ ID NO: 32248 - DNA, 25 bp, Homo sapiens
accactgtccatctggtggcagatc

SEQ ID NO: 32249 - DNA, 25 bp, Homo sapiens
catctggtggcagatccctcagtac

SEQ ID NO: 32250 - DNA, 25 bp, Homo sapiens
cctcagtacctgctcattgggatca

SEQ ID NO: 32251 - DNA, 25 bp, Homo sapiens
caggcctggagtttgcctactcaga

SEQ ID NO: 32252 - DNA, 25 bp, Homo sapiens
ctccatgcagggcgccatcatgggc

SEQ ID NO: 32253 - DNA, 25 bp, Homo sapiens
aacaattgccggatggacctctact

SEQ ID NO: 32254 - DNA, 25 bp, Homo sapiens
ctctcctatttgtctggatcgctgg

SEQ ID NO: 32255 - DNA, 25 bp, Homo sapiens
ggatcgctggacgctatgagagggc

SEQ ID NO: 32256 - DNA, 25 bp, Homo sapiens
caggggctgaacaggccctattcca

SEQ ID NO: 32257 - DNA, 25 bp, Homo sapiens
ggcaggcttcctagataattttcgt

SEQ ID NO: 32258 - DNA, 25 bp, Homo sapiens
ctgtggcatctgttgtcgcaggtat

SEQ ID NO: 32259 - DNA, 25 bp, Homo sapiens
gcagctgtggtgtatcctaagccag

SEQ ID NO: 32260 - DNA, 25 bp, Homo sapiens
aacagttgaaccatgcctttcacac

SEQ ID NO: 32261 - DNA, 25 bp, Homo sapiens
aatgctgtatccaatgctcaggtga

SEQ ID NO: 32262 - DNA, 25 bp, Homo sapiens
aggtgctcgagtttggcttttcatt

SEQ ID NO: 32263 - DNA, 25 bp, Homo sapiens
gggtcacttattgcttccatgtgga

SEQ ID NO: 32264 - DNA, 25 bp, Homo sapiens
atccgggactagctgtgttttttca

SEQ ID NO: 32265 - DNA, 25 bp, Homo sapiens
gaaccgaagagctatggacctgaga

SEQ ID NO: 32266 - DNA, 25 bp, Homo sapiens
tcacttcttaagtcacattttcctt

SEQ ID NO: 32267 - DNA, 25 bp, Homo sapiens
tttatctctcagtacacattgccaa

SEQ ID NO: 32268 - DNA, 25 bp, Homo sapiens
cagagcacccacctggaggtgtcac

SEQ ID NO: 32269 - DNA, 25 bp, Homo sapiens
cattcatccacctgtcagtcaacaa

SEQ ID NO: 32270 - DNA, 25 bp, Homo sapiens
ccgctgagcatcggcttgtatcaaa

SEQ ID NO: 32271 - DNA, 25 bp, Homo sapiens
ggcttgtatcaaaaggtccagacct

SEQ ID NO: 32272 - DNA, 25 bp, Homo sapiens
gcaatgacacgatctcggttcactg

SEQ ID NO: 32273 - DNA, 25 bp, Homo sapiens
acggtgattcactatgttggccagg

SEQ ID NO: 32274 - DNA, 25 bp, Homo sapiens
tggccaggctagtcacgaactcctg

SEQ ID NO: 32275 - DNA, 25 bp, Homo sapiens
ttgaggccaaattctgcgcttaagg

SEQ ID NO: 32276 - DNA, 25 bp, Homo sapiens
gtgcaccaagtgctggggtgggggc

SEQ ID NO: 32277 - DNA, 25 bp, Homo sapiens
ggggctggttataaacgaggccaca

SEQ ID NO: 32278 - DNA, 25 bp, Homo sapiens
acgaggccacaaatcatgcttgtta

SEQ ID NO: 32279 - DNA, 25 bp, Homo sapiens
gccctgaacgcgtgatggatctcgg

SEQ ID NO: 32280 - DNA, 25 bp, Homo sapiens
ctgcggcaggcgatcgaggagtgca

SEQ ID NO: 32281 - DNA, 25 bp, Homo sapiens
tgattctggagctgcccgagcagtc

SEQ ID NO: 32282 - DNA, 25 bp, Homo sapiens
ccaaacatccgagtgctccttgagc

SEQ ID NO: 32283 - DNA, 25 bp, Homo sapiens
gcaagagcgtcaagcagacctgtga

SEQ ID NO: 32284 - DNA, 25 bp, Homo sapiens
gtgtaacaccatcatctgggggctc

SEQ ID NO: 32285 - DNA, 25 bp, Homo sapiens
catctgggggctcattcagacctgg

SEQ ID NO: 32286 - DNA, 25 bp, Homo sapiens
ggccgagacccagacgaggagtgag

SEQ ID NO: 32287 - DNA, 25 bp, Homo sapiens
tccgctgggctcacattcagatgtg

SEQ ID NO: 32288 - DNA, 25 bp, Homo sapiens
atgtgagctatccagtgtggtggcc

SEQ ID NO: 32289 - DNA, 25 bp, Homo sapiens
aatatgcatttcctcgttgtactgt

SEQ ID NO: 32290 - DNA, 25 bp, Homo sapiens
ggccaggtttgttccagggcaagca

SEQ ID NO: 32291 - DNA, 25 bp, Homo sapiens
gcaatggcatactggcttctaaaat

SEQ ID NO: 32292 - DNA, 25 bp, Homo sapiens
gcttctaaaattcctctccagagct

SEQ ID NO: 32293 - DNA, 25 bp, Homo sapiens
gagctactctcaagttatatccagg

SEQ ID NO: 32294 - DNA, 25 bp, Homo sapiens
atatccaggggacaggcccctttgg

SEQ ID NO: 32295 - DNA, 25 bp, Homo sapiens
aaggatcattggactatcttctctg

SEQ ID NO: 32296 - DNA, 25 bp, Homo sapiens
gtgttcacagaatggccactgatag

SEQ ID NO: 32297 - DNA, 25 bp, Homo sapiens
acccactggaaggctcacaggcaag

SEQ ID NO: 32298 - DNA, 25 bp, Homo sapiens
cagaaggtgccaacactgtcgctac

SEQ ID NO: 32299 - DNA, 25 bp, Homo sapiens
tgagaaattcaccctcacaaacctt

SEQ ID NO: 32300 - DNA, 25 bp, Homo sapiens
agtgcagaggcacagattccgtcct

SEQ ID NO: 32301 - DNA, 25 bp, Homo sapiens
tttagtatgctacctcttctattga

SEQ ID NO: 32302 - DNA, 25 bp, Homo sapiens
aaggatgaactcctaatgccctctg

SEQ ID NO: 32303 - DNA, 25 bp, Homo sapiens
ctaatgccctctgttgtgacaacaa

SEQ ID NO: 32304 - DNA, 25 bp, Homo sapiens
tatagcttgtgtaacttccttttca

SEQ ID NO: 32305 - DNA, 25 bp, Homo sapiens
ttgtttcttatctcagtcatcacta

SEQ ID NO: 32306 - DNA, 25 bp, Homo sapiens
cactatggtgcttctgacgttgatg

SEQ ID NO: 32307 - DNA, 25 bp, Homo sapiens
gacgttgatgactgtcacactggat

SEQ ID NO: 32308 - DNA, 25 bp, Homo sapiens
tggatcctcctcagaaactaccgga

SEQ ID NO: 32309 - DNA, 25 bp, Homo sapiens
attggtgtgttttgtatcttgcttg

SEQ ID NO: 32310 - DNA, 25 bp, Homo sapiens
atcttgcttgaacttcctgttcttc

SEQ ID NO: 32311 - DNA, 25 bp, Homo sapiens
acttcctgttcttcttggtatactt

SEQ ID NO: 32312 - DNA, 25 bp, Homo sapiens
acaaagcaattcactacttccgtaa

SEQ ID NO: 32313 - DNA, 25 bp, Homo sapiens
aataatcagtacatccccaaaccaa

SEQ ID NO: 32314 - DNA, 25 bp, Homo sapiens
cccaaaccaaagcctgccagaataa

SEQ ID NO: 32315 - DNA, 25 bp, Homo sapiens
aaagaaaggacggactcgccacagc

SEQ ID NO: 32316 - DNA, 25 bp, Homo sapiens
cacagctgaactcctcacttttagg

SEQ ID NO: 32317 - DNA, 25 bp, Homo sapiens
ggacacaagactaccattgtacact

SEQ ID NO: 32318 - DNA, 25 bp, Homo sapiens
aatggatgtgcctaaaagctcccct

SEQ ID NO: 32319 - DNA, 25 bp, Homo sapiens
aaactgcagattttgccttgcactt

SEQ ID NO: 32320 - DNA, 25 bp, Homo sapiens
ttgccttgcactttttgaatctctc

SEQ ID NO: 32321 - DNA, 25 bp, Homo sapiens
atgcatctctgcgtattttcaagtt

SEQ ID NO: 32322 - DNA, 25 bp, Homo sapiens
gagcatatgttgtgactgtcgttga

SEQ ID NO: 32323 - DNA, 25 bp, Homo sapiens
atggagcatctactttatcaaaact

SEQ ID NO: 32324 - DNA, 25 bp, Homo sapiens
gacaaacccgtatcacattcttgca

SEQ ID NO: 32325 - DNA, 25 bp, Homo sapiens
acagccactagtgggtttgccagtg

SEQ ID NO: 32326 - DNA, 25 bp, Homo sapiens
gacaagcattccagtgatgccagta

SEQ ID NO: 32327 - DNA, 25 bp, Homo sapiens
ccagtagtttgctcccacagaatat

SEQ ID NO: 32328 - DNA, 25 bp, Homo sapiens
gcagagactcacagtagttctacgc

SEQ ID NO: 32329 - DNA, 25 bp, Homo sapiens
cagtagttctacgccagtacagcac

SEQ ID NO: 32330 - DNA, 25 bp, Homo sapiens
gcaccccatcaaaccagtggttcat

SEQ ID NO: 32331 - DNA, 25 bp, Homo sapiens
accagtggttcatccaactgctacc

SEQ ID NO: 32332 - DNA, 25 bp, Homo sapiens
ttccttctagtccatttacgctaca

SEQ ID NO: 32333 - DNA, 25 bp, Homo sapiens
ttacgctacagtctgatcaccagcc

SEQ ID NO: 32334 - DNA, 25 bp, Homo sapiens
gctccactgttacggttgagggaac

SEQ ID NO: 32335 - DNA, 25 bp, Homo sapiens
ggatcagccctgttagaagtctgtg

SEQ ID NO: 32336 - DNA, 25 bp, Homo sapiens
cctgttctctgcaatcatccaaaat

SEQ ID NO: 32337 - DNA, 25 bp, Homo sapiens
gaagctatatccagtgtttcactgc

SEQ ID NO: 32338 - DNA, 25 bp, Homo sapiens
acagattcactactcttactgattc

SEQ ID NO: 32339 - DNA, 25 bp, Homo sapiens
ttactgattcttcactgagctttgc

SEQ ID NO: 32340 - DNA, 25 bp, Homo sapiens
ataagcagagttccaagtctcccct

SEQ ID NO: 32341 - DNA, 25 bp, Homo sapiens
cctagggttgtctctacatttcttt

SEQ ID NO: 32342 - DNA, 25 bp, Homo sapiens
acatttctttatcattccagtgggt

SEQ ID NO: 32343 - DNA, 25 bp, Homo sapiens
cattacgtactgttgtttttccttg

SEQ ID NO: 32344 - DNA, 25 bp, Homo sapiens
ggtaattgatacctctctgttttat

SEQ ID NO: 32345 - DNA, 25 bp, Homo sapiens
aggtggagggcgtgttgtcgcaggt

SEQ ID NO: 32346 - DNA, 25 bp, Homo sapiens
tgtcgcaggtggacttcttgcaaca

SEQ ID NO: 32347 - DNA, 25 bp, Homo sapiens
tatggcgtgtgcgtgccaggttgtg

SEQ ID NO: 32348 - DNA, 25 bp, Homo sapiens
ggagaagttgtaccagcacgttcgc

SEQ ID NO: 32349 - DNA, 25 bp, Homo sapiens
cgcatccaggacgccatggaggtca

SEQ ID NO: 32350 - DNA, 25 bp, Homo sapiens
ggtcaccagcacgttcaaactgatg

SEQ ID NO: 32351 - DNA, 25 bp, Homo sapiens
agacccggttggtgcgtgagggctt

SEQ ID NO: 32352 - DNA, 25 bp, Homo sapiens
atgtggggatcgtggttgaccctct

SEQ ID NO: 32353 - DNA, 25 bp, Homo sapiens
ttgaccctctgtttgtactggacaa

SEQ ID NO: 32354 - DNA, 25 bp, Homo sapiens
ttgtactggacaaccgggcccagtc

SEQ ID NO: 32355 - DNA, 25 bp, Homo sapiens
tgtgagggaacctggaggctctgat

SEQ ID NO: 32356 - DNA, 25 bp, Homo sapiens
cattctatctaaattgtgtgtctgt

SEQ ID NO: 32357 - DNA, 25 bp, Homo sapiens
gtgtgtctgtttttgaaaggtgtgt

SEQ ID NO: 32358 - DNA, 25 bp, Homo sapiens
aggtgtgtgctttcaagtaggtggt

SEQ ID NO: 32359 - DNA, 25 bp, Homo sapiens
tatgcattgtagcagtaatcattta

SEQ ID NO: 32360 - DNA, 25 bp, Homo sapiens
ggaatgcttttgacatgttttaaca

SEQ ID NO: 32361 - DNA, 25 bp, Homo sapiens
ttaatggaaatctgttactcaggct

SEQ ID NO: 32362 - DNA, 25 bp, Homo sapiens
ttagctttttaccctcaactcaagt

SEQ ID NO: 32363 - DNA, 25 bp, Homo sapiens
agcaggctgttaatttcccatctat

SEQ ID NO: 32364 - DNA, 25 bp, Homo sapiens
atttcccatctatgaatagcacttt

SEQ ID NO: 32365 - DNA, 25 bp, Homo sapiens
atgcagcgttatgtggatcattatg

SEQ ID NO: 32366 - DNA, 25 bp, Homo sapiens
ttgtggttgatactcaagccttgta

SEQ ID NO: 32367 - DNA, 25 bp, Homo sapiens
gaagttgtgacctgtacttgtacta

SEQ ID NO: 32368 - DNA, 25 bp, Homo sapiens
gaaggagacttgttctagcgtgccc

SEQ ID NO: 32369 - DNA, 25 bp, Homo sapiens
tgccccatggtacctagtgtgtgtc

SEQ ID NO: 32370 - DNA, 25 bp, Homo sapiens
gtacctagtgtgtgtctgatgccgg

SEQ ID NO: 32371 - DNA, 25 bp, Homo sapiens
gtctgatgccggttggtgtcaaaga

SEQ ID NO: 32372 - DNA, 25 bp, Homo sapiens
gggcttcttgaaggaacttgccatt

SEQ ID NO: 32373 - DNA, 25 bp, Homo sapiens
ttccttgctttgaccactgcatgaa

SEQ ID NO: 32374 - DNA, 25 bp, Homo sapiens
gaccactgcatgaactgcttctaaa

SEQ ID NO: 32375 - DNA, 25 bp, Homo sapiens
atcattcctctctgtagatgctagg

SEQ ID NO: 32376 - DNA, 25 bp, Homo sapiens
gtattattaagttgatagccctcta

SEQ ID NO: 32377 - DNA, 25 bp, Homo sapiens
atagccctctagtcagttatattgc

SEQ ID NO: 32378 - DNA, 25 bp, Homo sapiens
cctatggccgtgggcctcaacaagg

SEQ ID NO: 32379 - DNA, 25 bp, Homo sapiens
ccgtgggcctcaacaagggccacaa

SEQ ID NO: 32380 - DNA, 25 bp, Homo sapiens
agggccacaaagtgaccaagaacgt

SEQ ID NO: 32381 - DNA, 25 bp, Homo sapiens
ccaagaacgtgagcaagcccaggca

SEQ ID NO: 32382 - DNA, 25 bp, Homo sapiens
gaccaaacacaccaagttcgtgcgg

SEQ ID NO: 32383 - DNA, 25 bp, Homo sapiens
gttcgtgcgggacatgattcgggag

SEQ ID NO: 32384 - DNA, 25 bp, Homo sapiens
ggacatgattcgggaggtgtgtggc

SEQ ID NO: 32385 - DNA, 25 bp, Homo sapiens
gcgcgccatggagttactgaaggtc

SEQ ID NO: 32386 - DNA, 25 bp, Homo sapiens
gagttactgaaggtctccaaggaca

SEQ ID NO: 32387 - DNA, 25 bp, Homo sapiens
gacaaacgggccctcaaatttatca

SEQ ID NO: 32388 - DNA, 25 bp, Homo sapiens
gaaaagggtggggacgcacatccgc

SEQ ID NO: 32389 - DNA, 25 bp, Homo sapiens
tagactctggccttcaccaatagtc

SEQ ID NO: 32390 - DNA, 25 bp, Homo sapiens
caccaatagtctctctgcaagacag

SEQ ID NO: 32391 - DNA, 25 bp, Homo sapiens
caaaagaactaagaggcccagccct

SEQ ID NO: 32392 - DNA, 25 bp, Homo sapiens
tcagaaacccttcagtgctacattt

SEQ ID NO: 32393 - DNA, 25 bp, Homo sapiens
cagtgctacattttgtggcttttta

SEQ ID NO: 32394 - DNA, 25 bp, Homo sapiens
aggatcattcaaaagttacccaaag

SEQ ID NO: 32395 - DNA, 25 bp, Homo sapiens
aaagggcttattgactctttctatt

SEQ ID NO: 32396 - DNA, 25 bp, Homo sapiens
ggaagcactaggttggcagagacac

SEQ ID NO: 32397 - DNA, 25 bp, Homo sapiens
ctttgtctagtgtattctcttcaca

SEQ ID NO: 32398 - DNA, 25 bp, Homo sapiens
gagtggtttctgcgtgtgtatattt

SEQ ID NO: 32399 - DNA, 25 bp, Homo sapiens
gatatttttcatgctccactatttt

SEQ ID NO: 32400 - DNA, 25 bp, Homo sapiens
acacttggctgggtttctacctagg

SEQ ID NO: 32401 - DNA, 25 bp, Homo sapiens
aggttgccaggttatcatcggagcc

SEQ ID NO: 32402 - DNA, 25 bp, Homo sapiens
agccttcttgtgtcctcaaagggcc

SEQ ID NO: 32403 - DNA, 25 bp, Homo sapiens
gggcagccatcgcagaattgtttgt

SEQ ID NO: 32404 - DNA, 25 bp, Homo sapiens
gtgggcaaagggctgctttagcact

SEQ ID NO: 32405 - DNA, 25 bp, Homo sapiens
gctttagcacttttcttttagcaaa

SEQ ID NO: 32406 - DNA, 25 bp, Homo sapiens
gactctcaggcacagggggttttaa

SEQ ID NO: 32407 - DNA, 25 bp, Homo sapiens
gaggtctggcaggtattcccatgat

SEQ ID NO: 32408 - DNA, 25 bp, Homo sapiens
aacacagtgaagccaactatcccat

SEQ ID NO: 32409 - DNA, 25 bp, Homo sapiens
ttctccaatatacttgcatccacct

SEQ ID NO: 32410 - DNA, 25 bp, Homo sapiens
tgcatccacctacaaatataacctt

SEQ ID NO: 32411 - DNA, 25 bp, Homo sapiens
agtggccccctaaacagaaagtgtg

SEQ ID NO: 32412 - DNA, 25 bp, Homo sapiens
ccctcgctgctcataaggacctggg

SEQ ID NO: 32413 - DNA, 25 bp, Homo sapiens
gaagaggaaagtgtcccaaggtctt

SEQ ID NO: 32414 - DNA, 25 bp, Homo sapiens
atagtttcctttcttggatctgcaa

SEQ ID NO: 32415 - DNA, 25 bp, Homo sapiens
tggcatggactgtttgctgacctct

SEQ ID NO: 32416 - DNA, 25 bp, Homo sapiens
gacctctgttctcttagggcatggg

SEQ ID NO: 32417 - DNA, 25 bp, Homo sapiens
gaggatatcaaattctctagccctt

SEQ ID NO: 32418 - DNA, 25 bp, Homo sapiens
ttgtccctagctgcatttcagtgga

SEQ ID NO: 32419 - DNA, 25 bp, Homo sapiens
gtggaccatggatagagggactgag

SEQ ID NO: 32420 - DNA, 25 bp, Homo sapiens
gcagggaggcacgcaggtactgtga

SEQ ID NO: 32421 - DNA, 25 bp, Homo sapiens
gtactgtgaaaatccttccctttgc

SEQ ID NO: 32422 - DNA, 25 bp, Homo sapiens
gagatgttcatgttgctgagctgta

SEQ ID NO: 32423 - DNA, 25 bp, Homo sapiens
ctgagctgtaagcaggagcaccctg

SEQ ID NO: 32424 - DNA, 25 bp, Homo sapiens
cttctctggtctttgacttgattaa

SEQ ID NO: 32425 - DNA, 25 bp, Homo sapiens
aagtatctccgctttcttgggaggg

SEQ ID NO: 32426 - DNA, 25 bp, Homo sapiens
cagtgaatgtgccatacaccttatg

SEQ ID NO: 32427 - DNA, 25 bp, Homo sapiens
accttatggtccacttcatgtgcct

SEQ ID NO: 32428 - DNA, 25 bp, Homo sapiens
aatcgataagtagctccacctgaag

SEQ ID NO: 32429 - DNA, 25 bp, Homo sapiens
aaacagctggaatccacactcacct

SEQ ID NO: 32430 - DNA, 25 bp, Homo sapiens
ctcattcccattgtttggatcatgc

SEQ ID NO: 32431 - DNA, 25 bp, Homo sapiens
tccaacacgtgttcacaatctccaa

SEQ ID NO: 32432 - DNA, 25 bp, Homo sapiens
tttcttctctgtgcttaatgtgatt

SEQ ID NO: 32433 - DNA, 25 bp, Homo sapiens
tcccaagagctcccaaagcctgaga

SEQ ID NO: 32434 - DNA, 25 bp, Homo sapiens
tgagaccagggtcatttgtccccaa

SEQ ID NO: 32435 - DNA, 25 bp, Homo sapiens
cctgctgttgctagtacctgttatt

SEQ ID NO: 32436 - DNA, 25 bp, Homo sapiens
tattacctggaggcctgtccagcac

SEQ ID NO: 32437 - DNA, 25 bp, Homo sapiens
cagcgctctcacaggcgagaacgtg

SEQ ID NO: 32438 - DNA, 25 bp, Homo sapiens
ggaggaggcgttcctcaagtgtgcc

SEQ ID NO: 32439 - DNA, 25 bp, Homo sapiens
gattgactcaggcgagctagacccg

SEQ ID NO: 32440 - DNA, 25 bp, Homo sapiens
gaggatgggctctggcattcagtac

SEQ ID NO: 32441 - DNA, 25 bp, Homo sapiens
tgtggctgctgagctctgtggagcc

SEQ ID NO: 32442 - DNA, 25 bp, Homo sapiens
tggccccggagaagctacgttgcca

SEQ ID NO: 32443 - DNA, 25 bp, Homo sapiens
gcctggctttggggcaagactgagc

SEQ ID NO: 32444 - DNA, 25 bp, Homo sapiens
tggtgagccctttggagctacacag

SEQ ID NO: 32445 - DNA, 25 bp, Homo sapiens
acagtcctgttatttgtagccttcc

SEQ ID NO: 32446 - DNA, 25 bp, Homo sapiens
ccttcccatttcctggtagtgtgac

SEQ ID NO: 32447 - DNA, 25 bp, Homo sapiens
gacaatgaagccttcagcctccatt

SEQ ID NO: 32448 - DNA, 25 bp, Homo sapiens
cacactgctaccttacaagtttcct

SEQ ID NO: 32449 - DNA, 25 bp, Homo sapiens
tttgtctgcctcataaccatcataa

SEQ ID NO: 32450 - DNA, 25 bp, Homo sapiens
gtgtgctaagtaccgtacacccatt

SEQ ID NO: 32451 - DNA, 25 bp, Homo sapiens
aaaaagctcagttggattcccttga

SEQ ID NO: 32452 - DNA, 25 bp, Homo sapiens
tcatagcttgagggtcctgtgccta

SEQ ID NO: 32453 - DNA, 25 bp, Homo sapiens
ctgtgcctattttgcggtgtggggg

SEQ ID NO: 32454 - DNA, 25 bp, Homo sapiens
gaggtaatgctcgggaagtgtcaca

SEQ ID NO: 32455 - DNA, 25 bp, Homo sapiens
gcccagggccatggaaggaccctta

SEQ ID NO: 32456 - DNA, 25 bp, Homo sapiens
aggacccttaggagttcgatgagag

SEQ ID NO: 32457 - DNA, 25 bp, Homo sapiens
tcatccccttactttaattcttggg

SEQ ID NO: 32458 - DNA, 25 bp, Homo sapiens
ttcttgggcctccaataagtgtccc

SEQ ID NO: 32459 - DNA, 25 bp, Homo sapiens
taagtgtcccataggtgtctggcca

SEQ ID NO: 32460 - DNA, 25 bp, Homo sapiens
gtgcgtgtgtgggcacaggtgtgag

SEQ ID NO: 32461 - DNA, 25 bp, Homo sapiens
tgtgagtgacagttaccccatttca

SEQ ID NO: 32462 - DNA, 25 bp, Homo sapiens
gacagttaccccatttcagtcattt

SEQ ID NO: 32463 - DNA, 25 bp, Homo sapiens
catttcagtcatttcctgctgcaac

SEQ ID NO: 32464 - DNA, 25 bp, Homo sapiens
gctttgtctctgttgagaatggact

SEQ ID NO: 32465 - DNA, 25 bp, Homo sapiens
tgagaatggactctacgctcaggca

SEQ ID NO: 32466 - DNA, 25 bp, Homo sapiens
ctgcatctcccagaagggatgagtc

SEQ ID NO: 32467 - DNA, 25 bp, Homo sapiens
gggatgagtctttgtcccgatgcaa

SEQ ID NO: 32468 - DNA, 25 bp, Homo sapiens
agggattcaacatgttggttaggct

SEQ ID NO: 32469 - DNA, 25 bp, Homo sapiens
ctcaggtgatccacatgactctgcc

SEQ ID NO: 32470 - DNA, 25 bp, Homo sapiens
ttcctgccccaaggcagatccacat

SEQ ID NO: 32471 - DNA, 25 bp, Homo sapiens
atcaccgaagctccctagaggggca

SEQ ID NO: 32472 - DNA, 25 bp, Homo sapiens
caggaagtttggggcgtggtgagtt

SEQ ID NO: 32473 - DNA, 25 bp, Homo sapiens
tggggcgtggtgagttggaatgata

SEQ ID NO: 32474 - DNA, 25 bp, Homo sapiens
atgatacgtccatttctctatgaaa

SEQ ID NO: 32475 - DNA, 25 bp, Homo sapiens
gaaatatttgctactagactgttca

SEQ ID NO: 32476 - DNA, 25 bp, Homo sapiens
tactagactgttcatttctctctga

SEQ ID NO: 32477 - DNA, 25 bp, Homo sapiens
gataggacctcaatgattcccttag

SEQ ID NO: 32478 - DNA, 25 bp, Homo sapiens
ggccatgtggcatcattgagcagca

SEQ ID NO: 32479 - DNA, 25 bp, Homo sapiens
gcatcttgccgccatgattggcacc

SEQ ID NO: 32480 - DNA, 25 bp, Homo sapiens
attggcaccagacagattccttagt

SEQ ID NO: 32481 - DNA, 25 bp, Homo sapiens
tgtatatggccagattccacttcct

SEQ ID NO: 32482 - DNA, 25 bp, Homo sapiens
tccacttcctgcgtttaactgggtg

SEQ ID NO: 32483 - DNA, 25 bp, Homo sapiens
gtcaaactgagcttcatgtccacat

SEQ ID NO: 32484 - DNA, 25 bp, Homo sapiens
gatggtaaccgtgtgttccaagcac

SEQ ID NO: 32485 - DNA, 25 bp, Homo sapiens
tggagcagagctctgtcttcttgat

SEQ ID NO: 32486 - DNA, 25 bp, Homo sapiens
gatgccatctcgggttgaaatctcc

SEQ ID NO: 32487 - DNA, 25 bp, Homo sapiens
tgaaatctccctggtcaaggctgac

SEQ ID NO: 32488 - DNA, 25 bp, Homo sapiens
gaaagggctccttcttggacaagat

SEQ ID NO: 32489 - DNA, 25 bp, Homo sapiens
ccagtgtcttacgtaattctcggcc

SEQ ID NO: 32490 - DNA, 25 bp, Homo sapiens
tccaggtaggcaagctggctgacct

SEQ ID NO: 32491 - DNA, 25 bp, Homo sapiens
gcaggagcagagctccaagcgcctg

SEQ ID NO: 32492 - DNA, 25 bp, Homo sapiens
aggacagagccgtgacaagcttcct

SEQ ID NO: 32493 - DNA, 25 bp, Homo sapiens
tcaagatctccccaaagggtgtccc

SEQ ID NO: 32494 - DNA, 25 bp, Homo sapiens
tagactctgcgaccagtacagaccc

SEQ ID NO: 32495 - DNA, 25 bp, Homo sapiens
gaagagacacatgctccacttggga

SEQ ID NO: 32496 - DNA, 25 bp, Homo sapiens
ccacgcaactcagggctcaagatga

SEQ ID NO: 32497 - DNA, 25 bp, Homo sapiens
cagtgttgtgccattgagttcccat

SEQ ID NO: 32498 - DNA, 25 bp, Homo sapiens
ttgagttcccatgtggatcattctg

SEQ ID NO: 32499 - DNA, 25 bp, Homo sapiens
taccgatgcctcttggagaccaagg

SEQ ID NO: 32500 - DNA, 25 bp, Homo sapiens
aggagttagggtgccttctgggatc

SEQ ID NO: 32501 - DNA, 25 bp, Homo sapiens
acagcagcggttctgacgtcatggt

SEQ ID NO: 32502 - DNA, 25 bp, Homo sapiens
tcaaatacccgaacttctccggtgt

SEQ ID NO: 32503 - DNA, 25 bp, Homo sapiens
ctggcttctggatattctctcaata

SEQ ID NO: 32504 - DNA, 25 bp, Homo sapiens
tcaatactgcttcctggatttctgc

SEQ ID NO: 32505 - DNA, 25 bp, Homo sapiens
ggatttctgcaatgaccctcaaaac

SEQ ID NO: 32506 - DNA, 25 bp, Homo sapiens
aacagagggctctatactccttagt

SEQ ID NO: 32507 - DNA, 25 bp, Homo sapiens
tactccttagtgtgactgcagcaaa

SEQ ID NO: 32508 - DNA, 25 bp, Homo sapiens
ctgacttctatctgggcttggccag

SEQ ID NO: 32509 - DNA, 25 bp, Homo sapiens
tcagcacacttactgctactctgta

SEQ ID NO: 32510 - DNA, 25 bp, Homo sapiens
cggccaaggagctgttcaacgagga

SEQ ID NO: 32511 - DNA, 25 bp, Homo sapiens
cacttaccgagccctgagaaacaaa

SEQ ID NO: 32512 - DNA, 25 bp, Homo sapiens
gacttccaagaggtcacccttgaga

SEQ ID NO: 32513 - DNA, 25 bp, Homo sapiens
cggagaggtggtgttacgctttgct

SEQ ID NO: 32514 - DNA, 25 bp, Homo sapiens
gcagcctatggctttcgaaacatcc

SEQ ID NO: 32515 - DNA, 25 bp, Homo sapiens
cccagactccagacggacatgcgga

SEQ ID NO: 32516 - DNA, 25 bp, Homo sapiens
acggacatgcggataaggccctgct

SEQ ID NO: 32517 - DNA, 25 bp, Homo sapiens
ggaaggcatttacgctgacatccct

SEQ ID NO: 32518 - DNA, 25 bp, Homo sapiens
gtgcacacgtgcaggagctgtacca

SEQ ID NO: 32519 - DNA, 25 bp, Homo sapiens
gctggaggggatcaactcccccaag

SEQ ID NO: 32520 - DNA, 25 bp, Homo sapiens
agtggtgaagtcaggccagggcctt

SEQ ID NO: 32521 - DNA, 25 bp, Homo sapiens
acagttcacatcccaccatagtgat

SEQ ID NO: 32522 - DNA, 25 bp, Homo sapiens
gaaggctttccacaaattgactctg

SEQ ID NO: 32523 - DNA, 25 bp, Homo sapiens
aacattttgctgtcctgaaagttgg

SEQ ID NO: 32524 - DNA, 25 bp, Homo sapiens
gagaccctataagagcactgacatg

SEQ ID NO: 32525 - DNA, 25 bp, Homo sapiens
tcttcctccctaaatattctacaat

SEQ ID NO: 32526 - DNA, 25 bp, Homo sapiens
agaggatttggctgaccagcttgct

SEQ ID NO: 32527 - DNA, 25 bp, Homo sapiens
cttgcttgtccaacagccttatttt

SEQ ID NO: 32528 - DNA, 25 bp, Homo sapiens
tgaagaagagggtttactggccggt

SEQ ID NO: 32529 - DNA, 25 bp, Homo sapiens
tactggccggttagaacccgtgact

SEQ ID NO: 32530 - DNA, 25 bp, Homo sapiens
atacccctatgcctacatcatattc

SEQ ID NO: 32531 - DNA, 25 bp, Homo sapiens
acatcatattccttacctcttttgg

SEQ ID NO: 32532 - DNA, 25 bp, Homo sapiens
ggatgataacgctctgcgatgccct

SEQ ID NO: 32533 - DNA, 25 bp, Homo sapiens
tgccctccacaatttcatcgatggc

SEQ ID NO: 32534 - DNA, 25 bp, Homo sapiens
tcgatggcctggcgattggggcttc

SEQ ID NO: 32535 - DNA, 25 bp, Homo sapiens
gactcagtacttccatagcaatcct

SEQ ID NO: 32536 - DNA, 25 bp, Homo sapiens
atgtgaggagtttccccacgagtta

SEQ ID NO: 32537 - DNA, 25 bp, Homo sapiens
gagactttgtgatcctactcaatgc

SEQ ID NO: 32538 - DNA, 25 bp, Homo sapiens
agggatgagcactcgacaagccttg

SEQ ID NO: 32539 - DNA, 25 bp, Homo sapiens
acaagccttgctattcaacttcctt

SEQ ID NO: 32540 - DNA, 25 bp, Homo sapiens
tggtgggcaacaatttcgctccaaa

SEQ ID NO: 32541 - DNA, 25 bp, Homo sapiens
gaaaaaccgatttcaccttcttcat

SEQ ID NO: 32542 - DNA, 25 bp, Homo sapiens
gccattctactcattaccttgtatg

SEQ ID NO: 32543 - DNA, 25 bp, Homo sapiens
tgaaagtgttcctggggtgctgtct

SEQ ID NO: 32544 - DNA, 25 bp, Homo sapiens
gtttcattacctgtattgtagcccc

SEQ ID NO: 32545 - DNA, 25 bp, Homo sapiens
tattacccagaattgctcttccata

SEQ ID NO: 32546 - DNA, 25 bp, Homo sapiens
gctcttccataaagcttgtgccttt

SEQ ID NO: 32547 - DNA, 25 bp, Homo sapiens
ttgtgcctttgtccaagctatacaa

SEQ ID NO: 32548 - DNA, 25 bp, Homo sapiens
tgtcttcatcggcatcaacgacctg

SEQ ID NO: 32549 - DNA, 25 bp, Homo sapiens
agaaggagggcgccttcgtgtactc

SEQ ID NO: 32550 - DNA, 25 bp, Homo sapiens
ccccatgcggaccttcaacaagtgg

SEQ ID NO: 32551 - DNA, 25 bp, Homo sapiens
aacaagtggcgcagcggtgagccca

SEQ ID NO: 32552 - DNA, 25 bp, Homo sapiens
tgcctacgacgaggaggactgcgtg

SEQ ID NO: 32553 - DNA, 25 bp, Homo sapiens
ccacaccaccatgtacttcatgtgt

SEQ ID NO: 32554 - DNA, 25 bp, Homo sapiens
gaccacgtctcacccagggtgacat

SEQ ID NO: 32555 - DNA, 25 bp, Homo sapiens
tcacccagggtgacatcaggaatgg

SEQ ID NO: 32556 - DNA, 25 bp, Homo sapiens
tcaggaatggtgctagcctctgcaa

SEQ ID NO: 32557 - DNA, 25 bp, Homo sapiens
tctgcaacacgacacccagtttgaa

SEQ ID NO: 32558 - DNA, 25 bp, Homo sapiens
caacacgacacccagtttgaagagc

SEQ ID NO: 32559 - DNA, 25 bp, Homo sapiens
ttgaagagctctatacaggtactaa

SEQ ID NO: 32560 - DNA, 25 bp, Homo sapiens
aggtactaagactagcaggggacac

SEQ ID NO: 32561 - DNA, 25 bp, Homo sapiens
aagactctgcacaaccagattgctt

SEQ ID NO: 32562 - DNA, 25 bp, Homo sapiens
aaccagattgcttgtgcagagggcc

SEQ ID NO: 32563 - DNA, 25 bp, Homo sapiens
agagggccacaataagtgtatgttt

SEQ ID NO: 32564 - DNA, 25 bp, Homo sapiens
aataatacactcacatgtttccaca

SEQ ID NO: 32565 - DNA, 25 bp, Homo sapiens
gcagatcatgaggctctttctctag

SEQ ID NO: 32566 - DNA, 25 bp, Homo sapiens
gacttggtgtcttgtagcctggtta

SEQ ID NO: 32567 - DNA, 25 bp, Homo sapiens
cgttgagcttctactgacgatgccc

SEQ ID NO: 32568 - DNA, 25 bp, Homo sapiens
atgccctgcatggaccagctgggat

SEQ ID NO: 32569 - DNA, 25 bp, Homo sapiens
cctgtgtccctaacgaccataggca

SEQ ID NO: 32570 - DNA, 25 bp, Homo sapiens
caatccatcttcttgtgtcagcaat

SEQ ID NO: 32571 - DNA, 25 bp, Homo sapiens
tcagcaatttctggacacccactgt

SEQ ID NO: 32572 - DNA, 25 bp, Homo sapiens
gagcctgtttacctgtgttcaaaat

SEQ ID NO: 32573 - DNA, 25 bp, Homo sapiens
tcaaaatctggcaccattcccttga

SEQ ID NO: 32574 - DNA, 25 bp, Homo sapiens
aggagggaccaggtctgccagtttc

SEQ ID NO: 32575 - DNA, 25 bp, Homo sapiens
aacctcctgtgatggtgtttcttcg

SEQ ID NO: 32576 - DNA, 25 bp, Homo sapiens
aggaaaaagttgccctcaagcctga

SEQ ID NO: 32577 - DNA, 25 bp, Homo sapiens
gtgtgtgcatattgagctcctgctg

SEQ ID NO: 32578 - DNA, 25 bp, Homo sapiens
gctcctgctgtggttaagcactgca

SEQ ID NO: 32579 - DNA, 25 bp, Homo sapiens
agcactgcaacagactctaccagag

SEQ ID NO: 32580 - DNA, 25 bp, Homo sapiens
aagcgagagaggcaccttgttctcc

SEQ ID NO: 32581 - DNA, 25 bp, Homo sapiens
gttctccaagaacttactgtccaat

SEQ ID NO: 32582 - DNA, 25 bp, Homo sapiens
tactgtccaatcatgctgtggtgca

SEQ ID NO: 32583 - DNA, 25 bp, Homo sapiens
gctgtggtgcattcctttgaagatc

SEQ ID NO: 32584 - DNA, 25 bp, Homo sapiens
gaagaatagccaaacttgtctttga

SEQ ID NO: 32585 - DNA, 25 bp, Homo sapiens
gagacccaaagctagtgaataattc

SEQ ID NO: 32586 - DNA, 25 bp, Homo sapiens
aatgactccaaaggcaatcccaaag

SEQ ID NO: 32587 - DNA, 25 bp, Homo sapiens
taatggcttgttcacgtgtgtgcta

SEQ ID NO: 32588 - DNA, 25 bp, Homo sapiens
aaatctctttatagttaggcttctg

SEQ ID NO: 32589 - DNA, 25 bp, Homo sapiens
atgtatctccagtagcaatgttgcc

SEQ ID NO: 32590 - DNA, 25 bp, Homo sapiens
ggagtcatttctacctagagtacca

SEQ ID NO: 32591 - DNA, 25 bp, Homo sapiens
gtaaacatctcccagtgtgctatag

SEQ ID NO: 32592 - DNA, 25 bp, Homo sapiens
ctactcctcactgctgacatgttaa

SEQ ID NO: 32593 - DNA, 25 bp, Homo sapiens
aaacacctaaggtagctctatgcta

SEQ ID NO: 32594 - DNA, 25 bp, Homo sapiens
tgctgatacgttgctcacattctca

SEQ ID NO: 32595 - DNA, 25 bp, Homo sapiens
ttcaactgcattaaccgatctgaga

SEQ ID NO: 32596 - DNA, 25 bp, Homo sapiens
gagagttttcctttaacctggactg

SEQ ID NO: 32597 - DNA, 25 bp, Homo sapiens
taacctggactgtgtttctcaagca

SEQ ID NO: 32598 - DNA, 25 bp, Homo sapiens
ctactacagtacttcctgacttctc

SEQ ID NO: 32599 - DNA, 25 bp, Homo sapiens
tcccattcaaaccattctagctgca

SEQ ID NO: 32600 - DNA, 25 bp, Homo sapiens
agaggctctgctggtcaaatacttg

SEQ ID NO: 32601 - DNA, 25 bp, Homo sapiens
actcctagctccagaagggctcagg

SEQ ID NO: 32602 - DNA, 25 bp, Homo sapiens
gccttccccacagatctaaggactg

SEQ ID NO: 32603 - DNA, 25 bp, Homo sapiens
ctgtccactgaggtttctcctaaaa

SEQ ID NO: 32604 - DNA, 25 bp, Homo sapiens
gaagctttgtacctcttttgcagga

SEQ ID NO: 32605 - DNA, 25 bp, Homo sapiens
acctcctatgactgctttctatgct

SEQ ID NO: 32606 - DNA, 25 bp, Homo sapiens
ctccccgcacatactcacggaaagg

SEQ ID NO: 32607 - DNA, 25 bp, Homo sapiens
ggaaccaatggtgctatttcccctc

SEQ ID NO: 32608 - DNA, 25 bp, Homo sapiens
tacttcagacatctccaaactcatc

SEQ ID NO: 32609 - DNA, 25 bp, Homo sapiens
ggccagaactgcagcattggcccca

SEQ ID NO: 32610 - DNA, 25 bp, Homo sapiens
ttggccccaatgtgagcctgggacc

SEQ ID NO: 32611 - DNA, 25 bp, Homo sapiens
cctggcgtggtggtcgaagatggtg

SEQ ID NO: 32612 - DNA, 25 bp, Homo sapiens
gatgagctctacctcaacggagcca

SEQ ID NO: 32613 - DNA, 25 bp, Homo sapiens
tgctgccccacaagtctattggcga

SEQ ID NO: 32614 - DNA, 25 bp, Homo sapiens
ccagagcctcgtatcatcatgtgag

SEQ ID NO: 32615 - DNA, 25 bp, Homo sapiens
agtgctggcctgacacatcagaaga

SEQ ID NO: 32616 - DNA, 25 bp, Homo sapiens
catcagaagaccctggacttgtcat

SEQ ID NO: 32617 - DNA, 25 bp, Homo sapiens
gtcattatttgtctggggggcactg

SEQ ID NO: 32618 - DNA, 25 bp, Homo sapiens
gtggacatcatctggcaggatccct

SEQ ID NO: 32619 - DNA, 25 bp, Homo sapiens
cccactccctcaagaagggccaggg

SEQ ID NO: 32620 - DNA, 25 bp, Homo sapiens
catacacagcacaaagaatgtcaga

SEQ ID NO: 32621 - DNA, 25 bp, Homo sapiens
gaatgtcagacagaatgccctgttc

SEQ ID NO: 32622 - DNA, 25 bp, Homo sapiens
gtcagacagaatgccctgttcgtgc

SEQ ID NO: 32623 - DNA, 25 bp, Homo sapiens
agacagaatgccctgttcgtgcagt

SEQ ID NO: 32624 - DNA, 25 bp, Homo sapiens
cagaatgccctgttcgtgcagtttg

SEQ ID NO: 32625 - DNA, 25 bp, Homo sapiens
ccctgttcgtgcagtttgctgaggt

SEQ ID NO: 32626 - DNA, 25 bp, Homo sapiens
cgtgcagtttgctgaggtgttcccg

SEQ ID NO: 32627 - DNA, 25 bp, Homo sapiens
cagatcccctgaactaccaaatagc

SEQ ID NO: 32628 - DNA, 25 bp, Homo sapiens
gatcccctgaactaccaaatagctg

SEQ ID NO: 32629 - DNA, 25 bp, Homo sapiens
gaactaccaaatagctgtgggcttt

SEQ ID NO: 32630 - DNA, 25 bp, Homo sapiens
accaaatagctgtgggctttctgga

SEQ ID NO: 32631 - DNA, 25 bp, Homo sapiens
aagtgctcctgagcggagccacctt

SEQ ID NO: 32632 - DNA, 25 bp, Homo sapiens
tcctcgtcacgtttggaaactcaga

SEQ ID NO: 32633 - DNA, 25 bp, Homo sapiens
gagaaacctgaaactatgacttgtc

SEQ ID NO: 32634 - DNA, 25 bp, Homo sapiens
gaaactatgacttgtcgtctttcca

SEQ ID NO: 32635 - DNA, 25 bp, Homo sapiens
gacttgtcgtctttccaataaccag

SEQ ID NO: 32636 - DNA, 25 bp, Homo sapiens
ccaataaccagagatacttgtttct

SEQ ID NO: 32637 - DNA, 25 bp, Homo sapiens
gtttctggatggagacagccactat

SEQ ID NO: 32638 - DNA, 25 bp, Homo sapiens
gagacagccactatgaaatcgaaat

SEQ ID NO: 32639 - DNA, 25 bp, Homo sapiens
attgtacacatttccaccgtgcaga

SEQ ID NO: 32640 - DNA, 25 bp, Homo sapiens
caccgtgcagatcctcacagaaggc

SEQ ID NO: 32641 - DNA, 25 bp, Homo sapiens
cgtgcagatcctcacagaaggcttc

SEQ ID NO: 32642 - DNA, 25 bp, Homo sapiens
gactaatgttacaccaatggccacc

SEQ ID NO: 32643 - DNA, 25 bp, Homo sapiens
agcgttctggtgcaggagtagccct

SEQ ID NO: 32644 - DNA, 25 bp, Homo sapiens
ccacctttcttccgttgaagcatac

SEQ ID NO: 32645 - DNA, 25 bp, Homo sapiens
aactgtcaccagtatgaccactcca

SEQ ID NO: 32646 - DNA, 25 bp, Homo sapiens
gaccactccacgatgctatgtaggg

SEQ ID NO: 32647 - DNA, 25 bp, Homo sapiens
cacagtgcttcgggggagactctat

SEQ ID NO: 32648 - DNA, 25 bp, Homo sapiens
gatggtaattccctgctaagtagca

SEQ ID NO: 32649 - DNA, 25 bp, Homo sapiens
atgaccctatcatcgacagctggga

SEQ ID NO: 32650 - DNA, 25 bp, Homo sapiens
acatccatgggaacccagcgctgtg

SEQ ID NO: 32651 - DNA, 25 bp, Homo sapiens
agtgaccattgttggagcaccatcc

SEQ ID NO: 32652 - DNA, 25 bp, Homo sapiens
catccagagctagtgaccagtccag

SEQ ID NO: 32653 - DNA, 25 bp, Homo sapiens
gtggttatattcccaacaacattaa

SEQ ID NO: 32654 - DNA, 25 bp, Homo sapiens
tctgcttctcttactatactcatac

SEQ ID NO: 32655 - DNA, 25 bp, Homo sapiens
ttatcaatgattcatgtttccctca

SEQ ID NO: 32656 - DNA, 25 bp, Homo sapiens
ggaaacaatcctagagagctcagag

SEQ ID NO: 32657 - DNA, 25 bp, Homo sapiens
gagctcagagcaattaaaccactat

SEQ ID NO: 32658 - DNA, 25 bp, Homo sapiens
aaaccactattccatgcttttaagt

SEQ ID NO: 32659 - DNA, 25 bp, Homo sapiens
tacaactcaatctaagtcagtccac

SEQ ID NO: 32660 - DNA, 25 bp, Homo sapiens
gtcagtccactttgacttcgtactg

SEQ ID NO: 32661 - DNA, 25 bp, Homo sapiens
tttgacttcgtactgtctttcacct

SEQ ID NO: 32662 - DNA, 25 bp, Homo sapiens
tcacctttccattgttgcatcttga

SEQ ID NO: 32663 - DNA, 25 bp, Homo sapiens
attcaggatgctaggggctacttct

SEQ ID NO: 32664 - DNA, 25 bp, Homo sapiens
gagctttatttggtgcatttaacgc

SEQ ID NO: 32665 - DNA, 25 bp, Homo sapiens
gtaattgcagaatccactttgcctg

SEQ ID NO: 32666 - DNA, 25 bp, Homo sapiens
tagactgttatcttgttggccctat

SEQ ID NO: 32667 - DNA, 25 bp, Homo sapiens
gttggccctatgaaattctgcactt

SEQ ID NO: 32668 - DNA, 25 bp, Homo sapiens
ttctgcacttttcattatatactct

SEQ ID NO: 32669 - DNA, 25 bp, Homo sapiens
atactctaccttcattaattacttc

SEQ ID NO: 32670 - DNA, 25 bp, Homo sapiens
agatgttctgccttagcactcagtt

SEQ ID NO: 32671 - DNA, 25 bp, Homo sapiens
ctttttcttcctgttcattatgctt

SEQ ID NO: 32672 - DNA, 25 bp, Homo sapiens
ggagtgccagcagtgtgataattta

SEQ ID NO: 32673 - DNA, 25 bp, Homo sapiens
aacttgctgctgcttagatcactgc

SEQ ID NO: 32674 - DNA, 25 bp, Homo sapiens
cttagatcactgcagcttctaggac

SEQ ID NO: 32675 - DNA, 25 bp, Homo sapiens
gatatgtacacatttctgcttctgc

SEQ ID NO: 32676 - DNA, 25 bp, Homo sapiens
catttctgcttctgcacatattttc

SEQ ID NO: 32677 - DNA, 25 bp, Homo sapiens
gcaacatcctaattggctcagtgca

SEQ ID NO: 32678 - DNA, 25 bp, Homo sapiens
ggctcagtgcacgtttggcaatagt

SEQ ID NO: 32679 - DNA, 25 bp, Homo sapiens
tggcaatagtgccagcctgtcttgt

SEQ ID NO: 32680 - DNA, 25 bp, Homo sapiens
gcctgtcttgtctttaatgcatgga

SEQ ID NO: 32681 - DNA, 25 bp, Homo sapiens
ttccctacctgcatcatgtgcatgt

SEQ ID NO: 32682 - DNA, 25 bp, Homo sapiens
atgctttcccaaattccattatttg

SEQ ID NO: 32683 - DNA, 25 bp, Homo sapiens
gcacaaacgatattccttatctgta

SEQ ID NO: 32684 - DNA, 25 bp, Homo sapiens
gattaaactggttgtcttatttctt

SEQ ID NO: 32685 - DNA, 25 bp, Homo sapiens
agtataatttccagtgattttcact

SEQ ID NO: 32686 - DNA, 25 bp, Homo sapiens
cgccgagctcctcggggaggtggac

SEQ ID NO: 32687 - DNA, 25 bp, Homo sapiens
tggaccgcacggaatttgaacagta

SEQ ID NO: 32688 - DNA, 25 bp, Homo sapiens
tgaacagtatctgcacttcgtgtgc

SEQ ID NO: 32689 - DNA, 25 bp, Homo sapiens
agctccgcggtatattactgcaact

SEQ ID NO: 32690 - DNA, 25 bp, Homo sapiens
tactgcaactatcctgacgtgtgac

SEQ ID NO: 32691 - DNA, 25 bp, Homo sapiens
tgacgtgtgacaggtccctgatccg

SEQ ID NO: 32692 - DNA, 25 bp, Homo sapiens
gcaggccagaagcagtgttacacac

SEQ ID NO: 32693 - DNA, 25 bp, Homo sapiens
gctaaggaaatcctcagactcctgg

SEQ ID NO: 32694 - DNA, 25 bp, Homo sapiens
ggtaatttattttgtctgccacttg

SEQ ID NO: 32695 - DNA, 25 bp, Homo sapiens
gagatttgtttcccacagttggatt

SEQ ID NO: 32696 - DNA, 25 bp, Homo sapiens
cctgggtgtgttttttcaatcttct

SEQ ID NO: 32697 - DNA, 25 bp, Homo sapiens
gaaatcattgtgtctgcattggtca

SEQ ID NO: 32698 - DNA, 25 bp, Homo sapiens
ctgcattggtcaagatcctggaggc

SEQ ID NO: 32699 - DNA, 25 bp, Homo sapiens
ggaggccaacatggacatcgtctac

SEQ ID NO: 32700 - DNA, 25 bp, Homo sapiens
gatatggtcaccaagatgcagcagg

SEQ ID NO: 32701 - DNA, 25 bp, Homo sapiens
gtaatgtctcagattgcgaatgtga

SEQ ID NO: 32702 - DNA, 25 bp, Homo sapiens
ggcattgcatgcccagcaagatcgg

SEQ ID NO: 32703 - DNA, 25 bp, Homo sapiens
agatcgaaactgaggttgctggcct

SEQ ID NO: 32704 - DNA, 25 bp, Homo sapiens
aaccatgcttgagtcacacaagctt

SEQ ID NO: 32705 - DNA, 25 bp, Homo sapiens
tacgtgcctaacagtagctctggga

SEQ ID NO: 32706 - DNA, 25 bp, Homo sapiens
gtagctctgggattttatcgcctgt

SEQ ID NO: 32707 - DNA, 25 bp, Homo sapiens
ggattttatcgcctgtggatctaat

SEQ ID NO: 32708 - DNA, 25 bp, Homo sapiens
agagaaagtcatctactctcacttc

SEQ ID NO: 32709 - DNA, 25 bp, Homo sapiens
tactctcacttcacatgtgctacag

SEQ ID NO: 32710 - DNA, 25 bp, Homo sapiens
tattcgctttgtgtttgctgctgtc

SEQ ID NO: 32711 - DNA, 25 bp, Homo sapiens
caaccttgtctaaaagctgctgccc

SEQ ID NO: 32712 - DNA, 25 bp, Homo sapiens
actcctcccctataacagaagatgt

SEQ ID NO: 32713 - DNA, 25 bp, Homo sapiens
tgtgatttgcaaactccttgtttta

SEQ ID NO: 32714 - DNA, 25 bp, Homo sapiens
ttgcaagtgcttctgacatcaccag

SEQ ID NO: 32715 - DNA, 25 bp, Homo sapiens
ccagtcccatgccaggaactaagga

SEQ ID NO: 32716 - DNA, 25 bp, Homo sapiens
aagtccttacatcccaaattgtgtt

SEQ ID NO: 32717 - DNA, 25 bp, Homo sapiens
gagcctgttagtttatagatcatgc

SEQ ID NO: 32718 - DNA, 25 bp, Homo sapiens
atcatgccttcaaacctctagagtt

SEQ ID NO: 32719 - DNA, 25 bp, Homo sapiens
gatgagatggttgttgccctagtct

SEQ ID NO: 32720 - DNA, 25 bp, Homo sapiens
gttgccctagtctgttggtagaacc

SEQ ID NO: 32721 - DNA, 25 bp, Homo sapiens
cccatttcaagccctgagtcaaaca

SEQ ID NO: 32722 - DNA, 25 bp, Homo sapiens
atcagttgattcttgtgccattttt

SEQ ID NO: 32723 - DNA, 25 bp, Homo sapiens
ttgcccatgttaggccctctaaaaa

SEQ ID NO: 32724 - DNA, 25 bp, Homo sapiens
aatctgatcttttttggctactgca

SEQ ID NO: 32725 - DNA, 25 bp, Homo sapiens
gtatcagctgcataccttgcacagt

SEQ ID NO: 32726 - DNA, 25 bp, Homo sapiens
tgcacagtggagctgactacctata

SEQ ID NO: 32727 - DNA, 25 bp, Homo sapiens
gactacctataaactctccctaagg

SEQ ID NO: 32728 - DNA, 25 bp, Homo sapiens
ctctccctaaggcatttgtttacag

SEQ ID NO: 32729 - DNA, 25 bp, Homo sapiens
ttacaggtgtattccattttagcag

SEQ ID NO: 32730 - DNA, 25 bp, Homo sapiens
aaacagcacaatggtgaccactgat

SEQ ID NO: 32731 - DNA, 25 bp, Homo sapiens
tggtgaccactgataaaggctttat

SEQ ID NO: 32732 - DNA, 25 bp, Homo sapiens
aaggctttattaggtatatctgagg

SEQ ID NO: 32733 - DNA, 25 bp, Homo sapiens
gtatatctgaggaagtgggtcacat

SEQ ID NO: 32734 - DNA, 25 bp, Homo sapiens
ctagtgaaatgaccccttgactttg

SEQ ID NO: 32735 - DNA, 25 bp, Homo sapiens
tccatgtcttggatacatacgtatc

SEQ ID NO: 32736 - DNA, 25 bp, Homo sapiens
catacgtatctatagagctggcatg

SEQ ID NO: 32737 - DNA, 25 bp, Homo sapiens
gagctggcatgtaattcttcctcta

SEQ ID NO: 32738 - DNA, 25 bp, Homo sapiens
tggcatgtaattcttcctctataaa

SEQ ID NO: 32739 - DNA, 25 bp, Homo sapiens
agggatatccccttggatttcactt

SEQ ID NO: 32740 - DNA, 25 bp, Homo sapiens
gaaaccagaattttagacagcaagc

SEQ ID NO: 32741 - DNA, 25 bp, Homo sapiens
cggaaggagcatgtgaacccgccag

SEQ ID NO: 32742 - DNA, 25 bp, Homo sapiens
gtgagcacgagcctgaagacatacc

SEQ ID NO: 32743 - DNA, 25 bp, Homo sapiens
ataccagcacttcaccctggagaaa

SEQ ID NO: 32744 - DNA, 25 bp, Homo sapiens
aagactggagcggttcttcttccgc

SEQ ID NO: 32745 - DNA, 25 bp, Homo sapiens
cgcagtgggaacatcgagcacccgg

SEQ ID NO: 32746 - DNA, 25 bp, Homo sapiens
cgagcacccggaggacaagctcttc

SEQ ID NO: 32747 - DNA, 25 bp, Homo sapiens
tcaacacgtctgtggaggtgctgcc

SEQ ID NO: 32748 - DNA, 25 bp, Homo sapiens
cttcgacaaccctcagtcagacaag

SEQ ID NO: 32749 - DNA, 25 bp, Homo sapiens
cagatcggctccttctacaagggag

SEQ ID NO: 32750 - DNA, 25 bp, Homo sapiens
ggtgattctgagcgagatcttcctg

SEQ ID NO: 32751 - DNA, 25 bp, Homo sapiens
tcctgaaaaaggccgactaagctgc

SEQ ID NO: 32752 - DNA, 25 bp, Homo sapiens
tgaactacgacaagctgagccgctc

SEQ ID NO: 32753 - DNA, 25 bp, Homo sapiens
gggcatcatccggaagccagacatc

SEQ ID NO: 32754 - DNA, 25 bp, Homo sapiens
ggaaaacgggcagtctgctctgctg

SEQ ID NO: 32755 - DNA, 25 bp, Homo sapiens
ctgctctgaccttccagagcccaag

SEQ ID NO: 32756 - DNA, 25 bp, Homo sapiens
gctgctcccctggaggacagaggga

SEQ ID NO: 32757 - DNA, 25 bp, Homo sapiens
agagggagacagggctgctccccaa

SEQ ID NO: 32758 - DNA, 25 bp, Homo sapiens
ccagcatttccagagcagagcctac

SEQ ID NO: 32759 - DNA, 25 bp, Homo sapiens
gggcagtgactcgacaaaggccaca

SEQ ID NO: 32760 - DNA, 25 bp, Homo sapiens
aaaggccacaggcagtccaggcctc

SEQ ID NO: 32761 - DNA, 25 bp, Homo sapiens
tgcagggagacatctgcacccctga

SEQ ID NO: 32762 - DNA, 25 bp, Homo sapiens
gagttgggcagccaggagtgccccc

SEQ ID NO: 32763 - DNA, 25 bp, Homo sapiens
ggtccgccttctggatgtgtatgaa

SEQ ID NO: 32764 - DNA, 25 bp, Homo sapiens
aggaagtggtcaagttctcagcctc

SEQ ID NO: 32765 - DNA, 25 bp, Homo sapiens
acccggtccttcagtggactgagag

SEQ ID NO: 32766 - DNA, 25 bp, Homo sapiens
caccaactttggcaagggcatccgc

SEQ ID NO: 32767 - DNA, 25 bp, Homo sapiens
ggcatccgctacgtatcttttgagc

SEQ ID NO: 32768 - DNA, 25 bp, Homo sapiens
gtacgggagagacgtgagttcctgg

SEQ ID NO: 32769 - DNA, 25 bp, Homo sapiens
agtgtgagggtcaggatccgtctgt

SEQ ID NO: 32770 - DNA, 25 bp, Homo sapiens
tccgtctgtcctagcgactggacta

SEQ ID NO: 32771 - DNA, 25 bp, Homo sapiens
tggactactgcctgacgttgtcagt

SEQ ID NO: 32772 - DNA, 25 bp, Homo sapiens
gacgttgtcagtcaagaccagcctt

SEQ ID NO: 32773 - DNA, 25 bp, Homo sapiens
gtgaaaccgtctccacaaataattt

SEQ ID NO: 32774 - DNA, 25 bp, Homo sapiens
gctcgatccaagcactgcagtgtgt

SEQ ID NO: 32775 - DNA, 25 bp, Homo sapiens
aactggtgtgtgcaccgtttcgacc

SEQ ID NO: 32776 - DNA, 25 bp, Homo sapiens
gtttcgaccatcactgtgtttgggt

SEQ ID NO: 32777 - DNA, 25 bp, Homo sapiens
ttgggtgaacaactgcatcggggcc

SEQ ID NO: 32778 - DNA, 25 bp, Homo sapiens
acatcaggtacttcctcatctacgt

SEQ ID NO: 32779 - DNA, 25 bp, Homo sapiens
atctacgtcttgaccttgacggcct

SEQ ID NO: 32780 - DNA, 25 bp, Homo sapiens
attgtgagcaccacttttctggtcc

SEQ ID NO: 32781 - DNA, 25 bp, Homo sapiens
cacttttctggtccacttggtggtg

SEQ ID NO: 32782 - DNA, 25 bp, Homo sapiens
ttacatcgatgaccttggacacctc

SEQ ID NO: 32783 - DNA, 25 bp, Homo sapiens
ggacacctccatgttatggacacgg

SEQ ID NO: 32784 - DNA, 25 bp, Homo sapiens
atggacacggtctttcttattcagt

SEQ ID NO: 32785 - DNA, 25 bp, Homo sapiens
gtgtcaggttagcatgctgccagca

SEQ ID NO: 32786 - DNA, 25 bp, Homo sapiens
tcagactggagtggtccgttctcac

SEQ ID NO: 32787 - DNA, 25 bp, Homo sapiens
ccttcagcttgggtacacacacaga

SEQ ID NO: 32788 - DNA, 25 bp, Homo sapiens
cctcagcctcacaccagaaatatta

SEQ ID NO: 32789 - DNA, 25 bp, Homo sapiens
ggcccacctcagctgtagtggtacc

SEQ ID NO: 32790 - DNA, 25 bp, Homo sapiens
tcagctgtagtggtacctgccacgg

SEQ ID NO: 32791 - DNA, 25 bp, Homo sapiens
gtctgctgcggatctcagtgaagga

SEQ ID NO: 32792 - DNA, 25 bp, Homo sapiens
gaggcaagaggctgggctaggtgag

SEQ ID NO: 32793 - DNA, 25 bp, Homo sapiens
taggtgagcctagcttggtggccct

SEQ ID NO: 32794 - DNA, 25 bp, Homo sapiens
tggtggccctggtggtgtttggggc

SEQ ID NO: 32795 - DNA, 25 bp, Homo sapiens
tggttctggctactgtgttgctgac

SEQ ID NO: 32796 - DNA, 25 bp, Homo sapiens
tgatgttttcctctgtacgaagccg

SEQ ID NO: 32797 - DNA, 25 bp, Homo sapiens
gtcagaaccctaatctccacaaaaa

SEQ ID NO: 32798 - DNA, 25 bp, Homo sapiens
acaaaaacattcccttcacttcagt

SEQ ID NO: 32799 - DNA, 25 bp, Homo sapiens
caaatgccagctctcaccagatggc

SEQ ID NO: 32800 - DNA, 25 bp, Homo sapiens
accagatggcctacgtgtttgaact

SEQ ID NO: 32801 - DNA, 25 bp, Homo sapiens
gaactgccatagtcagtgtgcgctt

SEQ ID NO: 32802 - DNA, 25 bp, Homo sapiens
tgtgcgcttatgtacttggggtgtg

SEQ ID NO: 32803 - DNA, 25 bp, Homo sapiens
gtatgctctgtggctacatatacac

SEQ ID NO: 32804 - DNA, 25 bp, Homo sapiens
tgtgcaactagccccagttttgaca

SEQ ID NO: 32805 - DNA, 25 bp, Homo sapiens
acagaataattcttggtcttcccca

SEQ ID NO: 32806 - DNA, 25 bp, Homo sapiens
atttgttgtacccatgactgttgcc

SEQ ID NO: 32807 - DNA, 25 bp, Homo sapiens
taacgaccagagtattgccctgcca

SEQ ID NO: 32808 - DNA, 25 bp, Homo sapiens
gagtcagagcagccacattgcttgc

SEQ ID NO: 32809 - DNA, 25 bp, Homo sapiens
ctgggccactgtatccaggacatca

SEQ ID NO: 32810 - DNA, 25 bp, Homo sapiens
atcatctctgccaggtcaactggag

SEQ ID NO: 32811 - DNA, 25 bp, Homo sapiens
aggtcaactggagtccctggtgact

SEQ ID NO: 32812 - DNA, 25 bp, Homo sapiens
tccctggtgactccattctgaggtg

SEQ ID NO: 32813 - DNA, 25 bp, Homo sapiens
gtgtgacaggggaaccgtagacttt

SEQ ID NO: 32814 - DNA, 25 bp, Homo sapiens
atcccgacagagtcatgctcgagcc

SEQ ID NO: 32815 - DNA, 25 bp, Homo sapiens
aagatccagaacttgcgtgcagctt

SEQ ID NO: 32816 - DNA, 25 bp, Homo sapiens
taatggagccctgggcgatcgctga

SEQ ID NO: 32817 - DNA, 25 bp, Homo sapiens
tgggcgatcgctgaatttcttccct

SEQ ID NO: 32818 - DNA, 25 bp, Homo sapiens
aaatctgttggatcccaatcctcac

SEQ ID NO: 32819 - DNA, 25 bp, Homo sapiens
gatcccaatcctcacatgtatgaag

SEQ ID NO: 32820 - DNA, 25 bp, Homo sapiens
tgttgaaagtactgctggctcttct

SEQ ID NO: 32821 - DNA, 25 bp, Homo sapiens
gaactacagtttagcattcctcagg

SEQ ID NO: 32822 - DNA, 25 bp, Homo sapiens
ttcctcaggctactggtgaaaacac

SEQ ID NO: 32823 - DNA, 25 bp, Homo sapiens
acaaccgttatggtctttgtctcca

SEQ ID NO: 32824 - DNA, 25 bp, Homo sapiens
aagactcattctacttgcaagcaaa

SEQ ID NO: 32825 - DNA, 25 bp, Homo sapiens
tgtagtcctatgaacagtctcctcg

SEQ ID NO: 32826 - DNA, 25 bp, Homo sapiens
agtctcctcgtgtatctccagagac

SEQ ID NO: 32827 - DNA, 25 bp, Homo sapiens
gtatctccagagactgcatgtgcaa

SEQ ID NO: 32828 - DNA, 25 bp, Homo sapiens
tgcttcatttgccacatagttgttg

SEQ ID NO: 32829 - DNA, 25 bp, Homo sapiens
tagattctcagctcttggtctgcaa

SEQ ID NO: 32830 - DNA, 25 bp, Homo sapiens
ttcaccaggagctcattcacatgcc

SEQ ID NO: 32831 - DNA, 25 bp, Homo sapiens
tcagagattcctggcaggctcctca

SEQ ID NO: 32832 - DNA, 25 bp, Homo sapiens
cacttcagtcggcccagggacaaaa

SEQ ID NO: 32833 - DNA, 25 bp, Homo sapiens
aattcctccattttgcaaagtcgga

SEQ ID NO: 32834 - DNA, 25 bp, Homo sapiens
gcaaagtcggattcttttcttgacg

SEQ ID NO: 32835 - DNA, 25 bp, Homo sapiens
ttttcttgacgacatctttgcagcc

SEQ ID NO: 32836 - DNA, 25 bp, Homo sapiens
gatggctcaacggctgaagacacac

SEQ ID NO: 32837 - DNA, 25 bp, Homo sapiens
ccttccttaccatgtctacaatata

SEQ ID NO: 32838 - DNA, 25 bp, Homo sapiens
aattatcacgacactcttatttcag

SEQ ID NO: 32839 - DNA, 25 bp, Homo sapiens
gatcacgccaagtggtgtatttccc

SEQ ID NO: 32840 - DNA, 25 bp, Homo sapiens
agtttccatgagccaccgaagttac

SEQ ID NO: 32841 - DNA, 25 bp, Homo sapiens
cgaagttaccttcatattccacgca

SEQ ID NO: 32842 - DNA, 25 bp, Homo sapiens
aactctgtgagcgatttgcccgaat

SEQ ID NO: 32843 - DNA, 25 bp, Homo sapiens
cgatttgcccgaatcatgttgtccc

SEQ ID NO: 32844 - DNA, 25 bp, Homo sapiens
cttgccttcctgtcacagggtttgc

SEQ ID NO: 32845 - DNA, 25 bp, Homo sapiens
agggtttgcttgttgctgctatagt

SEQ ID NO: 32846 - DNA, 25 bp, Homo sapiens
ggcgctcagacattttaaccggaac

SEQ ID NO: 32847 - DNA, 25 bp, Homo sapiens
ctcaacagctttccattcagtctgg

SEQ ID NO: 32848 - DNA, 25 bp, Homo sapiens
gtctggatccttccatgactacagc

SEQ ID NO: 32849 - DNA, 25 bp, Homo sapiens
gactacagccatttaagtgttcagc

SEQ ID NO: 32850 - DNA, 25 bp, Homo sapiens
agtgttcagcactgtgtacgataca

SEQ ID NO: 32851 - DNA, 25 bp, Homo sapiens
gagatgagggatgcagctgtccgca

SEQ ID NO: 32852 - DNA, 25 bp, Homo sapiens
agctgtccgcatggctgcagaagcc

SEQ ID NO: 32853 - DNA, 25 bp, Homo sapiens
tcctacctgcctgtgggcattgagc

SEQ ID NO: 32854 - DNA, 25 bp, Homo sapiens
gcatcatttcttagagctggaccac

SEQ ID NO: 32855 - DNA, 25 bp, Homo sapiens
ctacctcctcattcagactgtaggc

SEQ ID NO: 32856 - DNA, 25 bp, Homo sapiens
tcagactgtaggcttcttcggctac

SEQ ID NO: 32857 - DNA, 25 bp, Homo sapiens
gctacgtgcacttcaggcaggagct

SEQ ID NO: 32858 - DNA, 25 bp, Homo sapiens
cctggggattctgaggaggcagcct

SEQ ID NO: 32859 - DNA, 25 bp, Homo sapiens
tgggaagcaggcagtgtcttgggtg

SEQ ID NO: 32860 - DNA, 25 bp, Homo sapiens
atgctcccacctcgttaaaggtgat

SEQ ID NO: 32861 - DNA, 25 bp, Homo sapiens
tcgttaaaggtgatttccctctcaa

SEQ ID NO: 32862 - DNA, 25 bp, Homo sapiens
gtgtcagcgtgttatgatgccgtcc

SEQ ID NO: 32863 - DNA, 25 bp, Homo sapiens
gtaccaacctggctactggaatccc

SEQ ID NO: 32864 - DNA, 25 bp, Homo sapiens
tggaatccccagtagtaaagtgaaa

SEQ ID NO: 32865 - DNA, 25 bp, Homo sapiens
gtgaaatattcaaggctctccagca

SEQ ID NO: 32866 - DNA, 25 bp, Homo sapiens
gctctccagcacagacgatggctac

SEQ ID NO: 32867 - DNA, 25 bp, Homo sapiens
gacgatggctacattgaccttcagt

SEQ ID NO: 32868 - DNA, 25 bp, Homo sapiens
ggctacattgaccttcagtttaaga

SEQ ID NO: 32869 - DNA, 25 bp, Homo sapiens
agatcccttataaggccatcgcact

SEQ ID NO: 32870 - DNA, 25 bp, Homo sapiens
ttataaggccatcgcacttgccact

SEQ ID NO: 32871 - DNA, 25 bp, Homo sapiens
ctcctgctgtcaggctacatcagca

SEQ ID NO: 32872 - DNA, 25 bp, Homo sapiens
cgtggttactcctatgatgacattc

SEQ ID NO: 32873 - DNA, 25 bp, Homo sapiens
gtatgctaccattcgaactgagagt

SEQ ID NO: 32874 - DNA, 25 bp, Homo sapiens
gtattcggtggctaattccaggaca

SEQ ID NO: 32875 - DNA, 25 bp, Homo sapiens
ggaacttcaatccttcgtttcagaa

SEQ ID NO: 32876 - DNA, 25 bp, Homo sapiens
tagtgctacagtttcatacattttc

SEQ ID NO: 32877 - DNA, 25 bp, Homo sapiens
acattttctccagtgacgtgttgac

SEQ ID NO: 32878 - DNA, 25 bp, Homo sapiens
ctcttcactttttggcactggatgc

SEQ ID NO: 32879 - DNA, 25 bp, Homo sapiens
actggatgcatctcagcacagcagc

SEQ ID NO: 32880 - DNA, 25 bp, Homo sapiens
tttctaccaggtttggcaccgtagc

SEQ ID NO: 32881 - DNA, 25 bp, Homo sapiens
gcaccgtagctgttcctaatatttt

SEQ ID NO: 32882 - DNA, 25 bp, Homo sapiens
atgtggtggtaactcaagccgacca

SEQ ID NO: 32883 - DNA, 25 bp, Homo sapiens
tcaagccgaccaaataggccctctt

SEQ ID NO: 32884 - DNA, 25 bp, Homo sapiens
gactttcaaatctttggctgccttg

SEQ ID NO: 32885 - DNA, 25 bp, Homo sapiens
gccagtaggaggcgacacgaaggat

SEQ ID NO: 32886 - DNA, 25 bp, Homo sapiens
gaggcgacacgaaggatttgctgct

SEQ ID NO: 32887 - DNA, 25 bp, Homo sapiens
gcgacacgaaggatttgctgctgcc

SEQ ID NO: 32888 - DNA, 25 bp, Homo sapiens
gggatgggaaggaacctgaaggcat

SEQ ID NO: 32889 - DNA, 25 bp, Homo sapiens
aggcattttttccagagtggtgcag

SEQ ID NO: 32890 - DNA, 25 bp, Homo sapiens
ccagagtggtgcagtaccactgagg

SEQ ID NO: 32891 - DNA, 25 bp, Homo sapiens
accactgaggactgttgctgtattg

SEQ ID NO: 32892 - DNA, 25 bp, Homo sapiens
ggactgttgctgtattgattaggaa

SEQ ID NO: 32893 - DNA, 25 bp, Homo sapiens
agacagagtaatttgcagtttgttt

SEQ ID NO: 32894 - DNA, 25 bp, Homo sapiens
tatacttttgtttatctacaaccca

SEQ ID NO: 32895 - DNA, 25 bp, Homo sapiens
cactctggggttctcaagtccatga

SEQ ID NO: 32896 - DNA, 25 bp, Homo sapiens
atctggcaaactgaaccctttttat

SEQ ID NO: 32897 - DNA, 25 bp, Homo sapiens
gaaccctttttatacatcgacactg

SEQ ID NO: 32898 - DNA, 25 bp, Homo sapiens
gacactgtgtgtgatcgctcagacc

SEQ ID NO: 32899 - DNA, 25 bp, Homo sapiens
tcttccctaccactgggtacagatg

SEQ ID NO: 32900 - DNA, 25 bp, Homo sapiens
gggtacagatggatgcggcgaagtc

SEQ ID NO: 32901 - DNA, 25 bp, Homo sapiens
gaagttgttcacagcaatccgtgcc

SEQ ID NO: 32902 - DNA, 25 bp, Homo sapiens
gtcttgaaggtcattgtgtccttgg

SEQ ID NO: 32903 - DNA, 25 bp, Homo sapiens
tgtgtccttggtttccttgggagta

SEQ ID NO: 32904 - DNA, 25 bp, Homo sapiens
ggtcttcgaaacttgtgtggccaga

SEQ ID NO: 32905 - DNA, 25 bp, Homo sapiens
gggggagaattcagtgcccccttcg

SEQ ID NO: 32906 - DNA, 25 bp, Homo sapiens
ttaaaggtttgcccatttgttcact

SEQ ID NO: 32907 - DNA, 25 bp, Homo sapiens
ttcactgtatttagtccctgctaca

SEQ ID NO: 32908 - DNA, 25 bp, Homo sapiens
tccctgctacattccaggcattgta

SEQ ID NO: 32909 - DNA, 25 bp, Homo sapiens
gaaccacagagaagacattccctca

SEQ ID NO: 32910 - DNA, 25 bp, Homo sapiens
gagcgttctgtggttagttcgtgtc

SEQ ID NO: 32911 - DNA, 25 bp, Homo sapiens
agttcgtgtctaggatttgagtgcc

SEQ ID NO: 32912 - DNA, 25 bp, Homo sapiens
gagtgccttactgaatgcatttacc

SEQ ID NO: 32913 - DNA, 25 bp, Homo sapiens
tgcatttaccagcaaacatgtagca

SEQ ID NO: 32914 - DNA, 25 bp, Homo sapiens
acatgtagcaatctgttctctcatt

SEQ ID NO: 32915 - DNA, 25 bp, Homo sapiens
agcaatctgttctctcattgtgatt

SEQ ID NO: 32916 - DNA, 25 bp, Homo sapiens
aggaagtatggcgtggtacttattc

SEQ ID NO: 32917 - DNA, 25 bp, Homo sapiens
caggaggtgcggagggtggtggcgt

SEQ ID NO: 32918 - DNA, 25 bp, Homo sapiens
ctcggccgctgggccgaactactgt

SEQ ID NO: 32919 - DNA, 25 bp, Homo sapiens
ggaggtggagaccttccactgagcc

SEQ ID NO: 32920 - DNA, 25 bp, Homo sapiens
ccccgctgggtggattagtcttagc

SEQ ID NO: 32921 - DNA, 25 bp, Homo sapiens
tgggtggattagtcttagctcccta

SEQ ID NO: 32922 - DNA, 25 bp, Homo sapiens
ggattagtcttagctccctagagcc

SEQ ID NO: 32923 - DNA, 25 bp, Homo sapiens
agtcttagctccctagagcctgagc

SEQ ID NO: 32924 - DNA, 25 bp, Homo sapiens
tttggcctcggaggctcgggaccta

SEQ ID NO: 32925 - DNA, 25 bp, Homo sapiens
gacctacccatagctttgacctagg

SEQ ID NO: 32926 - DNA, 25 bp, Homo sapiens
cctacccatagctttgacctaggcc

SEQ ID NO: 32927 - DNA, 25 bp, Homo sapiens
cccgcacagcctgagtttgcaataa

SEQ ID NO: 32928 - DNA, 25 bp, Homo sapiens
ggccttcaatgacagtgtgctgggc

SEQ ID NO: 32929 - DNA, 25 bp, Homo sapiens
tgacagtgtgctgggctagcctgtg

SEQ ID NO: 32930 - DNA, 25 bp, Homo sapiens
ccccagttgcttatccagatgtgac

SEQ ID NO: 32931 - DNA, 25 bp, Homo sapiens
agatgtgacagagctcgacccaagc

SEQ ID NO: 32932 - DNA, 25 bp, Homo sapiens
gcctgcactgcctgggaaagtcggc

SEQ ID NO: 32933 - DNA, 25 bp, Homo sapiens
ctgcctgggaaagtcggccgagggc

SEQ ID NO: 32934 - DNA, 25 bp, Homo sapiens
gggcctcggtccatagagaacacca

SEQ ID NO: 32935 - DNA, 25 bp, Homo sapiens
tcggtccatagagaacaccaccacc

SEQ ID NO: 32936 - DNA, 25 bp, Homo sapiens
tcgggggctcagtctgggaggtaat

SEQ ID NO: 32937 - DNA, 25 bp, Homo sapiens
agtatggcggccaccagaaggctgt

SEQ ID NO: 32938 - DNA, 25 bp, Homo sapiens
accagaaggctgttgtctgcctggc

SEQ ID NO: 32939 - DNA, 25 bp, Homo sapiens
cttcctccagtgatggccggaagaa

SEQ ID NO: 32940 - DNA, 25 bp, Homo sapiens
gtgatggccggaagaagcgggggaa

SEQ ID NO: 32941 - DNA, 25 bp, Homo sapiens
gaagcgggggaagtacaaggacaag

SEQ ID NO: 32942 - DNA, 25 bp, Homo sapiens
ggcaaggagaaggcggaagcacagc

SEQ ID NO: 32943 - DNA, 25 bp, Homo sapiens
gggcgcaccaggcttattaagggag

SEQ ID NO: 32944 - DNA, 25 bp, Homo sapiens
cgcaccaggcttattaagggagatg

SEQ ID NO: 32945 - DNA, 25 bp, Homo sapiens
gatggcgaggtcctagaggaaatcg

SEQ ID NO: 32946 - DNA, 25 bp, Homo sapiens
agggtgccagtgggaagcctgatgg

SEQ ID NO: 32947 - DNA, 25 bp, Homo sapiens
gccagtgggaagcctgatgggtgct

SEQ ID NO: 32948 - DNA, 25 bp, Homo sapiens
gtgggaagcctgatgggtgctggtg

SEQ ID NO: 32949 - DNA, 25 bp, Homo sapiens
ggaagcctgatgggtgctggtggcc

SEQ ID NO: 32950 - DNA, 25 bp, Homo sapiens
acttcctgttgtcagttacatccga

SEQ ID NO: 32951 - DNA, 25 bp, Homo sapiens
ggacactgacatttcactcattcgc

SEQ ID NO: 32952 - DNA, 25 bp, Homo sapiens
tcactcattcgctattttgtcactg

SEQ ID NO: 32953 - DNA, 25 bp, Homo sapiens
gtcactgaggtgctggacgtcattg

SEQ ID NO: 32954 - DNA, 25 bp, Homo sapiens
ttttcctccccatcctggagaatga

SEQ ID NO: 32955 - DNA, 25 bp, Homo sapiens
gaatgacagcatcgcaggtaccatc

SEQ ID NO: 32956 - DNA, 25 bp, Homo sapiens
cgagcatgaccctgtgacggagttt

SEQ ID NO: 32957 - DNA, 25 bp, Homo sapiens
gagcatcctccagagctgaagcaga

SEQ ID NO: 32958 - DNA, 25 bp, Homo sapiens
gcagaacattccagaacccgttgtg

SEQ ID NO: 32959 - DNA, 25 bp, Homo sapiens
ttaagaggctcgggcagcgtcttga

SEQ ID NO: 32960 - DNA, 25 bp, Homo sapiens
tccaagctgacctcagttttctcac

SEQ ID NO: 32961 - DNA, 25 bp, Homo sapiens
tcagttgacttaaccctttgctgtc

SEQ ID NO: 32962 - DNA, 25 bp, Homo sapiens
aaaagagttggcgtttcctgttctg

SEQ ID NO: 32963 - DNA, 25 bp, Homo sapiens
gggtgctactgccaaacgttatggt

SEQ ID NO: 32964 - DNA, 25 bp, Homo sapiens
agtcgggatgcacaacttcaaccac

SEQ ID NO: 32965 - DNA, 25 bp, Homo sapiens
tcaaccaccgacttatcaatgcagc

SEQ ID NO: 32966 - DNA, 25 bp, Homo sapiens
aatgcagccgcctgtgtattgcaat

SEQ ID NO: 32967 - DNA, 25 bp, Homo sapiens
ggccgttaccttaagcactgagcca

SEQ ID NO: 32968 - DNA, 25 bp, Homo sapiens
tgcagcagaggtactcttctgtccc

SEQ ID NO: 32969 - DNA, 25 bp, Homo sapiens
tcccttccgtttatagttctctgag

SEQ ID NO: 32970 - DNA, 25 bp, Homo sapiens
tcaaaaggtcttgctgctgtcaggt

SEQ ID NO: 32971 - DNA, 25 bp, Homo sapiens
tgcactccatccatcataactgtat

SEQ ID NO: 32972 - DNA, 25 bp, Homo sapiens
ggaaagggttcagtggcaccttcca

SEQ ID NO: 32973 - DNA, 25 bp, Homo sapiens
attatcccagcccaggagttctgtt

SEQ ID NO: 32974 - DNA, 25 bp, Homo sapiens
tgaggatgaagagccgccacctaag

SEQ ID NO: 32975 - DNA, 25 bp, Homo sapiens
gcagagagggtccaaacctgcacct

SEQ ID NO: 32976 - DNA, 25 bp, Homo sapiens
aacctgcacctaaagtctcagctgc

SEQ ID NO: 32977 - DNA, 25 bp, Homo sapiens
tcagctgcccagcgggggaaagcta

SEQ ID NO: 32978 - DNA, 25 bp, Homo sapiens
aggcccttgcctaagaaagcacctc

SEQ ID NO: 32979 - DNA, 25 bp, Homo sapiens
gcacctcctaaggccaaaacgcctg

SEQ ID NO: 32980 - DNA, 25 bp, Homo sapiens
aaacgcctgccaagaagaccagacc

SEQ ID NO: 32981 - DNA, 25 bp, Homo sapiens
aacctagtggtggctcctcaaagaa

SEQ ID NO: 32982 - DNA, 25 bp, Homo sapiens
gggcaagggcaaatccaccatgaag

SEQ ID NO: 32983 - DNA, 25 bp, Homo sapiens
tgattttggctgcaggacctgggtc

SEQ ID NO: 32984 - DNA, 25 bp, Homo sapiens
aggacctgggtctattgttatctga

SEQ ID NO: 32985 - DNA, 25 bp, Homo sapiens
ttatctgacatctcttgacatgccc

SEQ ID NO: 32986 - DNA, 25 bp, Homo sapiens
tggttgatttactcaggggccaggt

SEQ ID NO: 32987 - DNA, 25 bp, Homo sapiens
gccaggtggggagttctctcccatg

SEQ ID NO: 32988 - DNA, 25 bp, Homo sapiens
gctggggtgtgaggactctgtgcac

SEQ ID NO: 32989 - DNA, 25 bp, Homo sapiens
ctgtgcacaccttagagttcctggc

SEQ ID NO: 32990 - DNA, 25 bp, Homo sapiens
cccactcctttgacttctggagagt

SEQ ID NO: 32991 - DNA, 25 bp, Homo sapiens
gaggtgggctcagctaagccacaat

SEQ ID NO: 32992 - DNA, 25 bp, Homo sapiens
tgctcagtgagtggcctagacattg

SEQ ID NO: 32993 - DNA, 25 bp, Homo sapiens
gggtcatgggctaaatgtcacctga

SEQ ID NO: 32994 - DNA, 25 bp, Homo sapiens
ggatgtgaagattgagccgtgcggg

SEQ ID NO: 32995 - DNA, 25 bp, Homo sapiens
tgaagattgagccgtgcgggcacct

SEQ ID NO: 32996 - DNA, 25 bp, Homo sapiens
ctggcagcactcggacagccagacc

SEQ ID NO: 32997 - DNA, 25 bp, Homo sapiens
ccttctgccgctgcgagatcaaggg

SEQ ID NO: 32998 - DNA, 25 bp, Homo sapiens
tcaagggctgggaggccgtgagtat

SEQ ID NO: 32999 - DNA, 25 bp, Homo sapiens
tgggaggccgtgagtatctaccagt

SEQ ID NO: 33000 - DNA, 25 bp, Homo sapiens
acggtcaggctactgctgaggactc

SEQ ID NO: 33001 - DNA, 25 bp, Homo sapiens
agatgtgctgctcaagggagcccca

SEQ ID NO: 33002 - DNA, 25 bp, Homo sapiens
gctcaagggagccccaagggctgga

SEQ ID NO: 33003 - DNA, 25 bp, Homo sapiens
ccacatttgagctctgcaagatctg

SEQ ID NO: 33004 - DNA, 25 bp, Homo sapiens
gagctctgcaagatctgtgctgaga

SEQ ID NO: 33005 - DNA, 25 bp, Homo sapiens
ctcccactttgcagtgcaggagtgc

SEQ ID NO: 33006 - DNA, 25 bp, Homo sapiens
cagcaccaggactggcggcaatgcc

SEQ ID NO: 33007 - DNA, 25 bp, Homo sapiens
aatgccagccacaggtgcaggcgtt

SEQ ID NO: 33008 - DNA, 25 bp, Homo sapiens
tgagtgaacagcaggcgaggcggca

SEQ ID NO: 33009 - DNA, 25 bp, Homo sapiens
ggcgaggcggcaagaggagctgcag

SEQ ID NO: 33010 - DNA, 25 bp, Homo sapiens
gaggcaagaacaagccggtgcccac

SEQ ID NO: 33011 - DNA, 25 bp, Homo sapiens
ggacatgactggcacaaacagctgt

SEQ ID NO: 33012 - DNA, 25 bp, Homo sapiens
acagctgtcatatgttcatggtcag

SEQ ID NO: 33013 - DNA, 25 bp, Homo sapiens
ggtcagatgtcatacattctcagct

SEQ ID NO: 33014 - DNA, 25 bp, Homo sapiens
tgtcttgttccaccagtatttacca

SEQ ID NO: 33015 - DNA, 25 bp, Homo sapiens
cccaccccacatcttaagtcagtgt

SEQ ID NO: 33016 - DNA, 25 bp, Homo sapiens
aaagctctgatatcctcaacaacca

SEQ ID NO: 33017 - DNA, 25 bp, Homo sapiens
attgttgccccagatgactgctgaa

SEQ ID NO: 33018 - DNA, 25 bp, Homo sapiens
tgtcaagtaattccagggaccccca

SEQ ID NO: 33019 - DNA, 25 bp, Homo sapiens
acagagcccaagagggtcagccctg

SEQ ID NO: 33020 - DNA, 25 bp, Homo sapiens
tcagccctgcttatcatcataggcc

SEQ ID NO: 33021 - DNA, 25 bp, Homo sapiens
cataggcccagcaggctgatctcga

SEQ ID NO: 33022 - DNA, 25 bp, Homo sapiens
aagccatcttagcaactttctcact

SEQ ID NO: 33023 - DNA, 25 bp, Homo sapiens
aagcaggattcagagctgctctccc

SEQ ID NO: 33024 - DNA, 25 bp, Homo sapiens
cttctaacctgcctggtcaagtttt

SEQ ID NO: 33025 - DNA, 25 bp, Homo sapiens
tttgtgaaacttatcctgctgtctc

SEQ ID NO: 33026 - DNA, 25 bp, Homo sapiens
cacccatatgtgctcaccatgtgta

SEQ ID NO: 33027 - DNA, 25 bp, Homo sapiens
atcctattcacacaaatatggcctc

SEQ ID NO: 33028 - DNA, 25 bp, Homo sapiens
atatggcctcattacccatcagaga

SEQ ID NO: 33029 - DNA, 25 bp, Homo sapiens
ggccttcaccacaaagtcagtactc

SEQ ID NO: 33030 - DNA, 25 bp, Homo sapiens
tctcccacttatcaaaccttgtcaa

SEQ ID NO: 33031 - DNA, 25 bp, Homo sapiens
tgtaatggagagtcacagctccttc

SEQ ID NO: 33032 - DNA, 25 bp, Homo sapiens
cagctccttccttataagtgaactc

SEQ ID NO: 33033 - DNA, 25 bp, Homo sapiens
agaaaaccctactagtgccgtgact

SEQ ID NO: 33034 - DNA, 25 bp, Homo sapiens
gtgccgtgactatggaaatgccttt

SEQ ID NO: 33035 - DNA, 25 bp, Homo sapiens
ggaaatgccttttgtggcaactcag

SEQ ID NO: 33036 - DNA, 25 bp, Homo sapiens
ttgtggcaactcagacttcattaaa

SEQ ID NO: 33037 - DNA, 25 bp, Homo sapiens
acatcagtgtgtttctagccaattg

SEQ ID NO: 33038 - DNA, 25 bp, Homo sapiens
gggctgatcaggttgggttatgcaa

SEQ ID NO: 33039 - DNA, 25 bp, Homo sapiens
gggttatgcaagaatctcccatgct

SEQ ID NO: 33040 - DNA, 25 bp, Homo sapiens
caagaatctcccatgctgaactgag

SEQ ID NO: 33041 - DNA, 25 bp, Homo sapiens
aaatttaggatccctgatgacccca

SEQ ID NO: 33042 - DNA, 25 bp, Homo sapiens
tccctgatgaccccactaattatag

SEQ ID NO: 33043 - DNA, 25 bp, Homo sapiens
ggtcatagaccacagagaagtttct

SEQ ID NO: 33044 - DNA, 25 bp, Homo sapiens
ttaatcccagatttggatcctacaa

SEQ ID NO: 33045 - DNA, 25 bp, Homo sapiens
atatgaatactcccaaatacttttt

SEQ ID NO: 33046 - DNA, 25 bp, Homo sapiens
aatacacatgaagaacctcaactta

SEQ ID NO: 33047 - DNA, 25 bp, Homo sapiens
gcagtgggaaattacctccatttgt

SEQ ID NO: 33048 - DNA, 25 bp, Homo sapiens
acctccatttgtaaactatgttgct

SEQ ID NO: 33049 - DNA, 25 bp, Homo sapiens
gaaaagtagctctaatcaagtgata

SEQ ID NO: 33050 - DNA, 25 bp, Homo sapiens
aatcaagtgatatttctgggatata

SEQ ID NO: 33051 - DNA, 25 bp, Homo sapiens
ctgggatatatcacttcagcacctg

SEQ ID NO: 33052 - DNA, 25 bp, Homo sapiens
acctggctccagagattatctacag

SEQ ID NO: 33053 - DNA, 25 bp, Homo sapiens
gagattatctacagctcactgaaca

SEQ ID NO: 33054 - DNA, 25 bp, Homo sapiens
cagctcactgaacatggcaatgtga

SEQ ID NO: 33055 - DNA, 25 bp, Homo sapiens
ggcaatgtgaaggatatcgacagca

SEQ ID NO: 33056 - DNA, 25 bp, Homo sapiens
ggatatcgacagcactgatcatgac

SEQ ID NO: 33057 - DNA, 25 bp, Homo sapiens
atcgacagcactgatcatgacagat

SEQ ID NO: 33058 - DNA, 25 bp, Homo sapiens
acagatggtgtgaatacattatgta

SEQ ID NO: 33059 - DNA, 25 bp, Homo sapiens
tatgtatcgagggctgatcaggttg

SEQ ID NO: 33060 - DNA, 25 bp, Homo sapiens
gacaagggggtctatgagcatttac

SEQ ID NO: 33061 - DNA, 25 bp, Homo sapiens
aatgcgaatgatcctgaagcctcaa

SEQ ID NO: 33062 - DNA, 25 bp, Homo sapiens
gaagcctcaaagtttcatgatattg

SEQ ID NO: 33063 - DNA, 25 bp, Homo sapiens
cctggaagctactcttaattggttt

SEQ ID NO: 33064 - DNA, 25 bp, Homo sapiens
gttattaaatccactcatcaatgtt

SEQ ID NO: 33065 - DNA, 25 bp, Homo sapiens
gtgcagatatctgatagccctttcc

SEQ ID NO: 33066 - DNA, 25 bp, Homo sapiens
ccctttccgttgcactcaagaggaa

SEQ ID NO: 33067 - DNA, 25 bp, Homo sapiens
gttgaatcggtatcatcttcaccaa

SEQ ID NO: 33068 - DNA, 25 bp, Homo sapiens
gaagagcaagtgtggcacttccttg

SEQ ID NO: 33069 - DNA, 25 bp, Homo sapiens
aattctgctgtcaagattcccatct

SEQ ID NO: 33070 - DNA, 25 bp, Homo sapiens
gattcccatctctaaggactccaag

SEQ ID NO: 33071 - DNA, 25 bp, Homo sapiens
ccaagtctccaggcaggactatcaa

SEQ ID NO: 33072 - DNA, 25 bp, Homo sapiens
gactatcaaaatggactccttcttc

SEQ ID NO: 33073 - DNA, 25 bp, Homo sapiens
tcctatcagctctagaaccccagag

SEQ ID NO: 33074 - DNA, 25 bp, Homo sapiens
ccagaggacttgcccagtaggccag

SEQ ID NO: 33075 - DNA, 25 bp, Homo sapiens
cagtaggccagctgagcacttacca

SEQ ID NO: 33076 - DNA, 25 bp, Homo sapiens
gcttttgccctcagcttgaatacag

SEQ ID NO: 33077 - DNA, 25 bp, Homo sapiens
agttcctggtgcatcaaagctgtaa

SEQ ID NO: 33078 - DNA, 25 bp, Homo sapiens
tcatcacctcttcctacaaataaac

SEQ ID NO: 33079 - DNA, 25 bp, Homo sapiens
gacaaaaggctttcattccctcttc

SEQ ID NO: 33080 - DNA, 25 bp, Homo sapiens
ggcaggcaggttatcagtccttggc

SEQ ID NO: 33081 - DNA, 25 bp, Homo sapiens
ccctatccttttctgtatcaaacaa

SEQ ID NO: 33082 - DNA, 25 bp, Homo sapiens
ggacgagtgcctcatgagactcgcc

SEQ ID NO: 33083 - DNA, 25 bp, Homo sapiens
actcctctcattggaggccctattt

SEQ ID NO: 33084 - DNA, 25 bp, Homo sapiens
gaacactgcaagcccttaatcagcc

SEQ ID NO: 33085 - DNA, 25 bp, Homo sapiens
taatcagccctctgtgacataggta

SEQ ID NO: 33086 - DNA, 25 bp, Homo sapiens
gacataggtagcagcccacggagat

SEQ ID NO: 33087 - DNA, 25 bp, Homo sapiens
ccacggagatcctaagctggctgtc

SEQ ID NO: 33088 - DNA, 25 bp, Homo sapiens
gctggctgtcttgtgtgcagcctga

SEQ ID NO: 33089 - DNA, 25 bp, Homo sapiens
tgccacctgggcagataacctggag

SEQ ID NO: 33090 - DNA, 25 bp, Homo sapiens
caccttttcttttcagcttgattgc

SEQ ID NO: 33091 - DNA, 25 bp, Homo sapiens
gggccctgcatttatgaggcaccta

SEQ ID NO: 33092 - DNA, 25 bp, Homo sapiens
gcatgaaggtccctgatgacccgga

SEQ ID NO: 33093 - DNA, 25 bp, Homo sapiens
gggctgcgcaagtacaactacacgc

SEQ ID NO: 33094 - DNA, 25 bp, Homo sapiens
gcactttctacgctcgggagcggct

SEQ ID NO: 33095 - DNA, 25 bp, Homo sapiens
tgcagagcgactggctgccttttga

SEQ ID NO: 33096 - DNA, 25 bp, Homo sapiens
ggcctcgggagggcagaagctgtcc

SEQ ID NO: 33097 - DNA, 25 bp, Homo sapiens
tgtccgaggacgagaacctggcctt

SEQ ID NO: 33098 - DNA, 25 bp, Homo sapiens
acctggccttgaacgagtgcgggct

SEQ ID NO: 33099 - DNA, 25 bp, Homo sapiens
agctcctgtcagccatcgagaagct

SEQ ID NO: 33100 - DNA, 25 bp, Homo sapiens
aaaagcagggttggcctcagccctg

SEQ ID NO: 33101 - DNA, 25 bp, Homo sapiens
acctctggaaatacttggctctgcc

SEQ ID NO: 33102 - DNA, 25 bp, Homo sapiens
gccccatgggcacgggaggggcgcc

SEQ ID NO: 33103 - DNA, 25 bp, Homo sapiens
agccgtggagctgtggaattgggcc

SEQ ID NO: 33104 - DNA, 25 bp, Homo sapiens
aacattctctccgtgaaatcatggt

SEQ ID NO: 33105 - DNA, 25 bp, Homo sapiens
cactgcccagaggtactgaggaaaa

SEQ ID NO: 33106 - DNA, 25 bp, Homo sapiens
atgggttcggcagatggtggtggta

SEQ ID NO: 33107 - DNA, 25 bp, Homo sapiens
agtgtggtaaatatgtgctccgctt

SEQ ID NO: 33108 - DNA, 25 bp, Homo sapiens
ctccgcttttgttgcatcactatgt

SEQ ID NO: 33109 - DNA, 25 bp, Homo sapiens
acaatgtaactttatgcttccaaat

SEQ ID NO: 33110 - DNA, 25 bp, Homo sapiens
atgtgaaccttgttgcagtgtataa

SEQ ID NO: 33111 - DNA, 25 bp, Homo sapiens
gaaatctcaccgaaacttactgctg

SEQ ID NO: 33112 - DNA, 25 bp, Homo sapiens
aatgattacattctcccttaagcag

SEQ ID NO: 33113 - DNA, 25 bp, Homo sapiens
ggatgtgccatgcaatggtgtctgt

SEQ ID NO: 33114 - DNA, 25 bp, Homo sapiens
gtgtctgtgtaattattttgctctt

SEQ ID NO: 33115 - DNA, 25 bp, Homo sapiens
aacccagatgacttactcaatgcct

SEQ ID NO: 33116 - DNA, 25 bp, Homo sapiens
aaggactatctcaagcaggtgctgg

SEQ ID NO: 33117 - DNA, 25 bp, Homo sapiens
gtgctggacattgatcttcatgctc

SEQ ID NO: 33118 - DNA, 25 bp, Homo sapiens
gcactacctgggaatcctgtatcgg

SEQ ID NO: 33119 - DNA, 25 bp, Homo sapiens
gtcacctgcaatctctttgttgtgc

SEQ ID NO: 33120 - DNA, 25 bp, Homo sapiens
ctcggccaaccatcatcaaagcaag

SEQ ID NO: 33121 - DNA, 25 bp, Homo sapiens
aaaacttgatcctcgtccagaatac

SEQ ID NO: 33122 - DNA, 25 bp, Homo sapiens
ttggcatcaccaagaaccactacct

SEQ ID NO: 33123 - DNA, 25 bp, Homo sapiens
gtctgatgagcatgcgcagtgccaa

SEQ ID NO: 33124 - DNA, 25 bp, Homo sapiens
gattgttgatgctacctccaaagac

SEQ ID NO: 33125 - DNA, 25 bp, Homo sapiens
gacagaacagtacgtggagctccac

SEQ ID NO: 33126 - DNA, 25 bp, Homo sapiens
tccagcgcggggatggcgctgtccg

SEQ ID NO: 33127 - DNA, 25 bp, Homo sapiens
caacgtcggcgtctacacgacagag

SEQ ID NO: 33128 - DNA, 25 bp, Homo sapiens
cccggctcctcacaagtcagagccc

SEQ ID NO: 33129 - DNA, 25 bp, Homo sapiens
ggctcctcacaagtcagagcccacg

SEQ ID NO: 33130 - DNA, 25 bp, Homo sapiens
gcccacggccagaaggtggcggacg

SEQ ID NO: 33131 - DNA, 25 bp, Homo sapiens
ccagaaggtggcggacgcgctgagc

SEQ ID NO: 33132 - DNA, 25 bp, Homo sapiens
gctgcaggcgtcgctggacaagttc

SEQ ID NO: 33133 - DNA, 25 bp, Homo sapiens
caggcgtcgctggacaagttcctga

SEQ ID NO: 33134 - DNA, 25 bp, Homo sapiens
acaagttcctgagccacgttatctc

SEQ ID NO: 33135 - DNA, 25 bp, Homo sapiens
cgttatctcggcgctggtttccgag

SEQ ID NO: 33136 - DNA, 25 bp, Homo sapiens
tctcggcgctggtttccgagtaccg

SEQ ID NO: 33137 - DNA, 25 bp, Homo sapiens
gcatcagctatgaacacatcctaac

SEQ ID NO: 33138 - DNA, 25 bp, Homo sapiens
atgcctcctacgtgtattattgcgc

SEQ ID NO: 33139 - DNA, 25 bp, Homo sapiens
gagacggtgcatggtgtggagtttg

SEQ ID NO: 33140 - DNA, 25 bp, Homo sapiens
tggagtttgactttatacccgatgt

SEQ ID NO: 33141 - DNA, 25 bp, Homo sapiens
ttgtgacatgtcctcaaacttcctg

SEQ ID NO: 33142 - DNA, 25 bp, Homo sapiens
aaacttcctgtccaagccagtggat

SEQ ID NO: 33143 - DNA, 25 bp, Homo sapiens
ggtcaccgtggtgattgtccgtgat

SEQ ID NO: 33144 - DNA, 25 bp, Homo sapiens
gtttcagcatctacgtcatgggctt

SEQ ID NO: 33145 - DNA, 25 bp, Homo sapiens
catgggcttggttctggagtggatt

SEQ ID NO: 33146 - DNA, 25 bp, Homo sapiens
ccgcggccatggagaagcttagctc

SEQ ID NO: 33147 - DNA, 25 bp, Homo sapiens
gggcctctctgtataatgctgtcac

SEQ ID NO: 33148 - DNA, 25 bp, Homo sapiens
atttctccggaagctgagccagtct

SEQ ID NO: 33149 - DNA, 25 bp, Homo sapiens
tctcctggtctagcccaggttgcca

SEQ ID NO: 33150 - DNA, 25 bp, Homo sapiens
gaacgcttggcattgcagagtgcta

SEQ ID NO: 33151 - DNA, 25 bp, Homo sapiens
gagccagtggagaacttgccaactt

SEQ ID NO: 33152 - DNA, 25 bp, Homo sapiens
gcaagttcatggctgagctgagacc

SEQ ID NO: 33153 - DNA, 25 bp, Homo sapiens
ctgactcccagttcaccatgaaaag

SEQ ID NO: 33154 - DNA, 25 bp, Homo sapiens
gggttctggcaacaggttcaagctg

SEQ ID NO: 33155 - DNA, 25 bp, Homo sapiens
tcaaaatgctacacccacattctct

SEQ ID NO: 33156 - DNA, 25 bp, Homo sapiens
atctccctgatcttccagacaaact

SEQ ID NO: 33157 - DNA, 25 bp, Homo sapiens
gacaaactacctggatgttgccctt

SEQ ID NO: 33158 - DNA, 25 bp, Homo sapiens
ttgtgatcacatacccttcttttaa

SEQ ID NO: 33159 - DNA, 25 bp, Homo sapiens
aaatagctagtttttttctgcatat

SEQ ID NO: 33160 - DNA, 25 bp, Homo sapiens
tgatatgcccttatttgcaatactt

SEQ ID NO: 33161 - DNA, 25 bp, Homo sapiens
ggtatgggatattttgttaggcaag

SEQ ID NO: 33162 - DNA, 25 bp, Homo sapiens
cttcttaaattgcaataggcttcca

SEQ ID NO: 33163 - DNA, 25 bp, Homo sapiens
gtttcagaacaaattaactcttggc

SEQ ID NO: 33164 - DNA, 25 bp, Homo sapiens
taactcttggcattatacgtctccc

SEQ ID NO: 33165 - DNA, 25 bp, Homo sapiens
gtacactttctgattttaacttcac

SEQ ID NO: 33166 - DNA, 25 bp, Homo sapiens
acttcactaatgtaattactctctc

SEQ ID NO: 33167 - DNA, 25 bp, Homo sapiens
aattactctctcaagaagcttttaa

SEQ ID NO: 33168 - DNA, 25 bp, Homo sapiens
ccaaaccccatgccaaattcatcat

SEQ ID NO: 33169 - DNA, 25 bp, Homo sapiens
aatactgcttataattttagagggg

SEQ ID NO: 33170 - DNA, 25 bp, Homo sapiens
gttgtttactgaatcctggtgtgaa

SEQ ID NO: 33171 - DNA, 25 bp, Homo sapiens
ctactgctgtacttccgatttacgg

SEQ ID NO: 33172 - DNA, 25 bp, Homo sapiens
gagtacctatttatgtgggccttca

SEQ ID NO: 33173 - DNA, 25 bp, Homo sapiens
gtgggccttcagtggatgggcagtg

SEQ ID NO: 33174 - DNA, 25 bp, Homo sapiens
acaagtagtcctgtttgccactaaa

SEQ ID NO: 33175 - DNA, 25 bp, Homo sapiens
gttatctctgccagtcacaagtgtg

SEQ ID NO: 33176 - DNA, 25 bp, Homo sapiens
acaagtgtggctggtgtcattctgg

SEQ ID NO: 33177 - DNA, 25 bp, Homo sapiens
tcattctgggtctgactggagccct

SEQ ID NO: 33178 - DNA, 25 bp, Homo sapiens
ctcctggactgtttctttaatttca

SEQ ID NO: 33179 - DNA, 25 bp, Homo sapiens
agccctgcagacatagtacctggtc

SEQ ID NO: 33180 - DNA, 25 bp, Homo sapiens
tacctggtcagaactatgcctcggt

SEQ ID NO: 33181 - DNA, 25 bp, Homo sapiens
tgaagcaggtatcttgcatggccca

SEQ ID NO: 33182 - DNA, 25 bp, Homo sapiens
tgccatgctacctctgaaagtcaaa

SEQ ID NO: 33183 - DNA, 25 bp, Homo sapiens
aagtcaaaggccgacgcttctattt

SEQ ID NO: 33184 - DNA, 25 bp, Homo sapiens
acgcttctatttcctcttggacaaa

SEQ ID NO: 33185 - DNA, 25 bp, Homo sapiens
caaaactggacacttccctaacaca

SEQ ID NO: 33186 - DNA, 25 bp, Homo sapiens
tgacaatactgtgggtgcctaccgg

SEQ ID NO: 33187 - DNA, 25 bp, Homo sapiens
gtgcctaccggagcttgtgaagaaa

SEQ ID NO: 33188 - DNA, 25 bp, Homo sapiens
aaatgacctcaagtcactcacctct

SEQ ID NO: 33189 - DNA, 25 bp, Homo sapiens
gtcactcacctctccaagaggagga

SEQ ID NO: 33190 - DNA, 25 bp, Homo sapiens
gtgttggttcacacctgttgtaatc

SEQ ID NO: 33191 - DNA, 25 bp, Homo sapiens
taaaggagcagtcatccctagggca

SEQ ID NO: 33192 - DNA, 25 bp, Homo sapiens
gagtgcagtagcacgatctcggctc

SEQ ID NO: 33193 - DNA, 25 bp, Homo sapiens
cctcagcctcctaagtatctgggat

SEQ ID NO: 33194 - DNA, 25 bp, Homo sapiens
tgtgccaccacacctgggtgatttt

SEQ ID NO: 33195 - DNA, 25 bp, Homo sapiens
ggtaattttgggtaatctgtctcta

SEQ ID NO: 33196 - DNA, 25 bp, Homo sapiens
aaattcaactggcttttatgcaaag

SEQ ID NO: 33197 - DNA, 25 bp, Homo sapiens
gacacctaggttccaattcattcac

SEQ ID NO: 33198 - DNA, 25 bp, Homo sapiens
aattcattcacattcttggttccag

SEQ ID NO: 33199 - DNA, 25 bp, Homo sapiens
atttctaatggatttgcttttcttt

SEQ ID NO: 33200 - DNA, 25 bp, Homo sapiens
gcttttctttttatatggattcctt

SEQ ID NO: 33201 - DNA, 25 bp, Homo sapiens
gattcctttaaaacttattccagat

SEQ ID NO: 33202 - DNA, 25 bp, Homo sapiens
ttattccagatgtagttccttccaa

SEQ ID NO: 33203 - DNA, 25 bp, Homo sapiens
gagcttacttagttgctgatttcca

SEQ ID NO: 33204 - DNA, 25 bp, Homo sapiens
gctgatttccagatttcgatgtttc

SEQ ID NO: 33205 - DNA, 25 bp, Homo sapiens
ttcttcccattttagctactgcagt

SEQ ID NO: 33206 - DNA, 25 bp, Homo sapiens
gctactgcagtgcttttgtttcaca

SEQ ID NO: 33207 - DNA, 25 bp, Homo sapiens
aaatgtgccattttattgctaagtg

SEQ ID NO: 33208 - DNA, 25 bp, Homo sapiens
tttctgctataattctttctcggtc

SEQ ID NO: 33209 - DNA, 25 bp, Homo sapiens
ttctcggtcagattgcaatgtcagc

SEQ ID NO: 33210 - DNA, 25 bp, Homo sapiens
tgtcagcagttactgccacactcct

SEQ ID NO: 33211 - DNA, 25 bp, Homo sapiens
ccacactcctgtcagcttaaacaca

SEQ ID NO: 33212 - DNA, 25 bp, Homo sapiens
aaatgttactgcttatcttttctta

SEQ ID NO: 33213 - DNA, 25 bp, Homo sapiens
agtactgggcttatatttcattgga

SEQ ID NO: 33214 - DNA, 25 bp, Homo sapiens
aatattgctctgcagtgcttttcag

SEQ ID NO: 33215 - DNA, 25 bp, Homo sapiens
gtagagtgagaccctctggtggaaa

SEQ ID NO: 33216 - DNA, 25 bp, Homo sapiens
ttattgccctgtggactcctttaat

SEQ ID NO: 33217 - DNA, 25 bp, Homo sapiens
acattagacgaagcttctcctgttt

SEQ ID NO: 33218 - DNA, 25 bp, Homo sapiens
ttcaaacacaggttttgcggaattt

SEQ ID NO: 33219 - DNA, 25 bp, Homo sapiens
gatagcaagcattcttttcctgaaa

SEQ ID NO: 33220 - DNA, 25 bp, Homo sapiens
attggtcatgtagcttttctgcgaa

SEQ ID NO: 33221 - DNA, 25 bp, Homo sapiens
ggtaaaccctaaatcttgccagact

SEQ ID NO: 33222 - DNA, 25 bp, Homo sapiens
ggggtgtgcatgcagatgtctggta

SEQ ID NO: 33223 - DNA, 25 bp, Homo sapiens
ggttttcagcagactttgctcctaa

SEQ ID NO: 33224 - DNA, 25 bp, Homo sapiens
ttgctcctaatggctctctgaaagt

SEQ ID NO: 33225 - DNA, 25 bp, Homo sapiens
cctttccccaaggtagcacatctgg

SEQ ID NO: 33226 - DNA, 25 bp, Homo sapiens
ccaaggtagcacatctggctcactc

SEQ ID NO: 33227 - DNA, 25 bp, Homo sapiens
ccgctacttctctggggaatgtggg

SEQ ID NO: 33228 - DNA, 25 bp, Homo sapiens
gggaatgtgggttccatccaggatt

SEQ ID NO: 33229 - DNA, 25 bp, Homo sapiens
gcacagctgcttcctgcaagaaagc

SEQ ID NO: 33230 - DNA, 25 bp, Homo sapiens
caagtctttggtctccctgagaagc

SEQ ID NO: 33231 - DNA, 25 bp, Homo sapiens
tttggtctccctgagaagccatgtc

SEQ ID NO: 33232 - DNA, 25 bp, Homo sapiens
gccctccagcttgtatttaagtccc

SEQ ID NO: 33233 - DNA, 25 bp, Homo sapiens
agcttgtatttaagtccctgggctg

SEQ ID NO: 33234 - DNA, 25 bp, Homo sapiens
ggtgtcatgtcaggcattttgcaag

SEQ ID NO: 33235 - DNA, 25 bp, Homo sapiens
attggccctcgggtgagctgagggt

SEQ ID NO: 33236 - DNA, 25 bp, Homo sapiens
aatagcagcgcagtgttactccagt

SEQ ID NO: 33237 - DNA, 25 bp, Homo sapiens
gacaatggaccatcttcctaggaac

SEQ ID NO: 33238 - DNA, 25 bp, Homo sapiens
aatcgtctgtttcctaaatcctgtt

SEQ ID NO: 33239 - DNA, 25 bp, Homo sapiens
gcctttgtctccgagtactgcagaa

SEQ ID NO: 33240 - DNA, 25 bp, Homo sapiens
cattttgacggtctaccagcgtggc

SEQ ID NO: 33241 - DNA, 25 bp, Homo sapiens
tggcggctggtgttggtcagatgca

SEQ ID NO: 33242 - DNA, 25 bp, Homo sapiens
gcacctgtgtgcactgggggaggga

SEQ ID NO: 33243 - DNA, 25 bp, Homo sapiens
ggcaggtgcagatccaagggctgtg

SEQ ID NO: 33244 - DNA, 25 bp, Homo sapiens
gacatcctgtcttcccagagaaggt

SEQ ID NO: 33245 - DNA, 25 bp, Homo sapiens
gagaaggtggacactcttgggctca

SEQ ID NO: 33246 - DNA, 25 bp, Homo sapiens
gctcattgtaaagtgcctgctgcat

SEQ ID NO: 33247 - DNA, 25 bp, Homo sapiens
acaggtgtgtgctaccacatcttgc

SEQ ID NO: 33248 - DNA, 25 bp, Homo sapiens
cctgttccactgacatttcttagac

SEQ ID NO: 33249 - DNA, 25 bp, Homo sapiens
tcttagacattcagcaaaaccccca

SEQ ID NO: 33250 - DNA, 25 bp, Homo sapiens
tctttcttgagggttggtcctgtcc

SEQ ID NO: 33251 - DNA, 25 bp, Homo sapiens
tggaagaggaagggcccgggcatca

SEQ ID NO: 33252 - DNA, 25 bp, Homo sapiens
agtgtagttagatcccaactcccat

SEQ ID NO: 33253 - DNA, 25 bp, Homo sapiens
acctctggcttcagtggtgggtggg

SEQ ID NO: 33254 - DNA, 25 bp, Homo sapiens
gaaagggcttcagtgggaacctctg

SEQ ID NO: 33255 - DNA, 25 bp, Homo sapiens
aacctctgagagcattttcctgttc

SEQ ID NO: 33256 - DNA, 25 bp, Homo sapiens
ccgcccccagtgataacatctgtga

SEQ ID NO: 33257 - DNA, 25 bp, Homo sapiens
atctgtgaagccagccattactcaa

SEQ ID NO: 33258 - DNA, 25 bp, Homo sapiens
tttcagctcagtgcccatgggcaag

SEQ ID NO: 33259 - DNA, 25 bp, Homo sapiens
catgatttccattccgtgttacaat

SEQ ID NO: 33260 - DNA, 25 bp, Homo sapiens
atgagcataaccttctcagtctcct

SEQ ID NO: 33261 - DNA, 25 bp, Homo sapiens
tcagtctcctgctctcaaatttagg

SEQ ID NO: 33262 - DNA, 25 bp, Homo sapiens
gggagcctctgagggactctttcat

SEQ ID NO: 33263 - DNA, 25 bp, Homo sapiens
gaagcctgggtggcgtcatgagctg

SEQ ID NO: 33264 - DNA, 25 bp, Homo sapiens
tgaaggatcatgctttcctgtcctg

SEQ ID NO: 33265 - DNA, 25 bp, Homo sapiens
cctgtcctggctccataggttatag

SEQ ID NO: 33266 - DNA, 25 bp, Homo sapiens
ggctgaacttcattgcctagctttg

SEQ ID NO: 33267 - DNA, 25 bp, Homo sapiens
tttgttcgttctgagccttcaagga

SEQ ID NO: 33268 - DNA, 25 bp, Homo sapiens
aaagagtttgacctcagagctccag

SEQ ID NO: 33269 - DNA, 25 bp, Homo sapiens
cactgcggcgagcagcttgagtgcc

SEQ ID NO: 33270 - DNA, 25 bp, Homo sapiens
gcttgagtgccggctggacacaggc

SEQ ID NO: 33271 - DNA, 25 bp, Homo sapiens
gagaggtgccggaacctctgtgtgc

SEQ ID NO: 33272 - DNA, 25 bp, Homo sapiens
gtcgttcgcagagtccgctctgcgg

SEQ ID NO: 33273 - DNA, 25 bp, Homo sapiens
ccccagatcgtgtcacatccatatg

SEQ ID NO: 33274 - DNA, 25 bp, Homo sapiens
agagagggccaagactgcagacctt

SEQ ID NO: 33275 - DNA, 25 bp, Homo sapiens
tgcagaccttggggaccgaggacac

SEQ ID NO: 33276 - DNA, 25 bp, Homo sapiens
ggctctgcaagttttgtgccttagc

SEQ ID NO: 33277 - DNA, 25 bp, Homo sapiens
ggcgacatctctggcaagttgggag

SEQ ID NO: 33278 - DNA, 25 bp, Homo sapiens
aggagtgccatctggtggatccttc

SEQ ID NO: 33279 - DNA, 25 bp, Homo sapiens
ggccaggggccttgagacaatttac

SEQ ID NO: 33280 - DNA, 25 bp, Homo sapiens
agttttcatcgtctgctcaataccg

SEQ ID NO: 33281 - DNA, 25 bp, Homo sapiens
tcaataccgtgggttcttcttcgtc

SEQ ID NO: 33282 - DNA, 25 bp, Homo sapiens
cccagtgtgaggccatcaccatgtg

SEQ ID NO: 33283 - DNA, 25 bp, Homo sapiens
aagacatcttggcctgatttgctgc

SEQ ID NO: 33284 - DNA, 25 bp, Homo sapiens
agaaagcggtcctctgaaatggttt

SEQ ID NO: 33285 - DNA, 25 bp, Homo sapiens
tttaaagggactcaaggtgcctgcc

SEQ ID NO: 33286 - DNA, 25 bp, Homo sapiens
cctgccacttcctcagcgaagaagt

SEQ ID NO: 33287 - DNA, 25 bp, Homo sapiens
tcccttcacaatcccagagtggcag

SEQ ID NO: 33288 - DNA, 25 bp, Homo sapiens
gtgccagcacaatctgccaaagttc

SEQ ID NO: 33289 - DNA, 25 bp, Homo sapiens
gccaaagttctagagaccctgttcc

SEQ ID NO: 33290 - DNA, 25 bp, Homo sapiens
acctcacatgcttcttctgtgtgta

SEQ ID NO: 33291 - DNA, 25 bp, Homo sapiens
acaagtgcttgtttagcggagaatt

SEQ ID NO: 33292 - DNA, 25 bp, Homo sapiens
tataactcaattttcacaaccacat

SEQ ID NO: 33293 - DNA, 25 bp, Homo sapiens
caattttcacaaccacatttaccaa

SEQ ID NO: 33294 - DNA, 25 bp, Homo sapiens
aattcatcataatgtctgttcaaca

SEQ ID NO: 33295 - DNA, 25 bp, Homo sapiens
gtctgttcaacattatcttatttgg

SEQ ID NO: 33296 - DNA, 25 bp, Homo sapiens
atggggaaattatcacttacaagta

SEQ ID NO: 33297 - DNA, 25 bp, Homo sapiens
gatggaagaacatacctttgacaaa

SEQ ID NO: 33298 - DNA, 25 bp, Homo sapiens
atcttgatgttaaaacctcaaagca

SEQ ID NO: 33299 - DNA, 25 bp, Homo sapiens
tagtgaggggagggcacgcttgtct

SEQ ID NO: 33300 - DNA, 25 bp, Homo sapiens
gcattgctcccttacttagtatgcc

SEQ ID NO: 33301 - DNA, 25 bp, Homo sapiens
tagtatgccaaatgtcttgaccaat

SEQ ID NO: 33302 - DNA, 25 bp, Homo sapiens
actttaggttcacatacctgcctgc

SEQ ID NO: 33303 - DNA, 25 bp, Homo sapiens
cctgcctgctagtcgggcaacatga

SEQ ID NO: 33304 - DNA, 25 bp, Homo sapiens
gaaacagacctcctgatacctttgc

SEQ ID NO: 33305 - DNA, 25 bp, Homo sapiens
ttgttgttcactttcctcataaaaa

SEQ ID NO: 33306 - DNA, 25 bp, Homo sapiens
tctctctgacacttagacctcaaac

SEQ ID NO: 33307 - DNA, 25 bp, Homo sapiens
gagctgccatccactgtataatttc

SEQ ID NO: 33308 - DNA, 25 bp, Homo sapiens
atttcgcctggcaactggactgagg

SEQ ID NO: 33309 - DNA, 25 bp, Homo sapiens
cagagtgcccagcgtttatcagagg

SEQ ID NO: 33310 - DNA, 25 bp, Homo sapiens
tcagaggcagcatccaagcccagag

SEQ ID NO: 33311 - DNA, 25 bp, Homo sapiens
gagatccactgctatggtcttgata

SEQ ID NO: 33312 - DNA, 25 bp, Homo sapiens
ttgatacatcctcaaactttccctt

SEQ ID NO: 33313 - DNA, 25 bp, Homo sapiens
tttgccttagcacacgttttatgga

SEQ ID NO: 33314 - DNA, 25 bp, Homo sapiens
tgatttgaaactggtgcttgtcgca

SEQ ID NO: 33315 - DNA, 25 bp, Homo sapiens
gtgcttgtcgcagaactgtcagagc

SEQ ID NO: 33316 - DNA, 25 bp, Homo sapiens
agagcatgaggagcgctcctcctgt

SEQ ID NO: 33317 - DNA, 25 bp, Homo sapiens
tcctgtgggtggacgcattcacgca

SEQ ID NO: 33318 - DNA, 25 bp, Homo sapiens
gcacctgctgctggcggtgagcagg

SEQ ID NO: 33319 - DNA, 25 bp, Homo sapiens
ctggcggtgagcagggggttcagca

SEQ ID NO: 33320 - DNA, 25 bp, Homo sapiens
ctctccccagcttaaactttgttgt

SEQ ID NO: 33321 - DNA, 25 bp, Homo sapiens
tattataggcttcaatgttttcatg

SEQ ID NO: 33322 - DNA, 25 bp, Homo sapiens
ttgagtgacacttcattgtaattca

SEQ ID NO: 33323 - DNA, 25 bp, Homo sapiens
agtaatatttcagttgggtatcttt

SEQ ID NO: 33324 - DNA, 25 bp, Homo sapiens
ttctcacttttcatccaggaagccg

SEQ ID NO: 33325 - DNA, 25 bp, Homo sapiens
aagagcaagaatcctcctgcaggct

SEQ ID NO: 33326 - DNA, 25 bp, Homo sapiens
gagctacacaccatttctggacttc

SEQ ID NO: 33327 - DNA, 25 bp, Homo sapiens
ggatcagcaaaactgtcagctccca

SEQ ID NO: 33328 - DNA, 25 bp, Homo sapiens
atcctcactctgagtcttggtatcc

SEQ ID NO: 33329 - DNA, 25 bp, Homo sapiens
ggtgtctgagatttggatccctggt

SEQ ID NO: 33330 - DNA, 25 bp, Homo sapiens
gacaccatgctcacagaactgggct

SEQ ID NO: 33331 - DNA, 25 bp, Homo sapiens
ggctcagagctccattttttgcaga

SEQ ID NO: 33332 - DNA, 25 bp, Homo sapiens
tggttagaagctgctgcaactgccc

SEQ ID NO: 33333 - DNA, 25 bp, Homo sapiens
tttgtggtcgaaaggctcagcctct

SEQ ID NO: 33334 - DNA, 25 bp, Homo sapiens
gctcagcctctctacatgaagtctg

SEQ ID NO: 33335 - DNA, 25 bp, Homo sapiens
tttttatctccacacgcagtatgaa

SEQ ID NO: 33336 - DNA, 25 bp, Homo sapiens
ctaggtagatgcactgctcacctgc

SEQ ID NO: 33337 - DNA, 25 bp, Homo sapiens
tctgacctgctttgcagacgtgcct

SEQ ID NO: 33338 - DNA, 25 bp, Homo sapiens
ctccgcacctcagcagtttggggtg

SEQ ID NO: 33339 - DNA, 25 bp, Homo sapiens
tcacctgtgtcccatagggtgcctt

SEQ ID NO: 33340 - DNA, 25 bp, Homo sapiens
agggtgccttctgaatactgttatt

SEQ ID NO: 33341 - DNA, 25 bp, Homo sapiens
tgttgcagaacgtgaccctgcgtgc

SEQ ID NO: 33342 - DNA, 25 bp, Homo sapiens
ccctgcgtgcaaacatgtaccgtgg

SEQ ID NO: 33343 - DNA, 25 bp, Homo sapiens
acatgtaccgtggcctggtatatga

SEQ ID NO: 33344 - DNA, 25 bp, Homo sapiens
tgtgggcaggatacttttccatggc

SEQ ID NO: 33345 - DNA, 25 bp, Homo sapiens
gtgcctttactgttgtgtggactgc

SEQ ID NO: 33346 - DNA, 25 bp, Homo sapiens
ggagggatcttccatgtacagtgcc

SEQ ID NO: 33347 - DNA, 25 bp, Homo sapiens
tgcccccagttcacttgtatatact

SEQ ID NO: 33348 - DNA, 25 bp, Homo sapiens
ctacggcggtgttgtttaccaggat

SEQ ID NO: 33349 - DNA, 25 bp, Homo sapiens
cactgccgctgcctacagtgacagt

SEQ ID NO: 33350 - DNA, 25 bp, Homo sapiens
acggacgagtttatgctgccgaccc

SEQ ID NO: 33351 - DNA, 25 bp, Homo sapiens
ccacctacggcgttggtgccatgaa

SEQ ID NO: 33352 - DNA, 25 bp, Homo sapiens
gcttttgcacctttgactgatgcca

SEQ ID NO: 33353 - DNA, 25 bp, Homo sapiens
gatgccaagactaggagccatgctg

SEQ ID NO: 33354 - DNA, 25 bp, Homo sapiens
tgctgatgatgtgggtctcgttctt

SEQ ID NO: 33355 - DNA, 25 bp, Homo sapiens
gggatacaaccgttttgctccatac

SEQ ID NO: 33356 - DNA, 25 bp, Homo sapiens
aaaggaagctttccgaggcctgagt

SEQ ID NO: 33357 - DNA, 25 bp, Homo sapiens
ccatccatgacctgggggttgtctt

SEQ ID NO: 33358 - DNA, 25 bp, Homo sapiens
catggagcacctggagaacgggccg

SEQ ID NO: 33359 - DNA, 25 bp, Homo sapiens
ctgtggactataacacctctgaccc

SEQ ID NO: 33360 - DNA, 25 bp, Homo sapiens
gactcctacgacaacttcagtgggc

SEQ ID NO: 33361 - DNA, 25 bp, Homo sapiens
cacacgcaggggccactagatggga

SEQ ID NO: 33362 - DNA, 25 bp, Homo sapiens
accggggctgttaatgccacacgtc

SEQ ID NO: 33363 - DNA, 25 bp, Homo sapiens
attttgtatcatcgtgcctatagcc

SEQ ID NO: 33364 - DNA, 25 bp, Homo sapiens
gctgccaccgtgtataaatcctggt

SEQ ID NO: 33365 - DNA, 25 bp, Homo sapiens
gtatgctccttatcctggacatgaa

SEQ ID NO: 33366 - DNA, 25 bp, Homo sapiens
aatgtattgtacactgacgcgtccc

SEQ ID NO: 33367 - DNA, 25 bp, Homo sapiens
actcctgtacagctgctttgtttct

SEQ ID NO: 33368 - DNA, 25 bp, Homo sapiens
atgcgacggtgtctggtgtcacgtc

SEQ ID NO: 33369 - DNA, 25 bp, Homo sapiens
tcgcctgagaagcccgtcttaggaa

SEQ ID NO: 33370 - DNA, 25 bp, Homo sapiens
acacagtgctcgggaggtttctgct

SEQ ID NO: 33371 - DNA, 25 bp, Homo sapiens
tcatggcagtctcttggtttgtgtc

SEQ ID NO: 33372 - DNA, 25 bp, Homo sapiens
gtctggccaaggccatgcgtgtgcc

SEQ ID NO: 33373 - DNA, 25 bp, Homo sapiens
cgagccccagcttaggcgagggagt

SEQ ID NO: 33374 - DNA, 25 bp, Homo sapiens
ttaggcgagggagtcaggctggctt

SEQ ID NO: 33375 - DNA, 25 bp, Homo sapiens
gctggggggacactagaagcaccgt

SEQ ID NO: 33376 - DNA, 25 bp, Homo sapiens
acgctcactgcctggcttggaaaag

SEQ ID NO: 33377 - DNA, 25 bp, Homo sapiens
aatcgaggctaagttcctctgcgcc

SEQ ID NO: 33378 - DNA, 25 bp, Homo sapiens
atttagtagcgtgacttgcctttcc

SEQ ID NO: 33379 - DNA, 25 bp, Homo sapiens
ggccgccgttcatcagcgaggcggc

SEQ ID NO: 33380 - DNA, 25 bp, Homo sapiens
cgccgtcctggattattgccggacc

SEQ ID NO: 33381 - DNA, 25 bp, Homo sapiens
gctcctcattctcaaggcgggaagg

SEQ ID NO: 33382 - DNA, 25 bp, Homo sapiens
atatttcaaatcacggagacctctc

SEQ ID NO: 33383 - DNA, 25 bp, Homo sapiens
gagacctctctttacaggaggcctc

SEQ ID NO: 33384 - DNA, 25 bp, Homo sapiens
cttcacctacgtcctgttctggacg

SEQ ID NO: 33385 - DNA, 25 bp, Homo sapiens
gcacgtctactgaaatgggggcccg

SEQ ID NO: 33386 - DNA, 25 bp, Homo sapiens
ggactgtggccagcaattaacacca

SEQ ID NO: 33387 - DNA, 25 bp, Homo sapiens
aacaccatgtagacttccttagttc

SEQ ID NO: 33388 - DNA, 25 bp, Homo sapiens
aattcgctgcttgttctgtaacgtt

SEQ ID NO: 33389 - DNA, 25 bp, Homo sapiens
gctccgcgttgttccgcgagaaagc

SEQ ID NO: 33390 - DNA, 25 bp, Homo sapiens
tgcctttgacactcttggaagtcca

SEQ ID NO: 33391 - DNA, 25 bp, Homo sapiens
cttggaagtccatgtagttctctac

SEQ ID NO: 33392 - DNA, 25 bp, Homo sapiens
gttctctacagacagacttcaaaga

SEQ ID NO: 33393 - DNA, 25 bp, Homo sapiens
ttatcaaagactaatctgtgccacc

SEQ ID NO: 33394 - DNA, 25 bp, Homo sapiens
gtgccacctctgattcagtgtttta

SEQ ID NO: 33395 - DNA, 25 bp, Homo sapiens
aaagttcttttctacagctctggga

SEQ ID NO: 33396 - DNA, 25 bp, Homo sapiens
tacagctctgggactattacattta

SEQ ID NO: 33397 - DNA, 25 bp, Homo sapiens
atttaattctgctcttgatagtcaa

SEQ ID NO: 33398 - DNA, 25 bp, Homo sapiens
gaccatggacaacaactgtcatctg

SEQ ID NO: 33399 - DNA, 25 bp, Homo sapiens
caactgtcatctgaaggactcttct

SEQ ID NO: 33400 - DNA, 25 bp, Homo sapiens
agagactggtgtttgatggatgttt

SEQ ID NO: 33401 - DNA, 25 bp, Homo sapiens
actgcaccatcgtgatcatcgttca

SEQ ID NO: 33402 - DNA, 25 bp, Homo sapiens
ttacctgctacgagaacttcaccga

SEQ ID NO: 33403 - DNA, 25 bp, Homo sapiens
acttcaccgataaccagttggacgt

SEQ ID NO: 33404 - DNA, 25 bp, Homo sapiens
catcttctgctactggcgttttgtg

SEQ ID NO: 33405 - DNA, 25 bp, Homo sapiens
gcttcggaccttacaacgtgtccca

SEQ ID NO: 33406 - DNA, 25 bp, Homo sapiens
gaaaaagcccctggtggcggtcaat

SEQ ID NO: 33407 - DNA, 25 bp, Homo sapiens
gtggcggtcaatagccgtggtgttc

SEQ ID NO: 33408 - DNA, 25 bp, Homo sapiens
ccgtggtgttcagttcactcaacgc

SEQ ID NO: 33409 - DNA, 25 bp, Homo sapiens
cttcttcagtggtgcgcagggcatt

SEQ ID NO: 33410 - DNA, 25 bp, Homo sapiens
tcctccctgttgggacgcagaggca

SEQ ID NO: 33411 - DNA, 25 bp, Homo sapiens
ggatgccaagttcggacttcactac

SEQ ID NO: 33412 - DNA, 25 bp, Homo sapiens
acaacagccatacaccgggcagatt

SEQ ID NO: 33413 - DNA, 25 bp, Homo sapiens
tacaccgggcagatttaccagccaa

SEQ ID NO: 33414 - DNA, 25 bp, Homo sapiens
aactcaggcatatactccagcttca

SEQ ID NO: 33415 - DNA, 25 bp, Homo sapiens
ttcacctcagcctttctatggaaac

SEQ ID NO: 33416 - DNA, 25 bp, Homo sapiens
aactttgaggatgagccacctttat

SEQ ID NO: 33417 - DNA, 25 bp, Homo sapiens
gccacattgctactggctggcaaaa

SEQ ID NO: 33418 - DNA, 25 bp, Homo sapiens
aatccagtttggctatgtatacggg

SEQ ID NO: 33419 - DNA, 25 bp, Homo sapiens
ttggttgtgtggcaagtgtccttgg

SEQ ID NO: 33420 - DNA, 25 bp, Homo sapiens
ttctcactgctgggattattggatg

SEQ ID NO: 33421 - DNA, 25 bp, Homo sapiens
tggtgtagtttttctgcttccaaaa

SEQ ID NO: 33422 - DNA, 25 bp, Homo sapiens
cttttagtagcatatccttgcgctt

SEQ ID NO: 33423 - DNA, 25 bp, Homo sapiens
ggtcatgggcgtggacgtaatgttc

SEQ ID NO: 33424 - DNA, 25 bp, Homo sapiens
tgccacttattggcctctcagttgt

SEQ ID NO: 33425 - DNA, 25 bp, Homo sapiens
tctcagttgtacaccgctttggaaa

SEQ ID NO: 33426 - DNA, 25 bp, Homo sapiens
cgctttggaaacagccttcatccca

SEQ ID NO: 33427 - DNA, 25 bp, Homo sapiens
ttcatcccattgtgcgtgttgtcat

SEQ ID NO: 33428 - DNA, 25 bp, Homo sapiens
gtcatgggtgacatctacctgctgc

SEQ ID NO: 33429 - DNA, 25 bp, Homo sapiens
atcccatcatctatggtgccaaaac

SEQ ID NO: 33430 - DNA, 25 bp, Homo sapiens
gccaaaaccaaacagatcagaacac

SEQ ID NO: 33431 - DNA, 25 bp, Homo sapiens
gatcagaacacgggtgctggctatg

SEQ ID NO: 33432 - DNA, 25 bp, Homo sapiens
acgggtgctggctatgttcaagatc

SEQ ID NO: 33433 - DNA, 25 bp, Homo sapiens
agatcagctgtgacaaggacttgca

SEQ ID NO: 33434 - DNA, 25 bp, Homo sapiens
aattcctgcaggagcactttaaccc

SEQ ID NO: 33435 - DNA, 25 bp, Homo sapiens
ccagagacggtacaacccaagctcc

SEQ ID NO: 33436 - DNA, 25 bp, Homo sapiens
ttgcgcaggagctgtagctgccgca

SEQ ID NO: 33437 - DNA, 25 bp, Homo sapiens
cacaaccccactggacgtttgcaaa

SEQ ID NO: 33438 - DNA, 25 bp, Homo sapiens
ttgcaaaacactgctcaacacccag

SEQ ID NO: 33439 - DNA, 25 bp, Homo sapiens
cacccaggagtccttggctttgaac

SEQ ID NO: 33440 - DNA, 25 bp, Homo sapiens
gcatggctagtgccttcaggacggt

SEQ ID NO: 33441 - DNA, 25 bp, Homo sapiens
caagtaggtggggtgaccgcctatt

SEQ ID NO: 33442 - DNA, 25 bp, Homo sapiens
atttccgaggggtgcaggccagagt

SEQ ID NO: 33443 - DNA, 25 bp, Homo sapiens
gcagatgtacaactcaccataccac

SEQ ID NO: 33444 - DNA, 25 bp, Homo sapiens
agccatcgcatggtctgtgtatgag

SEQ ID NO: 33445 - DNA, 25 bp, Homo sapiens
agaacactttgcacagttcggccat

SEQ ID NO: 33446 - DNA, 25 bp, Homo sapiens
gttcggccatgtcagaaggtgcatt

SEQ ID NO: 33447 - DNA, 25 bp, Homo sapiens
tttgacaaggagactggctttcaca

SEQ ID NO: 33448 - DNA, 25 bp, Homo sapiens
ggctttcacagaggtttgggttggg

SEQ ID NO: 33449 - DNA, 25 bp, Homo sapiens
cctcagcagcgcgaggtgctgcggc

SEQ ID NO: 33450 - DNA, 25 bp, Homo sapiens
aggacttcggaatgcactacaacag

SEQ ID NO: 33451 - DNA, 25 bp, Homo sapiens
gtgctgcggcgctgcgtagaagtat

SEQ ID NO: 33452 - DNA, 25 bp, Homo sapiens
gcgtagaagtatcaatcagccggtt

SEQ ID NO: 33453 - DNA, 25 bp, Homo sapiens
caatcagccggttgcttttgtgaga

SEQ ID NO: 33454 - DNA, 25 bp, Homo sapiens
agaagaattccttggactgcggcgt

SEQ ID NO: 33455 - DNA, 25 bp, Homo sapiens
ctgcggcgtcgagtcagctgaaaga

SEQ ID NO: 33456 - DNA, 25 bp, Homo sapiens
tctaggctggatgatgacccacctc

SEQ ID NO: 33457 - DNA, 25 bp, Homo sapiens
tacgctgctcaaagactaccagaat

SEQ ID NO: 33458 - DNA, 25 bp, Homo sapiens
gatgatgtcgtgaaaagactcttgt

SEQ ID NO: 33459 - DNA, 25 bp, Homo sapiens
aatggccaacaagaaggagatgcta

SEQ ID NO: 33460 - DNA, 25 bp, Homo sapiens
gaagaagattgttgcaaacccagag

SEQ ID NO: 33461 - DNA, 25 bp, Homo sapiens
gcaaacccagaggacaccagatccc

SEQ ID NO: 33462 - DNA, 25 bp, Homo sapiens
cagaggacaccagatccctggaggc

SEQ ID NO: 33463 - DNA, 25 bp, Homo sapiens
gatccctggaggctcgaattattgc

SEQ ID NO: 33464 - DNA, 25 bp, Homo sapiens
gaggctcgaattattgccttgtctg

SEQ ID NO: 33465 - DNA, 25 bp, Homo sapiens
aggagactcaaaagctgaagaagcg

SEQ ID NO: 33466 - DNA, 25 bp, Homo sapiens
gaagcgaagaagagccttaaaggct

SEQ ID NO: 33467 - DNA, 25 bp, Homo sapiens
tcagatgactgcgatttgccctctg

SEQ ID NO: 33468 - DNA, 25 bp, Homo sapiens
tgccctctgctcaggacataaacag

SEQ ID NO: 33469 - DNA, 25 bp, Homo sapiens
aacagactcgtgggacttcagaaca

SEQ ID NO: 33470 - DNA, 25 bp, Homo sapiens
atatgggctatctggactaccggaa

SEQ ID NO: 33471 - DNA, 25 bp, Homo sapiens
cacctgctctttcaatcctggtgtg

SEQ ID NO: 33472 - DNA, 25 bp, Homo sapiens
tcctggtgtgattgttgccaacatg

SEQ ID NO: 33473 - DNA, 25 bp, Homo sapiens
aggaaaacctctatagcagctccct

SEQ ID NO: 33474 - DNA, 25 bp, Homo sapiens
attaaccccctgtggcacataaggc

SEQ ID NO: 33475 - DNA, 25 bp, Homo sapiens
ggcacataaggcacctgggctggaa

SEQ ID NO: 33476 - DNA, 25 bp, Homo sapiens
gacataaaccttgggacttccctag

SEQ ID NO: 33477 - DNA, 25 bp, Homo sapiens
ttccctagtgttcacaacgacttat

SEQ ID NO: 33478 - DNA, 25 bp, Homo sapiens
tctgtgttctaatgactgtcctcgt

SEQ ID NO: 33479 - DNA, 25 bp, Homo sapiens
ctcagccaatccgcacatttagctc

SEQ ID NO: 33480 - DNA, 25 bp, Homo sapiens
tttagctctccaactaccatacaac

SEQ ID NO: 33481 - DNA, 25 bp, Homo sapiens
gaccatctctacgttggtattcccc

SEQ ID NO: 33482 - DNA, 25 bp, Homo sapiens
gtattccccgtccatctggagaaaa

SEQ ID NO: 33483 - DNA, 25 bp, Homo sapiens
gactgcaatcattccaaattcccag

SEQ ID NO: 33484 - DNA, 25 bp, Homo sapiens
attcccagctaattgtcattccata

SEQ ID NO: 33485 - DNA, 25 bp, Homo sapiens
aatgtccctcgaagttggagtgcca

SEQ ID NO: 33486 - DNA, 25 bp, Homo sapiens
gcttactgctatagctctcatcggt

SEQ ID NO: 33487 - DNA, 25 bp, Homo sapiens
tctcatcggtgtctgtgttttcatc

SEQ ID NO: 33488 - DNA, 25 bp, Homo sapiens
agcccaccggtttcattttgatgct

SEQ ID NO: 33489 - DNA, 25 bp, Homo sapiens
acaatggcgaggtgcgcaccgccag

SEQ ID NO: 33490 - DNA, 25 bp, Homo sapiens
gcggccaagcacaggctggtggtgc

SEQ ID NO: 33491 - DNA, 25 bp, Homo sapiens
gctggtggtgctggtcaaggacaat

SEQ ID NO: 33492 - DNA, 25 bp, Homo sapiens
tcaaggacaatggcgagcctccgcg

SEQ ID NO: 33493 - DNA, 25 bp, Homo sapiens
caccgtctacctggtggtggcgttg

SEQ ID NO: 33494 - DNA, 25 bp, Homo sapiens
ggcggtgcggctgtgtaggaggagc

SEQ ID NO: 33495 - DNA, 25 bp, Homo sapiens
cccttccagggcatcttgtggacat

SEQ ID NO: 33496 - DNA, 25 bp, Homo sapiens
ttgtggacatgagcggcaccaggac

SEQ ID NO: 33497 - DNA, 25 bp, Homo sapiens
cctatcccagagctaccagtatgag

SEQ ID NO: 33498 - DNA, 25 bp, Homo sapiens
gtgtctggcaggaggctcagggacc

SEQ ID NO: 33499 - DNA, 25 bp, Homo sapiens
tcaagttcctgaagccgattatccc

SEQ ID NO: 33500 - DNA, 25 bp, Homo sapiens
tccgcacttccactaatagccaagt

SEQ ID NO: 33501 - DNA, 25 bp, Homo sapiens
gacagcgtcatccttggtgatacaa

SEQ ID NO: 33502 - DNA, 25 bp, Homo sapiens
cagtatagctactcttattccacct

SEQ ID NO: 33503 - DNA, 25 bp, Homo sapiens
tgcttggcttccttgtacatcatga

SEQ ID NO: 33504 - DNA, 25 bp, Homo sapiens
tgatgaccctgaccagctggtacac

SEQ ID NO: 33505 - DNA, 25 bp, Homo sapiens
tggtacaccctgcaaagtttcagag

SEQ ID NO: 33506 - DNA, 25 bp, Homo sapiens
gagcatgaccagcaagtggccagct

SEQ ID NO: 33507 - DNA, 25 bp, Homo sapiens
gtgtgggtcaagatcagctccagct

SEQ ID NO: 33508 - DNA, 25 bp, Homo sapiens
tcgggacttcagctgaacctctgag

SEQ ID NO: 33509 - DNA, 25 bp, Homo sapiens
gaacctctgagtgccaaggacacca

SEQ ID NO: 33510 - DNA, 25 bp, Homo sapiens
ggaactcacaaaggtctccttcacc

SEQ ID NO: 33511 - DNA, 25 bp, Homo sapiens
ccggcctgataaagcgcgccgactg

SEQ ID NO: 33512 - DNA, 25 bp, Homo sapiens
ccactgtggggctctgagagtcctg

SEQ ID NO: 33513 - DNA, 25 bp, Homo sapiens
tcctgacacccagtggatcaccaaa

SEQ ID NO: 33514 - DNA, 25 bp, Homo sapiens
tgacacccagtggatcaccaaacca

SEQ ID NO: 33515 - DNA, 25 bp, Homo sapiens
acccagtggatcaccaaaccagtcc

SEQ ID NO: 33516 - DNA, 25 bp, Homo sapiens
accaaaccagtccacaagcacaggg

SEQ ID NO: 33517 - DNA, 25 bp, Homo sapiens
tgggctgacatctgcaggccgaaag

SEQ ID NO: 33518 - DNA, 25 bp, Homo sapiens
gctgacatctgcaggccgaaagagc

SEQ ID NO: 33519 - DNA, 25 bp, Homo sapiens
atctgcaggccgaaagagccgtggc

SEQ ID NO: 33520 - DNA, 25 bp, Homo sapiens
gccgaaagagccgtggccttggaaa

SEQ ID NO: 33521 - DNA, 25 bp, Homo sapiens
gaaagagccgtggccttggaaaggg

SEQ ID NO: 33522 - DNA, 25 bp, Homo sapiens
caggtgaccagcatcttcaatctag

SEQ ID NO: 33523 - DNA, 25 bp, Homo sapiens
gcatcttcaatctagttaccaccag

SEQ ID NO: 33524 - DNA, 25 bp, Homo sapiens
gttaccaccagcttggctagaattt

SEQ ID NO: 33525 - DNA, 25 bp, Homo sapiens
caagattctgtaatcctcttgccct

SEQ ID NO: 33526 - DNA, 25 bp, Homo sapiens
gccctctcacatcacaaattctgat

SEQ ID NO: 33527 - DNA, 25 bp, Homo sapiens
atgactgatagacttgctgatgtgc

SEQ ID NO: 33528 - DNA, 25 bp, Homo sapiens
atgaggtgtgtatatgcctttctcc

SEQ ID NO: 33529 - DNA, 25 bp, Homo sapiens
gtgttcaggctgtcattcaaattgg

SEQ ID NO: 33530 - DNA, 25 bp, Homo sapiens
actccttgactgtcacttgtaattg

SEQ ID NO: 33531 - DNA, 25 bp, Homo sapiens
tttcctcatgctgtcatccttaaag

SEQ ID NO: 33532 - DNA, 25 bp, Homo sapiens
actgtcccagccatgttgtacatag

SEQ ID NO: 33533 - DNA, 25 bp, Homo sapiens
ccttagcctccattacttagtatct

SEQ ID NO: 33534 - DNA, 25 bp, Homo sapiens
agtatctcttacagtttgctctggc

SEQ ID NO: 33535 - DNA, 25 bp, Homo sapiens
aaatgggcacctagtcagatcttct

SEQ ID NO: 33536 - DNA, 25 bp, Homo sapiens
cacctagtcagatcttctcagcttg

SEQ ID NO: 33537 - DNA, 25 bp, Homo sapiens
cgttagattgacacttccacacact

SEQ ID NO: 33538 - DNA, 25 bp, Homo sapiens
cacacactccctgtagtccaggtag

SEQ ID NO: 33539 - DNA, 25 bp, Homo sapiens
taggctgagccttgggaatagtttg

SEQ ID NO: 33540 - DNA, 25 bp, Homo sapiens
taacatcccaaggctaacctaacgt

SEQ ID NO: 33541 - DNA, 25 bp, Homo sapiens
ttctgtgcttctaagtgttctgtcc

SEQ ID NO: 33542 - DNA, 25 bp, Homo sapiens
aggctgctattgcttcatgtttcca

SEQ ID NO: 33543 - DNA, 25 bp, Homo sapiens
tgcttgcctaaaactacagtgcccc

SEQ ID NO: 33544 - DNA, 25 bp, Homo sapiens
gaaactgtgtggtgttcgctaaaag

SEQ ID NO: 33545 - DNA, 25 bp, Homo sapiens
aaagtccaaatcttcttgatattgt

SEQ ID NO: 33546 - DNA, 25 bp, Homo sapiens
ttgatattgtgaaccgtaccccttc

SEQ ID NO: 33547 - DNA, 25 bp, Homo sapiens
tagtttcttctggactttccttact

SEQ ID NO: 33548 - DNA, 25 bp, Homo sapiens
aaaattgggcctctactgtgatgat

SEQ ID NO: 33549 - DNA, 25 bp, Homo sapiens
actgtgatgattcctatttcctctc

SEQ ID NO: 33550 - DNA, 25 bp, Homo sapiens
ttcctatttcctctcatgttttaaa

SEQ ID NO: 33551 - DNA, 25 bp, Homo sapiens
cagacacttgtatgcatttccttga

SEQ ID NO: 33552 - DNA, 25 bp, Homo sapiens
gcatttccttgattcaatttgtgac

SEQ ID NO: 33553 - DNA, 25 bp, Homo sapiens
atttgtgaccttaccagttttgaat

SEQ ID NO: 33554 - DNA, 25 bp, Homo sapiens
gaattggaattgcaccatttcgtag

SEQ ID NO: 33555 - DNA, 25 bp, Homo sapiens
tccccaagtcttagctgttgctgct

SEQ ID NO: 33556 - DNA, 25 bp, Homo sapiens
agctgttgctgctcacgatgttgga

SEQ ID NO: 33557 - DNA, 25 bp, Homo sapiens
atgtgcggcattatccacgaggcaa

SEQ ID NO: 33558 - DNA, 25 bp, Homo sapiens
gaggcaaacgggtcatcgagcagct

SEQ ID NO: 33559 - DNA, 25 bp, Homo sapiens
gcagctggtcatgaaccacatgcat

SEQ ID NO: 33560 - DNA, 25 bp, Homo sapiens
gcaggtccgctataatgctctgctg

SEQ ID NO: 33561 - DNA, 25 bp, Homo sapiens
tggccgtgcagaagctcatggtgca

SEQ ID NO: 33562 - DNA, 25 bp, Homo sapiens
aataccttggcaagcagctccagtc

SEQ ID NO: 33563 - DNA, 25 bp, Homo sapiens
tccgcctcaatgcagaaccagtagt

SEQ ID NO: 33564 - DNA, 25 bp, Homo sapiens
tcctctgttatatagcttttcccaa

SEQ ID NO: 33565 - DNA, 25 bp, Homo sapiens
gcttttcccaatgctaatttccaaa

SEQ ID NO: 33566 - DNA, 25 bp, Homo sapiens
gcaccgggtacacttaacgtgtctc

SEQ ID NO: 33567 - DNA, 25 bp, Homo sapiens
acgtgtctctataagccaagttgct

SEQ ID NO: 33568 - DNA, 25 bp, Homo sapiens
aagccaagttgcttcaggaccttca

SEQ ID NO: 33569 - DNA, 25 bp, Homo sapiens
tcaccactggcctctagaatggtcc

SEQ ID NO: 33570 - DNA, 25 bp, Homo sapiens
ctgggggacatgtgtgcccatctgg

SEQ ID NO: 33571 - DNA, 25 bp, Homo sapiens
gtgagtggacctgacaagtgccaga

SEQ ID NO: 33572 - DNA, 25 bp, Homo sapiens
agtgccagagtaaccgtgtagacag

SEQ ID NO: 33573 - DNA, 25 bp, Homo sapiens
gagcagtgtagacagcgctcagccc

SEQ ID NO: 33574 - DNA, 25 bp, Homo sapiens
ccccaggtgtggacctcatgctggt

SEQ ID NO: 33575 - DNA, 25 bp, Homo sapiens
ccagcacagccagtgccatcaggga

SEQ ID NO: 33576 - DNA, 25 bp, Homo sapiens
agagctggtcccagcatggggtgca

SEQ ID NO: 33577 - DNA, 25 bp, Homo sapiens
tgtgtttttccctgtttgtagcaag

SEQ ID NO: 33578 - DNA, 25 bp, Homo sapiens
tgataattctgtttctcatctgccc

SEQ ID NO: 33579 - DNA, 25 bp, Homo sapiens
ctgcccattcagtattttgttttcc

SEQ ID NO: 33580 - DNA, 25 bp, Homo sapiens
ttttccttccgtcaagttgtcttat

SEQ ID NO: 33581 - DNA, 25 bp, Homo sapiens
attttttcaatgactacctctccat

SEQ ID NO: 33582 - DNA, 25 bp, Homo sapiens
gactacctctccatcattgaggttc

SEQ ID NO: 33583 - DNA, 25 bp, Homo sapiens
ttctggtgaagctctctgcagctgt

SEQ ID NO: 33584 - DNA, 25 bp, Homo sapiens
tctcattccttcccaacgatagtaa

SEQ ID NO: 33585 - DNA, 25 bp, Homo sapiens
gactctttagcatcgatacctcaac

SEQ ID NO: 33586 - DNA, 25 bp, Homo sapiens
cttgagagagctcatctaccctgtc

SEQ ID NO: 33587 - DNA, 25 bp, Homo sapiens
tctaccctgtctgttggtcagactc

SEQ ID NO: 33588 - DNA, 25 bp, Homo sapiens
atgtctaagcgttcagtttttcaaa

SEQ ID NO: 33589 - DNA, 25 bp, Homo sapiens
gcagcttattgcgatgtgtatggcc

SEQ ID NO: 33590 - DNA, 25 bp, Homo sapiens
gtgtatggccatgtttcattctcaa

SEQ ID NO: 33591 - DNA, 25 bp, Homo sapiens
acatggctacagcaactgcactgga

SEQ ID NO: 33592 - DNA, 25 bp, Homo sapiens
ctgcactggaacatttttgcttggt

SEQ ID NO: 33593 - DNA, 25 bp, Homo sapiens
tgagaacttgccttgcaggtttcct

SEQ ID NO: 33594 - DNA, 25 bp, Homo sapiens
caggtttccttcctcaaaaggagca

SEQ ID NO: 33595 - DNA, 25 bp, Homo sapiens
aaaggagcagggcagtcctttccct

SEQ ID NO: 33596 - DNA, 25 bp, Homo sapiens
ggttgacattcacaaactgttcttt

SEQ ID NO: 33597 - DNA, 25 bp, Homo sapiens
ttgtgaacatattttggacccttaa

SEQ ID NO: 33598 - DNA, 25 bp, Homo sapiens
acgggttatatgccaactctgtttg

SEQ ID NO: 33599 - DNA, 25 bp, Homo sapiens
atgtctgacttggcgatgccacgct

SEQ ID NO: 33600 - DNA, 25 bp, Homo sapiens
cgctcctaagtagttctgccatgaa

SEQ ID NO: 33601 - DNA, 25 bp, Homo sapiens
aggaaaagccgttacacatcacaca

SEQ ID NO: 33602 - DNA, 25 bp, Homo sapiens
acagcggtggtggcaggaagctcac

SEQ ID NO: 33603 - DNA, 25 bp, Homo sapiens
gctcactctcgcgtcagtattagag

SEQ ID NO: 33604 - DNA, 25 bp, Homo sapiens
aaagtgcctgtgaatcccgatgtgg

SEQ ID NO: 33605 - DNA, 25 bp, Homo sapiens
aaatgatgtgtccacacacgtaccc

SEQ ID NO: 33606 - DNA, 25 bp, Homo sapiens
gcatttctgtgtcatggttctgttt

SEQ ID NO: 33607 - DNA, 25 bp, Homo sapiens
taatcacgtgcggcggtgtctaagt

SEQ ID NO: 33608 - DNA, 25 bp, Homo sapiens
ccagtgtacgcgcagtgaccttgga

SEQ ID NO: 33609 - DNA, 25 bp, Homo sapiens
gaccttggatgacagtggctctttc

SEQ ID NO: 33610 - DNA, 25 bp, Homo sapiens
gccaatttggctggcacgctgagcg

SEQ ID NO: 33611 - DNA, 25 bp, Homo sapiens
cctcctgggtgctgaacgttgcatt

SEQ ID NO: 33612 - DNA, 25 bp, Homo sapiens
tgaacgttgcattctgtcctgatga

SEQ ID NO: 33613 - DNA, 25 bp, Homo sapiens
gcattctgtcctgatgacactcact

SEQ ID NO: 33614 - DNA, 25 bp, Homo sapiens
ctgatgacactcactttgtttccag

SEQ ID NO: 33615 - DNA, 25 bp, Homo sapiens
gtttgggatgttggaacgaggactt

SEQ ID NO: 33616 - DNA, 25 bp, Homo sapiens
acgaggacttgtgttcacaccttct

SEQ ID NO: 33617 - DNA, 25 bp, Homo sapiens
cacaccttctttgatcaccaggatc

SEQ ID NO: 33618 - DNA, 25 bp, Homo sapiens
ggttcaaaaattgtgtctgttggag

SEQ ID NO: 33619 - DNA, 25 bp, Homo sapiens
atgaccaggaaattcacatctatga

SEQ ID NO: 33620 - DNA, 25 bp, Homo sapiens
ggaaattcacatctatgattgtcca

SEQ ID NO: 33621 - DNA, 25 bp, Homo sapiens
ccacctgcgcaatagcccagaagat

SEQ ID NO: 33622 - DNA, 25 bp, Homo sapiens
taagcgggcgggcggtgaagagtca

SEQ ID NO: 33623 - DNA, 25 bp, Homo sapiens
ggacatttaaagcaccagccatcgt

SEQ ID NO: 33624 - DNA, 25 bp, Homo sapiens
taaagcaccagccatcgtgtggagc

SEQ ID NO: 33625 - DNA, 25 bp, Homo sapiens
tcgtgtggagcactaccaaggggcc

SEQ ID NO: 33626 - DNA, 25 bp, Homo sapiens
gatcatactgggcaggcgttggcgt

SEQ ID NO: 33627 - DNA, 25 bp, Homo sapiens
ctcctcttcgtgaacaccagcagat

SEQ ID NO: 33628 - DNA, 25 bp, Homo sapiens
cttcgtgaacaccagcagatacctc

SEQ ID NO: 33629 - DNA, 25 bp, Homo sapiens
gtgcctccactgatgcaggagctgc

SEQ ID NO: 33630 - DNA, 25 bp, Homo sapiens
cccttccttccgaatgatcagcagt

SEQ ID NO: 33631 - DNA, 25 bp, Homo sapiens
tgatgtgcttgggaaagctccctcc

SEQ ID NO: 33632 - DNA, 25 bp, Homo sapiens
tgctgttttccctaccagacaagca

SEQ ID NO: 33633 - DNA, 25 bp, Homo sapiens
taaaatagtagcccaggcttgcctg

SEQ ID NO: 33634 - DNA, 25 bp, Homo sapiens
ggcagggaggtgtggctgccagggc

SEQ ID NO: 33635 - DNA, 25 bp, Homo sapiens
tagaggttggcatcaggctgcccac

SEQ ID NO: 33636 - DNA, 25 bp, Homo sapiens
actggaagccagtggccgtccagag

SEQ ID NO: 33637 - DNA, 25 bp, Homo sapiens
gtggccgtccagaggaacgtgattg

SEQ ID NO: 33638 - DNA, 25 bp, Homo sapiens
gaattgctgtatatccatctggtgg

SEQ ID NO: 33639 - DNA, 25 bp, Homo sapiens
tccatctggtggagcactgctgtgt

SEQ ID NO: 33640 - DNA, 25 bp, Homo sapiens
ggagcactgctgtgtgtctgttaaa

SEQ ID NO: 33641 - DNA, 25 bp, Homo sapiens
taagcttttctttatacttgtccat

SEQ ID NO: 33642 - DNA, 25 bp, Homo sapiens
tacttgtccatagtttccaattttt

SEQ ID NO: 33643 - DNA, 25 bp, Homo sapiens
ttggctttgtggcgctcaacaagga

SEQ ID NO: 33644 - DNA, 25 bp, Homo sapiens
gaggaactgattgccaacttcccag

SEQ ID NO: 33645 - DNA, 25 bp, Homo sapiens
gcagccacggccacagtggaatgcc

SEQ ID NO: 33646 - DNA, 25 bp, Homo sapiens
ttgtaccgtgagaaccagggcctcc

SEQ ID NO: 33647 - DNA, 25 bp, Homo sapiens
cggcccctgacaacgtggagatggc

SEQ ID NO: 33648 - DNA, 25 bp, Homo sapiens
aaatggcactacttggtcccaaact

SEQ ID NO: 33649 - DNA, 25 bp, Homo sapiens
ctgcttgctcacatccatatcagaa

SEQ ID NO: 33650 - DNA, 25 bp, Homo sapiens
actgttatcttcttggccaggggaa

SEQ ID NO: 33651 - DNA, 25 bp, Homo sapiens
tgggctcctttatggtactctatgc

SEQ ID NO: 33652 - DNA, 25 bp, Homo sapiens
gctgcatagggacacccagcgcagc

SEQ ID NO: 33653 - DNA, 25 bp, Homo sapiens
actgggaagtggcctccagtgcagc

SEQ ID NO: 33654 - DNA, 25 bp, Homo sapiens
gtgcaatccgggaccccggaggagc

SEQ ID NO: 33655 - DNA, 25 bp, Homo sapiens
taaagaggctgaaccggagccggag

SEQ ID NO: 33656 - DNA, 25 bp, Homo sapiens
agccagagctggaacccgaggctga

SEQ ID NO: 33657 - DNA, 25 bp, Homo sapiens
agctggaacccgaggctgaagcaga

SEQ ID NO: 33658 - DNA, 25 bp, Homo sapiens
aaccagagccggaactggagccaga

SEQ ID NO: 33659 - DNA, 25 bp, Homo sapiens
gagcccgacttcgaggaaagggacg

SEQ ID NO: 33660 - DNA, 25 bp, Homo sapiens
acgagtccgaagattcctgaaggcc

SEQ ID NO: 33661 - DNA, 25 bp, Homo sapiens
ccgcccatgctggataggacctggg

SEQ ID NO: 33662 - DNA, 25 bp, Homo sapiens
gctggagctgaatcggatgccacca

SEQ ID NO: 33663 - DNA, 25 bp, Homo sapiens
tgaatcggatgccaccaaggctcgg

SEQ ID NO: 33664 - DNA, 25 bp, Homo sapiens
gtccagcccagtaccgctggaagtg

SEQ ID NO: 33665 - DNA, 25 bp, Homo sapiens
ccctggtgagccacttggcagcata

SEQ ID NO: 33666 - DNA, 25 bp, Homo sapiens
gcatatgtaggtaccagctcaaccc

SEQ ID NO: 33667 - DNA, 25 bp, Homo sapiens
ggagggcttagagctcacagccttg

SEQ ID NO: 33668 - DNA, 25 bp, Homo sapiens
aaggccacacacatcattgtcatta

SEQ ID NO: 33669 - DNA, 25 bp, Homo sapiens
ctctctggactgggagctcagtgag

SEQ ID NO: 33670 - DNA, 25 bp, Homo sapiens
gaggattctgaccagtgacttacac

SEQ ID NO: 33671 - DNA, 25 bp, Homo sapiens
ggctgtttgcccaggaacttagggt

SEQ ID NO: 33672 - DNA, 25 bp, Homo sapiens
ttagggtgggtacctctgagtccca

SEQ ID NO: 33673 - DNA, 25 bp, Homo sapiens
tcagccctaatctgcccttaggagt

SEQ ID NO: 33674 - DNA, 25 bp, Homo sapiens
tgcccttaggagtccaggctgcacc

SEQ ID NO: 33675 - DNA, 25 bp, Homo sapiens
tagccccctagtgggacaaggacct

SEQ ID NO: 33676 - DNA, 25 bp, Homo sapiens
aaagtcgttgcagatctaggatgtg

SEQ ID NO: 33677 - DNA, 25 bp, Homo sapiens
ggatgtggttgtggagtacttagca

SEQ ID NO: 33678 - DNA, 25 bp, Homo sapiens
gtacttagcatcggaactgcaatgt

SEQ ID NO: 33679 - DNA, 25 bp, Homo sapiens
gcatcggaactgcaatgttaggagc

SEQ ID NO: 33680 - DNA, 25 bp, Homo sapiens
ttatctaacagaatgtccaagtcat

SEQ ID NO: 33681 - DNA, 25 bp, Homo sapiens
tatgaatcctccctttgggaccaaa

SEQ ID NO: 33682 - DNA, 25 bp, Homo sapiens
agaacagcagtatattccttacaca

SEQ ID NO: 33683 - DNA, 25 bp, Homo sapiens
ttccttacacaaatcctcaactaga

SEQ ID NO: 33684 - DNA, 25 bp, Homo sapiens
cttcgatatgacctgccagcatcat

SEQ ID NO: 33685 - DNA, 25 bp, Homo sapiens
gacctgccagcatcatacaagtttc

SEQ ID NO: 33686 - DNA, 25 bp, Homo sapiens
gccagcatcatacaagtttcacaaa

SEQ ID NO: 33687 - DNA, 25 bp, Homo sapiens
ggaaagagcaggttctacctcagct

SEQ ID NO: 33688 - DNA, 25 bp, Homo sapiens
cctcagctggaggcctttatgaagg

SEQ ID NO: 33689 - DNA, 25 bp, Homo sapiens
ggagttgtttgcttgtgaatctgct

SEQ ID NO: 33690 - DNA, 25 bp, Homo sapiens
agggccactgtgttaattaagcgaa

SEQ ID NO: 33691 - DNA, 25 bp, Homo sapiens
taatgtggtaccagaccagccttct

SEQ ID NO: 33692 - DNA, 25 bp, Homo sapiens
cttctgagcgtgccttgagactagt

SEQ ID NO: 33693 - DNA, 25 bp, Homo sapiens
gacaccctaaaagccatcacaatga

SEQ ID NO: 33694 - DNA, 25 bp, Homo sapiens
ttagtgtgtttatccatcagcccag

SEQ ID NO: 33695 - DNA, 25 bp, Homo sapiens
catcagcccagagcacttactgaga

SEQ ID NO: 33696 - DNA, 25 bp, Homo sapiens
gagagtaaagaggctctagccaccc

SEQ ID NO: 33697 - DNA, 25 bp, Homo sapiens
tgggtcttcccatctaaactggtgg

SEQ ID NO: 33698 - DNA, 25 bp, Homo sapiens
gccacctaccatctcgagaaaagag

SEQ ID NO: 33699 - DNA, 25 bp, Homo sapiens
agaaaagagccgcactgatcctgca

SEQ ID NO: 33700 - DNA, 25 bp, Homo sapiens
tgcagttctttataggccggaggcc

SEQ ID NO: 33701 - DNA, 25 bp, Homo sapiens
gcctgatcaccctaggctcatgaat

SEQ ID NO: 33702 - DNA, 25 bp, Homo sapiens
atgaatgagcgcagtggccatgggg

SEQ ID NO: 33703 - DNA, 25 bp, Homo sapiens
ggaaccgagaccctggggactgatt

SEQ ID NO: 33704 - DNA, 25 bp, Homo sapiens
gactgattgggctgcatacttgcga

SEQ ID NO: 33705 - DNA, 25 bp, Homo sapiens
gaggtgggcaacgtgttctgttaac

SEQ ID NO: 33706 - DNA, 25 bp, Homo sapiens
taacaacagggaaccctcgtccaca

SEQ ID NO: 33707 - DNA, 25 bp, Homo sapiens
aacgctcaccgtaaaggtgtcttca

SEQ ID NO: 33708 - DNA, 25 bp, Homo sapiens
actctagcaaggttcccgtgtggtc

SEQ ID NO: 33709 - DNA, 25 bp, Homo sapiens
gtgaggctcagtcagaacctccacc

SEQ ID NO: 33710 - DNA, 25 bp, Homo sapiens
ctcccccacaccaaagacaggggca

SEQ ID NO: 33711 - DNA, 25 bp, Homo sapiens
ggggcagcgtagtattcaaaccagt

SEQ ID NO: 33712 - DNA, 25 bp, Homo sapiens
gaagagctcttcatgcattctttgc

SEQ ID NO: 33713 - DNA, 25 bp, Homo sapiens
aaagttacgccctcagaacatttat

SEQ ID NO: 33714 - DNA, 25 bp, Homo sapiens
gaatgtgccagttaaagtgctcaac

SEQ ID NO: 33715 - DNA, 25 bp, Homo sapiens
aaactcacatagcttacttctctct

SEQ ID NO: 33716 - DNA, 25 bp, Homo sapiens
agcttacttctctctctaaagtgca

SEQ ID NO: 33717 - DNA, 25 bp, Homo sapiens
taatggttctgcatgacctagccac

SEQ ID NO: 33718 - DNA, 25 bp, Homo sapiens
ctgctgggggttttcttctataacg

SEQ ID NO: 33719 - DNA, 25 bp, Homo sapiens
ttcttctataacgttgtccttgtga

SEQ ID NO: 33720 - DNA, 25 bp, Homo sapiens
ggcaactcaaaatctgcctgagcaa

SEQ ID NO: 33721 - DNA, 25 bp, Homo sapiens
ggctctgcagcagacatcagctaca

SEQ ID NO: 33722 - DNA, 25 bp, Homo sapiens
taatgtcttctgacgtgtttcctct

SEQ ID NO: 33723 - DNA, 25 bp, Homo sapiens
ccccggcagatgactacaactttaa

SEQ ID NO: 33724 - DNA, 25 bp, Homo sapiens
gagtttgtgatctgtttgatgtcca

SEQ ID NO: 33725 - DNA, 25 bp, Homo sapiens
acttgggactgttatctacctctaa

SEQ ID NO: 33726 - DNA, 25 bp, Homo sapiens
aactgtgtaacattttagacttctt

SEQ ID NO: 33727 - DNA, 25 bp, Homo sapiens
cactgattctgaagtgttcttccct

SEQ ID NO: 33728 - DNA, 25 bp, Homo sapiens
agggctctgattgctttaggggata

SEQ ID NO: 33729 - DNA, 25 bp, Homo sapiens
tctaattgtgaatccttctgttttt

SEQ ID NO: 33730 - DNA, 25 bp, Homo sapiens
ccacagaaatccagcatggcaactc

SEQ ID NO: 33731 - DNA, 25 bp, Homo sapiens
cagcggaggcgatacggcctcctcg

SEQ ID NO: 33732 - DNA, 25 bp, Homo sapiens
gacagcgacgaggagacggtctttg

SEQ ID NO: 33733 - DNA, 25 bp, Homo sapiens
gaggagacggtctttgagtcccgga

SEQ ID NO: 33734 - DNA, 25 bp, Homo sapiens
ggtctttgagtcccggaatctgaga

SEQ ID NO: 33735 - DNA, 25 bp, Homo sapiens
gaatctgagatgatgctgagccagg

SEQ ID NO: 33736 - DNA, 25 bp, Homo sapiens
ccagcagccatgagggaaggacagg

SEQ ID NO: 33737 - DNA, 25 bp, Homo sapiens
ctggccgagggtcccaggtgaagac

SEQ ID NO: 33738 - DNA, 25 bp, Homo sapiens
gaagactggagggaccccaacagcc

SEQ ID NO: 33739 - DNA, 25 bp, Homo sapiens
ttctcgccgggctgggaacaataaa

SEQ ID NO: 33740 - DNA, 25 bp, Homo sapiens
gaacaataaatgcagccatgtctct

SEQ ID NO: 33741 - DNA, 25 bp, Homo sapiens
aatgcagccatgtctctgcaaaaaa

SEQ ID NO: 33742 - DNA, 25 bp, Homo sapiens
atggcccagctgttgactatgagaa

SEQ ID NO: 33743 - DNA, 25 bp, Homo sapiens
atgagaaccaagatgtggcttcctc

SEQ ID NO: 33744 - DNA, 25 bp, Homo sapiens
ctagttggccagtcatcctgaagcc

SEQ ID NO: 33745 - DNA, 25 bp, Homo sapiens
caaagaagttgccaaagcctcctgc

SEQ ID NO: 33746 - DNA, 25 bp, Homo sapiens
ccacagccgggctggcagacatgac

SEQ ID NO: 33747 - DNA, 25 bp, Homo sapiens
ggcagacatgacggcagagctacag

SEQ ID NO: 33748 - DNA, 25 bp, Homo sapiens
gagaagaggcgggcactggagcact

SEQ ID NO: 33749 - DNA, 25 bp, Homo sapiens
tggagcactgattcggacacaccag

SEQ ID NO: 33750 - DNA, 25 bp, Homo sapiens
atggcccagcggccagattcttttt

SEQ ID NO: 33751 - DNA, 25 bp, Homo sapiens
ggtgccattcctgttagacgaggac

SEQ ID NO: 33752 - DNA, 25 bp, Homo sapiens
tgtcacctgcgtctagccaggacaa

SEQ ID NO: 33753 - DNA, 25 bp, Homo sapiens
ctttcactctactcagttcctgagg

SEQ ID NO: 33754 - DNA, 25 bp, Homo sapiens
gaagaaagcatctcacagctccgac

SEQ ID NO: 33755 - DNA, 25 bp, Homo sapiens
cagctccgacactattgcgagccat

SEQ ID NO: 33756 - DNA, 25 bp, Homo sapiens
gcgagccatacacaacctggtgtca

SEQ ID NO: 33757 - DNA, 25 bp, Homo sapiens
atgactatctccaaaatgcacctcc

SEQ ID NO: 33758 - DNA, 25 bp, Homo sapiens
tggttttgctggccttattggactc

SEQ ID NO: 33759 - DNA, 25 bp, Homo sapiens
aaagaagctagtgtatccgcctggt

SEQ ID NO: 33760 - DNA, 25 bp, Homo sapiens
tttcatgggattagctgcctccctc

SEQ ID NO: 33761 - DNA, 25 bp, Homo sapiens
cacaacaagccatcgtgtttgccca

SEQ ID NO: 33762 - DNA, 25 bp, Homo sapiens
gacctctgttatcttctgtgaaatc

SEQ ID NO: 33763 - DNA, 25 bp, Homo sapiens
gcaaactaacctggaatcccttcac

SEQ ID NO: 33764 - DNA, 25 bp, Homo sapiens
aagccagccaggactagtgaaccac

SEQ ID NO: 33765 - DNA, 25 bp, Homo sapiens
gatgagagctaaacctcttccacta

SEQ ID NO: 33766 - DNA, 25 bp, Homo sapiens
agccttcagactcagtggttgtttc

SEQ ID NO: 33767 - DNA, 25 bp, Homo sapiens
actgacctcccctagagggatgtct

SEQ ID NO: 33768 - DNA, 25 bp, Homo sapiens
ctctctagcagtcaactccatttgt

SEQ ID NO: 33769 - DNA, 25 bp, Homo sapiens
gtaataaagccctagcactctgaaa

SEQ ID NO: 33770 - DNA, 25 bp, Homo sapiens
agaagaagctgttcaaacgccggcg

SEQ ID NO: 33771 - DNA, 25 bp, Homo sapiens
ttgaatcgggagcggcgtctgaggc

SEQ ID NO: 33772 - DNA, 25 bp, Homo sapiens
ggggctgtgatagaccaagggctga

SEQ ID NO: 33773 - DNA, 25 bp, Homo sapiens
gtgcacgtgccaacattacactgtc

SEQ ID NO: 33774 - DNA, 25 bp, Homo sapiens
gaagaagcgcagaaaactcctccag

SEQ ID NO: 33775 - DNA, 25 bp, Homo sapiens
tatgaacttgcgtgggctactgctt

SEQ ID NO: 33776 - DNA, 25 bp, Homo sapiens
tgtagctttggtggttctcgaccgt

SEQ ID NO: 33777 - DNA, 25 bp, Homo sapiens
ctctttctttcttcacaggtatgct

SEQ ID NO: 33778 - DNA, 25 bp, Homo sapiens
gagtacacagtgaagtggcctccct

SEQ ID NO: 33779 - DNA, 25 bp, Homo sapiens
gcatacaaccaccaatgtctttcat

SEQ ID NO: 33780 - DNA, 25 bp, Homo sapiens
gtctttcatttcacgttcatgtcgg

SEQ ID NO: 33781 - DNA, 25 bp, Homo sapiens
tagatgggcagcggcatttcaactc

SEQ ID NO: 33782 - DNA, 25 bp, Homo sapiens
ttcaactccatgagtggcccagcga

SEQ ID NO: 33783 - DNA, 25 bp, Homo sapiens
gactaccttgtggagccctaagaac

SEQ ID NO: 33784 - DNA, 25 bp, Homo sapiens
agcactctacccacagtgacgtggt

SEQ ID NO: 33785 - DNA, 25 bp, Homo sapiens
gattttagtattgcttcgtgtcctc

SEQ ID NO: 33786 - DNA, 25 bp, Homo sapiens
gcagctgggctcttaatgttactta

SEQ ID NO: 33787 - DNA, 25 bp, Homo sapiens
acttattgtaactcacttcctgtaa

SEQ ID NO: 33788 - DNA, 25 bp, Homo sapiens
gtaagactcaatctactcttcaagt

SEQ ID NO: 33789 - DNA, 25 bp, Homo sapiens
tcttcaagttgatgtaccctctatg

SEQ ID NO: 33790 - DNA, 25 bp, Homo sapiens
gtaccctctatgactgtaattcctg

SEQ ID NO: 33791 - DNA, 25 bp, Homo sapiens
ctgtggtgatcttaagcgtgtcttg

SEQ ID NO: 33792 - DNA, 25 bp, Homo sapiens
gcgtgtcttgagttccatgcaaatt

SEQ ID NO: 33793 - DNA, 25 bp, Homo sapiens
gtgtccataatcaaatcatcatctt

SEQ ID NO: 33794 - DNA, 25 bp, Homo sapiens
aagggctaccccataattatcagac

SEQ ID NO: 33795 - DNA, 25 bp, Homo sapiens
tctttttccattctgtaatcttaaa

SEQ ID NO: 33796 - DNA, 25 bp, Homo sapiens
tcagcttcagtgcctgttcacaata

SEQ ID NO: 33797 - DNA, 25 bp, Homo sapiens
atgggcctggactctccagaaacta

SEQ ID NO: 33798 - DNA, 25 bp, Homo sapiens
gactctccagaaactacttgggcca

SEQ ID NO: 33799 - DNA, 25 bp, Homo sapiens
gaggagttttagggcttggggagag

SEQ ID NO: 33800 - DNA, 25 bp, Homo sapiens
gagggaggacacatctggaggaaat

SEQ ID NO: 33801 - DNA, 25 bp, Homo sapiens
aaaacacaaaacctcacaactgcct

SEQ ID NO: 33802 - DNA, 25 bp, Homo sapiens
tgcctggcaagcccagtatcacttg

SEQ ID NO: 33803 - DNA, 25 bp, Homo sapiens
ccagtatcacttgtttgggccctag

SEQ ID NO: 33804 - DNA, 25 bp, Homo sapiens
aagtctgtacatattggagctctgg

SEQ ID NO: 33805 - DNA, 25 bp, Homo sapiens
ggagctctgggagatgctggaataa

SEQ ID NO: 33806 - DNA, 25 bp, Homo sapiens
atctggcaggtgcccttgatgctat

SEQ ID NO: 33807 - DNA, 25 bp, Homo sapiens
tctcgtgctctaggacctgcacggg

SEQ ID NO: 33808 - DNA, 25 bp, Homo sapiens
gggacttaacatttcacgttgtatc

SEQ ID NO: 33809 - DNA, 25 bp, Homo sapiens
acgttgtatcttacttgcagtgaat

SEQ ID NO: 33810 - DNA, 25 bp, Homo sapiens
tgcaagggttacttttctctgggga

SEQ ID NO: 33811 - DNA, 25 bp, Homo sapiens
ccatgccgcatggtttggttaatga

SEQ ID NO: 33812 - DNA, 25 bp, Homo sapiens
gcttccacatgcctggcctaaaatg

SEQ ID NO: 33813 - DNA, 25 bp, Homo sapiens
atacaggtcttatatccccatatgg

SEQ ID NO: 33814 - DNA, 25 bp, Homo sapiens
tggaatttatccatcaaccacataa

SEQ ID NO: 33815 - DNA, 25 bp, Homo sapiens
tcaaagtttccacattagcactccc

SEQ ID NO: 33816 - DNA, 25 bp, Homo sapiens
taaggacgctgggagcctgtcagtt

SEQ ID NO: 33817 - DNA, 25 bp, Homo sapiens
gtttatgatctgacctaggtccccc

SEQ ID NO: 33818 - DNA, 25 bp, Homo sapiens
tatgggcgggacgtgtgtgtcatta

SEQ ID NO: 33819 - DNA, 25 bp, Homo sapiens
aactaattctgattgtgtcgtgccc

SEQ ID NO: 33820 - DNA, 25 bp, Homo sapiens
ttctgattgtgtcgtgcccaagtac

SEQ ID NO: 33821 - DNA, 25 bp, Homo sapiens
tagggaccaatgccacattgctttt

SEQ ID NO: 33822 - DNA, 25 bp, Homo sapiens
ttgtattttgctactttgcagtatt

SEQ ID NO: 33823 - DNA, 25 bp, Homo sapiens
caaagcagtagccacatggtgctgg

SEQ ID NO: 33824 - DNA, 25 bp, Homo sapiens
gcacaaacctggtcattttgatgac

SEQ ID NO: 33825 - DNA, 25 bp, Homo sapiens
gtggattcatattaccaccgctctc

SEQ ID NO: 33826 - DNA, 25 bp, Homo sapiens
ccaccgctctcatttcatggagtct

SEQ ID NO: 33827 - DNA, 25 bp, Homo sapiens
aagctcacgtcgtatttcttctttt

SEQ ID NO: 33828 - DNA, 25 bp, Homo sapiens
ggaattttgcttctcggttatcctg

SEQ ID NO: 33829 - DNA, 25 bp, Homo sapiens
tctcggttatcctgtgcttcagatg

SEQ ID NO: 33830 - DNA, 25 bp, Homo sapiens
tcaataaatgccccaactgctttgt

SEQ ID NO: 33831 - DNA, 25 bp, Homo sapiens
gcgcagcatggaggactttgtcact

SEQ ID NO: 33832 - DNA, 25 bp, Homo sapiens
tttgtcacttgggtggactcgtcca

SEQ ID NO: 33833 - DNA, 25 bp, Homo sapiens
gactcgtccaagatcaagcggcacg

SEQ ID NO: 33834 - DNA, 25 bp, Homo sapiens
ggagcgcgatgacttcgatctggaa

SEQ ID NO: 33835 - DNA, 25 bp, Homo sapiens
cccactttgcatggctgtcttttac

SEQ ID NO: 33836 - DNA, 25 bp, Homo sapiens
gaggcctgatgctggagattctatg

SEQ ID NO: 33837 - DNA, 25 bp, Homo sapiens
ggtgctctcctcaagggtatcagac

SEQ ID NO: 33838 - DNA, 25 bp, Homo sapiens
gcatagagccacgggaggtgcgtcc

SEQ ID NO: 33839 - DNA, 25 bp, Homo sapiens
ctcctggccgtggttaagctgtgta

SEQ ID NO: 33840 - DNA, 25 bp, Homo sapiens
atctcctcccttgtttaaatgtcaa

SEQ ID NO: 33841 - DNA, 25 bp, Homo sapiens
ggggctttgaaataacaccaccagt

SEQ ID NO: 33842 - DNA, 25 bp, Homo sapiens
caccaccagtggtcttaaggttgaa

SEQ ID NO: 33843 - DNA, 25 bp, Homo sapiens
gaagtgtggttcagggccagtgcat

SEQ ID NO: 33844 - DNA, 25 bp, Homo sapiens
gggccagtgcatattagtggacagc

SEQ ID NO: 33845 - DNA, 25 bp, Homo sapiens
tatatctggaaagcggtctgcccct

SEQ ID NO: 33846 - DNA, 25 bp, Homo sapiens
tctgcccctggaggtggtagcaagg

SEQ ID NO: 33847 - DNA, 25 bp, Homo sapiens
gagatactccagccaaaaatgcaca

SEQ ID NO: 33848 - DNA, 25 bp, Homo sapiens
gactcaaaaccatcatcaacaccaa

SEQ ID NO: 33849 - DNA, 25 bp, Homo sapiens
acaccaaaaggacctagttctgtag

SEQ ID NO: 33850 - DNA, 25 bp, Homo sapiens
aaagcgcattgaacagtcctgggca

SEQ ID NO: 33851 - DNA, 25 bp, Homo sapiens
aacagtcctgggcactacatgtaaa

SEQ ID NO: 33852 - DNA, 25 bp, Homo sapiens
tgttctgctgcttagccagttcatc

SEQ ID NO: 33853 - DNA, 25 bp, Homo sapiens
agtgtgtgaagatggcccaccgagc

SEQ ID NO: 33854 - DNA, 25 bp, Homo sapiens
tattaccaaatcacaggcctcggct

SEQ ID NO: 33855 - DNA, 25 bp, Homo sapiens
gcctcggcttcctgaaggagttgtt

SEQ ID NO: 33856 - DNA, 25 bp, Homo sapiens
gagttgttccgaagagcaaacccca

SEQ ID NO: 33857 - DNA, 25 bp, Homo sapiens
ctccgtcaagcccatctacaaaaaa

SEQ ID NO: 33858 - DNA, 25 bp, Homo sapiens
cccgctggaacagggtgcgcatgcc

SEQ ID NO: 33859 - DNA, 25 bp, Homo sapiens
aatgtctgctactcaagaacacctt

SEQ ID NO: 33860 - DNA, 25 bp, Homo sapiens
ctggtccctccaacatgcatggaca

SEQ ID NO: 33861 - DNA, 25 bp, Homo sapiens
gtgggactaacttcagtacccttgg

SEQ ID NO: 33862 - DNA, 25 bp, Homo sapiens
cccttggcctgcacagtagcaatgc

SEQ ID NO: 33863 - DNA, 25 bp, Homo sapiens
gaaatacacccgtcagattctggag

SEQ ID NO: 33864 - DNA, 25 bp, Homo sapiens
ggcgcaaatatccttcgagattcaa

SEQ ID NO: 33865 - DNA, 25 bp, Homo sapiens
agcaaacggcttcagaccatctgtc

SEQ ID NO: 33866 - DNA, 25 bp, Homo sapiens
gtcacgggcacaccatactggatga

SEQ ID NO: 33867 - DNA, 25 bp, Homo sapiens
tctggagtgttgcatgtaccgtggt

SEQ ID NO: 33868 - DNA, 25 bp, Homo sapiens
tgctaactgaaaagccgccttgggc

SEQ ID NO: 33869 - DNA, 25 bp, Homo sapiens
ctgccatctttaaaatcgccactca

SEQ ID NO: 33870 - DNA, 25 bp, Homo sapiens
ccactcagccaacaaacccaaagct

SEQ ID NO: 33871 - DNA, 25 bp, Homo sapiens
tcagactatactcgagatttcctca

SEQ ID NO: 33872 - DNA, 25 bp, Homo sapiens
gaggccaaactgagaccttcagctg

SEQ ID NO: 33873 - DNA, 25 bp, Homo sapiens
tatcactagcagccagtaacctctc

SEQ ID NO: 33874 - DNA, 25 bp, Homo sapiens
gcgatgcagaaatgaaccaccggag

SEQ ID NO: 33875 - DNA, 25 bp, Homo sapiens
accaccggagttcaatgcgagttct

SEQ ID NO: 33876 - DNA, 25 bp, Homo sapiens
gcgagttcttggggatgttgtcagg

SEQ ID NO: 33877 - DNA, 25 bp, Homo sapiens
ggtgtcggaaacaagccatcctcat

SEQ ID NO: 33878 - DNA, 25 bp, Homo sapiens
gccatcctcatctctagaagtaagc

SEQ ID NO: 33879 - DNA, 25 bp, Homo sapiens
caaatgccgaagagctcagacaccc

SEQ ID NO: 33880 - DNA, 25 bp, Homo sapiens
gggttgactctttggtgtcactttc

SEQ ID NO: 33881 - DNA, 25 bp, Homo sapiens
atgtcacagatctaagcagcaggga

SEQ ID NO: 33882 - DNA, 25 bp, Homo sapiens
ttactgtacatcagccatttcctct

SEQ ID NO: 33883 - DNA, 25 bp, Homo sapiens
catttcctctccattgacaaaatcc

SEQ ID NO: 33884 - DNA, 25 bp, Homo sapiens
ctggattggacaattcacggccctt

SEQ ID NO: 33885 - DNA, 25 bp, Homo sapiens
tggaattagaccatttggcctttga

SEQ ID NO: 33886 - DNA, 25 bp, Homo sapiens
acccaacatttcttagcatgagcta

SEQ ID NO: 33887 - DNA, 25 bp, Homo sapiens
gctacctcatctctagaagctggga

SEQ ID NO: 33888 - DNA, 25 bp, Homo sapiens
gctgggatggacttactattcttgt

SEQ ID NO: 33889 - DNA, 25 bp, Homo sapiens
ggtgctatgcttctgttattattcc

SEQ ID NO: 33890 - DNA, 25 bp, Homo sapiens
atgatggtgctaaaattcttcctat

SEQ ID NO: 33891 - DNA, 25 bp, Homo sapiens
cataactgttagacttcccgtttct

SEQ ID NO: 33892 - DNA, 25 bp, Homo sapiens
aagagcatcgttccaatgcttgttc

SEQ ID NO: 33893 - DNA, 25 bp, Homo sapiens
gctttgtaatacttgcatgcttctt

SEQ ID NO: 33894 - DNA, 25 bp, Homo sapiens
agaacatgtaggtccccttgtgtct

SEQ ID NO: 33895 - DNA, 25 bp, Homo sapiens
gcatttgttggctctattttaattt

SEQ ID NO: 33896 - DNA, 25 bp, Homo sapiens
tagattccggtatatcgttcttcaa

SEQ ID NO: 33897 - DNA, 25 bp, Homo sapiens
gttcttcaagacacttgctctaagc

SEQ ID NO: 33898 - DNA, 25 bp, Homo sapiens
cccatcatagatcttgctcctgtgg

SEQ ID NO: 33899 - DNA, 25 bp, Homo sapiens
tgctcctgtggatgttggcggcaca

SEQ ID NO: 33900 - DNA, 25 bp, Homo sapiens
gttggcggcacagaccaggaattcg

SEQ ID NO: 33901 - DNA, 25 bp, Homo sapiens
aattcggcgttgaaattgggccagt

SEQ ID NO: 33902 - DNA, 25 bp, Homo sapiens
gacacatcgacaatgagcaccacca

SEQ ID NO: 33903 - DNA, 25 bp, Homo sapiens
ccaccgccattcacaagaactttga

SEQ ID NO: 33904 - DNA, 25 bp, Homo sapiens
tgaagttgatcctgagactcttgaa

SEQ ID NO: 33905 - DNA, 25 bp, Homo sapiens
gactcttgaagtaatggctgatcct

SEQ ID NO: 33906 - DNA, 25 bp, Homo sapiens
gatgaccaatgacaatgaccacctt

SEQ ID NO: 33907 - DNA, 25 bp, Homo sapiens
ctccccctttgaaactcaagcacag

SEQ ID NO: 33908 - DNA, 25 bp, Homo sapiens
ctttcccccgctatgtcataggtag

SEQ ID NO: 33909 - DNA, 25 bp, Homo sapiens
tctgaagagctcagctgtcaccggg

SEQ ID NO: 33910 - DNA, 25 bp, Homo sapiens
tgtcaccgggcatagcctggaagcc

SEQ ID NO: 33911 - DNA, 25 bp, Homo sapiens
gcctcctagatcattgtccttgatg

SEQ ID NO: 33912 - DNA, 25 bp, Homo sapiens
gtggctgaattgagaccttgctgat

SEQ ID NO: 33913 - DNA, 25 bp, Homo sapiens
gatgtattcatgtcagcacctgagt

SEQ ID NO: 33914 - DNA, 25 bp, Homo sapiens
agcagcctcttcgcataggcagtga

SEQ ID NO: 33915 - DNA, 25 bp, Homo sapiens
tctctgttcgctgctgtcagcataa

SEQ ID NO: 33916 - DNA, 25 bp, Homo sapiens
gcataatgattgtgttccttcccta

SEQ ID NO: 33917 - DNA, 25 bp, Homo sapiens
tccttccctatgggatccatctgtt

SEQ ID NO: 33918 - DNA, 25 bp, Homo sapiens
gaaatctatttttaactcttatgtt

SEQ ID NO: 33919 - DNA, 25 bp, Homo sapiens
attgtaattttcctacttctttgat

SEQ ID NO: 33920 - DNA, 25 bp, Homo sapiens
tgggggttctgggcacagacatcta

SEQ ID NO: 33921 - DNA, 25 bp, Homo sapiens
gcacagacatctaacctggtattgt

SEQ ID NO: 33922 - DNA, 25 bp, Homo sapiens
ggtattgtaaggcagaggctcccat

SEQ ID NO: 33923 - DNA, 25 bp, Homo sapiens
aggcagaggctcccattggaatggt

SEQ ID NO: 33924 - DNA, 25 bp, Homo sapiens
gaatggtagtggtccgggtcagttg

SEQ ID NO: 33925 - DNA, 25 bp, Homo sapiens
gtccgggtcagttgttcatggtgta

SEQ ID NO: 33926 - DNA, 25 bp, Homo sapiens
ggtgtaagctttgcacagtgtatta

SEQ ID NO: 33927 - DNA, 25 bp, Homo sapiens
gtattaacattgggagggtctggct

SEQ ID NO: 33928 - DNA, 25 bp, Homo sapiens
cttgaaaatttggccaccctcagcc

SEQ ID NO: 33929 - DNA, 25 bp, Homo sapiens
aggtgctttaggtctggttcagggt

SEQ ID NO: 33930 - DNA, 25 bp, Homo sapiens
gggtcgggcattctttgttgtttgc

SEQ ID NO: 33931 - DNA, 25 bp, Homo sapiens
gaattctaatgccgtcttaagtttt

SEQ ID NO: 33932 - DNA, 25 bp, Homo sapiens
gtgtgatggatgatgctgctggttg

SEQ ID NO: 33933 - DNA, 25 bp, Homo sapiens
atgagggaccgttgagctcactacc

SEQ ID NO: 33934 - DNA, 25 bp, Homo sapiens
agctcactaccacctggagtttgag

SEQ ID NO: 33935 - DNA, 25 bp, Homo sapiens
atctgcacgtgcccttgtagaggat

SEQ ID NO: 33936 - DNA, 25 bp, Homo sapiens
tgtagaggatccttaccgtcctaga

SEQ ID NO: 33937 - DNA, 25 bp, Homo sapiens
tacttgctccaaaagaccctctgag

SEQ ID NO: 33938 - DNA, 25 bp, Homo sapiens
gaccctctgagttaacgtttcagct

SEQ ID NO: 33939 - DNA, 25 bp, Homo sapiens
tcctctgaactgttactgcctgaat

SEQ ID NO: 33940 - DNA, 25 bp, Homo sapiens
cctctgtcctcaaatgtccaaaatg

SEQ ID NO: 33941 - DNA, 25 bp, Homo sapiens
ttggaggacctctgttcatatccca

SEQ ID NO: 33942 - DNA, 25 bp, Homo sapiens
ggctcttgccagcagtggagttact

SEQ ID NO: 33943 - DNA, 25 bp, Homo sapiens
gagttactgtagagggatgtcccaa

SEQ ID NO: 33944 - DNA, 25 bp, Homo sapiens
agagggatgtcccaagcttgttttc

SEQ ID NO: 33945 - DNA, 25 bp, Homo sapiens
tttgaaactctcctgtgtctgtgtt

SEQ ID NO: 33946 - DNA, 25 bp, Homo sapiens
gtgtgtgagagcacatcagtgtgtg

SEQ ID NO: 33947 - DNA, 25 bp, Homo sapiens
gcacatcagtgtgtgcaggctgtgt

SEQ ID NO: 33948 - DNA, 25 bp, Homo sapiens
tcccttcagacccatcattgagaac

SEQ ID NO: 33949 - DNA, 25 bp, Homo sapiens
caggccctctgcgggggaaacaaga

SEQ ID NO: 33950 - DNA, 25 bp, Homo sapiens
gggaaacaagatcacccagcatcct

SEQ ID NO: 33951 - DNA, 25 bp, Homo sapiens
atattttgtatcatcgtgcctatag

SEQ ID NO: 33952 - DNA, 25 bp, Homo sapiens
attttgtatcatcgtgcctatagcc

SEQ ID NO: 33953 - DNA, 25 bp, Homo sapiens
cgctgccaccgtgtataaatcctgg

SEQ ID NO: 33954 - DNA, 25 bp, Homo sapiens
tgccaccgtgtataaatcctggtgt

SEQ ID NO: 33955 - DNA, 25 bp, Homo sapiens
tgctccttatcctggacatgaatgt

SEQ ID NO: 33956 - DNA, 25 bp, Homo sapiens
tccttatcctggacatgaatgtatt

SEQ ID NO: 33957 - DNA, 25 bp, Homo sapiens
aatgtattgtacactgacgcgtccc

SEQ ID NO: 33958 - DNA, 25 bp, Homo sapiens
agctgctttgtttctttgcaatgca

SEQ ID NO: 33959 - DNA, 25 bp, Homo sapiens
gctgctttgtttctttgcaatgcat

SEQ ID NO: 33960 - DNA, 25 bp, Homo sapiens
gctttgtttctttgcaatgcattgt

SEQ ID NO: 33961 - DNA, 25 bp, Homo sapiens
ctttgcaatgcattgtatggcttta

SEQ ID NO: 33962 - DNA, 25 bp, Homo sapiens
ttctgagacacatcgtcctgctgag

SEQ ID NO: 33963 - DNA, 25 bp, Homo sapiens
tgagagcccagatgcttaggtccac

SEQ ID NO: 33964 - DNA, 25 bp, Homo sapiens
gtccactagggcccatctagggaag

SEQ ID NO: 33965 - DNA, 25 bp, Homo sapiens
gaaaggagatttcagcggcttcccc

SEQ ID NO: 33966 - DNA, 25 bp, Homo sapiens
gtcgggatgcttcccggatgtctac

SEQ ID NO: 33967 - DNA, 25 bp, Homo sapiens
cagtgagattactgcttcctgtttc

SEQ ID NO: 33968 - DNA, 25 bp, Homo sapiens
aagagggatctgtagtcgctgcctg

SEQ ID NO: 33969 - DNA, 25 bp, Homo sapiens
tctgtgggcggcccctttaagactc

SEQ ID NO: 33970 - DNA, 25 bp, Homo sapiens
gcaaactatggcatgtggccccgtg

SEQ ID NO: 33971 - DNA, 25 bp, Homo sapiens
ggccccgtgagctaggaatggtttt

SEQ ID NO: 33972 - DNA, 25 bp, Homo sapiens
ggctcaagcgatggcttttaccttt

SEQ ID NO: 33973 - DNA, 25 bp, Homo sapiens
ggagcctcatggagtcaggtgccaa

SEQ ID NO: 33974 - DNA, 25 bp, Homo sapiens
gtgctgatccaggagtggttcaccc

SEQ ID NO: 33975 - DNA, 25 bp, Homo sapiens
ggagcgaaggttcgagctgctgagc

SEQ ID NO: 33976 - DNA, 25 bp, Homo sapiens
gggccatgctggccatcgaagactg

SEQ ID NO: 33977 - DNA, 25 bp, Homo sapiens
agactggcagaaaacgtccgctcag

SEQ ID NO: 33978 - DNA, 25 bp, Homo sapiens
caccgagagcagctcctactggagg

SEQ ID NO: 33979 - DNA, 25 bp, Homo sapiens
gtgaaccagcgcgatgagctagtcc

SEQ ID NO: 33980 - DNA, 25 bp, Homo sapiens
gggacctggaccacaaggagcggat

SEQ ID NO: 33981 - DNA, 25 bp, Homo sapiens
ccacaaggagcggatcgccctggag

SEQ ID NO: 33982 - DNA, 25 bp, Homo sapiens
cgccgcaagctgagccggcagttga

SEQ ID NO: 33983 - DNA, 25 bp, Homo sapiens
ccggcagttgagccggcgggagcgc

SEQ ID NO: 33984 - DNA, 25 bp, Homo sapiens
cttggtgtcctggtgtgaatagaca

SEQ ID NO: 33985 - DNA, 25 bp, Homo sapiens
gaagctgtactatatgttgctctct

SEQ ID NO: 33986 - DNA, 25 bp, Homo sapiens
actatatgttgctctctcagtggca

SEQ ID NO: 33987 - DNA, 25 bp, Homo sapiens
gctctctcagtggcaacaatgaagt

SEQ ID NO: 33988 - DNA, 25 bp, Homo sapiens
tgtgcagttaaatttgtatacgtat

SEQ ID NO: 33989 - DNA, 25 bp, Homo sapiens
agatgaaccgttaaaatagcactta

SEQ ID NO: 33990 - DNA, 25 bp, Homo sapiens
cacatgtaagttgtatggcagttta

SEQ ID NO: 33991 - DNA, 25 bp, Homo sapiens
ggcagtttacagaactcaatgactt

SEQ ID NO: 33992 - DNA, 25 bp, Homo sapiens
ggttttcatatgagctacacattgt

SEQ ID NO: 33993 - DNA, 25 bp, Homo sapiens
tacacattgtgtacattgattgttt

SEQ ID NO: 33994 - DNA, 25 bp, Homo sapiens
aatccattctgtcattttcaacttt

SEQ ID NO: 33995 - DNA, 25 bp, Homo sapiens
gatttccaggaagcctttgatcacc

SEQ ID NO: 33996 - DNA, 25 bp, Homo sapiens
gcttaagtactgcaacctcttggtg

SEQ ID NO: 33997 - DNA, 25 bp, Homo sapiens
atgtgttccaggtttttcatcgact

SEQ ID NO: 33998 - DNA, 25 bp, Homo sapiens
ggagtcctatttgcagaaccacttt

SEQ ID NO: 33999 - DNA, 25 bp, Homo sapiens
agactttaaaccttatcaccatgct

SEQ ID NO: 34000 - DNA, 25 bp, Homo sapiens
caccatgctggctatccgggtgtta

SEQ ID NO: 34001 - DNA, 25 bp, Homo sapiens
atgtcacttgctattaccagccagc

SEQ ID NO: 34002 - DNA, 25 bp, Homo sapiens
gccccctatgtagcagatgccaact

SEQ ID NO: 34003 - DNA, 25 bp, Homo sapiens
caggttcagccagtattcacgtgcc

SEQ ID NO: 34004 - DNA, 25 bp, Homo sapiens
attcacgtgccagcaacagacctac

SEQ ID NO: 34005 - DNA, 25 bp, Homo sapiens
ccacttggctaccctgcaattaaga

SEQ ID NO: 34006 - DNA, 25 bp, Homo sapiens
ggttcggatagcgccatcatgaccg

SEQ ID NO: 34007 - DNA, 25 bp, Homo sapiens
tgaccgggtcctataacaacttctt

SEQ ID NO: 34008 - DNA, 25 bp, Homo sapiens
gcggagggatgtgaccctggaggcc

SEQ ID NO: 34009 - DNA, 25 bp, Homo sapiens
cgagagagagcagcaaaccgcgcgc

SEQ ID NO: 34010 - DNA, 25 bp, Homo sapiens
ggcaccccgtggacaatgtcattgc

SEQ ID NO: 34011 - DNA, 25 bp, Homo sapiens
gtggctgccaccaataacttgtaca

SEQ ID NO: 34012 - DNA, 25 bp, Homo sapiens
agaaaaggcatcattgtccgctcca

SEQ ID NO: 34013 - DNA, 25 bp, Homo sapiens
aagaacagtgacgcacctgctactt

SEQ ID NO: 34014 - DNA, 25 bp, Homo sapiens
gttccgcctcggcgaggcgcgagac

SEQ ID NO: 34015 - DNA, 25 bp, Homo sapiens
tcacgtggagacgctctcgaagcag

SEQ ID NO: 34016 - DNA, 25 bp, Homo sapiens
gacactgctcccaaaaggtcattac

SEQ ID NO: 34017 - DNA, 25 bp, Homo sapiens
ggtgattgatttctatgctccttgg

SEQ ID NO: 34018 - DNA, 25 bp, Homo sapiens
tccttggtgtggaccttgccagaat

SEQ ID NO: 34019 - DNA, 25 bp, Homo sapiens
gaccttgccagaattttgctccaga

SEQ ID NO: 34020 - DNA, 25 bp, Homo sapiens
ttgctccagaatttgagctcttggc

SEQ ID NO: 34021 - DNA, 25 bp, Homo sapiens
atttgagctcttggctaggatgatt

SEQ ID NO: 34022 - DNA, 25 bp, Homo sapiens
gtgaaagctggaaaagtagactgtc

SEQ ID NO: 34023 - DNA, 25 bp, Homo sapiens
gtagactgtcaggcttatgctcaga

SEQ ID NO: 34024 - DNA, 25 bp, Homo sapiens
gtcaggcttatgctcagacatgcca

SEQ ID NO: 34025 - DNA, 25 bp, Homo sapiens
tatgctcagacatgccagaaagctg

SEQ ID NO: 34026 - DNA, 25 bp, Homo sapiens
agctgggatcagggcctatccaact

SEQ ID NO: 34027 - DNA, 25 bp, Homo sapiens
ggatcagggcctatccaactgttaa

SEQ ID NO: 34028 - DNA, 25 bp, Homo sapiens
aagaagagcagataaataccagaga

SEQ ID NO: 34029 - DNA, 25 bp, Homo sapiens
gagatgcaaaagcaatcgctgcctt

SEQ ID NO: 34030 - DNA, 25 bp, Homo sapiens
agcaatcgctgccttaataagtgaa

SEQ ID NO: 34031 - DNA, 25 bp, Homo sapiens
ggaaactctccgaaatcaaggcaag

SEQ ID NO: 34032 - DNA, 25 bp, Homo sapiens
atgacatcagaagacacctatttag

SEQ ID NO: 34033 - DNA, 25 bp, Homo sapiens
gaagacacctatttagaatgttaca

SEQ ID NO: 34034 - DNA, 25 bp, Homo sapiens
acattatcttagacttgcagttgta

SEQ ID NO: 34035 - DNA, 25 bp, Homo sapiens
gacttgcagttgtactgccagaatt

SEQ ID NO: 34036 - DNA, 25 bp, Homo sapiens
gccagaattatctacagcactggtg

SEQ ID NO: 34037 - DNA, 25 bp, Homo sapiens
agcactggtgtaaaagaagggtctg

SEQ ID NO: 34038 - DNA, 25 bp, Homo sapiens
gcaggctataatatatggttcacac

SEQ ID NO: 34039 - DNA, 25 bp, Homo sapiens
gggcactatgagttccttaatttaa

SEQ ID NO: 34040 - DNA, 25 bp, Homo sapiens
gggagagatgcaatgccatacggtg

SEQ ID NO: 34041 - DNA, 25 bp, Homo sapiens
gccatacggtgatacggacctttaa

SEQ ID NO: 34042 - DNA, 25 bp, Homo sapiens
tgctcactggcagctgtgtgtctta

SEQ ID NO: 34043 - DNA, 25 bp, Homo sapiens
ttaacagcattctttcaagtcctgg

SEQ ID NO: 34044 - DNA, 25 bp, Homo sapiens
aacttgtactacatacttgatctga

SEQ ID NO: 34045 - DNA, 25 bp, Homo sapiens
ttgcttgcttaatgattcccaggaa

SEQ ID NO: 34046 - DNA, 25 bp, Homo sapiens
ttcccaggaaacttcgttgtaggca

SEQ ID NO: 34047 - DNA, 25 bp, Homo sapiens
actgtgatttattcaactctgttct

SEQ ID NO: 34048 - DNA, 25 bp, Homo sapiens
tatctggaattgtcatgctgcctca

SEQ ID NO: 34049 - DNA, 25 bp, Homo sapiens
gtcatgctgcctcaatttacagaaa

SEQ ID NO: 34050 - DNA, 25 bp, Homo sapiens
tcatggtcccaaacagcaattactt

SEQ ID NO: 34051 - DNA, 25 bp, Homo sapiens
aaagatcacctacttcatcatctct

SEQ ID NO: 34052 - DNA, 25 bp, Homo sapiens
gctatcacttaagtttgcttcctag

SEQ ID NO: 34053 - DNA, 25 bp, Homo sapiens
ttcttaactatgacactggcaccaa

SEQ ID NO: 34054 - DNA, 25 bp, Homo sapiens
ggcaccaatgagagtcctgtgactg

SEQ ID NO: 34055 - DNA, 25 bp, Homo sapiens
gtgactgactttcacatttccacca

SEQ ID NO: 34056 - DNA, 25 bp, Homo sapiens
catttccaccattactcaattactg

SEQ ID NO: 34057 - DNA, 25 bp, Homo sapiens
tactggtaccataccacctctaatc

SEQ ID NO: 34058 - DNA, 25 bp, Homo sapiens
acctctaatcccctaaatcaaactg

SEQ ID NO: 34059 - DNA, 25 bp, Homo sapiens
atgaatatccttgtaccctctatat

SEQ ID NO: 34060 - DNA, 25 bp, Homo sapiens
gtaccctctatatagctaacttcca

SEQ ID NO: 34061 - DNA, 25 bp, Homo sapiens
taggggggagatttgaccggcaggc

SEQ ID NO: 34062 - DNA, 25 bp, Homo sapiens
cttctacaacgctgactacctggcg

SEQ ID NO: 34063 - DNA, 25 bp, Homo sapiens
cccggctggcaggtgaactggcagg

SEQ ID NO: 34064 - DNA, 25 bp, Homo sapiens
tggcaggtgaactggcaggccagga

SEQ ID NO: 34065 - DNA, 25 bp, Homo sapiens
aggggctggaggtgatggatgtttt

SEQ ID NO: 34066 - DNA, 25 bp, Homo sapiens
gccgtagagccagggctggtgcaga

SEQ ID NO: 34067 - DNA, 25 bp, Homo sapiens
cagggctggtgcagaagttctccct

SEQ ID NO: 34068 - DNA, 25 bp, Homo sapiens
gcccacggctcagtgaagaactcta

SEQ ID NO: 34069 - DNA, 25 bp, Homo sapiens
tcagtgaagaactctaccaccgctg

SEQ ID NO: 34070 - DNA, 25 bp, Homo sapiens
ctggctatggctctctttgagcagg

SEQ ID NO: 34071 - DNA, 25 bp, Homo sapiens
agcaggccaatagcacttagcccgc

SEQ ID NO: 34072 - DNA, 25 bp, Homo sapiens
taaaacaaaccttgtgctcttttca

SEQ ID NO: 34073 - DNA, 25 bp, Homo sapiens
gttctacatcaatatcatccctgtc

SEQ ID NO: 34074 - DNA, 25 bp, Homo sapiens
gaccaggctgtgaaatccacacatc

SEQ ID NO: 34075 - DNA, 25 bp, Homo sapiens
tctttagaactagtcgtctcctctt

SEQ ID NO: 34076 - DNA, 25 bp, Homo sapiens
cttccctgttcttactggttgacat

SEQ ID NO: 34077 - DNA, 25 bp, Homo sapiens
atcactctttgcacactcttgtgtt

SEQ ID NO: 34078 - DNA, 25 bp, Homo sapiens
tcccagcacctagtatgctcagtaa

SEQ ID NO: 34079 - DNA, 25 bp, Homo sapiens
aacctttgattctacttacagccca

SEQ ID NO: 34080 - DNA, 25 bp, Homo sapiens
acagcccatgatagcctcttagata

SEQ ID NO: 34081 - DNA, 25 bp, Homo sapiens
tcgggagtgcactttttgactgtag

SEQ ID NO: 34082 - DNA, 25 bp, Homo sapiens
gcatctcaacaaaggtggcagcagt

SEQ ID NO: 34083 - DNA, 25 bp, Homo sapiens
aacgcaggacatcagattcctcatg

SEQ ID NO: 34084 - DNA, 25 bp, Homo sapiens
tgcaaaatggccattccagctccat

SEQ ID NO: 34085 - DNA, 25 bp, Homo sapiens
atccagccatcacatcacaggagga

SEQ ID NO: 34086 - DNA, 25 bp, Homo sapiens
acacttcttccgttaattcctgtgg

SEQ ID NO: 34087 - DNA, 25 bp, Homo sapiens
tcctgtggaccagaactgattccca

SEQ ID NO: 34088 - DNA, 25 bp, Homo sapiens
actgattcccacagctacagttcag

SEQ ID NO: 34089 - DNA, 25 bp, Homo sapiens
gaattcaggggttcgcttggtaagg

SEQ ID NO: 34090 - DNA, 25 bp, Homo sapiens
aatggatactgtcggtctgtgctcc

SEQ ID NO: 34091 - DNA, 25 bp, Homo sapiens
gtcggtctgtgctccaggagactta

SEQ ID NO: 34092 - DNA, 25 bp, Homo sapiens
gctgaaacactttgcacaatgcctg

SEQ ID NO: 34093 - DNA, 25 bp, Homo sapiens
atgcctggcgtgttatgcactcaat

SEQ ID NO: 34094 - DNA, 25 bp, Homo sapiens
cctcccagggtttgatcgattgagc

SEQ ID NO: 34095 - DNA, 25 bp, Homo sapiens
gtttgatcgattgagcaggacagcc

SEQ ID NO: 34096 - DNA, 25 bp, Homo sapiens
tgctcctggacagggaccctggtaa

SEQ ID NO: 34097 - DNA, 25 bp, Homo sapiens
acagggaccctggtaagagctctct

SEQ ID NO: 34098 - DNA, 25 bp, Homo sapiens
cccatgtcccaagttgtgccaaggg

SEQ ID NO: 34099 - DNA, 25 bp, Homo sapiens
ccaagttgtgccaagggaatgcctc

SEQ ID NO: 34100 - DNA, 25 bp, Homo sapiens
ccccctctccgtaggtgtacagagg

SEQ ID NO: 34101 - DNA, 25 bp, Homo sapiens
ggaggcagtggggttaacagatccc

SEQ ID NO: 34102 - DNA, 25 bp, Homo sapiens
aacagatcccacaagtcctaacttt

SEQ ID NO: 34103 - DNA, 25 bp, Homo sapiens
ggaatttattctatcaactgcctga

SEQ ID NO: 34104 - DNA, 25 bp, Homo sapiens
ccctggctctgtaaccattaacctc

SEQ ID NO: 34105 - DNA, 25 bp, Homo sapiens
catctggcctgccgcaaggggaatg

SEQ ID NO: 34106 - DNA, 25 bp, Homo sapiens
caaggggaatgtggtcctggcgcag

SEQ ID NO: 34107 - DNA, 25 bp, Homo sapiens
cagctcctgatctggtacggggtgg

SEQ ID NO: 34108 - DNA, 25 bp, Homo sapiens
tacggggtggacgtcatggcccgag

SEQ ID NO: 34109 - DNA, 25 bp, Homo sapiens
cgagatgcccacgggaacacagcgc

SEQ ID NO: 34110 - DNA, 25 bp, Homo sapiens
ggcctccagccaggagtgcatcaac

SEQ ID NO: 34111 - DNA, 25 bp, Homo sapiens
atcaacgtgcttctgcagtacggct

SEQ ID NO: 34112 - DNA, 25 bp, Homo sapiens
ttgactgcagtctccttggtgcaaa

SEQ ID NO: 34113 - DNA, 25 bp, Homo sapiens
gcattttcagtacttttcgtaaact

SEQ ID NO: 34114 - DNA, 25 bp, Homo sapiens
aggtggatttgttagtctcaggccc

SEQ ID NO: 34115 - DNA, 25 bp, Homo sapiens
gccacattgcccaagtcacacaggc

SEQ ID NO: 34116 - DNA, 25 bp, Homo sapiens
taaaatccctatgatctctgtctca

SEQ ID NO: 34117 - DNA, 25 bp, Homo sapiens
gaagatcgcatactacacacaggaa

SEQ ID NO: 34118 - DNA, 25 bp, Homo sapiens
ccagccagctcctaagtcttaaggc

SEQ ID NO: 34119 - DNA, 25 bp, Homo sapiens
gtcttaaggctctgtgttagtgata

SEQ ID NO: 34120 - DNA, 25 bp, Homo sapiens
ggtgtaggcagtgcaatgtcttcga

SEQ ID NO: 34121 - DNA, 25 bp, Homo sapiens
gaaggtggtaactcattgcatggat

SEQ ID NO: 34122 - DNA, 25 bp, Homo sapiens
tttattctaatccaagttcttccac

SEQ ID NO: 34123 - DNA, 25 bp, Homo sapiens
cctctcattgagtctcattcctcat

SEQ ID NO: 34124 - DNA, 25 bp, Homo sapiens
gagtctcattcctcatctataggat

SEQ ID NO: 34125 - DNA, 25 bp, Homo sapiens
aataagagcatgtacctggcaggtt

SEQ ID NO: 34126 - DNA, 25 bp, Homo sapiens
agtgcttgcaactttgaataccaaa

SEQ ID NO: 34127 - DNA, 25 bp, Homo sapiens
cttggagatatttccgtcctccacc

SEQ ID NO: 34128 - DNA, 25 bp, Homo sapiens
cacgtgtctgtggctggaactgccc

SEQ ID NO: 34129 - DNA, 25 bp, Homo sapiens
ctccccacagctggtaatctggact

SEQ ID NO: 34130 - DNA, 25 bp, Homo sapiens
gcctaccaccattccatatttaagt

SEQ ID NO: 34131 - DNA, 25 bp, Homo sapiens
tatttaagtggagcccctacgtaga

SEQ ID NO: 34132 - DNA, 25 bp, Homo sapiens
ggctttattttagtctccttttcag

SEQ ID NO: 34133 - DNA, 25 bp, Homo sapiens
ccttttcagggatgtcgtgggcggg

SEQ ID NO: 34134 - DNA, 25 bp, Homo sapiens
gctgccttcaccacatattagtgct

SEQ ID NO: 34135 - DNA, 25 bp, Homo sapiens
aatacatggagacgacgcaccctcc

SEQ ID NO: 34136 - DNA, 25 bp, Homo sapiens
tccaggatgctcgctgggattccca

SEQ ID NO: 34137 - DNA, 25 bp, Homo sapiens
gggcctctgaacggaacagtgtccc

SEQ ID NO: 34138 - DNA, 25 bp, Homo sapiens
tgatggtctcatctctgaatttata

SEQ ID NO: 34139 - DNA, 25 bp, Homo sapiens
tatttctcattcttttgaacatact

SEQ ID NO: 34140 - DNA, 25 bp, Homo sapiens
gatttcaggcaagtattcattttta

SEQ ID NO: 34141 - DNA, 25 bp, Homo sapiens
tcatttttaacttgctacctacttt

SEQ ID NO: 34142 - DNA, 25 bp, Homo sapiens
atgatctttttccgacttctaaaca

SEQ ID NO: 34143 - DNA, 25 bp, Homo sapiens
gtttctcagtctgctttagctttta

SEQ ID NO: 34144 - DNA, 25 bp, Homo sapiens
aactctggaagcgcatgcacactga

SEQ ID NO: 34145 - DNA, 25 bp, Homo sapiens
gcatgcacactgaactctgctcagt

SEQ ID NO: 34146 - DNA, 25 bp, Homo sapiens
gaactctgctcagtgctaaacagtc

SEQ ID NO: 34147 - DNA, 25 bp, Homo sapiens
ttcctcagggtttcagccctaaaat

SEQ ID NO: 34148 - DNA, 25 bp, Homo sapiens
ggataatcagtgtatgttgcaccag

SEQ ID NO: 34149 - DNA, 25 bp, Homo sapiens
gaacagccgtggctgctttatctct

SEQ ID NO: 34150 - DNA, 25 bp, Homo sapiens
tccacggtgtactcaggcctgagtg

SEQ ID NO: 34151 - DNA, 25 bp, Homo sapiens
tttgaactggaactgctggctcaca

SEQ ID NO: 34152 - DNA, 25 bp, Homo sapiens
tggctcacacagggttttcgacaac

SEQ ID NO: 34153 - DNA, 25 bp, Homo sapiens
cgacaactgcagctgaatctcatgg

SEQ ID NO: 34154 - DNA, 25 bp, Homo sapiens
ggattcctctgccttacgcagaaac

SEQ ID NO: 34155 - DNA, 25 bp, Homo sapiens
tgcttgccactggtcctggcagaaa

SEQ ID NO: 34156 - DNA, 25 bp, Homo sapiens
actggtcctggcagaaatggcggct

SEQ ID NO: 34157 - DNA, 25 bp, Homo sapiens
gcctgccaggaaggcagtttcgcct

SEQ ID NO: 34158 - DNA, 25 bp, Homo sapiens
ggaaagagcagagcccgtgggaagc

SEQ ID NO: 34159 - DNA, 25 bp, Homo sapiens
ttcccccatctgtttgccagagggg

SEQ ID NO: 34160 - DNA, 25 bp, Homo sapiens
cacccaccatttataactttcaaca

SEQ ID NO: 34161 - DNA, 25 bp, Homo sapiens
aagctttcaccaaaacacccagaat

SEQ ID NO: 34162 - DNA, 25 bp, Homo sapiens
tactgctggaatggacatctttgcc

SEQ ID NO: 34163 - DNA, 25 bp, Homo sapiens
tctttgccaaattctctgcatatat

SEQ ID NO: 34164 - DNA, 25 bp, Homo sapiens
gaagcactggagaggggtctcctga

SEQ ID NO: 34165 - DNA, 25 bp, Homo sapiens
ggtctcctgaaaaccctgcagaaac

SEQ ID NO: 34166 - DNA, 25 bp, Homo sapiens
tcctctccctgatgaaattgatgaa

SEQ ID NO: 34167 - DNA, 25 bp, Homo sapiens
gacattagctgattgcaacctgctg

SEQ ID NO: 34168 - DNA, 25 bp, Homo sapiens
acctgctgcccaaactgcatattgt

SEQ ID NO: 34169 - DNA, 25 bp, Homo sapiens
ggcatctggagatacctaactaatg

SEQ ID NO: 34170 - DNA, 25 bp, Homo sapiens
gatgtagccaaaagactcaccaagt

SEQ ID NO: 34171 - DNA, 25 bp, Homo sapiens
ctgtgcatggcacggctcaagacag

SEQ ID NO: 34172 - DNA, 25 bp, Homo sapiens
gtcctgaaatacgtgctgtttcttc

SEQ ID NO: 34173 - DNA, 25 bp, Homo sapiens
tgtttcttctgggtacactggtcat

SEQ ID NO: 34174 - DNA, 25 bp, Homo sapiens
gatcatggcctccatgtgggcttac

SEQ ID NO: 34175 - DNA, 25 bp, Homo sapiens
gccatctacacctccatgatgacta

SEQ ID NO: 34176 - DNA, 25 bp, Homo sapiens
gatgactagcgacaactactactac

SEQ ID NO: 34177 - DNA, 25 bp, Homo sapiens
ccctgccactatcagatctgcaaga

SEQ ID NO: 34178 - DNA, 25 bp, Homo sapiens
acgatcgggaggaactgtacgcagt

SEQ ID NO: 34179 - DNA, 25 bp, Homo sapiens
gcagtgacgtgacactggcctgggg

SEQ ID NO: 34180 - DNA, 25 bp, Homo sapiens
ggagctgtatcgagggggaggcgcc

SEQ ID NO: 34181 - DNA, 25 bp, Homo sapiens
ggacagattgatttccagctgaata

SEQ ID NO: 34182 - DNA, 25 bp, Homo sapiens
ttgtgggacactactctttgttcct

SEQ ID NO: 34183 - DNA, 25 bp, Homo sapiens
cctgacgtcgggcgagcgtgaggag

SEQ ID NO: 34184 - DNA, 25 bp, Homo sapiens
gcgtgaggagagaaccctgcagcgg

SEQ ID NO: 34185 - DNA, 25 bp, Homo sapiens
tggagactcagatgtttcggggctt

SEQ ID NO: 34186 - DNA, 25 bp, Homo sapiens
tctgtttgaggtccgagcccaagag

SEQ ID NO: 34187 - DNA, 25 bp, Homo sapiens
aacactccccagtggagagcacagc

SEQ ID NO: 34188 - DNA, 25 bp, Homo sapiens
aagggaaaacttcctcctagtgcag

SEQ ID NO: 34189 - DNA, 25 bp, Homo sapiens
cctttctgaaaggctgggtcccagg

SEQ ID NO: 34190 - DNA, 25 bp, Homo sapiens
tcccaggttgtcacggtgcggaact

SEQ ID NO: 34191 - DNA, 25 bp, Homo sapiens
agaaagggagcccgagaccaggcgt

SEQ ID NO: 34192 - DNA, 25 bp, Homo sapiens
gtgtcgccgacatgcaaatgggttg

SEQ ID NO: 34193 - DNA, 25 bp, Homo sapiens
gactggctgagcagtgggttccttc

SEQ ID NO: 34194 - DNA, 25 bp, Homo sapiens
aaagcaggctgtttgctcacttctt

SEQ ID NO: 34195 - DNA, 25 bp, Homo sapiens
tggatttcttactacctaacgccca

SEQ ID NO: 34196 - DNA, 25 bp, Homo sapiens
gactctcaaaccatacctggtgggg

SEQ ID NO: 34197 - DNA, 25 bp, Homo sapiens
ttcttccctaggtcaaagccactat

SEQ ID NO: 34198 - DNA, 25 bp, Homo sapiens
atgggagcccacggaactaagtagg

SEQ ID NO: 34199 - DNA, 25 bp, Homo sapiens
gagcttctgccaaatttcattcctc

SEQ ID NO: 34200 - DNA, 25 bp, Homo sapiens
tttcattcctcaaacctttcaggag

SEQ ID NO: 34201 - DNA, 25 bp, Homo sapiens
tcaggaggggtggttggcgtttcta

SEQ ID NO: 34202 - DNA, 25 bp, Homo sapiens
gcaggtgtccacttaactgactagc

SEQ ID NO: 34203 - DNA, 25 bp, Homo sapiens
aaacgacattaccttgtgcattttt

SEQ ID NO: 34204 - DNA, 25 bp, Homo sapiens
tgcctaagcctgtctgtgcttcaga

SEQ ID NO: 34205 - DNA, 25 bp, Homo sapiens
ctggctgtggggtaactgggggtat

SEQ ID NO: 34206 - DNA, 25 bp, Homo sapiens
ctgggggtatgagctgtggccacag

SEQ ID NO: 34207 - DNA, 25 bp, Homo sapiens
gtggccacaggtgagcaaggcaggg

SEQ ID NO: 34208 - DNA, 25 bp, Homo sapiens
aggcagggaactgcaatccagccct

SEQ ID NO: 34209 - DNA, 25 bp, Homo sapiens
cgtaggggcagaggtcgccagctag

SEQ ID NO: 34210 - DNA, 25 bp, Homo sapiens
tgtccacttgtcaccttaggttttc

SEQ ID NO: 34211 - DNA, 25 bp, Homo sapiens
tctgtgtgtttcatatccaacggca

SEQ ID NO: 34212 - DNA, 25 bp, Homo sapiens
gggacagagtcctctaaatactcca

SEQ ID NO: 34213 - DNA, 25 bp, Homo sapiens
atagcacacccagagccagggatcc

SEQ ID NO: 34214 - DNA, 25 bp, Homo sapiens
gagccagggatccctttgtagtttt

SEQ ID NO: 34215 - DNA, 25 bp, Homo sapiens
ggctcttctttgacagcatggccga

SEQ ID NO: 34216 - DNA, 25 bp, Homo sapiens
atggccgatcgggatggtggtcaga

SEQ ID NO: 34217 - DNA, 25 bp, Homo sapiens
aatggcttcaacattcctcaagtca

SEQ ID NO: 34218 - DNA, 25 bp, Homo sapiens
tggaagacctgcattccttggactc

SEQ ID NO: 34219 - DNA, 25 bp, Homo sapiens
ggctgtgcacgaagactgctttgtg

SEQ ID NO: 34220 - DNA, 25 bp, Homo sapiens
aaggcagagtcctaacgttgcatct

SEQ ID NO: 34221 - DNA, 25 bp, Homo sapiens
aacgttgcatcttattcgagctggc

SEQ ID NO: 34222 - DNA, 25 bp, Homo sapiens
ttcgagctggcagttctgttcacgt

SEQ ID NO: 34223 - DNA, 25 bp, Homo sapiens
ttgccggcaatggatgtctttgtgg

SEQ ID NO: 34224 - DNA, 25 bp, Homo sapiens
gtctttgtggtgatgatccttcaga

SEQ ID NO: 34225 - DNA, 25 bp, Homo sapiens
taaagcctcttttagtccattgaga

SEQ ID NO: 34226 - DNA, 25 bp, Homo sapiens
aggcagcgctgcggagaggagcggc

SEQ ID NO: 34227 - DNA, 25 bp, Homo sapiens
agaggagcggcagagtgggttgtct

SEQ ID NO: 34228 - DNA, 25 bp, Homo sapiens
gcaggcaaccaggcaagtgtgtcgg

SEQ ID NO: 34229 - DNA, 25 bp, Homo sapiens
gtgtcggggctggggtgtgaatgcc

SEQ ID NO: 34230 - DNA, 25 bp, Homo sapiens
ggtgtgaatgccagcctgtgagtcc

SEQ ID NO: 34231 - DNA, 25 bp, Homo sapiens
gcctgtgagtcccggaactatgtgg

SEQ ID NO: 34232 - DNA, 25 bp, Homo sapiens
gggacagtgcctatgtgatcacctc

SEQ ID NO: 34233 - DNA, 25 bp, Homo sapiens
ggctaagcttaggggcatttcccaa

SEQ ID NO: 34234 - DNA, 25 bp, Homo sapiens
ccctggtgtctgacagcctcaagga

SEQ ID NO: 34235 - DNA, 25 bp, Homo sapiens
cctggccccaagtgtgagtgatgag

SEQ ID NO: 34236 - DNA, 25 bp, Homo sapiens
gatgagcaataaacgtaccgtcccc

SEQ ID NO: 34237 - DNA, 25 bp, Homo sapiens
gtaaatagttaaccttcagtagtct

SEQ ID NO: 34238 - DNA, 25 bp, Homo sapiens
ttaaggcattaatacttctctggac

SEQ ID NO: 34239 - DNA, 25 bp, Homo sapiens
taatacttctctggacatgcgcgtt

SEQ ID NO: 34240 - DNA, 25 bp, Homo sapiens
tggacatgcgcgtttgagggtggag

SEQ ID NO: 34241 - DNA, 25 bp, Homo sapiens
gcgcgtttgagggtggaggggtcct

SEQ ID NO: 34242 - DNA, 25 bp, Homo sapiens
gaggggtcctgtaaggtgcttcatc

SEQ ID NO: 34243 - DNA, 25 bp, Homo sapiens
aggtgcttcatcgtctgtgattact

SEQ ID NO: 34244 - DNA, 25 bp, Homo sapiens
tcgtctgtgattactgcttgggatg

SEQ ID NO: 34245 - DNA, 25 bp, Homo sapiens
cttgggatgtgttctttggcagctt

SEQ ID NO: 34246 - DNA, 25 bp, Homo sapiens
ggcagcttgtgagattactttacct

SEQ ID NO: 34247 - DNA, 25 bp, Homo sapiens
attgacaatggcgtttttttataca

SEQ ID NO: 34248 - DNA, 25 bp, Homo sapiens
tagtccatactgagtgtcatcaaca

SEQ ID NO: 34249 - DNA, 25 bp, Homo sapiens
tctattttaatctcaatcccctttt

SEQ ID NO: 34250 - DNA, 25 bp, Homo sapiens
acccatgcctcttcaggctggaaac

SEQ ID NO: 34251 - DNA, 25 bp, Homo sapiens
tctcttggttccctaaagcactttc

SEQ ID NO: 34252 - DNA, 25 bp, Homo sapiens
gcactttcttctgactgctgtgatt

SEQ ID NO: 34253 - DNA, 25 bp, Homo sapiens
gctgtgattcagtgaaccttgccct

SEQ ID NO: 34254 - DNA, 25 bp, Homo sapiens
gccctttgctttctattacttgtgc

SEQ ID NO: 34255 - DNA, 25 bp, Homo sapiens
tattacttgtgcatttgcctcacct

SEQ ID NO: 34256 - DNA, 25 bp, Homo sapiens
atttgcctcacctgacaatgtttta

SEQ ID NO: 34257 - DNA, 25 bp, Homo sapiens
tttaaatcgcctttgtatctcctta

SEQ ID NO: 34258 - DNA, 25 bp, Homo sapiens
ttgtatctccttagctgctcaataa

SEQ ID NO: 34259 - DNA, 25 bp, Homo sapiens
gttcatgtcagagactcactgccag

SEQ ID NO: 34260 - DNA, 25 bp, Homo sapiens
cactgccagaaaagccttacccatt

SEQ ID NO: 34261 - DNA, 25 bp, Homo sapiens
ttgagaccgcaactgcttgcactga

SEQ ID NO: 34262 - DNA, 25 bp, Homo sapiens
ttttagttggtctggtgttcgggct

SEQ ID NO: 34263 - DNA, 25 bp, Homo sapiens
gtcacttattctttgcctgattcag

SEQ ID NO: 34264 - DNA, 25 bp, Homo sapiens
gaatcattattcatgacccctctgc

SEQ ID NO: 34265 - DNA, 25 bp, Homo sapiens
gacccctctgcaaatgtgtcagtct

SEQ ID NO: 34266 - DNA, 25 bp, Homo sapiens
gtctccaaagagagtatctcccccc

SEQ ID NO: 34267 - DNA, 25 bp, Homo sapiens
atctccccccaaattttgtgtagct

SEQ ID NO: 34268 - DNA, 25 bp, Homo sapiens
tgtgcatgcctgagttgattccgaa

SEQ ID NO: 34269 - DNA, 25 bp, Homo sapiens
agcagagagggagccgttcatgtca

SEQ ID NO: 34270 - DNA, 25 bp, Homo sapiens
agtgaatcactgtagcaatggcttt

SEQ ID NO: 34271 - DNA, 25 bp, Homo sapiens
atggctttgattcagaccttaaaat

SEQ ID NO: 34272 - DNA, 25 bp, Homo sapiens
gtggcaggtattgtaactgtttttt

SEQ ID NO: 34273 - DNA, 25 bp, Homo sapiens
aagcatgttgcgctttgcatcagca

SEQ ID NO: 34274 - DNA, 25 bp, Homo sapiens
gttgcgctttgcatcagcaaggcat

SEQ ID NO: 34275 - DNA, 25 bp, Homo sapiens
agcaaggcattgacttctgaaaaaa

SEQ ID NO: 34276 - DNA, 25 bp, Homo sapiens
aaatgggatactatagactactgag

SEQ ID NO: 34277 - DNA, 25 bp, Homo sapiens
gacactttatggaattttatgagac

SEQ ID NO: 34278 - DNA, 25 bp, Homo sapiens
ttatgagactttttgtgggaacaga

SEQ ID NO: 34279 - DNA, 25 bp, Homo sapiens
aacagggatgtatttcattgtatgt

SEQ ID NO: 34280 - DNA, 25 bp, Homo sapiens
gtatgttttgggtatggctttggaa

SEQ ID NO: 34281 - DNA, 25 bp, Homo sapiens
cctggcttcacagagggtctgcgga

SEQ ID NO: 34282 - DNA, 25 bp, Homo sapiens
ctgcggattgacactggttcttttc

SEQ ID NO: 34283 - DNA, 25 bp, Homo sapiens
ggagggagaggtccctgcaaggtcc

SEQ ID NO: 34284 - DNA, 25 bp, Homo sapiens
gagggatggaaatgccgtcacagta

SEQ ID NO: 34285 - DNA, 25 bp, Homo sapiens
gactggagcgtctacaaggatggag

SEQ ID NO: 34286 - DNA, 25 bp, Homo sapiens
ggagctactcaggcctaacgttagc

SEQ ID NO: 34287 - DNA, 25 bp, Homo sapiens
gccttccgtgacagatccttgaggt

SEQ ID NO: 34288 - DNA, 25 bp, Homo sapiens
gccacctgctctaactcttgagtgg

SEQ ID NO: 34289 - DNA, 25 bp, Homo sapiens
gctcggggacaggacagcagcaaga

SEQ ID NO: 34290 - DNA, 25 bp, Homo sapiens
gccttcccgacagtggggtgggttg

SEQ ID NO: 34291 - DNA, 25 bp, Homo sapiens
agtgtgaggtgaaccctttggtggg

SEQ ID NO: 34292 - DNA, 25 bp, Homo sapiens
ctcacccaagtgctccggagagtga

SEQ ID NO: 34293 - DNA, 25 bp, Homo sapiens
gagagtgacaggaaacccacggctc

SEQ ID NO: 34294 - DNA, 25 bp, Homo sapiens
actagggggtcctacagctacgtgg

SEQ ID NO: 34295 - DNA, 25 bp, Homo sapiens
agctacgtggccgtgggcagtactg

SEQ ID NO: 34296 - DNA, 25 bp, Homo sapiens
gtttgcgggggaagccacacatcgc

SEQ ID NO: 34297 - DNA, 25 bp, Homo sapiens
ggctctgctgtcgggatggagggag

SEQ ID NO: 34298 - DNA, 25 bp, Homo sapiens
ttccacccgtgtcgggggtaggctg

SEQ ID NO: 34299 - DNA, 25 bp, Homo sapiens
caccttctcagttcttgtgtctgtt

SEQ ID NO: 34300 - DNA, 25 bp, Homo sapiens
gtctggccagggttgacttgagctg

SEQ ID NO: 34301 - DNA, 25 bp, Homo sapiens
gagctgagacaccagatgctcacgg

SEQ ID NO: 34302 - DNA, 25 bp, Homo sapiens
atgctcacggagatgctggacacat

SEQ ID NO: 34303 - DNA, 25 bp, Homo sapiens
tagattttaacatcctttgcggtcc

SEQ ID NO: 34304 - DNA, 25 bp, Homo sapiens
cggtcccagtccaaggtaggctggt

SEQ ID NO: 34305 - DNA, 25 bp, Homo sapiens
caaggtaggctggtgtcatagtctt

SEQ ID NO: 34306 - DNA, 25 bp, Homo sapiens
taatccatgaccactgtttttttcc

SEQ ID NO: 34307 - DNA, 25 bp, Homo sapiens
ttcctatttatatcaccaggtagcc

SEQ ID NO: 34308 - DNA, 25 bp, Homo sapiens
gtcaatagataagtgtccctgtttt

SEQ ID NO: 34309 - DNA, 25 bp, Homo sapiens
tgagaagatttattccaccaggggt

SEQ ID NO: 34310 - DNA, 25 bp, Homo sapiens
tccaccaggggtatttcagctttga

SEQ ID NO: 34311 - DNA, 25 bp, Homo sapiens
gaaaccaaatctgtgtatctaatac

SEQ ID NO: 34312 - DNA, 25 bp, Homo sapiens
atgtttgctaaactacccaagtaag

SEQ ID NO: 34313 - DNA, 25 bp, Homo sapiens
ggcttcaccaaggtgtggtttgcca

SEQ ID NO: 34314 - DNA, 25 bp, Homo sapiens
ctgacataatatccctcaacttccg

SEQ ID NO: 34315 - DNA, 25 bp, Homo sapiens
ctcaacttccgcagcgcaagcatga

SEQ ID NO: 34316 - DNA, 25 bp, Homo sapiens
gcaagcatgatcagctcagactgtg

SEQ ID NO: 34317 - DNA, 25 bp, Homo sapiens
tgccaatgaccgcgtgccgtatggc

SEQ ID NO: 34318 - DNA, 25 bp, Homo sapiens
gagtcacagaaggtctcccatgtgt

SEQ ID NO: 34319 - DNA, 25 bp, Homo sapiens
ggttgtgaggtctccttgaagtgtt

SEQ ID NO: 34320 - DNA, 25 bp, Homo sapiens
tgaagtgttgtgagcttctccactc

SEQ ID NO: 34321 - DNA, 25 bp, Homo sapiens
tacagagcctggctgaacacgcgtc

SEQ ID NO: 34322 - DNA, 25 bp, Homo sapiens
aacacgcgtcatctgccaaaagttt

SEQ ID NO: 34323 - DNA, 25 bp, Homo sapiens
gaatctaattagggctttgctcgta

SEQ ID NO: 34324 - DNA, 25 bp, Homo sapiens
tcccgcgctattgtgtcttaattaa

SEQ ID NO: 34325 - DNA, 25 bp, Homo sapiens
gtggacctacctgataaataccctt

SEQ ID NO: 34326 - DNA, 25 bp, Homo sapiens
taaataccctttcaaatctccatct

SEQ ID NO: 34327 - DNA, 25 bp, Homo sapiens
ataaaattttccatcccaacattga

SEQ ID NO: 34328 - DNA, 25 bp, Homo sapiens
aacttggacagctctctatgatctt

SEQ ID NO: 34329 - DNA, 25 bp, Homo sapiens
ccaatatatttgagtccttcctgcc

SEQ ID NO: 34330 - DNA, 25 bp, Homo sapiens
ctgcctcagttattggcctatccta

SEQ ID NO: 34331 - DNA, 25 bp, Homo sapiens
tagatcctctcaatggtgacgctgc

SEQ ID NO: 34332 - DNA, 25 bp, Homo sapiens
gtacctccaccgaccagaagaatac

SEQ ID NO: 34333 - DNA, 25 bp, Homo sapiens
gagtacatccagaaatacgccacgg

SEQ ID NO: 34334 - DNA, 25 bp, Homo sapiens
aagagggtaccggggacagctcatc

SEQ ID NO: 34335 - DNA, 25 bp, Homo sapiens
gagagctctatgtctgacttttccg

SEQ ID NO: 34336 - DNA, 25 bp, Homo sapiens
ggaggtgctcaagtacagcgagttc

SEQ ID NO: 34337 - DNA, 25 bp, Homo sapiens
ggtgctcaagtacagcgagttcttc

SEQ ID NO: 34338 - DNA, 25 bp, Homo sapiens
gctcaagtacagcgagttcttcacg

SEQ ID NO: 34339 - DNA, 25 bp, Homo sapiens
caagtacagcgagttcttcacgggc

SEQ ID NO: 34340 - DNA, 25 bp, Homo sapiens
gcgcagcgtgcacgaggagttttga

SEQ ID NO: 34341 - DNA, 25 bp, Homo sapiens
tcactctgccgaaggcgctgacggc

SEQ ID NO: 34342 - DNA, 25 bp, Homo sapiens
actctgccgaaggcgctgacggcat

SEQ ID NO: 34343 - DNA, 25 bp, Homo sapiens
tctgccgaaggcgctgacggcatcg

SEQ ID NO: 34344 - DNA, 25 bp, Homo sapiens
tgccgaaggcgctgacggcatcgcg

SEQ ID NO: 34345 - DNA, 25 bp, Homo sapiens
aaacttcgctggaaatgagtagcca

SEQ ID NO: 34346 - DNA, 25 bp, Homo sapiens
tgagtagccaggaagttcaggggag

SEQ ID NO: 34347 - DNA, 25 bp, Homo sapiens
catgggctactacgagacggtggcg

SEQ ID NO: 34348 - DNA, 25 bp, Homo sapiens
tgtgcacagccacatgaccaacaca

SEQ ID NO: 34349 - DNA, 25 bp, Homo sapiens
agctgctctttcgtgaggaggcgct

SEQ ID NO: 34350 - DNA, 25 bp, Homo sapiens
gctgctgtcagtgctgaccgagcgc

SEQ ID NO: 34351 - DNA, 25 bp, Homo sapiens
cctgctgatccgcaaaaacggccgg

SEQ ID NO: 34352 - DNA, 25 bp, Homo sapiens
aacggccggacggtgaatctgggcg

SEQ ID NO: 34353 - DNA, 25 bp, Homo sapiens
tgaatctgggcggcaagacgtcggt

SEQ ID NO: 34354 - DNA, 25 bp, Homo sapiens
gcaagacgtcggtgaccgtgtaccc

SEQ ID NO: 34355 - DNA, 25 bp, Homo sapiens
cgtgtaccccggggatgtgttctgt

SEQ ID NO: 34356 - DNA, 25 bp, Homo sapiens
gcagcgtctatgagtatcgccgggc

SEQ ID NO: 34357 - DNA, 25 bp, Homo sapiens
gccgtgtgaggatcccgcaataaag

SEQ ID NO: 34358 - DNA, 25 bp, Homo sapiens
tcgactctgctgctcatgggaagaa

SEQ ID NO: 34359 - DNA, 25 bp, Homo sapiens
acagaattgctcctgcatgcaacta

SEQ ID NO: 34360 - DNA, 25 bp, Homo sapiens
tgtcttgtgagctgatcgcttggag

SEQ ID NO: 34361 - DNA, 25 bp, Homo sapiens
tgagctgatcgcttggagggtcctc

SEQ ID NO: 34362 - DNA, 25 bp, Homo sapiens
ggagggtcctctttttatgttgagt

SEQ ID NO: 34363 - DNA, 25 bp, Homo sapiens
ctttttatgttgagttgctgcttcc

SEQ ID NO: 34364 - DNA, 25 bp, Homo sapiens
cattttgctatggggggcaggcagg

SEQ ID NO: 34365 - DNA, 25 bp, Homo sapiens
gtatagggactgtcataccagtgaa

SEQ ID NO: 34366 - DNA, 25 bp, Homo sapiens
gatatgatgacaaggttgatccact

SEQ ID NO: 34367 - DNA, 25 bp, Homo sapiens
gatccacttcaagaattgcttgctt

SEQ ID NO: 34368 - DNA, 25 bp, Homo sapiens
gagatgtgtttcaacaagccaacta

SEQ ID NO: 34369 - DNA, 25 bp, Homo sapiens
cctgagaacttcttctgggtgggca

SEQ ID NO: 34370 - DNA, 25 bp, Homo sapiens
gggtgggcattggggcacagaagcc

SEQ ID NO: 34371 - DNA, 25 bp, Homo sapiens
gaagccctatgatgacgatgccgag

SEQ ID NO: 34372 - DNA, 25 bp, Homo sapiens
tacatgaaacacacacgtctcttcc

SEQ ID NO: 34373 - DNA, 25 bp, Homo sapiens
gtgctccaacgagaagggctacttt

SEQ ID NO: 34374 - DNA, 25 bp, Homo sapiens
gaagggctactttgcagtgactgag

SEQ ID NO: 34375 - DNA, 25 bp, Homo sapiens
actgagaaatgctccgacttttgcc

SEQ ID NO: 34376 - DNA, 25 bp, Homo sapiens
gctccgacttttgccaagatgacct

SEQ ID NO: 34377 - DNA, 25 bp, Homo sapiens
acatcatgttgctagacaatggcca

SEQ ID NO: 34378 - DNA, 25 bp, Homo sapiens
caagaggtctacatgtgggtgggga

SEQ ID NO: 34379 - DNA, 25 bp, Homo sapiens
ggacccagactagccaggtggagat

SEQ ID NO: 34380 - DNA, 25 bp, Homo sapiens
ccggcatctcttccaaggcaatggg

SEQ ID NO: 34381 - DNA, 25 bp, Homo sapiens
ggatcatgaattccttcgtcaacga

SEQ ID NO: 34382 - DNA, 25 bp, Homo sapiens
cgtcaacgacatcttcgagcgcatc

SEQ ID NO: 34383 - DNA, 25 bp, Homo sapiens
attaacgctacgatgcctgaaccta

SEQ ID NO: 34384 - DNA, 25 bp, Homo sapiens
gcattacaacaagcgctcgaccatc

SEQ ID NO: 34385 - DNA, 25 bp, Homo sapiens
tcgaccatcacctccagggagatcc

SEQ ID NO: 34386 - DNA, 25 bp, Homo sapiens
gtaagcatctttacacctaatccca

SEQ ID NO: 34387 - DNA, 25 bp, Homo sapiens
tacacctaatcccaaaggctctttt

SEQ ID NO: 34388 - DNA, 25 bp, Homo sapiens
taagagccacgcatgttttcaataa

SEQ ID NO: 34389 - DNA, 25 bp, Homo sapiens
gctcctgccccaaagaagggctcca

SEQ ID NO: 34390 - DNA, 25 bp, Homo sapiens
agggctccaagaaggcggtgactaa

SEQ ID NO: 34391 - DNA, 25 bp, Homo sapiens
caccgagcagggtaaccacgaccag

SEQ ID NO: 34392 - DNA, 25 bp, Homo sapiens
ttcggctgggaacttgacggtgctg

SEQ ID NO: 34393 - DNA, 25 bp, Homo sapiens
agtacagttagactttcacttccgc

SEQ ID NO: 34394 - DNA, 25 bp, Homo sapiens
tgactgcaaccctggagtacgtgga

SEQ ID NO: 34395 - DNA, 25 bp, Homo sapiens
gatcggaacgacagaggtgccctgc

SEQ ID NO: 34396 - DNA, 25 bp, Homo sapiens
gtcatctttatggtgtatccccttg

SEQ ID NO: 34397 - DNA, 25 bp, Homo sapiens
tgaaagggatgttggccacctgccc

SEQ ID NO: 34398 - DNA, 25 bp, Homo sapiens
cagtgagcctccttgaacatgctta

SEQ ID NO: 34399 - DNA, 25 bp, Homo sapiens
aacatgcttattccaacgctttgag

SEQ ID NO: 34400 - DNA, 25 bp, Homo sapiens
gggctggaagccttgacacatggaa

SEQ ID NO: 34401 - DNA, 25 bp, Homo sapiens
gtgattcaggacactttccatccta

SEQ ID NO: 34402 - DNA, 25 bp, Homo sapiens
tgttgttgctttaggctcacggcac

SEQ ID NO: 34403 - DNA, 25 bp, Homo sapiens
tcacggcacgcttgcgtatgtctgt

SEQ ID NO: 34404 - DNA, 25 bp, Homo sapiens
gcttgcgtatgtctgttaccatgtc

SEQ ID NO: 34405 - DNA, 25 bp, Homo sapiens
tatgccgaatgccctcaggggactt

SEQ ID NO: 34406 - DNA, 25 bp, Homo sapiens
gccctcaggggacttgaatctttcc

SEQ ID NO: 34407 - DNA, 25 bp, Homo sapiens
aaaccaggtttagacagtatgagtc

SEQ ID NO: 34408 - DNA, 25 bp, Homo sapiens
agacagtatgagtcaatgtgcagtg

SEQ ID NO: 34409 - DNA, 25 bp, Homo sapiens
agcccacacttgagaggatgaatgt

SEQ ID NO: 34410 - DNA, 25 bp, Homo sapiens
tacagcccctttttcatatgttgct

SEQ ID NO: 34411 - DNA, 25 bp, Homo sapiens
tgctcctggagcctttgaataaaaa

SEQ ID NO: 34412 - DNA, 25 bp, Homo sapiens
gattgtgaatatttccatatggatt

SEQ ID NO: 34413 - DNA, 25 bp, Homo sapiens
tgagatggagctgagactttattta

SEQ ID NO: 34414 - DNA, 25 bp, Homo sapiens
gaggtccctccaacatgtttggacc

SEQ ID NO: 34415 - DNA, 25 bp, Homo sapiens
tccctccaacatgtttggacccagc

SEQ ID NO: 34416 - DNA, 25 bp, Homo sapiens
tccaacatgtttggacccagctcct

SEQ ID NO: 34417 - DNA, 25 bp, Homo sapiens
tgcccagaaccaagtgccatttctc

SEQ ID NO: 34418 - DNA, 25 bp, Homo sapiens
cccagaaccaagtgccatttctcac

SEQ ID NO: 34419 - DNA, 25 bp, Homo sapiens
agaaccaagtgccatttctcactct

SEQ ID NO: 34420 - DNA, 25 bp, Homo sapiens
catttctcactctggagccttaata

SEQ ID NO: 34421 - DNA, 25 bp, Homo sapiens
ttctcactctggagccttaataaac

SEQ ID NO: 34422 - DNA, 25 bp, Homo sapiens
cactctggagccttaataaactgca

SEQ ID NO: 34423 - DNA, 25 bp, Homo sapiens
ggagccttaataaactgcaatttgt

SEQ ID NO: 34424 - DNA, 25 bp, Homo sapiens
tattcagccaaaattaccgttttag

SEQ ID NO: 34425 - DNA, 25 bp, Homo sapiens
aatgccacatcctatatggtgttat

SEQ ID NO: 34426 - DNA, 25 bp, Homo sapiens
gaaagtacatttgtttgcctgtctt

SEQ ID NO: 34427 - DNA, 25 bp, Homo sapiens
ttcattttgtacattcttcccattc

SEQ ID NO: 34428 - DNA, 25 bp, Homo sapiens
aagtcatcataatttgttgccataa

SEQ ID NO: 34429 - DNA, 25 bp, Homo sapiens
gagtaacttcttaaatccctgttct

SEQ ID NO: 34430 - DNA, 25 bp, Homo sapiens
aaatccctgttctagcaaactaata

SEQ ID NO: 34431 - DNA, 25 bp, Homo sapiens
atattggttcatgtgcttgtgtata

SEQ ID NO: 34432 - DNA, 25 bp, Homo sapiens
aatagaccctactgtactgtgcttt

SEQ ID NO: 34433 - DNA, 25 bp, Homo sapiens
actgtactgtgctttggacatttga

SEQ ID NO: 34434 - DNA, 25 bp, Homo sapiens
tcactggaccgacgttttaacaacg

SEQ ID NO: 34435 - DNA, 25 bp, Homo sapiens
attgtaagagtatgccaccacgccc

SEQ ID NO: 34436 - DNA, 25 bp, Homo sapiens
atgacgtgaggctgctttgccttca

SEQ ID NO: 34437 - DNA, 25 bp, Homo sapiens
ttgccttcaataatacctagttttc

SEQ ID NO: 34438 - DNA, 25 bp, Homo sapiens
cctagttttcagctgttccaactcg

SEQ ID NO: 34439 - DNA, 25 bp, Homo sapiens
ctgttccaactcgtttccaaataga

SEQ ID NO: 34440 - DNA, 25 bp, Homo sapiens
gaaattagctggaacacactacagt

SEQ ID NO: 34441 - DNA, 25 bp, Homo sapiens
ggaacacactacagtaatctcaagg

SEQ ID NO: 34442 - DNA, 25 bp, Homo sapiens
gataccaagaagtcagcatggtacc

SEQ ID NO: 34443 - DNA, 25 bp, Homo sapiens
gcatggtacccaattgaaacctttt

SEQ ID NO: 34444 - DNA, 25 bp, Homo sapiens
gggaattcattctatttgcactaaa

SEQ ID NO: 34445 - DNA, 25 bp, Homo sapiens
ctatttgcactaaaagccttaactg

SEQ ID NO: 34446 - DNA, 25 bp, Homo sapiens
tgacgtagacgactactcgctgcac

SEQ ID NO: 34447 - DNA, 25 bp, Homo sapiens
cacgcgcggcaccaagtggattgcc

SEQ ID NO: 34448 - DNA, 25 bp, Homo sapiens
cggcaagcgctgttccaacaggaga

SEQ ID NO: 34449 - DNA, 25 bp, Homo sapiens
gtcgccagttgcccaagatcagggg

SEQ ID NO: 34450 - DNA, 25 bp, Homo sapiens
taaaggtctggccaatgtcttgccc

SEQ ID NO: 34451 - DNA, 25 bp, Homo sapiens
tttattgtgtactgactccatctgc

SEQ ID NO: 34452 - DNA, 25 bp, Homo sapiens
tccatctgccccgtcaaataaaaaa

SEQ ID NO: 34453 - DNA, 25 bp, Homo sapiens
tcaggatgacgtggacctccgtgac

SEQ ID NO: 34454 - DNA, 25 bp, Homo sapiens
tgcgtgtcaagccccaacagggcac

SEQ ID NO: 34455 - DNA, 25 bp, Homo sapiens
acagggcacagcagtcttctggtac

SEQ ID NO: 34456 - DNA, 25 bp, Homo sapiens
cttctggtacaactacctgcctgat

SEQ ID NO: 34457 - DNA, 25 bp, Homo sapiens
tggtgaccttttcctatgtctaggc

SEQ ID NO: 34458 - DNA, 25 bp, Homo sapiens
ggtgctgctattttgtgagctccgg

SEQ ID NO: 34459 - DNA, 25 bp, Homo sapiens
tccggctcctgtttagcttttattt

SEQ ID NO: 34460 - DNA, 25 bp, Homo sapiens
atttcagttctaacctcagtccaga

SEQ ID NO: 34461 - DNA, 25 bp, Homo sapiens
ttcagccacggctacaataccggaa

SEQ ID NO: 34462 - DNA, 25 bp, Homo sapiens
gagagccacctggggtacatgttga

SEQ ID NO: 34463 - DNA, 25 bp, Homo sapiens
aggtgattctgtaagttgtccctca

SEQ ID NO: 34464 - DNA, 25 bp, Homo sapiens
gttgtccctcaactgtacttggaga

SEQ ID NO: 34465 - DNA, 25 bp, Homo sapiens
gaaaaatcatgtataccctcaccca

SEQ ID NO: 34466 - DNA, 25 bp, Homo sapiens
ccctcacccacctaagttgatatct

SEQ ID NO: 34467 - DNA, 25 bp, Homo sapiens
gtatgtatttgctggtgtcgtgtaa

SEQ ID NO: 34468 - DNA, 25 bp, Homo sapiens
gtgatgaccgtggcagtgtcttctc

SEQ ID NO: 34469 - DNA, 25 bp, Homo sapiens
tctttcctctttgatatggccacag

SEQ ID NO: 34470 - DNA, 25 bp, Homo sapiens
gcttgcctcaacaagttgctgctct

SEQ ID NO: 34471 - DNA, 25 bp, Homo sapiens
agacaacgaggggaccctgcagctg

SEQ ID NO: 34472 - DNA, 25 bp, Homo sapiens
tgaagagaagcttccccatcgagca

SEQ ID NO: 34473 - DNA, 25 bp, Homo sapiens
atgtgcgtgcacttctttgatgtgg

SEQ ID NO: 34474 - DNA, 25 bp, Homo sapiens
gtgcttgatgtcagcttcaactgcg

SEQ ID NO: 34475 - DNA, 25 bp, Homo sapiens
tcaactgcgacgagagcctactggc

SEQ ID NO: 34476 - DNA, 25 bp, Homo sapiens
tgacgccagcggcatggtcatcgtc

SEQ ID NO: 34477 - DNA, 25 bp, Homo sapiens
tggtcatcgtctggaggcgggagca

SEQ ID NO: 34478 - DNA, 25 bp, Homo sapiens
agcagaagtagggtcctgtcggccc

SEQ ID NO: 34479 - DNA, 25 bp, Homo sapiens
tgaaggctgggctaatgctcctgga

SEQ ID NO: 34480 - DNA, 25 bp, Homo sapiens
ggatattcatttacgaccttcctct

SEQ ID NO: 34481 - DNA, 25 bp, Homo sapiens
agtagtcctaggaagcccactgatc

SEQ ID NO: 34482 - DNA, 25 bp, Homo sapiens
tccccaacgggagcaagacttctaa

SEQ ID NO: 34483 - DNA, 25 bp, Homo sapiens
atgtgtagattaagctgtccccagg

SEQ ID NO: 34484 - DNA, 25 bp, Homo sapiens
gaagagccccaagcagactatgtct

SEQ ID NO: 34485 - DNA, 25 bp, Homo sapiens
acaggccagtgcagactttgcttcc

SEQ ID NO: 34486 - DNA, 25 bp, Homo sapiens
accttatctacccattaacacttgt

SEQ ID NO: 34487 - DNA, 25 bp, Homo sapiens
ttgttagagacacctcagtcgggcc

SEQ ID NO: 34488 - DNA, 25 bp, Homo sapiens
tttaagcccacacactctgtagctt

SEQ ID NO: 34489 - DNA, 25 bp, Homo sapiens
gaaggctttttccaagtttgtcata

SEQ ID NO: 34490 - DNA, 25 bp, Homo sapiens
ggaattggagtttttcattcaggaa

SEQ ID NO: 34491 - DNA, 25 bp, Homo sapiens
tgttgttttagggagcacggacttc

SEQ ID NO: 34492 - DNA, 25 bp, Homo sapiens
agggagcacggacttcctagaagat

SEQ ID NO: 34493 - DNA, 25 bp, Homo sapiens
caatcatttttcttcagctttatca

SEQ ID NO: 34494 - DNA, 25 bp, Homo sapiens
gtgggaaagagattcctcgctggat

SEQ ID NO: 34495 - DNA, 25 bp, Homo sapiens
tcgctggatcaatcgacttgcctac

SEQ ID NO: 34496 - DNA, 25 bp, Homo sapiens
gctcctgtataccctttctacagag

SEQ ID NO: 34497 - DNA, 25 bp, Homo sapiens
tataccctttctacagagttgcctc

SEQ ID NO: 34498 - DNA, 25 bp, Homo sapiens
ccctgcagtctagtgtcagccaaga

SEQ ID NO: 34499 - DNA, 25 bp, Homo sapiens
cgggcgccacactaaactataaatg

SEQ ID NO: 34500 - DNA, 25 bp, Homo sapiens
ctataaatgtctccaaagtcacaca

SEQ ID NO: 34501 - DNA, 25 bp, Homo sapiens
aataacgcaaatggcttcctctttc

SEQ ID NO: 34502 - DNA, 25 bp, Homo sapiens
caactccatgtatttattcaagtgc

SEQ ID NO: 34503 - DNA, 25 bp, Homo sapiens
gacacaatgagcttagtacctccaa

SEQ ID NO: 34504 - DNA, 25 bp, Homo sapiens
atgtaaccctgctttgggaatatgg

SEQ ID NO: 34505 - DNA, 25 bp, Homo sapiens
gtaacttgtgtctcatgaaaatcag

SEQ ID NO: 34506 - DNA, 25 bp, Homo sapiens
gtagaacagggtcccacaggtttgg

SEQ ID NO: 34507 - DNA, 25 bp, Homo sapiens
ggtttggggacattgagatcacttg

SEQ ID NO: 34508 - DNA, 25 bp, Homo sapiens
gagatcacttgtcttgtggtgggga

SEQ ID NO: 34509 - DNA, 25 bp, Homo sapiens
tgctgaggggtagcaggtccatctc

SEQ ID NO: 34510 - DNA, 25 bp, Homo sapiens
ggtccaacagtcgtatcctggtgaa

SEQ ID NO: 34511 - DNA, 25 bp, Homo sapiens
tggtgaatgtctgttcagctcttct

SEQ ID NO: 34512 - DNA, 25 bp, Homo sapiens
tgtacctacaggccatattgctcag

SEQ ID NO: 34513 - DNA, 25 bp, Homo sapiens
atattgctcaggctcaggacaaggc

SEQ ID NO: 34514 - DNA, 25 bp, Homo sapiens
caggacaaggcctcaggtcgtgggc

SEQ ID NO: 34515 - DNA, 25 bp, Homo sapiens
gacaggatgtggagtggccaggacc

SEQ ID NO: 34516 - DNA, 25 bp, Homo sapiens
tggccaggaccaagacagcaagcta

SEQ ID NO: 34517 - DNA, 25 bp, Homo sapiens
agcaagctacgcaattgcagccacc

SEQ ID NO: 34518 - DNA, 25 bp, Homo sapiens
gctgcttgccatgcacagtgatcag

SEQ ID NO: 34519 - DNA, 25 bp, Homo sapiens
agagagaggctggggtgtgtcctgt

SEQ ID NO: 34520 - DNA, 25 bp, Homo sapiens
gctgaacaggacaacctctcatcac

SEQ ID NO: 34521 - DNA, 25 bp, Homo sapiens
gacacagtgtaggggccatgcagct

SEQ ID NO: 34522 - DNA, 25 bp, Homo sapiens
gcagctggcgtaggtggcagttggg

SEQ ID NO: 34523 - DNA, 25 bp, Homo sapiens
aattccattcaggttctccaacctt

SEQ ID NO: 34524 - DNA, 25 bp, Homo sapiens
agaggtgacaccataaagtcctgct

SEQ ID NO: 34525 - DNA, 25 bp, Homo sapiens
atggtcgctatttacagtttttcag

SEQ ID NO: 34526 - DNA, 25 bp, Homo sapiens
aaaaatgcttaatccctcatattca

SEQ ID NO: 34527 - DNA, 25 bp, Homo sapiens
ctcatattcaatttcatcaagcctt

SEQ ID NO: 34528 - DNA, 25 bp, Homo sapiens
atcaagccttgtatacttctgctta

SEQ ID NO: 34529 - DNA, 25 bp, Homo sapiens
aattcaatccttggttgttatggca

SEQ ID NO: 34530 - DNA, 25 bp, Homo sapiens
agacagactctggtactatggtaac

SEQ ID NO: 34531 - DNA, 25 bp, Homo sapiens
gattagctttgtagaactgacctgt

SEQ ID NO: 34532 - DNA, 25 bp, Homo sapiens
actgacctgtttatttggcaatgct

SEQ ID NO: 34533 - DNA, 25 bp, Homo sapiens
ggatcatttcggtttcagacttcaa

SEQ ID NO: 34534 - DNA, 25 bp, Homo sapiens
gtaggggttacaattcacattcctt

SEQ ID NO: 34535 - DNA, 25 bp, Homo sapiens
agctggaccaaggctaacctttcta

SEQ ID NO: 34536 - DNA, 25 bp, Homo sapiens
ctttctccctctatgacacaaatga

SEQ ID NO: 34537 - DNA, 25 bp, Homo sapiens
ggagggtgcacataacccttaccct

SEQ ID NO: 34538 - DNA, 25 bp, Homo sapiens
ttaccctacctctgccaaaaagtgg

SEQ ID NO: 34539 - DNA, 25 bp, Homo sapiens
ggactgctcggatgatctttcttag

SEQ ID NO: 34540 - DNA, 25 bp, Homo sapiens
ttagtgctacttctttcagctgtcc

SEQ ID NO: 34541 - DNA, 25 bp, Homo sapiens
cagctgtccctgtagcgacaggtct

SEQ ID NO: 34542 - DNA, 25 bp, Homo sapiens
caggtctaagatctgactgcctcct

SEQ ID NO: 34543 - DNA, 25 bp, Homo sapiens
ctcttctcttcagctaggctagctg

SEQ ID NO: 34544 - DNA, 25 bp, Homo sapiens
gctagcacctagcatttcagcagag

SEQ ID NO: 34545 - DNA, 25 bp, Homo sapiens
gacactaacgaacgagccatgcgca

SEQ ID NO: 34546 - DNA, 25 bp, Homo sapiens
gccatgcgcatggctgacttctggc

SEQ ID NO: 34547 - DNA, 25 bp, Homo sapiens
ggcccctcggtacaaagatcaaact

SEQ ID NO: 34548 - DNA, 25 bp, Homo sapiens
gggggctacacaagaatgctgcaga

SEQ ID NO: 34549 - DNA, 25 bp, Homo sapiens
gaatgctgcagatcccaaatcggag

SEQ ID NO: 34550 - DNA, 25 bp, Homo sapiens
tgcctctgcctcgcagagacagcca

SEQ ID NO: 34551 - DNA, 25 bp, Homo sapiens
accagctgctgcagggtttgcggca

SEQ ID NO: 34552 - DNA, 25 bp, Homo sapiens
gtttgcggcaggacctcaggcaaag

SEQ ID NO: 34553 - DNA, 25 bp, Homo sapiens
gccaggaagcaagcaaccacagctc

SEQ ID NO: 34554 - DNA, 25 bp, Homo sapiens
gagtctgcagcccttaatcagtacc

SEQ ID NO: 34555 - DNA, 25 bp, Homo sapiens
atgatcacaggcctttggagcactt

SEQ ID NO: 34556 - DNA, 25 bp, Homo sapiens
ggggctactaaccatggagcagttc

SEQ ID NO: 34557 - DNA, 25 bp, Homo sapiens
gagcagttcaacactgtcctcaaga

SEQ ID NO: 34558 - DNA, 25 bp, Homo sapiens
aatgcagacttgctcaactaccgct

SEQ ID NO: 34559 - DNA, 25 bp, Homo sapiens
tcaactaccgctcactgtttatgga

SEQ ID NO: 34560 - DNA, 25 bp, Homo sapiens
gccagagtgagccctttgtgcaaaa

SEQ ID NO: 34561 - DNA, 25 bp, Homo sapiens
atgaggaagtgactctgcccaagct

SEQ ID NO: 34562 - DNA, 25 bp, Homo sapiens
tgaacacctacatgagccaggcctt

SEQ ID NO: 34563 - DNA, 25 bp, Homo sapiens
cagctccctgagtcggaaatgccag

SEQ ID NO: 34564 - DNA, 25 bp, Homo sapiens
agccgtggtggaaatcctccagact

SEQ ID NO: 34565 - DNA, 25 bp, Homo sapiens
ctgccctggagcggcttcaggtgat

SEQ ID NO: 34566 - DNA, 25 bp, Homo sapiens
tcaggcgtgtgggacctcgagagcc

SEQ ID NO: 34567 - DNA, 25 bp, Homo sapiens
tcccctgtcaacggcaagatcacgg

SEQ ID NO: 34568 - DNA, 25 bp, Homo sapiens
ggaagatctggaagctggccgacgt

SEQ ID NO: 34569 - DNA, 25 bp, Homo sapiens
tggacaaggacgggctgctggacga

SEQ ID NO: 34570 - DNA, 25 bp, Homo sapiens
gccaaccacctcatcaaggtcaagc

SEQ ID NO: 34571 - DNA, 25 bp, Homo sapiens
caagctggagggccacgagctgccc

SEQ ID NO: 34572 - DNA, 25 bp, Homo sapiens
gtttgcaggccagtggccactgtcc

SEQ ID NO: 34573 - DNA, 25 bp, Homo sapiens
ggtggagcaccaggtaccacacagc

SEQ ID NO: 34574 - DNA, 25 bp, Homo sapiens
gctcggagtctgcaggaactggcct

SEQ ID NO: 34575 - DNA, 25 bp, Homo sapiens
gtgaggatggatgcgggcgctgtcc

SEQ ID NO: 34576 - DNA, 25 bp, Homo sapiens
tccttgccgggaagtcactgttgaa

SEQ ID NO: 34577 - DNA, 25 bp, Homo sapiens
aagttgcagtggcttgttcacacct

SEQ ID NO: 34578 - DNA, 25 bp, Homo sapiens
gggcaggtttggagcccatgggacc

SEQ ID NO: 34579 - DNA, 25 bp, Homo sapiens
gggtctctgtccaggagcagcagag

SEQ ID NO: 34580 - DNA, 25 bp, Homo sapiens
gcagcagaggaggctgacaggccct

SEQ ID NO: 34581 - DNA, 25 bp, Homo sapiens
caccctcccaatgcttatatgctga

SEQ ID NO: 34582 - DNA, 25 bp, Homo sapiens
atatgctgaagctcacagaatgggc

SEQ ID NO: 34583 - DNA, 25 bp, Homo sapiens
cacagaatgggcttcttgcctgaca

SEQ ID NO: 34584 - DNA, 25 bp, Homo sapiens
gggcttcttgcctgacagcaagtca

SEQ ID NO: 34585 - DNA, 25 bp, Homo sapiens
caaagtgtaagcttactttccatcc

SEQ ID NO: 34586 - DNA, 25 bp, Homo sapiens
atttcccatgagcacacttctgggg

SEQ ID NO: 34587 - DNA, 25 bp, Homo sapiens
cagcagagctttggagatgccccag

SEQ ID NO: 34588 - DNA, 25 bp, Homo sapiens
agcttccacagagctcgtttgcaaa

SEQ ID NO: 34589 - DNA, 25 bp, Homo sapiens
cattttttggtgtccgtttgtattg

SEQ ID NO: 34590 - DNA, 25 bp, Homo sapiens
ttggtgtccgtttgtattgaataat

SEQ ID NO: 34591 - DNA, 25 bp, Homo sapiens
caaaaggtggattatcttctgaaga

SEQ ID NO: 34592 - DNA, 25 bp, Homo sapiens
ggaaactgttagtccagaatgatgt

SEQ ID NO: 34593 - DNA, 25 bp, Homo sapiens
gttatagattctctagttttctccc

SEQ ID NO: 34594 - DNA, 25 bp, Homo sapiens
tctctagttttctccctagggatgg

SEQ ID NO: 34595 - DNA, 25 bp, Homo sapiens
gagcccggggagcagggtcatgaac

SEQ ID NO: 34596 - DNA, 25 bp, Homo sapiens
ggagcagggtcatgaacttttttct

SEQ ID NO: 34597 - DNA, 25 bp, Homo sapiens
caatcaagggttttgtattcagaat

SEQ ID NO: 34598 - DNA, 25 bp, Homo sapiens
ggaatgggacattggtgtgtttaga

SEQ ID NO: 34599 - DNA, 25 bp, Homo sapiens
caaatctgtacagtttctattgttc

SEQ ID NO: 34600 - DNA, 25 bp, Homo sapiens
ggctgcatcgcagtgaatttctggt

SEQ ID NO: 34601 - DNA, 25 bp, Homo sapiens
tccctcaccaaggcttcaggccttg

SEQ ID NO: 34602 - DNA, 25 bp, Homo sapiens
aggccttgactgatggagcactggt

SEQ ID NO: 34603 - DNA, 25 bp, Homo sapiens
gagagcctggagtgtgcatgctggc

SEQ ID NO: 34604 - DNA, 25 bp, Homo sapiens
ggaggatcttggaatgtggtcataa

SEQ ID NO: 34605 - DNA, 25 bp, Homo sapiens
gcaggtctgggtgagggttctcagg

SEQ ID NO: 34606 - DNA, 25 bp, Homo sapiens
ggttctcaggaagttgccacacagg

SEQ ID NO: 34607 - DNA, 25 bp, Homo sapiens
ctccccagcgctgtgatgttgggcg

SEQ ID NO: 34608 - DNA, 25 bp, Homo sapiens
gtgatgttgggcgagtcactgcgtc

SEQ ID NO: 34609 - DNA, 25 bp, Homo sapiens
ataataatggctgtacctcgcgggg

SEQ ID NO: 34610 - DNA, 25 bp, Homo sapiens
gccggtgagatgctctatctgccgg

SEQ ID NO: 34611 - DNA, 25 bp, Homo sapiens
ggtgcagacatgctgtgtgaatctc

SEQ ID NO: 34612 - DNA, 25 bp, Homo sapiens
aatgcgtcgtagatgtcgcgtgttg

SEQ ID NO: 34613 - DNA, 25 bp, Homo sapiens
tgaggtgatccttagcaacgtgcca

SEQ ID NO: 34614 - DNA, 25 bp, Homo sapiens
ggaccatttgggatcccgaatctca

SEQ ID NO: 34615 - DNA, 25 bp, Homo sapiens
taatcaatgtatactcccttactgg

SEQ ID NO: 34616 - DNA, 25 bp, Homo sapiens
gaaccaggacacacaattcgccaat

SEQ ID NO: 34617 - DNA, 25 bp, Homo sapiens
tcatcccaccatataaccttcgatt

SEQ ID NO: 34618 - DNA, 25 bp, Homo sapiens
ataaccttcgattgtgcttctcaac

SEQ ID NO: 34619 - DNA, 25 bp, Homo sapiens
ccccataatttctcccagagaccat

SEQ ID NO: 34620 - DNA, 25 bp, Homo sapiens
aaaccagttgcaccttaaaccatgg

SEQ ID NO: 34621 - DNA, 25 bp, Homo sapiens
tcctatgcaacgtgtcttgtagcac

SEQ ID NO: 34622 - DNA, 25 bp, Homo sapiens
ttcttttctaaccaagaggctggtt

SEQ ID NO: 34623 - DNA, 25 bp, Homo sapiens
ttggcatctctgtcccattccctgg

SEQ ID NO: 34624 - DNA, 25 bp, Homo sapiens
agatggaattccttcaggccggcac

SEQ ID NO: 34625 - DNA, 25 bp, Homo sapiens
tccaagggagcctcatgcagatagt

SEQ ID NO: 34626 - DNA, 25 bp, Homo sapiens
aagggagcctcatgcagatagtagg

SEQ ID NO: 34627 - DNA, 25 bp, Homo sapiens
gagcctcatgcagatagtaggaaat

SEQ ID NO: 34628 - DNA, 25 bp, Homo sapiens
cctcatgcagatagtaggaaatcag

SEQ ID NO: 34629 - DNA, 25 bp, Homo sapiens
gagactaaggctatctgcttccctt

SEQ ID NO: 34630 - DNA, 25 bp, Homo sapiens
actaaggctatctgcttcccttatg

SEQ ID NO: 34631 - DNA, 25 bp, Homo sapiens
aaggctatctgcttcccttatgccc

SEQ ID NO: 34632 - DNA, 25 bp, Homo sapiens
tctgcttcccttatgccctgactgg

SEQ ID NO: 34633 - DNA, 25 bp, Homo sapiens
agggcatcccagctaggccttggga

SEQ ID NO: 34634 - DNA, 25 bp, Homo sapiens
gagaaatcccgggaactgtattgac

SEQ ID NO: 34635 - DNA, 25 bp, Homo sapiens
aatcccgggaactgtattgacacaa

SEQ ID NO: 34636 - DNA, 25 bp, Homo sapiens
attgacacaaagattcttattgcac

SEQ ID NO: 34637 - DNA, 25 bp, Homo sapiens
acacaaagattcttattgcacttgt

SEQ ID NO: 34638 - DNA, 25 bp, Homo sapiens
gcaccccgtaactggactggggaca

SEQ ID NO: 34639 - DNA, 25 bp, Homo sapiens
aggctacagacatggcgccatcctc

SEQ ID NO: 34640 - DNA, 25 bp, Homo sapiens
atacaatgacccatgtggtctgcgt

SEQ ID NO: 34641 - DNA, 25 bp, Homo sapiens
agtccaaattttcctggctcccctg

SEQ ID NO: 34642 - DNA, 25 bp, Homo sapiens
tcccaggtcctgcacactgtctttt

SEQ ID NO: 34643 - DNA, 25 bp, Homo sapiens
cctcagccctgtttgctatttcatg

SEQ ID NO: 34644 - DNA, 25 bp, Homo sapiens
ccctgtttgctatttcatgtctgca

SEQ ID NO: 34645 - DNA, 25 bp, Homo sapiens
ttgctatttcatgtctgcatggtac

SEQ ID NO: 34646 - DNA, 25 bp, Homo sapiens
gtctgcatggtacgagacacccctt

SEQ ID NO: 34647 - DNA, 25 bp, Homo sapiens
catacactgccatggtatgtacata

SEQ ID NO: 34648 - DNA, 25 bp, Homo sapiens
ctgccatggtatgtacatatgcatc

SEQ ID NO: 34649 - DNA, 25 bp, Homo sapiens
agcatgtagctcattctgctcagcc

SEQ ID NO: 34650 - DNA, 25 bp, Homo sapiens
agctcattctgctcagcctctggcg

SEQ ID NO: 34651 - DNA, 25 bp, Homo sapiens
ccattgctgtcactgtcgtcccaga

SEQ ID NO: 34652 - DNA, 25 bp, Homo sapiens
cgtctcctggaaacgctggggctgc

SEQ ID NO: 34653 - DNA, 25 bp, Homo sapiens
gcagtcagggcctgctttgcagaat

SEQ ID NO: 34654 - DNA, 25 bp, Homo sapiens
gctccaggccaaagtgccggtgaga

SEQ ID NO: 34655 - DNA, 25 bp, Homo sapiens
ccatggctgtgttggtgtggcccat

SEQ ID NO: 34656 - DNA, 25 bp, Homo sapiens
ggactcgtggctgtcaatgggacct

SEQ ID NO: 34657 - DNA, 25 bp, Homo sapiens
ctgtcaatgggacctgtggctgtcg

SEQ ID NO: 34658 - DNA, 25 bp, Homo sapiens
tcggtgggaccctggttattgatgt

SEQ ID NO: 34659 - DNA, 25 bp, Homo sapiens
ttgatgtggccctggctgccggcac

SEQ ID NO: 34660 - DNA, 25 bp, Homo sapiens
acggcccgtggctgttgacgcacct

SEQ ID NO: 34661 - DNA, 25 bp, Homo sapiens
ttgacgcacctgtggttgttagtgg

SEQ ID NO: 34662 - DNA, 25 bp, Homo sapiens
aaggccggcaggtcaacctcgcgct

SEQ ID NO: 34663 - DNA, 25 bp, Homo sapiens
ggcaggtcaacctcgcgcttgctgg

SEQ ID NO: 34664 - DNA, 25 bp, Homo sapiens
cggcagtattgaagctcgtgacaag

SEQ ID NO: 34665 - DNA, 25 bp, Homo sapiens
attgaagctcgtgacaagtgccttc

SEQ ID NO: 34666 - DNA, 25 bp, Homo sapiens
gctcgtgacaagtgccttcacacag

SEQ ID NO: 34667 - DNA, 25 bp, Homo sapiens
gtgacaagtgccttcacacagaccc

SEQ ID NO: 34668 - DNA, 25 bp, Homo sapiens
tcgcaactgtccacgcgtgccgtgg

SEQ ID NO: 34669 - DNA, 25 bp, Homo sapiens
cctcctcgtgaaagtgcatttttgt

SEQ ID NO: 34670 - DNA, 25 bp, Homo sapiens
ctgggcctccagttcttccacatgt

SEQ ID NO: 34671 - DNA, 25 bp, Homo sapiens
cctccagttcttccacatgtgtgca

SEQ ID NO: 34672 - DNA, 25 bp, Homo sapiens
cctcctcaccttttgttgctatcgg

SEQ ID NO: 34673 - DNA, 25 bp, Homo sapiens
ctcaccttttgttgctatcggcagc

SEQ ID NO: 34674 - DNA, 25 bp, Homo sapiens
ccttttgttgctatcggcagctgct

SEQ ID NO: 34675 - DNA, 25 bp, Homo sapiens
ggctctgggttcctctgccctggaa

SEQ ID NO: 34676 - DNA, 25 bp, Homo sapiens
tctgggttcctctgccctggaaggg

SEQ ID NO: 34677 - DNA, 25 bp, Homo sapiens
ccaaggccccgtgctggatatttaa

SEQ ID NO: 34678 - DNA, 25 bp, Homo sapiens
cacaggagggccaggcatgtattcc

SEQ ID NO: 34679 - DNA, 25 bp, Homo sapiens
agggccaggcatgtattcctcagag

SEQ ID NO: 34680 - DNA, 25 bp, Homo sapiens
aggcatgtattcctcagaggcgaaa

SEQ ID NO: 34681 - DNA, 25 bp, Homo sapiens
tgtattcctcagaggcgaaactgcc

SEQ ID NO: 34682 - DNA, 25 bp, Homo sapiens
cctcagaggcgaaactgccaaactc

SEQ ID NO: 34683 - DNA, 25 bp, Homo sapiens
ggcgaaactgccaaactctttctcc

SEQ ID NO: 34684 - DNA, 25 bp, Homo sapiens
tttctcctgtcttgggttggctggc

SEQ ID NO: 34685 - DNA, 25 bp, Homo sapiens
gcatctagggtacagcctctgctca

SEQ ID NO: 34686 - DNA, 25 bp, Homo sapiens
gatgctcacctgtgccatctgtcct

SEQ ID NO: 34687 - DNA, 25 bp, Homo sapiens
ggccgagcctctacctgaagcaact

SEQ ID NO: 34688 - DNA, 25 bp, Homo sapiens
agcctctacctgaagcaactctgct

SEQ ID NO: 34689 - DNA, 25 bp, Homo sapiens
gggcctgagccacgtcccctaggag

SEQ ID NO: 34690 - DNA, 25 bp, Homo sapiens
agtgagctcaggactactggatccc

SEQ ID NO: 34691 - DNA, 25 bp, Homo sapiens
gagctcaggactactggatcccatg

SEQ ID NO: 34692 - DNA, 25 bp, Homo sapiens
caggtgtccagcagacctcaaggca

SEQ ID NO: 34693 - DNA, 25 bp, Homo sapiens
gtcacctaacccaggagtccacaga

SEQ ID NO: 34694 - DNA, 25 bp, Homo sapiens
acctaacccaggagtccacagactg

SEQ ID NO: 34695 - DNA, 25 bp, Homo sapiens
taacccaggagtccacagactgatg

SEQ ID NO: 34696 - DNA, 25 bp, Homo sapiens
gtccacagactgatgtgacctcagg

SEQ ID NO: 34697 - DNA, 25 bp, Homo sapiens
cacagactgatgtgacctcaggttc

SEQ ID NO: 34698 - DNA, 25 bp, Homo sapiens
ctgatgtgacctcaggttcccacat

SEQ ID NO: 34699 - DNA, 25 bp, Homo sapiens
gtgacctcaggttcccacatcagtg

SEQ ID NO: 34700 - DNA, 25 bp, Homo sapiens
gcccacctggtagaagtgttctgga

SEQ ID NO: 34701 - DNA, 25 bp, Homo sapiens
cacctggtagaagtgttctggatat

SEQ ID NO: 34702 - DNA, 25 bp, Homo sapiens
actcagcccgggaagcaggaagccc

SEQ ID NO: 34703 - DNA, 25 bp, Homo sapiens
cagcccgggaagcaggaagcccctt

SEQ ID NO: 34704 - DNA, 25 bp, Homo sapiens
gcaggaagccccttctgtcactggt

SEQ ID NO: 34705 - DNA, 25 bp, Homo sapiens
gaagccccttctgtcactggtctca

SEQ ID NO: 34706 - DNA, 25 bp, Homo sapiens
ccttctgtcactggtctcagacaca

SEQ ID NO: 34707 - DNA, 25 bp, Homo sapiens
tgtcactggtctcagacacaggccc

SEQ ID NO: 34708 - DNA, 25 bp, Homo sapiens
cccacggcacctctgggagctggga

SEQ ID NO: 34709 - DNA, 25 bp, Homo sapiens
tgggctgagccacaaggcccccgat

SEQ ID NO: 34710 - DNA, 25 bp, Homo sapiens
ggctgagccacaaggcccccgatgg

SEQ ID NO: 34711 - DNA, 25 bp, Homo sapiens
atcggggcctgctgctcctgctggc

SEQ ID NO: 34712 - DNA, 25 bp, Homo sapiens
aatctgtggggtcagcactgtactc

SEQ ID NO: 34713 - DNA, 25 bp, Homo sapiens
tggggtcagcactgtactccgttgc

SEQ ID NO: 34714 - DNA, 25 bp, Homo sapiens
agtagcccagaccacggcagggcat

SEQ ID NO: 34715 - DNA, 25 bp, Homo sapiens
gtagcccagaccacggcagggcatg

SEQ ID NO: 34716 - DNA, 25 bp, Homo sapiens
ccagaccacggcagggcatgacctg

SEQ ID NO: 34717 - DNA, 25 bp, Homo sapiens
ggcttccaaataccactctgtccgg

SEQ ID NO: 34718 - DNA, 25 bp, Homo sapiens
gaaagcatgtctgctgggtgtgacc

SEQ ID NO: 34719 - DNA, 25 bp, Homo sapiens
aaagcatgtctgctgggtgtgacca

SEQ ID NO: 34720 - DNA, 25 bp, Homo sapiens
aagcatgtctgctgggtgtgaccat

SEQ ID NO: 34721 - DNA, 25 bp, Homo sapiens
atgtctgctgggtgtgaccatgttt

SEQ ID NO: 34722 - DNA, 25 bp, Homo sapiens
tgtctgctgggtgtgaccatgtttc

SEQ ID NO: 34723 - DNA, 25 bp, Homo sapiens
gtctgctgggtgtgaccatgtttcc

SEQ ID NO: 34724 - DNA, 25 bp, Homo sapiens
tctgctgggtgtgaccatgtttcct

SEQ ID NO: 34725 - DNA, 25 bp, Homo sapiens
ctgctgggtgtgaccatgtttcctc

SEQ ID NO: 34726 - DNA, 25 bp, Homo sapiens
tgctgggtgtgaccatgtttcctct

SEQ ID NO: 34727 - DNA, 25 bp, Homo sapiens
tgggtgtgaccatgtttcctctcaa

SEQ ID NO: 34728 - DNA, 25 bp, Homo sapiens
gggtgtgaccatgtttcctctcaat

SEQ ID NO: 34729 - DNA, 25 bp, Homo sapiens
ggtgtgaccatgtttcctctcaata

SEQ ID NO: 34730 - DNA, 25 bp, Homo sapiens
gtgtgaccatgtttcctctcaataa

SEQ ID NO: 34731 - DNA, 25 bp, Homo sapiens
gtgaccatgtttcctctcaataaag

SEQ ID NO: 34732 - DNA, 25 bp, Homo sapiens
ggaaagcatgtctgctgggtgtgac

SEQ ID NO: 34733 - DNA, 25 bp, Homo sapiens
agcatgtctgctgggtgtgaccatg

SEQ ID NO: 34734 - DNA, 25 bp, Homo sapiens
gcatgtctgctgggtgtgaccatgt

SEQ ID NO: 34735 - DNA, 25 bp, Homo sapiens
catgtctgctgggtgtgaccatgtt

SEQ ID NO: 34736 - DNA, 25 bp, Homo sapiens
tgtgaccatgtttcctctcaataaa

SEQ ID NO: 34737 - DNA, 25 bp, Homo sapiens
tgaccatgtttcctctcaataaagt

SEQ ID NO: 34738 - DNA, 25 bp, Homo sapiens
gaccatgtttcctctcaataaagtt

SEQ ID NO: 34739 - DNA, 25 bp, Homo sapiens
ccatgtttcctctcaataaagttcc

SEQ ID NO: 34740 - DNA, 25 bp, Homo sapiens
catgtttcctctcaataaagttccc

SEQ ID NO: 34741 - DNA, 25 bp, Homo sapiens
tgtttcctctcaataaagttcccct

SEQ ID NO: 34742 - DNA, 25 bp, Homo sapiens
gtttcctctcaataaagttcccctg

SEQ ID NO: 34743 - DNA, 25 bp, Homo sapiens
ttcctctcaataaagttcccctgtg

SEQ ID NO: 34744 - DNA, 25 bp, Homo sapiens
ctctcaataaagttcccctgtgaca

SEQ ID NO: 34745 - DNA, 25 bp, Homo sapiens
ctcaataaagttcccctgtgacact

SEQ ID NO: 34746 - DNA, 25 bp, Homo sapiens
tcaataaagttcccctgtgacactc

SEQ ID NO: 34747 - DNA, 25 bp, Homo sapiens
taaagttcccctgtgacactcaaaa

SEQ ID NO: 34748 - DNA, 25 bp, Homo sapiens
cgcccggccttgcatgctctttgac

SEQ ID NO: 34749 - DNA, 25 bp, Homo sapiens
ccggccttgcatgctctttgaccct

SEQ ID NO: 34750 - DNA, 25 bp, Homo sapiens
gccttgcatgctctttgaccctgaa

SEQ ID NO: 34751 - DNA, 25 bp, Homo sapiens
gctctttgaccctgaatttgaccta

SEQ ID NO: 34752 - DNA, 25 bp, Homo sapiens
ctttgaccctgaatttgacctactt

SEQ ID NO: 34753 - DNA, 25 bp, Homo sapiens
ccctgaatttgacctacttgctggg

SEQ ID NO: 34754 - DNA, 25 bp, Homo sapiens
tgaatttgacctacttgctggggta

SEQ ID NO: 34755 - DNA, 25 bp, Homo sapiens
atttgacctacttgctggggtacag

SEQ ID NO: 34756 - DNA, 25 bp, Homo sapiens
acttgctggggtacagttgcttcct

SEQ ID NO: 34757 - DNA, 25 bp, Homo sapiens
ggtacagttgcttccttttgaacct

SEQ ID NO: 34758 - DNA, 25 bp, Homo sapiens
acagttgcttccttttgaacctcca

SEQ ID NO: 34759 - DNA, 25 bp, Homo sapiens
gttgcttccttttgaacctccaaca

SEQ ID NO: 34760 - DNA, 25 bp, Homo sapiens
tccttttgaacctccaacagggaag

SEQ ID NO: 34761 - DNA, 25 bp, Homo sapiens
ttttgaacctccaacagggaaggct

SEQ ID NO: 34762 - DNA, 25 bp, Homo sapiens
aacagggaaggctctgtccagaaag

SEQ ID NO: 34763 - DNA, 25 bp, Homo sapiens
ggctctgtccagaaaggattgaatg

SEQ ID NO: 34764 - DNA, 25 bp, Homo sapiens
ccccaggcgatggacaattatgata

SEQ ID NO: 34765 - DNA, 25 bp, Homo sapiens
tattgcctctatgtgcaactgacag

SEQ ID NO: 34766 - DNA, 25 bp, Homo sapiens
ctctatgtgcaactgacagatgacc

SEQ ID NO: 34767 - DNA, 25 bp, Homo sapiens
tgcaactgacagatgaccgcaataa

SEQ ID NO: 34768 - DNA, 25 bp, Homo sapiens
aactgacagatgaccgcaataatga

SEQ ID NO: 34769 - DNA, 25 bp, Homo sapiens
cagatgaccgcaataatgaatgagc

SEQ ID NO: 34770 - DNA, 25 bp, Homo sapiens
tgcttgagatgtcttaacctattcc

SEQ ID NO: 34771 - DNA, 25 bp, Homo sapiens
gcttgagatgtcttaacctattccc

SEQ ID NO: 34772 - DNA, 25 bp, Homo sapiens
aaggagtggtcaagcccttgcccag

SEQ ID NO: 34773 - DNA, 25 bp, Homo sapiens
tctctattctggaagagcggtccag

SEQ ID NO: 34774 - DNA, 25 bp, Homo sapiens
gccactgaattatgccagggcgcac

SEQ ID NO: 34775 - DNA, 25 bp, Homo sapiens
gccagggcgcactttccactggagt

SEQ ID NO: 34776 - DNA, 25 bp, Homo sapiens
cgcactttccactggagttcacttt

SEQ ID NO: 34777 - DNA, 25 bp, Homo sapiens
tccactggagttcactttcaattgc

SEQ ID NO: 34778 - DNA, 25 bp, Homo sapiens
agttcactttcaattgcttctgtgc

SEQ ID NO: 34779 - DNA, 25 bp, Homo sapiens
tgcttctgtgcaataaaaccaagtg

SEQ ID NO: 34780 - DNA, 25 bp, Homo sapiens
ccaggaaactgcaggggctcacgga

SEQ ID NO: 34781 - DNA, 25 bp, Homo sapiens
agctttcctccgtagagaccatgtg

SEQ ID NO: 34782 - DNA, 25 bp, Homo sapiens
aacacttctgctgtgccaagaacat

SEQ ID NO: 34783 - DNA, 25 bp, Homo sapiens
gtgccaagaacatgagggagccagt

SEQ ID NO: 34784 - DNA, 25 bp, Homo sapiens
catgagggagccagtgttttgtcag

SEQ ID NO: 34785 - DNA, 25 bp, Homo sapiens
ttgtcagcaggaagaaagggcctgc

SEQ ID NO: 34786 - DNA, 25 bp, Homo sapiens
gtagtcaggagacacctcaggggca

SEQ ID NO: 34787 - DNA, 25 bp, Homo sapiens
gtcaggagacacctcaggggcaaca

SEQ ID NO: 34788 - DNA, 25 bp, Homo sapiens
ctcaggggcaacagcacaggcccag

SEQ ID NO: 34789 - DNA, 25 bp, Homo sapiens
gggcaacagcacaggcccagagtac

SEQ ID NO: 34790 - DNA, 25 bp, Homo sapiens
ccactgcgtctgtcctggggtcatg

SEQ ID NO: 34791 - DNA, 25 bp, Homo sapiens
tctgtcctggggtcatgaggatgct

SEQ ID NO: 34792 - DNA, 25 bp, Homo sapiens
tcatgaggatgctgaggttgacgac

SEQ ID NO: 34793 - DNA, 25 bp, Homo sapiens
ctttcactcctttggccaaaggttg

SEQ ID NO: 34794 - DNA, 25 bp, Homo sapiens
tgtgtactccgcagctgtttggggt

SEQ ID NO: 34795 - DNA, 25 bp, Homo sapiens
tgggacatttctgtacttctcgatt

SEQ ID NO: 34796 - DNA, 25 bp, Homo sapiens
gcttcctgaaccattaccagatgaa

SEQ ID NO: 34797 - DNA, 25 bp, Homo sapiens
gatgaaaaacccaaatggtccatac

SEQ ID NO: 34798 - DNA, 25 bp, Homo sapiens
tgaagttgtgtttctccactgctca

SEQ ID NO: 34799 - DNA, 25 bp, Homo sapiens
gttgtgtttctccactgctcagcac

SEQ ID NO: 34800 - DNA, 25 bp, Homo sapiens
tgtgtttctccactgctcagcacgc

SEQ ID NO: 34801 - DNA, 25 bp, Homo sapiens
gctcagcacgcctcctaattaggtg

SEQ ID NO: 34802 - DNA, 25 bp, Homo sapiens
tcagcacgcctcctaattaggtgcc

SEQ ID NO: 34803 - DNA, 25 bp, Homo sapiens
aattaggtgcctaggaagagtccca

SEQ ID NO: 34804 - DNA, 25 bp, Homo sapiens
attaggtgcctaggaagagtcccat

SEQ ID NO: 34805 - DNA, 25 bp, Homo sapiens
ggaagacatttctctttcctttatg

SEQ ID NO: 34806 - DNA, 25 bp, Homo sapiens
aggggaactgttatctcccaagatt

SEQ ID NO: 34807 - DNA, 25 bp, Homo sapiens
gggaactgttatctcccaagattaa

SEQ ID NO: 34808 - DNA, 25 bp, Homo sapiens
ggaactgttatctcccaagattaac

SEQ ID NO: 34809 - DNA, 25 bp, Homo sapiens
tttcctgttcatacatttgtgctgc

SEQ ID NO: 34810 - DNA, 25 bp, Homo sapiens
ctgttcatacatttgtgctgcccat

SEQ ID NO: 34811 - DNA, 25 bp, Homo sapiens
gctgcccatgtactcttggcacatt

SEQ ID NO: 34812 - DNA, 25 bp, Homo sapiens
taaacactagttggaagctctcaat

SEQ ID NO: 34813 - DNA, 25 bp, Homo sapiens
ggggagcctcaagcacaatctagct

SEQ ID NO: 34814 - DNA, 25 bp, Homo sapiens
gtcctcctaaagactctgtaatgct

SEQ ID NO: 34815 - DNA, 25 bp, Homo sapiens
ctggtggtcgtgtagaggtccttct

SEQ ID NO: 34816 - DNA, 25 bp, Homo sapiens
tggtggtcgtgtagaggtccttctc

SEQ ID NO: 34817 - DNA, 25 bp, Homo sapiens
gtggtcgtgtagaggtccttctcct

SEQ ID NO: 34818 - DNA, 25 bp, Homo sapiens
gtcgtgtagaggtccttctcctttc

SEQ ID NO: 34819 - DNA, 25 bp, Homo sapiens
gtgtagaggtccttctcctttcaca

SEQ ID NO: 34820 - DNA, 25 bp, Homo sapiens
gtagaggtccttctcctttcacatg

SEQ ID NO: 34821 - DNA, 25 bp, Homo sapiens
gaggtccttctcctttcacatggtg

SEQ ID NO: 34822 - DNA, 25 bp, Homo sapiens
gtccttctcctttcacatggtgcag

SEQ ID NO: 34823 - DNA, 25 bp, Homo sapiens
tctcctttcacatggtgcagagagc

SEQ ID NO: 34824 - DNA, 25 bp, Homo sapiens
ctttcacatggtgcagagagcgagg

SEQ ID NO: 34825 - DNA, 25 bp, Homo sapiens
tcacatggtgcagagagcgaggacc

SEQ ID NO: 34826 - DNA, 25 bp, Homo sapiens
acatggtgcagagagcgaggacctc

SEQ ID NO: 34827 - DNA, 25 bp, Homo sapiens
tacaaccttttgaattagttccgtg

SEQ ID NO: 34828 - DNA, 25 bp, Homo sapiens
tcctctgaggaggaaccggaggtct

SEQ ID NO: 34829 - DNA, 25 bp, Homo sapiens
cgaggacctggcaggcaatgcagcc

SEQ ID NO: 34830 - DNA, 25 bp, Homo sapiens
gacctggcaggcaatgcagcctctc

SEQ ID NO: 34831 - DNA, 25 bp, Homo sapiens
agaaggagtgccataccttctccca

SEQ ID NO: 34832 - DNA, 25 bp, Homo sapiens
ctctgccccaagagcaggaggtgcc

SEQ ID NO: 34833 - DNA, 25 bp, Homo sapiens
ccaagagcaggaggtgcctgaaagc

SEQ ID NO: 34834 - DNA, 25 bp, Homo sapiens
caagagcaggaggtgcctgaaagct

SEQ ID NO: 34835 - DNA, 25 bp, Homo sapiens
cctcagcaggccaaacatggccaga

SEQ ID NO: 34836 - DNA, 25 bp, Homo sapiens
ttgctgtgtagttccctctgcctgg

SEQ ID NO: 34837 - DNA, 25 bp, Homo sapiens
tgcctggcaacatcttacttgtcct

SEQ ID NO: 34838 - DNA, 25 bp, Homo sapiens
tggcaacatcttacttgtcctttga

SEQ ID NO: 34839 - DNA, 25 bp, Homo sapiens
tgaggccccaactcaagtgtcacct

SEQ ID NO: 34840 - DNA, 25 bp, Homo sapiens
tcccccaggcagaaatagttgtctg

SEQ ID NO: 34841 - DNA, 25 bp, Homo sapiens
ccccaggcagaaatagttgtctgtg

SEQ ID NO: 34842 - DNA, 25 bp, Homo sapiens
atagttgtctgtgcttccttggttc

SEQ ID NO: 34843 - DNA, 25 bp, Homo sapiens
gcttccttggttcatgcttctactg

SEQ ID NO: 34844 - DNA, 25 bp, Homo sapiens
ctccctcgtggaggtgccgtgcttt

SEQ ID NO: 34845 - DNA, 25 bp, Homo sapiens
gtatgtgcgctcagggtctctgttt

SEQ ID NO: 34846 - DNA, 25 bp, Homo sapiens
ctcagggtctctgtttaagtatcag

SEQ ID NO: 34847 - DNA, 25 bp, Homo sapiens
gtctctgtttaagtatcagctaaag

SEQ ID NO: 34848 - DNA, 25 bp, Homo sapiens
cttcctccgtgtctgtcatacactg

SEQ ID NO: 34849 - DNA, 25 bp, Homo sapiens
ccgtgtctgtcatacactgagacca

SEQ ID NO: 34850 - DNA, 25 bp, Homo sapiens
ctgtcatacactgagaccaacaggc

SEQ ID NO: 34851 - DNA, 25 bp, Homo sapiens
tcatacactgagaccaacaggctac

SEQ ID NO: 34852 - DNA, 25 bp, Homo sapiens
accaacaggctacagtgtccctgat

SEQ ID NO: 34853 - DNA, 25 bp, Homo sapiens
ctacagtgtccctgattcttggaaa

SEQ ID NO: 34854 - DNA, 25 bp, Homo sapiens
cagtgtccctgattcttggaaaagc

SEQ ID NO: 34855 - DNA, 25 bp, Homo sapiens
ctgtgttgagctgacattcaaatgg

SEQ ID NO: 34856 - DNA, 25 bp, Homo sapiens
tgggacctttcctccatccctgttg

SEQ ID NO: 34857 - DNA, 25 bp, Homo sapiens
actggtgctaactggcccaggcact

SEQ ID NO: 34858 - DNA, 25 bp, Homo sapiens
atggcctctgcagcacacgcagctg

SEQ ID NO: 34859 - DNA, 25 bp, Homo sapiens
tggcctctgcagcacacgcagctgg

SEQ ID NO: 34860 - DNA, 25 bp, Homo sapiens
gtaccctcgtatgcaggtgactgtg

SEQ ID NO: 34861 - DNA, 25 bp, Homo sapiens
taccctcgtatgcaggtgactgtgt

SEQ ID NO: 34862 - DNA, 25 bp, Homo sapiens
accctcgtatgcaggtgactgtgtt

SEQ ID NO: 34863 - DNA, 25 bp, Homo sapiens
ccctcgtatgcaggtgactgtgttt

SEQ ID NO: 34864 - DNA, 25 bp, Homo sapiens
cctcgtatgcaggtgactgtgtttg

SEQ ID NO: 34865 - DNA, 25 bp, Homo sapiens
ctcgtatgcaggtgactgtgtttga

SEQ ID NO: 34866 - DNA, 25 bp, Homo sapiens
tcgtatgcaggtgactgtgtttgac

SEQ ID NO: 34867 - DNA, 25 bp, Homo sapiens
cgtatgcaggtgactgtgtttgacc

SEQ ID NO: 34868 - DNA, 25 bp, Homo sapiens
gtatgcaggtgactgtgtttgacct

SEQ ID NO: 34869 - DNA, 25 bp, Homo sapiens
tatgcaggtgactgtgtttgacctc

SEQ ID NO: 34870 - DNA, 25 bp, Homo sapiens
atgcaggtgactgtgtttgacctcc

SEQ ID NO: 34871 - DNA, 25 bp, Homo sapiens
tgcaggtgactgtgtttgacctccc

SEQ ID NO: 34872 - DNA, 25 bp, Homo sapiens
caggtgactgtgtttgacctcccag

SEQ ID NO: 34873 - DNA, 25 bp, Homo sapiens
aggtgactgtgtttgacctcccaga

SEQ ID NO: 34874 - DNA, 25 bp, Homo sapiens
ggtgactgtgtttgacctcccagac

SEQ ID NO: 34875 - DNA, 25 bp, Homo sapiens
gtgactgtgtttgacctcccagaca

SEQ ID NO: 34876 - DNA, 25 bp, Homo sapiens
gtgaaggagacctgtgcttggttca

SEQ ID NO: 34877 - DNA, 25 bp, Homo sapiens
actgacaactacgagcaggcccgga

SEQ ID NO: 34878 - DNA, 25 bp, Homo sapiens
agctggaagacaggatcaggtgcca

SEQ ID NO: 34879 - DNA, 25 bp, Homo sapiens
aagacaggatcaggtgccagcggac

SEQ ID NO: 34880 - DNA, 25 bp, Homo sapiens
agacaggatcaggtgccagcggacc

SEQ ID NO: 34881 - DNA, 25 bp, Homo sapiens
gtcaaccctgccaggagctgagggc

SEQ ID NO: 34882 - DNA, 25 bp, Homo sapiens
tggggcccccattcacgttggtcct

SEQ ID NO: 34883 - DNA, 25 bp, Homo sapiens
cattcacgttggtcctcagggaaac

SEQ ID NO: 34884 - DNA, 25 bp, Homo sapiens
tcacgttggtcctcagggaaaccag

SEQ ID NO: 34885 - DNA, 25 bp, Homo sapiens
gcgcgtgtccactctgatcctgcat

SEQ ID NO: 34886 - DNA, 25 bp, Homo sapiens
tggagcccatcatcctctccgtggg

SEQ ID NO: 34887 - DNA, 25 bp, Homo sapiens
gaggtctccatcaaggaggcagccg

SEQ ID NO: 34888 - DNA, 25 bp, Homo sapiens
tctccatcaaggaggcagccgaggc

SEQ ID NO: 34889 - DNA, 25 bp, Homo sapiens
gggaagtcacctttgatacaaccaa

SEQ ID NO: 34890 - DNA, 25 bp, Homo sapiens
tttgatacaaccaagtcggatgggc

SEQ ID NO: 34891 - DNA, 25 bp, Homo sapiens
acacccttcaagcaggcggtgaagg

SEQ ID NO: 34892 - DNA, 25 bp, Homo sapiens
ccagggatgctctttgtaaatatcg

SEQ ID NO: 34893 - DNA, 25 bp, Homo sapiens
gccccaaggttccagaggccctagg

SEQ ID NO: 34894 - DNA, 25 bp, Homo sapiens
ctgaacctcgaggaactccaggacg

SEQ ID NO: 34895 - DNA, 25 bp, Homo sapiens
acagtcagggttcacttgggctctc

SEQ ID NO: 34896 - DNA, 25 bp, Homo sapiens
ttgggctctctctagctccccaatt

SEQ ID NO: 34897 - DNA, 25 bp, Homo sapiens
cccagctgcactttaaccctagaag

SEQ ID NO: 34898 - DNA, 25 bp, Homo sapiens
cagctgcactttaaccctagaaggt

SEQ ID NO: 34899 - DNA, 25 bp, Homo sapiens
agctgcactttaaccctagaaggtg

SEQ ID NO: 34900 - DNA, 25 bp, Homo sapiens
gcaggcgggcccatgaagaaagccc

SEQ ID NO: 34901 - DNA, 25 bp, Homo sapiens
caggcgggcccatgaagaaagcccc

SEQ ID NO: 34902 - DNA, 25 bp, Homo sapiens
cactgtctgcgtctgctcttctgtg

SEQ ID NO: 34903 - DNA, 25 bp, Homo sapiens
gtctgcgtctgctcttctgtgccca

SEQ ID NO: 34904 - DNA, 25 bp, Homo sapiens
cctcctggctgttgcgacgcgggct

SEQ ID NO: 34905 - DNA, 25 bp, Homo sapiens
tcaccattggacagtctccctgatg

SEQ ID NO: 34906 - DNA, 25 bp, Homo sapiens
agtctccctgatggaccctcagtct

SEQ ID NO: 34907 - DNA, 25 bp, Homo sapiens
cctgatggaccctcagtcttctcat

SEQ ID NO: 34908 - DNA, 25 bp, Homo sapiens
accggatctgctctgaccgcacttg

SEQ ID NO: 34909 - DNA, 25 bp, Homo sapiens
gctctgaccgcacttgaaggctggg

SEQ ID NO: 34910 - DNA, 25 bp, Homo sapiens
tgtgccggccattcgttttctctct

SEQ ID NO: 34911 - DNA, 25 bp, Homo sapiens
tgccggccattcgttttctctctct

SEQ ID NO: 34912 - DNA, 25 bp, Homo sapiens
caccctcgaggcagggaaaagccat

SEQ ID NO: 34913 - DNA, 25 bp, Homo sapiens
ccagttgaaagacacccagtgcaca

SEQ ID NO: 34914 - DNA, 25 bp, Homo sapiens
acatctgggccgtggactatctgat

SEQ ID NO: 34915 - DNA, 25 bp, Homo sapiens
cgtggactatctgatcttggtcctg

SEQ ID NO: 34916 - DNA, 25 bp, Homo sapiens
ctatctgatcttggtcctggccgag

SEQ ID NO: 34917 - DNA, 25 bp, Homo sapiens
cagcccggagtaaggttcagaaagt

SEQ ID NO: 34918 - DNA, 25 bp, Homo sapiens
cgagaaacccagttctcctgggcca

SEQ ID NO: 34919 - DNA, 25 bp, Homo sapiens
tcctgggccaaggatcccttctggc

SEQ ID NO: 34920 - DNA, 25 bp, Homo sapiens
ttctggcaaagctgctgctccgccg

SEQ ID NO: 34921 - DNA, 25 bp, Homo sapiens
gcaaagctgctgctccgccgcttgg

SEQ ID NO: 34922 - DNA, 25 bp, Homo sapiens
caaagctgctgctccgccgcttggt

SEQ ID NO: 34923 - DNA, 25 bp, Homo sapiens
gtaagggctcccaggtcttcatctg

SEQ ID NO: 34924 - DNA, 25 bp, Homo sapiens
tgtcccgggagagcatcttcaacaa

SEQ ID NO: 34925 - DNA, 25 bp, Homo sapiens
acagctctaacctggcctgtgtctt

SEQ ID NO: 34926 - DNA, 25 bp, Homo sapiens
tggcctgtgtcttcgggctgaattt

SEQ ID NO: 34927 - DNA, 25 bp, Homo sapiens
gtgtcttcgggctgaatttgatctg

SEQ ID NO: 34928 - DNA, 25 bp, Homo sapiens
tgcccctgaacatgttcactgaact

SEQ ID NO: 34929 - DNA, 25 bp, Homo sapiens
tgttcactgaactgctgatcgagta

SEQ ID NO: 34930 - DNA, 25 bp, Homo sapiens
ctgaactgctgatcgagtactatga

SEQ ID NO: 34931 - DNA, 25 bp, Homo sapiens
ttgcaggaggctgtgccacggacac

SEQ ID NO: 34932 - DNA, 25 bp, Homo sapiens
tgtgccacggacacaagccacgggc

SEQ ID NO: 34933 - DNA, 25 bp, Homo sapiens
gccagaagacgtctctagtgttgcg

SEQ ID NO: 34934 - DNA, 25 bp, Homo sapiens
cagaagacgtctctagtgttgcgaa

SEQ ID NO: 34935 - DNA, 25 bp, Homo sapiens
aagacgtctctagtgttgcgaacac

SEQ ID NO: 34936 - DNA, 25 bp, Homo sapiens
cgtctctagtgttgcgaacactctg

SEQ ID NO: 34937 - DNA, 25 bp, Homo sapiens
cacacctgtctgtgcacttgtatgt

SEQ ID NO: 34938 - DNA, 25 bp, Homo sapiens
acctgtctgtgcacttgtatgtttt

SEQ ID NO: 34939 - DNA, 25 bp, Homo sapiens
ctgtgcacttgtatgttttgtaaac

SEQ ID NO: 34940 - DNA, 25 bp, Homo sapiens
gagggcagtccctcagaatcccaga

SEQ ID NO: 34941 - DNA, 25 bp, Homo sapiens
cagaacccaggataggaaatgggtg

SEQ ID NO: 34942 - DNA, 25 bp, Homo sapiens
tcctctcctatggtgagcccagcgt

SEQ ID NO: 34943 - DNA, 25 bp, Homo sapiens
tctcctatggtgagcccagcgtggg

SEQ ID NO: 34944 - DNA, 25 bp, Homo sapiens
ccagttgggctgtgttaaaggaagc

SEQ ID NO: 34945 - DNA, 25 bp, Homo sapiens
agcccccagagtcctgtgcattctg

SEQ ID NO: 34946 - DNA, 25 bp, Homo sapiens
agtcctgtgcattctgccaaggctc

SEQ ID NO: 34947 - DNA, 25 bp, Homo sapiens
gtgcattctgccaaggctccatagc

SEQ ID NO: 34948 - DNA, 25 bp, Homo sapiens
ctttgccaaatgcacggagctctgc

SEQ ID NO: 34949 - DNA, 25 bp, Homo sapiens
ccattccggtgcagtgcaggccttg

SEQ ID NO: 34950 - DNA, 25 bp, Homo sapiens
tctgcgttcgtctcggtgggcttct

SEQ ID NO: 34951 - DNA, 25 bp, Homo sapiens
tcctgcatgggagttgtgttcctgt

SEQ ID NO: 34952 - DNA, 25 bp, Homo sapiens
caggatgactgtcttccctattctt

SEQ ID NO: 34953 - DNA, 25 bp, Homo sapiens
caagtcccaagatgccagaaaggca

SEQ ID NO: 34954 - DNA, 25 bp, Homo sapiens
tgccagaaaggcagtctcccaagga

SEQ ID NO: 34955 - DNA, 25 bp, Homo sapiens
ccaaggacccaccatgcagaagtgt

SEQ ID NO: 34956 - DNA, 25 bp, Homo sapiens
ccatcactcctgtgcctgctggggt

SEQ ID NO: 34957 - DNA, 25 bp, Homo sapiens
tgtctgctgggctggagataagact

SEQ ID NO: 34958 - DNA, 25 bp, Homo sapiens
agggcccagagttcaccctctagtg

SEQ ID NO: 34959 - DNA, 25 bp, Homo sapiens
cagagttcaccctctagtggatcca

SEQ ID NO: 34960 - DNA, 25 bp, Homo sapiens
tcaccctctagtggatccaggagga

SEQ ID NO: 34961 - DNA, 25 bp, Homo sapiens
tctagtggatccaggaggagcagca

SEQ ID NO: 34962 - DNA, 25 bp, Homo sapiens
acccgagccctggagtggcccagta

SEQ ID NO: 34963 - DNA, 25 bp, Homo sapiens
gagtggcccagtacccttccaagag

SEQ ID NO: 34964 - DNA, 25 bp, Homo sapiens
agtcccagccaggacaaagtatgcg

SEQ ID NO: 34965 - DNA, 25 bp, Homo sapiens
agccaggacaaagtatgcggcccat

SEQ ID NO: 34966 - DNA, 25 bp, Homo sapiens
gtatgcggcccatcctggtgcgaca

SEQ ID NO: 34967 - DNA, 25 bp, Homo sapiens
tcctggtgcgacagcgtgggacaat

SEQ ID NO: 34968 - DNA, 25 bp, Homo sapiens
tgtgaacatggactcgaagacatgg

SEQ ID NO: 34969 - DNA, 25 bp, Homo sapiens
catggactcgaagacatggcccttt

SEQ ID NO: 34970 - DNA, 25 bp, Homo sapiens
gacatggccctttctctgtagttga

SEQ ID NO: 34971 - DNA, 25 bp, Homo sapiens
aacacctttaagaggcttgaaagag

SEQ ID NO: 34972 - DNA, 25 bp, Homo sapiens
ttcagtacatcgtgggccgcagcag

SEQ ID NO: 34973 - DNA, 25 bp, Homo sapiens
tgggccgcagcaggaagcaaagcaa

SEQ ID NO: 34974 - DNA, 25 bp, Homo sapiens
tgcttatccacgtggacaccaaggc

SEQ ID NO: 34975 - DNA, 25 bp, Homo sapiens
agcccacagccaaagtgatagagga

SEQ ID NO: 34976 - DNA, 25 bp, Homo sapiens
atgtttgcgttcatcgcgcggtgcc

SEQ ID NO: 34977 - DNA, 25 bp, Homo sapiens
tgtttgcgttcatcgcgcggtgcct

SEQ ID NO: 34978 - DNA, 25 bp, Homo sapiens
gcgacagaaaacctcaagggctttc

SEQ ID NO: 34979 - DNA, 25 bp, Homo sapiens
ttgacaccaagaaaccactgggcat

SEQ ID NO: 34980 - DNA, 25 bp, Homo sapiens
aaccactgggcataatgcttcccca

SEQ ID NO: 34981 - DNA, 25 bp, Homo sapiens
tgggcataatgcttccccacgggaa

SEQ ID NO: 34982 - DNA, 25 bp, Homo sapiens
ttcctgcactcacaggctacagttg

SEQ ID NO: 34983 - DNA, 25 bp, Homo sapiens
cactcacaggctacagttgaacaga

SEQ ID NO: 34984 - DNA, 25 bp, Homo sapiens
ctgtctaggcacatgtggttttttg

SEQ ID NO: 34985 - DNA, 25 bp, Homo sapiens
ctaaatggcaacaaacacattgtga

SEQ ID NO: 34986 - DNA, 25 bp, Homo sapiens
tgagaactgttctcatggagaagac

SEQ ID NO: 34987 - DNA, 25 bp, Homo sapiens
ttctcatggagaagacttctttgca

SEQ ID NO: 34988 - DNA, 25 bp, Homo sapiens
gggatcacagaccatttctttcttt

SEQ ID NO: 34989 - DNA, 25 bp, Homo sapiens
cagaccatttctttctttcggccag

SEQ ID NO: 34990 - DNA, 25 bp, Homo sapiens
accatttctttctttcggccaggct

SEQ ID NO: 34991 - DNA, 25 bp, Homo sapiens
catttctttctttcggccaggctga

SEQ ID NO: 34992 - DNA, 25 bp, Homo sapiens
tttctttcggccaggctgaggccct

SEQ ID NO: 34993 - DNA, 25 bp, Homo sapiens
tttcggccaggctgaggccctgacg

SEQ ID NO: 34994 - DNA, 25 bp, Homo sapiens
aggccctgacgtggatgggcaaact

SEQ ID NO: 34995 - DNA, 25 bp, Homo sapiens
ccctgacgtggatgggcaaactgca

SEQ ID NO: 34996 - DNA, 25 bp, Homo sapiens
tgcatgacgccctgctctggggagc

SEQ ID NO: 34997 - DNA, 25 bp, Homo sapiens
gcgtctggcgcgatctctgcctgct

SEQ ID NO: 34998 - DNA, 25 bp, Homo sapiens
tctctgcctgcttactcgggaaatt

SEQ ID NO: 34999 - DNA, 25 bp, Homo sapiens
tgcttactcgggaaatttgcttttg

SEQ ID NO: 35000 - DNA, 25 bp, Homo sapiens
gcttactcgggaaatttgcttttgc

SEQ ID NO: 35001 - DNA, 25 bp, Homo sapiens
tactcgggaaatttgcttttgccaa

SEQ ID NO: 35002 - DNA, 25 bp, Homo sapiens
gaaatttgcttttgccaaacccgct

SEQ ID NO: 35003 - DNA, 25 bp, Homo sapiens
tgcttttgccaaacccgctttttcg

SEQ ID NO: 35004 - DNA, 25 bp, Homo sapiens
agtgctatctgatgacggggaaaca

SEQ ID NO: 35005 - DNA, 25 bp, Homo sapiens
gatgtgtgtggacatctctgaccat

SEQ ID NO: 35006 - DNA, 25 bp, Homo sapiens
tgtgtggacatctctgaccatccat

SEQ ID NO: 35007 - DNA, 25 bp, Homo sapiens
gacatctctgaccatccatcgctgt

SEQ ID NO: 35008 - DNA, 25 bp, Homo sapiens
gtctcaggcatgaccacgtccagtg

SEQ ID NO: 35009 - DNA, 25 bp, Homo sapiens
ggcatgaccacgtccagtgaagaca

SEQ ID NO: 35010 - DNA, 25 bp, Homo sapiens
atttgaggcagcacatctcaggacc

SEQ ID NO: 35011 - DNA, 25 bp, Homo sapiens
ggcagcacatctcaggacccaggca

SEQ ID NO: 35012 - DNA, 25 bp, Homo sapiens
tgtgtggaacagctcaccttgtcag

SEQ ID NO: 35013 - DNA, 25 bp, Homo sapiens
ctcagggcatctctgagacacaggg

SEQ ID NO: 35014 - DNA, 25 bp, Homo sapiens
gcatctctgagacacaggggcagaa

SEQ ID NO: 35015 - DNA, 25 bp, Homo sapiens
tcttttgagtcctcatccatggagt

SEQ ID NO: 35016 - DNA, 25 bp, Homo sapiens
gagtcctcatccatggagtgctgtg

SEQ ID NO: 35017 - DNA, 25 bp, Homo sapiens
ctcatccatggagtgctgtgtttgg

SEQ ID NO: 35018 - DNA, 25 bp, Homo sapiens
tcatccatggagtgctgtgtttggg

SEQ ID NO: 35019 - DNA, 25 bp, Homo sapiens
accaggatgcccattctccaggact

SEQ ID NO: 35020 - DNA, 25 bp, Homo sapiens
ggatctgctcgtcatcatttttcct

SEQ ID NO: 35021 - DNA, 25 bp, Homo sapiens
tcacgaatattatgcccagtttctg

SEQ ID NO: 35022 - DNA, 25 bp, Homo sapiens
atattatgcccagtttctgcctctg

SEQ ID NO: 35023 - DNA, 25 bp, Homo sapiens
attatgcccagtttctgcctctgag

SEQ ID NO: 35024 - DNA, 25 bp, Homo sapiens
ttatgcccagtttctgcctctgagg

SEQ ID NO: 35025 - DNA, 25 bp, Homo sapiens
tttctgcctctgagggaaagcccag

SEQ ID NO: 35026 - DNA, 25 bp, Homo sapiens
cctctgagggaaagcccagaaaagg

SEQ ID NO: 35027 - DNA, 25 bp, Homo sapiens
aggggcccagtcctggcctggcttc

SEQ ID NO: 35028 - DNA, 25 bp, Homo sapiens
tggcctggcttctcctttggaagtg

SEQ ID NO: 35029 - DNA, 25 bp, Homo sapiens
tggcttctcctttggaagtgaggca

SEQ ID NO: 35030 - DNA, 25 bp, Homo sapiens
tcctttggaagtgaggcattgcacg

SEQ ID NO: 35031 - DNA, 25 bp, Homo sapiens
cctttggaagtgaggcattgcacgg

SEQ ID NO: 35032 - DNA, 25 bp, Homo sapiens
cattgcacggggagacgtacgtatc

SEQ ID NO: 35033 - DNA, 25 bp, Homo sapiens
ttgcacggggagacgtacgtatcag

SEQ ID NO: 35034 - DNA, 25 bp, Homo sapiens
gacgtacgtatcagcggccccttga

SEQ ID NO: 35035 - DNA, 25 bp, Homo sapiens
atcagcggccccttgactctgggga

SEQ ID NO: 35036 - DNA, 25 bp, Homo sapiens
gctctgtgggcttctccaggagcag

SEQ ID NO: 35037 - DNA, 25 bp, Homo sapiens
acaggagctgggagccccgtctcca

SEQ ID NO: 35038 - DNA, 25 bp, Homo sapiens
ctgggagccccgtctccaggaaaag

SEQ ID NO: 35039 - DNA, 25 bp, Homo sapiens
gccccgtctccaggaaaaggagagg

SEQ ID NO: 35040 - DNA, 25 bp, Homo sapiens
ggctacttgatcttgctgaaagtgt

SEQ ID NO: 35041 - DNA, 25 bp, Homo sapiens
gctacttgatcttgctgaaagtgtt

SEQ ID NO: 35042 - DNA, 25 bp, Homo sapiens
cttgatcttgctgaaagtgtttcta

SEQ ID NO: 35043 - DNA, 25 bp, Homo sapiens
aaacgtatcatgcaccaactgtgaa

SEQ ID NO: 35044 - DNA, 25 bp, Homo sapiens
atagctgccgcttgcgcagaggacc

SEQ ID NO: 35045 - DNA, 25 bp, Homo sapiens
gagaggctccccatgcaacactgga

SEQ ID NO: 35046 - DNA, 25 bp, Homo sapiens
actgttccagagagcgggcagacct

SEQ ID NO: 35047 - DNA, 25 bp, Homo sapiens
gttcctgccagaaacgaccctctgt

SEQ ID NO: 35048 - DNA, 25 bp, Homo sapiens
aacgaccctctgtggccgatgggcc

SEQ ID NO: 35049 - DNA, 25 bp, Homo sapiens
ccaactcagccagtgttgggactgg

SEQ ID NO: 35050 - DNA, 25 bp, Homo sapiens
cagtgttgggactggctcagagccc

SEQ ID NO: 35051 - DNA, 25 bp, Homo sapiens
gggcagctgggactctggaatcttc

SEQ ID NO: 35052 - DNA, 25 bp, Homo sapiens
accaccattggacctatcttggctt

SEQ ID NO: 35053 - DNA, 25 bp, Homo sapiens
ttggacctatcttggcttctcggct

SEQ ID NO: 35054 - DNA, 25 bp, Homo sapiens
ggcttctttgagctgttcccttctc

SEQ ID NO: 35055 - DNA, 25 bp, Homo sapiens
ccataatctcttagtggattgagcc

SEQ ID NO: 35056 - DNA, 25 bp, Homo sapiens
ctcttagtggattgagccctcttgg

SEQ ID NO: 35057 - DNA, 25 bp, Homo sapiens
tggattgagccctcttggaaagact

SEQ ID NO: 35058 - DNA, 25 bp, Homo sapiens
agccctcttggaaagacttctctgc

SEQ ID NO: 35059 - DNA, 25 bp, Homo sapiens
tggaaagacttctctgccatccctt

SEQ ID NO: 35060 - DNA, 25 bp, Homo sapiens
tctgccatccctttgcacctgagag

SEQ ID NO: 35061 - DNA, 25 bp, Homo sapiens
tgccatccctttgcacctgagaggg

SEQ ID NO: 35062 - DNA, 25 bp, Homo sapiens
gggagttgagcctggcttgaacctt

SEQ ID NO: 35063 - DNA, 25 bp, Homo sapiens
agcctggcttgaacctttggaacca

SEQ ID NO: 35064 - DNA, 25 bp, Homo sapiens
cctggcttgaacctttggaaccaga

SEQ ID NO: 35065 - DNA, 25 bp, Homo sapiens
tggcttgaacctttggaaccagaaa

SEQ ID NO: 35066 - DNA, 25 bp, Homo sapiens
gcttgaacctttggaaccagaaaag

SEQ ID NO: 35067 - DNA, 25 bp, Homo sapiens
gaggccacactcctgggagctgatg

SEQ ID NO: 35068 - DNA, 25 bp, Homo sapiens
agtgacacagccatccttgggtgta

SEQ ID NO: 35069 - DNA, 25 bp, Homo sapiens
cacagccatccttgggtgtaggcta

SEQ ID NO: 35070 - DNA, 25 bp, Homo sapiens
agtctggccgcgtgctttcggccat

SEQ ID NO: 35071 - DNA, 25 bp, Homo sapiens
gtctggccgcgtgctttcggccatg

SEQ ID NO: 35072 - DNA, 25 bp, Homo sapiens
tggccgcgtgctttcggccatgatc

SEQ ID NO: 35073 - DNA, 25 bp, Homo sapiens
ggccgcgtgctttcggccatgatcc

SEQ ID NO: 35074 - DNA, 25 bp, Homo sapiens
tgctttcggccatgatccggggagc

SEQ ID NO: 35075 - DNA, 25 bp, Homo sapiens
tttcggccatgatccggggagcagc

SEQ ID NO: 35076 - DNA, 25 bp, Homo sapiens
atccggggagcagcagatggctctc

SEQ ID NO: 35077 - DNA, 25 bp, Homo sapiens
gcagcagatggctctcggttccagg

SEQ ID NO: 35078 - DNA, 25 bp, Homo sapiens
cagcagatggctctcggttccaggt

SEQ ID NO: 35079 - DNA, 25 bp, Homo sapiens
agcagatggctctcggttccaggtg

SEQ ID NO: 35080 - DNA, 25 bp, Homo sapiens
atacttcgaggctgatcctccaggg

SEQ ID NO: 35081 - DNA, 25 bp, Homo sapiens
ttcgaggctgatcctccagggcagg

SEQ ID NO: 35082 - DNA, 25 bp, Homo sapiens
tcgaggctgatcctccagggcaggt

SEQ ID NO: 35083 - DNA, 25 bp, Homo sapiens
atcctccagggcaggtggctgcctc

SEQ ID NO: 35084 - DNA, 25 bp, Homo sapiens
agctccacaggttgggagccgtcgt

SEQ ID NO: 35085 - DNA, 25 bp, Homo sapiens
cgcccagcgttccaggcacatgaag

SEQ ID NO: 35086 - DNA, 25 bp, Homo sapiens
attccaaagcctctgattgttgttt

SEQ ID NO: 35087 - DNA, 25 bp, Homo sapiens
tcctcccgaaggaacagctgattca

SEQ ID NO: 35088 - DNA, 25 bp, Homo sapiens
aggaacagctgattcatgctcctcc

SEQ ID NO: 35089 - DNA, 25 bp, Homo sapiens
gcaattgtcacgtctgtgatttatt

SEQ ID NO: 35090 - DNA, 25 bp, Homo sapiens
caattgtcacgtctgtgatttattt

SEQ ID NO: 35091 - DNA, 25 bp, Homo sapiens
gctcatgggccctggtgtttgcacc

SEQ ID NO: 35092 - DNA, 25 bp, Homo sapiens
ctcatgggccctggtgtttgcaccg

SEQ ID NO: 35093 - DNA, 25 bp, Homo sapiens
atgggccctggtgtttgcaccgcac

SEQ ID NO: 35094 - DNA, 25 bp, Homo sapiens
gtttgcaccgcactttgtaatcagt

SEQ ID NO: 35095 - DNA, 25 bp, Homo sapiens
tgcaccgcactttgtaatcagtccc

SEQ ID NO: 35096 - DNA, 25 bp, Homo sapiens
gcactttgtaatcagtcccgtggtt

SEQ ID NO: 35097 - DNA, 25 bp, Homo sapiens
ctttgtaatcagtcccgtggttgtc

SEQ ID NO: 35098 - DNA, 25 bp, Homo sapiens
tcccgtggttgtctgtacagaatta

SEQ ID NO: 35099 - DNA, 25 bp, Homo sapiens
cgtggttgtctgtacagaattaaac

SEQ ID NO: 35100 - DNA, 25 bp, Homo sapiens
gctccctctgagtcccatgctggtg

SEQ ID NO: 35101 - DNA, 25 bp, Homo sapiens
ctctgagtcccatgctggtgcccag

SEQ ID NO: 35102 - DNA, 25 bp, Homo sapiens
tctgagtcccatgctggtgcccagc

SEQ ID NO: 35103 - DNA, 25 bp, Homo sapiens
gtcccatgctggtgcccagcctagg

SEQ ID NO: 35104 - DNA, 25 bp, Homo sapiens
ccccatgacgcagaactcctggagg

SEQ ID NO: 35105 - DNA, 25 bp, Homo sapiens
gaactcctggaggtagcagcagctc

SEQ ID NO: 35106 - DNA, 25 bp, Homo sapiens
ccagagtggtgtcctctggcagccc

SEQ ID NO: 35107 - DNA, 25 bp, Homo sapiens
agttggcggtcacagagggctcctc

SEQ ID NO: 35108 - DNA, 25 bp, Homo sapiens
cagagggctcctctgccaggcagtg

SEQ ID NO: 35109 - DNA, 25 bp, Homo sapiens
aagccctgggtttggcctcaggagc

SEQ ID NO: 35110 - DNA, 25 bp, Homo sapiens
gggggactgccctagtccttgccag

SEQ ID NO: 35111 - DNA, 25 bp, Homo sapiens
caggtcgccagcaccctggagaagc

SEQ ID NO: 35112 - DNA, 25 bp, Homo sapiens
caaaggccacgactgcctgttgggg

SEQ ID NO: 35113 - DNA, 25 bp, Homo sapiens
gcatggacagtgtgctcaagctgtg

SEQ ID NO: 35114 - DNA, 25 bp, Homo sapiens
ggtccttcactgtgtgtacacagca

SEQ ID NO: 35115 - DNA, 25 bp, Homo sapiens
aagagcatgtgtgtgccacttcccc

SEQ ID NO: 35116 - DNA, 25 bp, Homo sapiens
agggagtcccagagccctggacctt

SEQ ID NO: 35117 - DNA, 25 bp, Homo sapiens
ccagagccctggaccttgggcctag

SEQ ID NO: 35118 - DNA, 25 bp, Homo sapiens
agccctggaccttgggcctagaccg

SEQ ID NO: 35119 - DNA, 25 bp, Homo sapiens
ggaccttgggcctagaccgcgtgat

SEQ ID NO: 35120 - DNA, 25 bp, Homo sapiens
ccttgggcctagaccgcgtgataaa

SEQ ID NO: 35121 - DNA, 25 bp, Homo sapiens
gaccgcgtgataaaactgggttgag

SEQ ID NO: 35122 - DNA, 25 bp, Homo sapiens
ttgagggatgctggaaccagttacg

SEQ ID NO: 35123 - DNA, 25 bp, Homo sapiens
aagtcagtgtagacctgagctggga

SEQ ID NO: 35124 - DNA, 25 bp, Homo sapiens
cacctcttccctgaagagacaggca

SEQ ID NO: 35125 - DNA, 25 bp, Homo sapiens
ttctgccttgagtccccaggggaaa

SEQ ID NO: 35126 - DNA, 25 bp, Homo sapiens
tttaaggttcccagaatatgcaaat

SEQ ID NO: 35127 - DNA, 25 bp, Homo sapiens
tcccagaatatgcaaattggtatta

SEQ ID NO: 35128 - DNA, 25 bp, Homo sapiens
tcattttacgtgagcatctatattg

SEQ ID NO: 35129 - DNA, 25 bp, Homo sapiens
gagcatctatattgtacagggctgg

SEQ ID NO: 35130 - DNA, 25 bp, Homo sapiens
gcgggctccacctcaggttttcact

SEQ ID NO: 35131 - DNA, 25 bp, Homo sapiens
cctcaggttttcacttttcgctccg

SEQ ID NO: 35132 - DNA, 25 bp, Homo sapiens
gaatacgctgccatcaactccatgc

SEQ ID NO: 35133 - DNA, 25 bp, Homo sapiens
catgctggaccagatcaactcctgt

SEQ ID NO: 35134 - DNA, 25 bp, Homo sapiens
ccacctggaggagaagaatgaccac

SEQ ID NO: 35135 - DNA, 25 bp, Homo sapiens
ccctggcttagacaccttctcaagg

SEQ ID NO: 35136 - DNA, 25 bp, Homo sapiens
ttagacaccttctcaagggctggcc

SEQ ID NO: 35137 - DNA, 25 bp, Homo sapiens
agacaccttctcaagggctggcctt

SEQ ID NO: 35138 - DNA, 25 bp, Homo sapiens
gacaccttctcaagggctggccttc

SEQ ID NO: 35139 - DNA, 25 bp, Homo sapiens
ttcagggacccctggtgggtctgcc

SEQ ID NO: 35140 - DNA, 25 bp, Homo sapiens
tctgcccaggccttgagtgtccaca

SEQ ID NO: 35141 - DNA, 25 bp, Homo sapiens
ctgcccaggccttgagtgtccacat

SEQ ID NO: 35142 - DNA, 25 bp, Homo sapiens
ccaggccttgagtgtccacattaaa

SEQ ID NO: 35143 - DNA, 25 bp, Homo sapiens
gccttgagtgtccacattaaatggg

SEQ ID NO: 35144 - DNA, 25 bp, Homo sapiens
ccttgagtgtccacattaaatgggt

SEQ ID NO: 35145 - DNA, 25 bp, Homo sapiens
agtgtccacattaaatgggtctccc

SEQ ID NO: 35146 - DNA, 25 bp, Homo sapiens
tgtccacattaaatgggtctcccac

SEQ ID NO: 35147 - DNA, 25 bp, Homo sapiens
ccccaacggagacctggggatgccg

SEQ ID NO: 35148 - DNA, 25 bp, Homo sapiens
ttgagcactgcactgtttctccctc

SEQ ID NO: 35149 - DNA, 25 bp, Homo sapiens
ggggcagtctggtacggaacatatt

SEQ ID NO: 35150 - DNA, 25 bp, Homo sapiens
gggcagtctggtacggaacatattt

SEQ ID NO: 35151 - DNA, 25 bp, Homo sapiens
ttattgcctccatgcatgtgtgtgt

SEQ ID NO: 35152 - DNA, 25 bp, Homo sapiens
actggtgtgcgtggacacgtctgaa

SEQ ID NO: 35153 - DNA, 25 bp, Homo sapiens
tgtggggctctttcagggaccacag

SEQ ID NO: 35154 - DNA, 25 bp, Homo sapiens
gctctttcagggaccacagaggagg

SEQ ID NO: 35155 - DNA, 25 bp, Homo sapiens
gccaccctgaaatccccaataatgg

SEQ ID NO: 35156 - DNA, 25 bp, Homo sapiens
ctgaaatccccaataatggtgcctc

SEQ ID NO: 35157 - DNA, 25 bp, Homo sapiens
aaatccccaataatggtgcctcagt

SEQ ID NO: 35158 - DNA, 25 bp, Homo sapiens
ataatggtgcctcagtgggccccag

SEQ ID NO: 35159 - DNA, 25 bp, Homo sapiens
atggtgcctcagtgggccccagagt

SEQ ID NO: 35160 - DNA, 25 bp, Homo sapiens
ttccagtgggagagtacggttccct

SEQ ID NO: 35161 - DNA, 25 bp, Homo sapiens
ggagagtacggttccctcctgtctc

SEQ ID NO: 35162 - DNA, 25 bp, Homo sapiens
tccgcacctccatctttgtggataa

SEQ ID NO: 35163 - DNA, 25 bp, Homo sapiens
cgcacctccatctttgtggataata

SEQ ID NO: 35164 - DNA, 25 bp, Homo sapiens
cccttggagatatttccgtcctcca

SEQ ID NO: 35165 - DNA, 25 bp, Homo sapiens
tgtggctggaactgcccagcctgct

SEQ ID NO: 35166 - DNA, 25 bp, Homo sapiens
accaccattccatatttaagtggag

SEQ ID NO: 35167 - DNA, 25 bp, Homo sapiens
ttccatatttaagtggagcccctac

SEQ ID NO: 35168 - DNA, 25 bp, Homo sapiens
atatttaagtggagcccctacgtag

SEQ ID NO: 35169 - DNA, 25 bp, Homo sapiens
tattttagtctccttttcagggatg

SEQ ID NO: 35170 - DNA, 25 bp, Homo sapiens
tttagtctccttttcagggatgtcg

SEQ ID NO: 35171 - DNA, 25 bp, Homo sapiens
tagtctccttttcagggatgtcgtg

SEQ ID NO: 35172 - DNA, 25 bp, Homo sapiens
agtctccttttcagggatgtcgtgg

SEQ ID NO: 35173 - DNA, 25 bp, Homo sapiens
agggggttcttggtgctacagccct

SEQ ID NO: 35174 - DNA, 25 bp, Homo sapiens
gggttcttggtgctacagccctctc

SEQ ID NO: 35175 - DNA, 25 bp, Homo sapiens
accctccaggatgctcgctgggatt

SEQ ID NO: 35176 - DNA, 25 bp, Homo sapiens
ccctccaggatgctcgctgggattc

SEQ ID NO: 35177 - DNA, 25 bp, Homo sapiens
caggatgctcgctgggattcccacg

SEQ ID NO: 35178 - DNA, 25 bp, Homo sapiens
aggggcctctgaacggaacagtgtc

SEQ ID NO: 35179 - DNA, 25 bp, Homo sapiens
ctgaacggaacagtgtccccacaga

SEQ ID NO: 35180 - DNA, 25 bp, Homo sapiens
tctgctgacctgacagtgctggcgg

SEQ ID NO: 35181 - DNA, 25 bp, Homo sapiens
gagggccgcaccatgctgactgcct

SEQ ID NO: 35182 - DNA, 25 bp, Homo sapiens
agggccgcaccatgctgactgcctg

SEQ ID NO: 35183 - DNA, 25 bp, Homo sapiens
cgcaccatgctgactgcctgaatct

SEQ ID NO: 35184 - DNA, 25 bp, Homo sapiens
gcaccatgctgactgcctgaatctc

SEQ ID NO: 35185 - DNA, 25 bp, Homo sapiens
atgctgactgcctgaatctctgctg

SEQ ID NO: 35186 - DNA, 25 bp, Homo sapiens
tgcctgaatctctgctgaggctgcc

SEQ ID NO: 35187 - DNA, 25 bp, Homo sapiens
tcactgcagtgtccagcccagtgtt

SEQ ID NO: 35188 - DNA, 25 bp, Homo sapiens
actgcagtgtccagcccagtgttga

SEQ ID NO: 35189 - DNA, 25 bp, Homo sapiens
tgtccagcccagtgttgaacagatt

SEQ ID NO: 35190 - DNA, 25 bp, Homo sapiens
gtccagcccagtgttgaacagattg

SEQ ID NO: 35191 - DNA, 25 bp, Homo sapiens
agcccagtgttgaacagattgtagc

SEQ ID NO: 35192 - DNA, 25 bp, Homo sapiens
gcccagtgttgaacagattgtagcg

SEQ ID NO: 35193 - DNA, 25 bp, Homo sapiens
cagattgtagcgttctgtctcatta

SEQ ID NO: 35194 - DNA, 25 bp, Homo sapiens
tgtagcgttctgtctcattacgagc

SEQ ID NO: 35195 - DNA, 25 bp, Homo sapiens
gttctgtctcattacgagcaaataa

SEQ ID NO: 35196 - DNA, 25 bp, Homo sapiens
tctgtctgaggagaacatggccacc

SEQ ID NO: 35197 - DNA, 25 bp, Homo sapiens
agcccttgctctgagctgcttctct

SEQ ID NO: 35198 - DNA, 25 bp, Homo sapiens
gagctgcttctctggcgctatcctg

SEQ ID NO: 35199 - DNA, 25 bp, Homo sapiens
cctgcaaccccagctggggacataa

SEQ ID NO: 35200 - DNA, 25 bp, Homo sapiens
ccccagctggggacataatggagct

SEQ ID NO: 35201 - DNA, 25 bp, Homo sapiens
acataatggagctctgagtgctggt

SEQ ID NO: 35202 - DNA, 25 bp, Homo sapiens
ttccccacaacagaagagaccagcg

SEQ ID NO: 35203 - DNA, 25 bp, Homo sapiens
acaacagaagagaccagcgactccc

SEQ ID NO: 35204 - DNA, 25 bp, Homo sapiens
agcgactcccgcaaagggacaaggt

SEQ ID NO: 35205 - DNA, 25 bp, Homo sapiens
ctcctgcagagtaggcatctgggca

SEQ ID NO: 35206 - DNA, 25 bp, Homo sapiens
cagagtaggcatctgggcaccaaga

SEQ ID NO: 35207 - DNA, 25 bp, Homo sapiens
accttccctcaacagaggacactga

SEQ ID NO: 35208 - DNA, 25 bp, Homo sapiens
cctcaacagaggacactgagcccaa

SEQ ID NO: 35209 - DNA, 25 bp, Homo sapiens
cagaggacactgagcccaacggagt

SEQ ID NO: 35210 - DNA, 25 bp, Homo sapiens
acactgagcccaacggagttctggg

SEQ ID NO: 35211 - DNA, 25 bp, Homo sapiens
cccccaagaagaactgaataaagat

SEQ ID NO: 35212 - DNA, 25 bp, Homo sapiens
gccatgatttagttggccagcacta

SEQ ID NO: 35213 - DNA, 25 bp, Homo sapiens
atttagttggccagcactaactcca

SEQ ID NO: 35214 - DNA, 25 bp, Homo sapiens
tagttggccagcactaactccacct

SEQ ID NO: 35215 - DNA, 25 bp, Homo sapiens
ctccagcccactgctttaggatgac

SEQ ID NO: 35216 - DNA, 25 bp, Homo sapiens
tccagcccactgctttaggatgaca

SEQ ID NO: 35217 - DNA, 25 bp, Homo sapiens
cagcccactgctttaggatgacaca

SEQ ID NO: 35218 - DNA, 25 bp, Homo sapiens
ccactgctttaggatgacacaatga

SEQ ID NO: 35219 - DNA, 25 bp, Homo sapiens
catagaaatcagtctctctggtttg

SEQ ID NO: 35220 - DNA, 25 bp, Homo sapiens
ttttgattcttcagagagaactact

SEQ ID NO: 35221 - DNA, 25 bp, Homo sapiens
caaagaatgcacttttccctatggg

SEQ ID NO: 35222 - DNA, 25 bp, Homo sapiens
ttcttttggcttggtttggaccaca

SEQ ID NO: 35223 - DNA, 25 bp, Homo sapiens
tcttttggcttggtttggaccacag

SEQ ID NO: 35224 - DNA, 25 bp, Homo sapiens
tgctacccagggttttagagcccct

SEQ ID NO: 35225 - DNA, 25 bp, Homo sapiens
ccagggttttagagcccctgctcta

SEQ ID NO: 35226 - DNA, 25 bp, Homo sapiens
agcccctgctctaggaaacagttta

SEQ ID NO: 35227 - DNA, 25 bp, Homo sapiens
tcccagcacattgaatgggtaagca

SEQ ID NO: 35228 - DNA, 25 bp, Homo sapiens
cggctctggctgtccctgtgccggt

SEQ ID NO: 35229 - DNA, 25 bp, Homo sapiens
aaactcaagcacagctgcgaggagg

SEQ ID NO: 35230 - DNA, 25 bp, Homo sapiens
ccccgctatgtcataggtagtggag

SEQ ID NO: 35231 - DNA, 25 bp, Homo sapiens
cccaagtctgttctgactttgcctg

SEQ ID NO: 35232 - DNA, 25 bp, Homo sapiens
cctcctagatcattgtccttgatgt

SEQ ID NO: 35233 - DNA, 25 bp, Homo sapiens
ttgtccttgatgtccaggctgggtc

SEQ ID NO: 35234 - DNA, 25 bp, Homo sapiens
tgatgtccaggctgggtcatttaaa

SEQ ID NO: 35235 - DNA, 25 bp, Homo sapiens
accttgctgatgtattcatgtcagc

SEQ ID NO: 35236 - DNA, 25 bp, Homo sapiens
ctgatgtattcatgtcagcacctga

SEQ ID NO: 35237 - DNA, 25 bp, Homo sapiens
tattcatgtcagcacctgagtcaca

SEQ ID NO: 35238 - DNA, 25 bp, Homo sapiens
cagcctcttcgcataggcagtgatt

SEQ ID NO: 35239 - DNA, 25 bp, Homo sapiens
cttcgcataggcagtgatttgcgat

SEQ ID NO: 35240 - DNA, 25 bp, Homo sapiens
tctctgttcgctgctgtcagcataa

SEQ ID NO: 35241 - DNA, 25 bp, Homo sapiens
gtgttccttccctatgggatccatc

SEQ ID NO: 35242 - DNA, 25 bp, Homo sapiens
cttccctatgggatccatctgtttt

SEQ ID NO: 35243 - DNA, 25 bp, Homo sapiens
tatgggatccatctgttttgtaaac

SEQ ID NO: 35244 - DNA, 25 bp, Homo sapiens
gcaaagagagacacaccctgagccg

SEQ ID NO: 35245 - DNA, 25 bp, Homo sapiens
ctgaggccttgttccagaaggagca

SEQ ID NO: 35246 - DNA, 25 bp, Homo sapiens
ccttgttccagaaggagcagctcgt

SEQ ID NO: 35247 - DNA, 25 bp, Homo sapiens
tccagaaggagcagctcgtgctggc

SEQ ID NO: 35248 - DNA, 25 bp, Homo sapiens
aggagcagctcgtgctggccctgta

SEQ ID NO: 35249 - DNA, 25 bp, Homo sapiens
agcagctcgtgctggccctgtatcc

SEQ ID NO: 35250 - DNA, 25 bp, Homo sapiens
gtgctggccctgtatccccagacta

SEQ ID NO: 35251 - DNA, 25 bp, Homo sapiens
agcggccccaggatgactactcggt

SEQ ID NO: 35252 - DNA, 25 bp, Homo sapiens
gcggccccaggatgactactcggtc

SEQ ID NO: 35253 - DNA, 25 bp, Homo sapiens
ggccccaggatgactactcggtcct

SEQ ID NO: 35254 - DNA, 25 bp, Homo sapiens
cctcaatgtggctcagagatacgtg

SEQ ID NO: 35255 - DNA, 25 bp, Homo sapiens
ctcagagatacgtggtggcttgtaa

SEQ ID NO: 35256 - DNA, 25 bp, Homo sapiens
agtgatgccgcctggcagactcgcc

SEQ ID NO: 35257 - DNA, 25 bp, Homo sapiens
cagaggacgtgctgggattaaacac

SEQ ID NO: 35258 - DNA, 25 bp, Homo sapiens
tccccagatatggtgacctggggag

SEQ ID NO: 35259 - DNA, 25 bp, Homo sapiens
cccagatatggtgacctggggagct

SEQ ID NO: 35260 - DNA, 25 bp, Homo sapiens
tcgcctctgcaggaaagagcagagc

SEQ ID NO: 35261 - DNA, 25 bp, Homo sapiens
cctctgcaggaaagagcagagcccg

SEQ ID NO: 35262 - DNA, 25 bp, Homo sapiens
gcccagcacgcatggtattgccagc

SEQ ID NO: 35263 - DNA, 25 bp, Homo sapiens
tgtagtctctgctccctgcatttca

SEQ ID NO: 35264 - DNA, 25 bp, Homo sapiens
gactggcaacagaacagccgtggct

SEQ ID NO: 35265 - DNA, 25 bp, Homo sapiens
aacagccgtggctgctttatctctc

SEQ ID NO: 35266 - DNA, 25 bp, Homo sapiens
gggagcctggccacctcgcagctgt

SEQ ID NO: 35267 - DNA, 25 bp, Homo sapiens
ggagcctggccacctcgcagctgtt

SEQ ID NO: 35268 - DNA, 25 bp, Homo sapiens
ccctcaacctttgaactggaactgc

SEQ ID NO: 35269 - DNA, 25 bp, Homo sapiens
aacctttgaactggaactgctggct

SEQ ID NO: 35270 - DNA, 25 bp, Homo sapiens
agggttttcgacaactgcagctgaa

SEQ ID NO: 35271 - DNA, 25 bp, Homo sapiens
ttttcgacaactgcagctgaatctc

SEQ ID NO: 35272 - DNA, 25 bp, Homo sapiens
gacaactgcagctgaatctcatgga

SEQ ID NO: 35273 - DNA, 25 bp, Homo sapiens
tgaatctcatggaaaagctggattc

SEQ ID NO: 35274 - DNA, 25 bp, Homo sapiens
ggaaaagctggattcctctgcctta

SEQ ID NO: 35275 - DNA, 25 bp, Homo sapiens
cggttcttcagttttctgagaagag

SEQ ID NO: 35276 - DNA, 25 bp, Homo sapiens
agtgcacggggtgacccaggccttc

SEQ ID NO: 35277 - DNA, 25 bp, Homo sapiens
gcacggtggccctgctgcagttgat

SEQ ID NO: 35278 - DNA, 25 bp, Homo sapiens
cgctgtacggatgcagcagctgaaa

SEQ ID NO: 35279 - DNA, 25 bp, Homo sapiens
aattaaaaccatggaggcgatcagc

SEQ ID NO: 35280 - DNA, 25 bp, Homo sapiens
attaaaaccatggaggcgatcagcg

SEQ ID NO: 35281 - DNA, 25 bp, Homo sapiens
catggaggcgatcagcgaggttctc

SEQ ID NO: 35282 - DNA, 25 bp, Homo sapiens
ggcgatcagcgaggttctccaggac

SEQ ID NO: 35283 - DNA, 25 bp, Homo sapiens
cagcgaggttctccaggaccttagg

SEQ ID NO: 35284 - DNA, 25 bp, Homo sapiens
ggttctccaggaccttaggtttgat

SEQ ID NO: 35285 - DNA, 25 bp, Homo sapiens
ccaggaccttaggtttgatgcggaa

SEQ ID NO: 35286 - DNA, 25 bp, Homo sapiens
ggaccttaggtttgatgcggaatct

SEQ ID NO: 35287 - DNA, 25 bp, Homo sapiens
ccttaggtttgatgcggaatctgcc

SEQ ID NO: 35288 - DNA, 25 bp, Homo sapiens
gtttgatgcggaatctgccgagtga

SEQ ID NO: 35289 - DNA, 25 bp, Homo sapiens
atctgccgagtgatggcggctcccc

SEQ ID NO: 35290 - DNA, 25 bp, Homo sapiens
tctgccgagtgatggcggctcccca

SEQ ID NO: 35291 - DNA, 25 bp, Homo sapiens
actgcgctgctgaccttcctgcagt

SEQ ID NO: 35292 - DNA, 25 bp, Homo sapiens
actggctgagcagtgggttccttca

SEQ ID NO: 35293 - DNA, 25 bp, Homo sapiens
tgagcagtgggttccttcaggttcc

SEQ ID NO: 35294 - DNA, 25 bp, Homo sapiens
tgggttccttcaggttccttgccaa

SEQ ID NO: 35295 - DNA, 25 bp, Homo sapiens
caacttctccaaacaaagcaggctg

SEQ ID NO: 35296 - DNA, 25 bp, Homo sapiens
tccaaacaaagcaggctgtttgctc

SEQ ID NO: 35297 - DNA, 25 bp, Homo sapiens
caaagcaggctgtttgctcacttct

SEQ ID NO: 35298 - DNA, 25 bp, Homo sapiens
ttcttcaaaaggaggaatgataacc

SEQ ID NO: 35299 - DNA, 25 bp, Homo sapiens
gaatgataacccaaatctgcccaag

SEQ ID NO: 35300 - DNA, 25 bp, Homo sapiens
gataacccaaatctgcccaagtgac

SEQ ID NO: 35301 - DNA, 25 bp, Homo sapiens
ccaaatctgcccaagtgacacttga

SEQ ID NO: 35302 - DNA, 25 bp, Homo sapiens
tctgcccaagtgacacttgagaagg

SEQ ID NO: 35303 - DNA, 25 bp, Homo sapiens
gctggggttcctggtggatttctta

SEQ ID NO: 35304 - DNA, 25 bp, Homo sapiens
tggggttcctggtggatttcttact

SEQ ID NO: 35305 - DNA, 25 bp, Homo sapiens
gttcctggtggatttcttactacct

SEQ ID NO: 35306 - DNA, 25 bp, Homo sapiens
tggtggatttcttactacctaacgc

SEQ ID NO: 35307 - DNA, 25 bp, Homo sapiens
ctgacttctgactggctgagcagtg

SEQ ID NO: 35308 - DNA, 25 bp, Homo sapiens
ttgctgctctggaggcccggctccg

SEQ ID NO: 35309 - DNA, 25 bp, Homo sapiens
cctccgatttttggaaagaagtgca

SEQ ID NO: 35310 - DNA, 25 bp, Homo sapiens
gacaaggaccccatgctgattcttc

SEQ ID NO: 35311 - DNA, 25 bp, Homo sapiens
gctgattcttcgaggccgagtccct

SEQ ID NO: 35312 - DNA, 25 bp, Homo sapiens
accgcacaccagtggggtctcgctg

SEQ ID NO: 35313 - DNA, 25 bp, Homo sapiens
agcagcgaagtggacgtctcggatc

SEQ ID NO: 35314 - DNA, 25 bp, Homo sapiens
gaagtggacgtctcggatctcggct

SEQ ID NO: 35315 - DNA, 25 bp, Homo sapiens
gacgtctcggatctcggctcgcgaa

SEQ ID NO: 35316 - DNA, 25 bp, Homo sapiens
tcggatctcggctcgcgaaactaca

SEQ ID NO: 35317 - DNA, 25 bp, Homo sapiens
ggctcgcgaaactacagtgcccgca

SEQ ID NO: 35318 - DNA, 25 bp, Homo sapiens
tacagtgcccgcacagacttctact

SEQ ID NO: 35319 - DNA, 25 bp, Homo sapiens
cgcacagacttctactgcctggtgt

SEQ ID NO: 35320 - DNA, 25 bp, Homo sapiens
acagacttctactgcctggtgtcca

SEQ ID NO: 35321 - DNA, 25 bp, Homo sapiens
tgcctggtgtccaaggatgatatgt

SEQ ID NO: 35322 - DNA, 25 bp, Homo sapiens
ccccagagtgcaggatcatagggac

SEQ ID NO: 35323 - DNA, 25 bp, Homo sapiens
cagagtgcaggatcatagggacagc

SEQ ID NO: 35324 - DNA, 25 bp, Homo sapiens
tttgttcctgacgtcgggcgagcgt

SEQ ID NO: 35325 - DNA, 25 bp, Homo sapiens
gaggccttccgcaaagctgtctcct

SEQ ID NO: 35326 - DNA, 25 bp, Homo sapiens
tggagactcagatgtttcggggctt

SEQ ID NO: 35327 - DNA, 25 bp, Homo sapiens
ggtccgagcccaagagtatctggaa

SEQ ID NO: 35328 - DNA, 25 bp, Homo sapiens
gagcacagcggtgtcaataagttcc

SEQ ID NO: 35329 - DNA, 25 bp, Homo sapiens
gtcaataagttcctgaagggactag

SEQ ID NO: 35330 - DNA, 25 bp, Homo sapiens
ttcctgaagggactaggcaataaaa

SEQ ID NO: 35331 - DNA, 25 bp, Homo sapiens
caagaaataactctcagcctcaagg

SEQ ID NO: 35332 - DNA, 25 bp, Homo sapiens
taactctcagcctcaagggaaaact

SEQ ID NO: 35333 - DNA, 25 bp, Homo sapiens
ggaaaacttcctcctagtgcagccc

SEQ ID NO: 35334 - DNA, 25 bp, Homo sapiens
gtcccaggttgtcacggtgcggaac

SEQ ID NO: 35335 - DNA, 25 bp, Homo sapiens
tcccaggttgtcacggtgcggaact

SEQ ID NO: 35336 - DNA, 25 bp, Homo sapiens
tctggccgaggctgggctcttccct

SEQ ID NO: 35337 - DNA, 25 bp, Homo sapiens
gggctcttccctggatgaggacctg

SEQ ID NO: 35338 - DNA, 25 bp, Homo sapiens
cgtgtcgccgacatgcaaatgggtt

SEQ ID NO: 35339 - DNA, 25 bp, Homo sapiens
gccgacatgcaaatgggttgttttg

SEQ ID NO: 35340 - DNA, 25 bp, Homo sapiens
tttattgaaactgtggattcttgcc

SEQ ID NO: 35341 - DNA, 25 bp, Homo sapiens
gctgtcccttgtatttactttaagc

SEQ ID NO: 35342 - DNA, 25 bp, Homo sapiens
acttatcattcattcggtatggttt

SEQ ID NO: 35343 - DNA, 25 bp, Homo sapiens
cgcatcaagggcataagttattgtg

SEQ ID NO: 35344 - DNA, 25 bp, Homo sapiens
cctgtcccttgtacacattctggta

SEQ ID NO: 35345 - DNA, 25 bp, Homo sapiens
tgtcccttgtacacattctggtatg

SEQ ID NO: 35346 - DNA, 25 bp, Homo sapiens
gtcccttgtacacattctggtatga

SEQ ID NO: 35347 - DNA, 25 bp, Homo sapiens
cgtgcccaactgaggaacaggagaa

SEQ ID NO: 35348 - DNA, 25 bp, Homo sapiens
cccaactgaggaacaggagaagaaa

SEQ ID NO: 35349 - DNA, 25 bp, Homo sapiens
agaagaaatcaccaatttgggctct

SEQ ID NO: 35350 - DNA, 25 bp, Homo sapiens
gttattgtgaacgtttttgccaatc

SEQ ID NO: 35351 - DNA, 25 bp, Homo sapiens
tattgattctgttgcacattttgca

SEQ ID NO: 35352 - DNA, 25 bp, Homo sapiens
gattctgttgcacattttgcactgg

SEQ ID NO: 35353 - DNA, 25 bp, Homo sapiens
ctgttgcacattttgcactggttta

SEQ ID NO: 35354 - DNA, 25 bp, Homo sapiens
gcacattttgcactggtttatggcg

SEQ ID NO: 35355 - DNA, 25 bp, Homo sapiens
atcactgctcaacagccctgctaga

SEQ ID NO: 35356 - DNA, 25 bp, Homo sapiens
aggcacgcagccacggccacagtgg

SEQ ID NO: 35357 - DNA, 25 bp, Homo sapiens
catcaccggcgtctacttgtaccgt

SEQ ID NO: 35358 - DNA, 25 bp, Homo sapiens
ggcgtctacttgtaccgtgagaacc

SEQ ID NO: 35359 - DNA, 25 bp, Homo sapiens
ccctcctaaggaggtgcttcccatg

SEQ ID NO: 35360 - DNA, 25 bp, Homo sapiens
cctcctaaggaggtgcttcccatgc

SEQ ID NO: 35361 - DNA, 25 bp, Homo sapiens
gtgcttcccatgctctttgtaaatg

SEQ ID NO: 35362 - DNA, 25 bp, Homo sapiens
tcccatgctctttgtaaatggcact

SEQ ID NO: 35363 - DNA, 25 bp, Homo sapiens
tgcttgctcacatccatatcagaag

SEQ ID NO: 35364 - DNA, 25 bp, Homo sapiens
ctcacatccatatcagaaggggatt

SEQ ID NO: 35365 - DNA, 25 bp, Homo sapiens
catccatatcagaaggggattttta

SEQ ID NO: 35366 - DNA, 25 bp, Homo sapiens
gaaaggaccacaaggcaatctgggg

SEQ ID NO: 35367 - DNA, 25 bp, Homo sapiens
gacccagtagacaatggaagcccca

SEQ ID NO: 35368 - DNA, 25 bp, Homo sapiens
cagggccaggtgacagtgaagctca

SEQ ID NO: 35369 - DNA, 25 bp, Homo sapiens
gctcctttatggtactctatgcagt

SEQ ID NO: 35370 - DNA, 25 bp, Homo sapiens
ttatggtactctatgcagttaacat

SEQ ID NO: 35371 - DNA, 25 bp, Homo sapiens
tgtatctagctgcatagggacaccc

SEQ ID NO: 35372 - DNA, 25 bp, Homo sapiens
cagactttcgaagcagccatcctca

SEQ ID NO: 35373 - DNA, 25 bp, Homo sapiens
ccacgctcccagattgatatctatg

SEQ ID NO: 35374 - DNA, 25 bp, Homo sapiens
tcccagattgatatctatgtgcagg

SEQ ID NO: 35375 - DNA, 25 bp, Homo sapiens
cagatggtgggacctatgcagcttg

SEQ ID NO: 35376 - DNA, 25 bp, Homo sapiens
gtgaatgcagccacgctggcagtgc

SEQ ID NO: 35377 - DNA, 25 bp, Homo sapiens
cccatgagagactttgtgtgtgcgt

SEQ ID NO: 35378 - DNA, 25 bp, Homo sapiens
agagactttgtgtgtgcgtgctcag

SEQ ID NO: 35379 - DNA, 25 bp, Homo sapiens
tttgtgtgtgcgtgctcagctggct

SEQ ID NO: 35380 - DNA, 25 bp, Homo sapiens
cctggcggacctcagccatgtggag

SEQ ID NO: 35381 - DNA, 25 bp, Homo sapiens
cctcagccatgtggaggaagcagct

SEQ ID NO: 35382 - DNA, 25 bp, Homo sapiens
ctcagccatgtggaggaagcagctg

SEQ ID NO: 35383 - DNA, 25 bp, Homo sapiens
aggctgctgcccaggctgcccgaga

SEQ ID NO: 35384 - DNA, 25 bp, Homo sapiens
tgctgcccaggctgcccgagatgtg

SEQ ID NO: 35385 - DNA, 25 bp, Homo sapiens
tgcccgagatgtgcacaccctctta

SEQ ID NO: 35386 - DNA, 25 bp, Homo sapiens
gcacaccctcttagatcgagtggtc

SEQ ID NO: 35387 - DNA, 25 bp, Homo sapiens
cctcttagatcgagtggtccggcag

SEQ ID NO: 35388 - DNA, 25 bp, Homo sapiens
aggagtccaggctgcaccctggaga

SEQ ID NO: 35389 - DNA, 25 bp, Homo sapiens
ctagtgggacaaggacctgaccctc

SEQ ID NO: 35390 - DNA, 25 bp, Homo sapiens
ccatttcccctggtgagccacttgg

SEQ ID NO: 35391 - DNA, 25 bp, Homo sapiens
cacttggcagcatatgtaggtacca

SEQ ID NO: 35392 - DNA, 25 bp, Homo sapiens
tatgtaggtaccagctcaaccccac

SEQ ID NO: 35393 - DNA, 25 bp, Homo sapiens
cgcaagttcctgagctgaacatgga

SEQ ID NO: 35394 - DNA, 25 bp, Homo sapiens
ttcctgagctgaacatggagcaagg

SEQ ID NO: 35395 - DNA, 25 bp, Homo sapiens
gcttagagctcacagccttgggaag

SEQ ID NO: 35396 - DNA, 25 bp, Homo sapiens
agctcacagccttgggaagtgagac

SEQ ID NO: 35397 - DNA, 25 bp, Homo sapiens
cagccttgggaagtgagactagaag

SEQ ID NO: 35398 - DNA, 25 bp, Homo sapiens
tagacaaaggccacacacatcattg

SEQ ID NO: 35399 - DNA, 25 bp, Homo sapiens
actgggagctcagtgaggattctga

SEQ ID NO: 35400 - DNA, 25 bp, Homo sapiens
agctcagtgaggattctgaccagtg

SEQ ID NO: 35401 - DNA, 25 bp, Homo sapiens
cctctgagtcccagggacctgggca

SEQ ID NO: 35402 - DNA, 25 bp, Homo sapiens
accagtgacttacacaaaaggcgct

SEQ ID NO: 35403 - DNA, 25 bp, Homo sapiens
gacttacacaaaaggcgctctatac

SEQ ID NO: 35404 - DNA, 25 bp, Homo sapiens
aaccacctgctgcacgagagcgaca

SEQ ID NO: 35405 - DNA, 25 bp, Homo sapiens
tgcacgagagcgacacggacaagga

SEQ ID NO: 35406 - DNA, 25 bp, Homo sapiens
atgtttgtgggcagtcaggccacca

SEQ ID NO: 35407 - DNA, 25 bp, Homo sapiens
ttgtgggcagtcaggccaccaacta

SEQ ID NO: 35408 - DNA, 25 bp, Homo sapiens
ctgacccggcaccacgatgagctgt

SEQ ID NO: 35409 - DNA, 25 bp, Homo sapiens
cccggcaccacgatgagctgtgagc

SEQ ID NO: 35410 - DNA, 25 bp, Homo sapiens
tcagaggcccgcacaatgaccggag

SEQ ID NO: 35411 - DNA, 25 bp, Homo sapiens
agaggcccgcacaatgaccggagga

SEQ ID NO: 35412 - DNA, 25 bp, Homo sapiens
aggcagatgcagtcccaggcatcct

SEQ ID NO: 35413 - DNA, 25 bp, Homo sapiens
agatgcagtcccaggcatcctcctg

SEQ ID NO: 35414 - DNA, 25 bp, Homo sapiens
aggggctgtcatagtcccagaggat

SEQ ID NO: 35415 - DNA, 25 bp, Homo sapiens
ggggctgtcatagtcccagaggata

SEQ ID NO: 35416 - DNA, 25 bp, Homo sapiens
gtcatagtcccagaggataagcaat

SEQ ID NO: 35417 - DNA, 25 bp, Homo sapiens
agtcccagaggataagcaataccta

SEQ ID NO: 35418 - DNA, 25 bp, Homo sapiens
aggataagcaatacctatttctgac

SEQ ID NO: 35419 - DNA, 25 bp, Homo sapiens
aagcaatacctatttctgactgagt

SEQ ID NO: 35420 - DNA, 25 bp, Homo sapiens
ttctgcctggcttgcctgcttctgc

SEQ ID NO: 35421 - DNA, 25 bp, Homo sapiens
tgccctttccagaggggtctcactg

SEQ ID NO: 35422 - DNA, 25 bp, Homo sapiens
ggtctcactgacagccagagacagc

SEQ ID NO: 35423 - DNA, 25 bp, Homo sapiens
gagagtgggcgtgtcacctgtccca

SEQ ID NO: 35424 - DNA, 25 bp, Homo sapiens
gggcgtgtcacctgtcccaggttcc

SEQ ID NO: 35425 - DNA, 25 bp, Homo sapiens
aggttcccagcaagtctgcagctgt

SEQ ID NO: 35426 - DNA, 25 bp, Homo sapiens
ttcccagcaagtctgcagctgtgca

SEQ ID NO: 35427 - DNA, 25 bp, Homo sapiens
cagctgtgcagtcctggggtccctg

SEQ ID NO: 35428 - DNA, 25 bp, Homo sapiens
gtgctgtccagcaggggccctgcct

SEQ ID NO: 35429 - DNA, 25 bp, Homo sapiens
gccgctcctgcctggtctgggctgt

SEQ ID NO: 35430 - DNA, 25 bp, Homo sapiens
ctcctgcctggtctgggctgtgtgt

SEQ ID NO: 35431 - DNA, 25 bp, Homo sapiens
tctgggctgtgtgtggcgccctttc

SEQ ID NO: 35432 - DNA, 25 bp, Homo sapiens
ctgggctgtgtgtggcgccctttcc

SEQ ID NO: 35433 - DNA, 25 bp, Homo sapiens
tgttcctctgtgttctgtgtgcgtc

SEQ ID NO: 35434 - DNA, 25 bp, Homo sapiens
cctctgtgttctgtgtgcgtcttaa

SEQ ID NO: 35435 - DNA, 25 bp, Homo sapiens
gtgtgcgtcttaagcaataaagcgt

SEQ ID NO: 35436 - DNA, 25 bp, Homo sapiens
atctccgcatttccagttgtattag

SEQ ID NO: 35437 - DNA, 25 bp, Homo sapiens
gcatttccagttgtattagccaata

SEQ ID NO: 35438 - DNA, 25 bp, Homo sapiens
agctccgggtctcttctacctgcat

SEQ ID NO: 35439 - DNA, 25 bp, Homo sapiens
ccatggagtcattgttctaataatc

SEQ ID NO: 35440 - DNA, 25 bp, Homo sapiens
accaattcagactcagatcctcgtg

SEQ ID NO: 35441 - DNA, 25 bp, Homo sapiens
attcagactcagatcctcgtggtct

SEQ ID NO: 35442 - DNA, 25 bp, Homo sapiens
gagcatgctgcttgctgtctgtgca

SEQ ID NO: 35443 - DNA, 25 bp, Homo sapiens
tgctgtctgtgcagctcccatttcc

SEQ ID NO: 35444 - DNA, 25 bp, Homo sapiens
ttccccttcttcctgatagacttgg

SEQ ID NO: 35445 - DNA, 25 bp, Homo sapiens
gctgtgtgcctccactccaaggctg

SEQ ID NO: 35446 - DNA, 25 bp, Homo sapiens
ggatggaagatctctccttagatag

SEQ ID NO: 35447 - DNA, 25 bp, Homo sapiens
agaacctgtcttcctccctggcatt

SEQ ID NO: 35448 - DNA, 25 bp, Homo sapiens
gtctgggcgtgacactgggactctc

SEQ ID NO: 35449 - DNA, 25 bp, Homo sapiens
ctttgtgctgccaacctgagattga

SEQ ID NO: 35450 - DNA, 25 bp, Homo sapiens
tgcctcagagcagcacagagagttg

SEQ ID NO: 35451 - DNA, 25 bp, Homo sapiens
agcacagagagttggggccccctga

SEQ ID NO: 35452 - DNA, 25 bp, Homo sapiens
cttggtttccagaatttctagagtg

SEQ ID NO: 35453 - DNA, 25 bp, Homo sapiens
ggcatgattccagtcaatgggggac

SEQ ID NO: 35454 - DNA, 25 bp, Homo sapiens
gattccagtcaatgggggaccgccc

SEQ ID NO: 35455 - DNA, 25 bp, Homo sapiens
agtcaatgggggaccgcccgtgtct

SEQ ID NO: 35456 - DNA, 25 bp, Homo sapiens
ggggaccgcccgtgtctaagcatgt

SEQ ID NO: 35457 - DNA, 25 bp, Homo sapiens
ccgtgtctaagcatgtgcaaaggag

SEQ ID NO: 35458 - DNA, 25 bp, Homo sapiens
ggtcattgtttgtcattgagtcttc

SEQ ID NO: 35459 - DNA, 25 bp, Homo sapiens
tgtttgtcattgagtcttctctcag

SEQ ID NO: 35460 - DNA, 25 bp, Homo sapiens
gtcattgagtcttctctcagaatca

SEQ ID NO: 35461 - DNA, 25 bp, Homo sapiens
tctctcagaatcagcgagcccagct

SEQ ID NO: 35462 - DNA, 25 bp, Homo sapiens
tcagaatcagcgagcccagctgtag

SEQ ID NO: 35463 - DNA, 25 bp, Homo sapiens
cttgccccacttcagaggttttggg

SEQ ID NO: 35464 - DNA, 25 bp, Homo sapiens
cacttcagaggttttggggttcagg

SEQ ID NO: 35465 - DNA, 25 bp, Homo sapiens
gggttcagggtgctgtgtctcccct

SEQ ID NO: 35466 - DNA, 25 bp, Homo sapiens
gggtgctgtgtctccccttgcctgt

SEQ ID NO: 35467 - DNA, 25 bp, Homo sapiens
ttgcctgtgcccaggtcatcccaaa

SEQ ID NO: 35468 - DNA, 25 bp, Homo sapiens
tcttccttattccataggctgggag

SEQ ID NO: 35469 - DNA, 25 bp, Homo sapiens
tcgtaccagctagaagggagaagag

SEQ ID NO: 35470 - DNA, 25 bp, Homo sapiens
cgtaccagctagaagggagaagaga

SEQ ID NO: 35471 - DNA, 25 bp, Homo sapiens
tgaacacggggcttccttacagccc

SEQ ID NO: 35472 - DNA, 25 bp, Homo sapiens
cggggcttccttacagccccggatg

SEQ ID NO: 35473 - DNA, 25 bp, Homo sapiens
gggcttccttacagccccggatgca

SEQ ID NO: 35474 - DNA, 25 bp, Homo sapiens
ttacagccccggatgcagattttag

SEQ ID NO: 35475 - DNA, 25 bp, Homo sapiens
cagccccggatgcagattttagagg

SEQ ID NO: 35476 - DNA, 25 bp, Homo sapiens
agccccggatgcagattttagaggg

SEQ ID NO: 35477 - DNA, 25 bp, Homo sapiens
ccccggatgcagattttagagggag

SEQ ID NO: 35478 - DNA, 25 bp, Homo sapiens
ctggacttggcagtttcttgctccc

SEQ ID NO: 35479 - DNA, 25 bp, Homo sapiens
gacttggcagtttcttgctcccagc

SEQ ID NO: 35480 - DNA, 25 bp, Homo sapiens
cttggcagtttcttgctcccagcac

SEQ ID NO: 35481 - DNA, 25 bp, Homo sapiens
ttggcagtttcttgctcccagcacc

SEQ ID NO: 35482 - DNA, 25 bp, Homo sapiens
acctcttccttattccataggctgg

SEQ ID NO: 35483 - DNA, 25 bp, Homo sapiens
cctcttccttattccataggctggg

SEQ ID NO: 35484 - DNA, 25 bp, Homo sapiens
tctctgccgcctcagtttgtctgct

SEQ ID NO: 35485 - DNA, 25 bp, Homo sapiens
tcctacccggcctcaaatggtgctg

SEQ ID NO: 35486 - DNA, 25 bp, Homo sapiens
ctacccggcctcaaatggtgctgct

SEQ ID NO: 35487 - DNA, 25 bp, Homo sapiens
acccggcctcaaatggtgctgctgc

SEQ ID NO: 35488 - DNA, 25 bp, Homo sapiens
ggcctcaaatggtgctgctgcccat

SEQ ID NO: 35489 - DNA, 25 bp, Homo sapiens
aaatggtgctgctgcccatgatggt

SEQ ID NO: 35490 - DNA, 25 bp, Homo sapiens
gtgctgctgcccatgatggtaccac

SEQ ID NO: 35491 - DNA, 25 bp, Homo sapiens
gctgctgcccatgatggtaccacac

SEQ ID NO: 35492 - DNA, 25 bp, Homo sapiens
tgctgcccatgatggtaccacacca

SEQ ID NO: 35493 - DNA, 25 bp, Homo sapiens
tgcccatgatggtaccacaccaggg

SEQ ID NO: 35494 - DNA, 25 bp, Homo sapiens
ccatgatggtaccacaccagggcct

SEQ ID NO: 35495 - DNA, 25 bp, Homo sapiens
gatggtaccacaccagggcctcagc

SEQ ID NO: 35496 - DNA, 25 bp, Homo sapiens
gtctcagcttatcctggagggaatt

SEQ ID NO: 35497 - DNA, 25 bp, Homo sapiens
tctcagcttatcctggagggaattg

SEQ ID NO: 35498 - DNA, 25 bp, Homo sapiens
ctcagcttatcctggagggaattgg

SEQ ID NO: 35499 - DNA, 25 bp, Homo sapiens
tcagcttatcctggagggaattggg

SEQ ID NO: 35500 - DNA, 25 bp, Homo sapiens
cccctgggagtgtaacatgactgcc

SEQ ID NO: 35501 - DNA, 25 bp, Homo sapiens
cgccccatgtgtgtgagaggcgtcc

SEQ ID NO: 35502 - DNA, 25 bp, Homo sapiens
ccatgtgtgtgagaggcgtcctctg

SEQ ID NO: 35503 - DNA, 25 bp, Homo sapiens
gcgtcctctgggagagcatggatcc

SEQ ID NO: 35504 - DNA, 25 bp, Homo sapiens
ggagagcatggatcctgaggtccca

SEQ ID NO: 35505 - DNA, 25 bp, Homo sapiens
agctgacctctgtcctgtgtgccca

SEQ ID NO: 35506 - DNA, 25 bp, Homo sapiens
ctgtgtgcccagtggccccaggtga

SEQ ID NO: 35507 - DNA, 25 bp, Homo sapiens
caggtgacgtgtcttcaagaagagg

SEQ ID NO: 35508 - DNA, 25 bp, Homo sapiens
aggtctcagccttagatccaaggac

SEQ ID NO: 35509 - DNA, 25 bp, Homo sapiens
gccttagatccaaggacagtccaag

SEQ ID NO: 35510 - DNA, 25 bp, Homo sapiens
aagtcctaagaccatggagttggtg

SEQ ID NO: 35511 - DNA, 25 bp, Homo sapiens
ccatggagttggtgatctgggatct

SEQ ID NO: 35512 - DNA, 25 bp, Homo sapiens
ggatctgggtttgctgatatttctc

SEQ ID NO: 35513 - DNA, 25 bp, Homo sapiens
gatctgggtttgctgatatttctca

SEQ ID NO: 35514 - DNA, 25 bp, Homo sapiens
tatttctcaccgtgaatctcttggt

SEQ ID NO: 35515 - DNA, 25 bp, Homo sapiens
tctcaccgtgaatctcttggtggtg

SEQ ID NO: 35516 - DNA, 25 bp, Homo sapiens
caccttgctgggtctgtggcatttt

SEQ ID NO: 35517 - DNA, 25 bp, Homo sapiens
accttgctgggtctgtggcattttc

SEQ ID NO: 35518 - DNA, 25 bp, Homo sapiens
cttgctgggtctgtggcattttcca

SEQ ID NO: 35519 - DNA, 25 bp, Homo sapiens
ttgctgggtctgtggcattttccaa

SEQ ID NO: 35520 - DNA, 25 bp, Homo sapiens
tgggtctgtggcattttccaagggc

SEQ ID NO: 35521 - DNA, 25 bp, Homo sapiens
ggtctgtggcattttccaagggccc

SEQ ID NO: 35522 - DNA, 25 bp, Homo sapiens
tctgtggcattttccaagggcccac

SEQ ID NO: 35523 - DNA, 25 bp, Homo sapiens
tgtggcattttccaagggcccacgt

SEQ ID NO: 35524 - DNA, 25 bp, Homo sapiens
tggcattttccaagggcccacgtag

SEQ ID NO: 35525 - DNA, 25 bp, Homo sapiens
gccaagtggcccaggctctgaactg

SEQ ID NO: 35526 - DNA, 25 bp, Homo sapiens
gctttaatcaggacaccgtgaggac

SEQ ID NO: 35527 - DNA, 25 bp, Homo sapiens
atcaggacaccgtgaggacaagtga

SEQ ID NO: 35528 - DNA, 25 bp, Homo sapiens
tcaggacaccgtgaggacaagtgag

SEQ ID NO: 35529 - DNA, 25 bp, Homo sapiens
acaccgtgaggacaagtgaggccgt

SEQ ID NO: 35530 - DNA, 25 bp, Homo sapiens
caccgtgaggacaagtgaggccgtc

SEQ ID NO: 35531 - DNA, 25 bp, Homo sapiens
caagtgaggccgtcagtcttggtgt

SEQ ID NO: 35532 - DNA, 25 bp, Homo sapiens
ctgggagtccccatcagaggcagtg

SEQ ID NO: 35533 - DNA, 25 bp, Homo sapiens
tgggagtccccatcagaggcagtga

SEQ ID NO: 35534 - DNA, 25 bp, Homo sapiens
tggtctgcatgacactaagacgctt

SEQ ID NO: 35535 - DNA, 25 bp, Homo sapiens
ggtctgcatgacactaagacgcttg

SEQ ID NO: 35536 - DNA, 25 bp, Homo sapiens
gtctgcatgacactaagacgcttgt

SEQ ID NO: 35537 - DNA, 25 bp, Homo sapiens
tctgcatgacactaagacgcttgtc

SEQ ID NO: 35538 - DNA, 25 bp, Homo sapiens
ctgcatgacactaagacgcttgtcc

SEQ ID NO: 35539 - DNA, 25 bp, Homo sapiens
tgcatgacactaagacgcttgtcca

SEQ ID NO: 35540 - DNA, 25 bp, Homo sapiens
catgacactaagacgcttgtccaca

SEQ ID NO: 35541 - DNA, 25 bp, Homo sapiens
acactaagacgcttgtccacagcgg

SEQ ID NO: 35542 - DNA, 25 bp, Homo sapiens
cactaagacgcttgtccacagcggc

SEQ ID NO: 35543 - DNA, 25 bp, Homo sapiens
actaagacgcttgtccacagcggcg

SEQ ID NO: 35544 - DNA, 25 bp, Homo sapiens
ctaagacgcttgtccacagcggcga

SEQ ID NO: 35545 - DNA, 25 bp, Homo sapiens
taagacgcttgtccacagcggcgac

SEQ ID NO: 35546 - DNA, 25 bp, Homo sapiens
aagacgcttgtccacagcggcgacc

SEQ ID NO: 35547 - DNA, 25 bp, Homo sapiens
gcaaggccagacttttccgtcgttt

SEQ ID NO: 35548 - DNA, 25 bp, Homo sapiens
acctgaggggcctcttatgggctgg

SEQ ID NO: 35549 - DNA, 25 bp, Homo sapiens
acccaggtgctaggaacactccttc

SEQ ID NO: 35550 - DNA, 25 bp, Homo sapiens
gtgctaggaacactccttcacagat

SEQ ID NO: 35551 - DNA, 25 bp, Homo sapiens
tgggtgcttggaggaaggaaaccca

SEQ ID NO: 35552 - DNA, 25 bp, Homo sapiens
aaacccagctctggtccatagagag

SEQ ID NO: 35553 - DNA, 25 bp, Homo sapiens
agctctggtccatagagagcaaaac

SEQ ID NO: 35554 - DNA, 25 bp, Homo sapiens
tggcgcagcatattcaggaagctca

SEQ ID NO: 35555 - DNA, 25 bp, Homo sapiens
ttcaggaagctcagggccctggctc

SEQ ID NO: 35556 - DNA, 25 bp, Homo sapiens
agtgggtccaatgcactttgttctg

SEQ ID NO: 35557 - DNA, 25 bp, Homo sapiens
tccaatgcactttgttctggctctt

SEQ ID NO: 35558 - DNA, 25 bp, Homo sapiens
tgttctggctcttccaggctgggag

SEQ ID NO: 35559 - DNA, 25 bp, Homo sapiens
ctgcctcctttgtgaggaagccgct

SEQ ID NO: 35560 - DNA, 25 bp, Homo sapiens
cttccatggactttgttagtttctc

SEQ ID NO: 35561 - DNA, 25 bp, Homo sapiens
tggactttgttagtttctccaagca

SEQ ID NO: 35562 - DNA, 25 bp, Homo sapiens
gtttctccaagcaggacatggacaa

SEQ ID NO: 35563 - DNA, 25 bp, Homo sapiens
tcatcaccaacgtctgtgccatttt

SEQ ID NO: 35564 - DNA, 25 bp, Homo sapiens
tcgcgcaggctgacggctcggccta

SEQ ID NO: 35565 - DNA, 25 bp, Homo sapiens
caggctgacggctcggcctacattg

SEQ ID NO: 35566 - DNA, 25 bp, Homo sapiens
gacggctcggcctacattgagcagg

SEQ ID NO: 35567 - DNA, 25 bp, Homo sapiens
ctcggcctacattgagcagggcaac

SEQ ID NO: 35568 - DNA, 25 bp, Homo sapiens
cctacattgagcagggcaacaccaa

SEQ ID NO: 35569 - DNA, 25 bp, Homo sapiens
attgagcagggcaacaccaaggcac

SEQ ID NO: 35570 - DNA, 25 bp, Homo sapiens
gagcagggcaacaccaaggcactgg

SEQ ID NO: 35571 - DNA, 25 bp, Homo sapiens
agggcaacaccaaggcactggctgt

SEQ ID NO: 35572 - DNA, 25 bp, Homo sapiens
caacaccaaggcactggctgtggtc

SEQ ID NO: 35573 - DNA, 25 bp, Homo sapiens
acaccaaggcactggctgtggtcta

SEQ ID NO: 35574 - DNA, 25 bp, Homo sapiens
caaggcactggctgtggtctacggc

SEQ ID NO: 35575 - DNA, 25 bp, Homo sapiens
aggcactggctgtggtctacggccc

SEQ ID NO: 35576 - DNA, 25 bp, Homo sapiens
gcactggctgtggtctacggcccgc

SEQ ID NO: 35577 - DNA, 25 bp, Homo sapiens
actggctgtggtctacggcccgcac

SEQ ID NO: 35578 - DNA, 25 bp, Homo sapiens
agctgcgcaagatccaggcgcggat

SEQ ID NO: 35579 - DNA, 25 bp, Homo sapiens
ttcgcgcaggctgacggctcggcct

SEQ ID NO: 35580 - DNA, 11167 bp, Homo sapiens
tcctacaagcagccggcggcgccgccgagtgaggggacgcggcgcggtggggcggcgcggcccgaggaggcggcggaggaggggccgcccgcggcccccggctcactccggcactccgggccgctcggcccccatgcctgcccgaccgcgctgccggagccccaggtccgggggcggaggggagcgctgccgcgggggtgggcgggcggggcgcgggggccatgtgcgagcgcggcagggaggcgggcggggcgggctgcaggcggggtccgactctggggccagtccgggccacggttgggacccagtcgagggtcggactggtcagggttcaggcgggatccggcgtccgagtcctggtgggccggcctggggcaggatctggctctggctgcgggtcctgactcgggtcagggttgggcctccgatccagcccgctccggggcagggttcaatcccgcatttgccgaagtccctggggctggccggggtggaagacggggagggctctatgtctgggaaggggctctgaagaccacgtgggggcgctcgaaggggcctggggccaccctcctctctgggtcaaaggtcatcgcaccggcaggggagaacttcctcctccttggctctccccacttacttcctgataacctggtagaggtctcccgcgggcggggagggggaggcgtagcaactttaggcaacttcccaaaggtgtgcgcaggttgggggcgggacgcggcgccccgggaggtggcggcctctgcgacagcgggagtataagagtggacctgcaggctggtcgcgaggaggtggagcggcgcccgccgtgtgcctgggaccggcatgctggggcaggagggcagccgcgtgtcaggtgtgaaaagctctggaggtgttttcatgagtccgtgcctgtgcgtgtggatgtggggagacctagtgagagtgtgtgtgatcatgagccttgactgagttcgtggatggggtgtgcgctccaggagaagtgtgtgagcacaagtgtgagcaggagtgagcacgggtttgggaaggccggtgcaagtgtgaaagccctcagcagagagcgagcctgcgtgggcttgtggggctcctgagcaccccggtgagtggagtgtgtgaactcggtgtgagcacgtccactggccttgggtctgctctccaatgcagaatacccagatgagggcagggtctcagaggtccccccaacatctggagaaaactgggaagtatcctgctcctggctagggattccaggtggggttgaaggttgcctgggggctacggttaccctgctccctggcctgggtgggagtaggggctttctaagcctcccccaggttcccaagggggagacctgctgtcagttactggccctgaagactctgtttccatggcaacagctaggagggggcagtgttcctgggcagtccttccttggactctgccccccttcttccccacttgctgggcttggaagcctggccctaggcccgaggttgggcaacccgtgtggcagggtgtctcccatcccccataccagtgctttcctgcgaacctatgggtctctccgtgcaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccagggtgagcccccagcccactcccctgtcctttgccctgcaccctctgggtacactgctgggtgcaataggccccctgatggctgtggcaccgcttgaggctaacaatctggtgtttccagtccctctacctcccagagacactctttccctgagaagtatggtaaaagcaccgggtgtgctgatgcattgcagtggatgtgagtgagttcagggtaccacctgggtactctaggcccagcaccttctacagtggctctgaaagagtccaaggcagcctctgtctgttcctaagctttgttcttgtttctggcagcttctgacctctccccagcatagaacatgtcccctttttgttaattttcccaaagcagcaccaacacaaggcagattttaatttttttttttttgagacagagtctcactctgttgttcaggctagagtgcagtggcacaatctctgctcactgcaacctttgcccctgggttcaagagattctcctgcctcagcctcctgagtagctgagactgcaggtgtgcaccaccacgcccagctaatttttgtatttttagtagagacgacgtttcaccatgtcggccaggctggtctggaattcctgaccacaaatgatccacctgcctcggcctcccaaaacaaggcagatttttatcagtacttgagaggggctacatcatagtttagcacccaactttaaaaagactaacaggcaaggccggacacagttgctcacacctgtaatcccagcactttgggaggccaaggtgggcggatcacctgaggtcaggagatcgagaccagcctggccagggtggtgaaaccgcatctctactaaaaatgcaaaaaattagctgggcatggtggctcgcgcctgtaatctcagctacttgctacttgagaggctgaggcaggagaattgcttgaacccaggaggcagaggttgcagtgagccaagatcacaccactgtactccagcctgggtgacagagcgagattccatctcaaaaaaaaaaaaaaaaggccgggcactgtggctcatgtaatcccagcactttgggaggccgaggcgggcggatcatgaggtcaggagattgagaacatcctggctaacacggtgaaacactgtctctactaaaaatacaaaaaattagctgggcatggtggcgggcgcctgtaatcccagctacttgggaggctgaggcaggagaatggcgtgaacccaggaggcggaggttgcagtgagccaagatcacgccactgcactccagcctgggcgacagagtgagactccgtctcaaaaaaaaaaaaaaaaaggctgggcgcggtggctcatgcctgtaatcccagcactttgggaggccgagacgggcggatcacctgaggtcaggagtttgagaccagcctgaccaatgtgatgaaaccccgtctctactgaaaatacaaaaattagccaagcatggtggcatgcgcctgtcatcccactcaagaggctgagacaggagaattgcttgaacctgggaggcagaggttgcaatgagcccagatcgcgccattgcactctagcctgcgcaacaaaagtgaaactccacctcaaaaaacaaaaacaaaaacaaaaacaaaaaaacccaaaaacgctgggcttggtggctcatggcctgtaatcccagcactttgggaggctgaggcagacggatcacgaggtcaggagttcgagaccagcctggccaacatggtaaaaccccgtctctactaaaaatacaaaaattagccgggcgtggtggtgagtgcctgtaatcccactacttgggaggctgaggcaggagaattgcttgaacccgggaggcagaggttgcagtgagctgagatcatgccacagcactctagtctgggcaacagaatgagacactctcatctcaaaaaaaaaaaaaaaaggacttacaggcatgtctgctcttaaaagtcactaatttttttctcactcaggaaagcttatcagaatttgggggaatgagcaagatgctgacattaagcattgcctgggaagggcctattatttccgttatttctgcttttatgtaaccattggttactttgggggctataacacgtataattaaaaaaaaaaaaaaaaaggccaagtgtggtggctcacacctgtaatctcagcactttcggaggctaagatgggaggatcacaaggtcaggagttcgagaccagcctggccaacatggtgaaaccctgtctgtactagaaatacaaaaattagccaggtgtcgtggtgggtgcctgtagtcccagctactcaggaggctgaggcaggagaattgctggaacccaggaggcagaggttggagttagccaagatcgtgccactgcactcccagcctgggtgacagagtgagagttcgtatcaaaaaaaaaaaaaaaaaaaaaatcttgagtgcttaccttgtgctaggcactgtattcttttatgatctcagttagtccccacagcaaccctataaggtgtcagtactgttataactgaaactaagagaggcatttgaaactttgttgaagtctcacaactaggaaatggcagaaccaagatttgaacttgggtcagtataggtccagagctgagctcttcaatgttagactgcttcctctgcttattactaataacaccgaactttggacagacgctgaatgactgattgtgacattccagcacgtttttttttttttttttgagacagtctcgtgtggtcgcccaggctggagtgcagtggcacgatctcggctcactgcaagctccgcctcccgggttcacaccattctcctgcctcagcctcctgagtagctgggactacaggtgcccgccaccacgcctggctaattttttgtacttttagtagagacggggtttcagcgtgttagccaagatggtcttgatttcctgacctcgagatccacctgccttggactcccaaagtgctgggattacaggcgtgagccactgctcctggccaggttttttttttttttttttttttttttgagatggagttttgctcttgttgtccaggctggagtgcaacggcctgcagtcgtggttcactgcaacctctgcctcccgggttcaagccattcacctgcctcagcctcccaagtagctgggattacaggcgcctgccaccatgcccggctaatttttgtgtttttagtagggatggggtttcaccatgttggccaggctggcctcaaactcctgacctcaggcgatctgccctcctcgggcttccaaagtgctgggattataggtgtgagccactgcaccccgccaatccagcaagttttaacttggccaaaatccaccaatcttaaactttgtgcacccttcccactctgaagaacagtgagccagccggccagggtgcgggtatctcctacctaccctggggcccctcactgtatgttgactattgacaaatatttattgtgtgctggctgtgaataggacttgtatattgagcacttaggtgtcatgaaccatgctggatgttttgaccatattatcccctttaattctcacgacccaactctgtggggcacttttacagctgggaaactgagggttcaaggggttaggtatgggacttgcccaaggtcataaaggtatgtggtagccagagtccctgttcggcacagacctgttctttgctgtcctggccagtgttccaggccttggggacatagctggggctgaagcagggctgtttctgccctcaggcagtttacatcctggcagaggggagagctgggcaacagtgagttgcacagacttgtcttattaccgctgtggtatgtgcaggaaggggaggtgctggttctgaggctccagagggcttgtctttttttttttttttttgagacggagtctcgctttgttgcccaggctagagtccagtggcgcgatctcggctcagtgcaagctccgcctcccgggttcaagcgattctcctgcctcagcctccccaatagctgggattacaggcgcatggcaccacgcacggctaattttggtatttttagtagagactgggtttcaccatgttagccaggatggtctcgatctcctgacctcgtgatccacccgcctcggcctcccaaagtgctgggattacgctcccggcctctttttttttttagacagagtctcactctgttgccaggctatagtacagtggcacgatctcagcttactgcaacctccgcctcccaggttcaagcgattgttctccctcagcctcccgagtagctgggactacaggcacacgcccagctaatttttgtatttttagtagagacagggtttcaccgtgttggtcaggctggtctcaaactcctcacctcgtgatctgcctgcctcggcctcccaaagtgctgggattataggcgtgagccactgcgcctggcctttttttttttttggtacagagtttcgctctggttgcccaggctggagtgcaatggcacgatcttggctcactgcagcctctgcctcccgggttcaagcgattctcctgcctcagcctccggagcagctgggattacagacatgcaccaccatgtccggctaatttttttttttcgagatggagtctcactgtgtcacccaggctggagtgcagtggcacaatctcggctcactgcaacctctgcctcccgggttcaagcgattctcctgcctcagcctcctgagtagctgggactacaggtgcctgccaccacacccagctaatttttgtacttttagtagagacggggttttaccatgttggccaggctggtcttgaacttctgacctcaggtgatccacccacctcggtctcccaaagtgctgggattacaggcgtgagccaccgtgcccggccgtggtgtcttgagctgagtgcagaagcgcaaatagggggtaggagaaaatgcaccgcgaggagaaatgtgctgcgggcctgctgtctagctgtgtcatttggtcgttgcggggccctgtgaggccgggagggctgccagcacccaccatgtgccaggcctcgttgctagtgctggggccagttcctgccccggtggagctgccactgaagggggaggcgtaataaacaagataggtgagtgcatatgcagcgtggtctgttgtgctgagggctgaagagaaaccagaagcagggctcagaggccaggaggactctgcaaagggatttggcattatcacagggtggccagggaagatcttcaaggtgacagtgagcagagggaggtgagggagcctgtgtggacttcaggactagagctccaggcagggcctgtttgaggaacatggaggaggcgagagcaaggagtagaggtcaaaaggaggcaagaagcaggggcgtaggcctaggaggacataggttcgctttggcttggactcagagaagggaaatccccagagggttttgagaagaggaggtacaggatgtaatggaggcttaataggaccctcttggctgctgagtcgagaacagactggagcaagcagggacagccaagcgaggggcgaggtgacagtgactatcaggtcaagggtggaagtagttgccaggggcaggaggcggattctggaccttggaggaggtaaagcccaccagaatgtgtcggtggcttggatgtggggtgtgagaggaaccagagattctgcctaggtttcttcttgggcaagtgaacacgtggagtccacgtaggctgtgttcggtccgagatgccttctagacatgcaggatgtcaaggaggcagctggagagatgggtctggagctcacagcaagtccaggctagaggtagaaacgtgagagccccacggctggggaagattgccatgggattggagatgagctccaaggacagccctggcagtctggatggaagagcttgggaagatgctcagaaaccacaaagtggctggtgcggtgggaggaaaaccagagtgtatgctgtcctagaagcaaaagaagaaagtgtttcagtgtttctaggagcaggaagtgatcaacagccttagatcctccttttaggccaagtaacatgaggactaagaattgaccactggatttagcaatgcagaggtccttgtggcccttgatgtcggcagatgagggcagtgtggtccagagatgaggcttggggctgagatgcagccccgctgcctggtccagctcctccctcatccaggcagggctcccccgcccagcagccactcccctccctgcctgctcatggccccctgctctccctttcctccccatacccccagacctgtgcttgcccggggagagtcagggctctcctgtcagctgggtcccctcccagccccgggaggccgccactggagccctgcctcttcctggcagggagcatcgagtacagctgtccggcctccaacgagtgtgagatcaccaagcggagacgcaaggcctgccaggcctgccgcttcaccaagtgcctgcgggtgggcatgctcaaggagggtgagcgctgggcaggggctgggcgagggctgggggagtcggggacccgggccaggtgggggtgaggcctgggagttctggtgagtggactcggggaggacagctctggagagcaagccccaccctgcccacagcaccacagtcacagtcctatctgtcccacaattcaaggagtgcgcctggaccgcgtccggggtgggcggcagaagtacaagcggcggccggaggtggacccactgcccttcccgggccccttccctgctgggcccctggcagtcgctggaggcccccggaagacaggtgagagcactgtgggtacctggggctacgaaaccggaggcctatgtgtggcatcatagttaccttgggcactgggacctgtatttccccttcgtctcttcactcactcatttccccaagacatgtgaaactgccttttcctgcatcaggaaaagtagtagaactgggaacagggacgattttccaacactcacagcctgtccacaaacacacgggctttccctgggagacagttagcgctcttccctggagggaagtcactggacagctgctactgaggaaggccacagggggagccactgtgggaagatgcttgacccctgaggcctgacagattcgagtgctcctgactcttgtcctctaattgtcacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggtaaagggcccaggtgacccggggctgccctgaacgggcccggctctggtgcgcttgctcagccaggcccgctccccgctgccccctaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactgggggctgccctgctgcaactagtgcggcggctgcaggccctgcggctggagcgagaggagtatgttctactaaaggccttggcccttgccaattcaggtgagtctggggcaggcactgacaggtgaggtgtctccgtaaggtcttcaggttaactcagtgacggtagcacagccccattttgcagataacgaaaactgaggcttagggaagaacaatgacttgctagaagtcaaaaagcaagccaagtgcaggctccaaactgcacacaggattttgagccctagtgccacactaatgcagaaaggtcatttagtgggagggaaggtggggagggtacaaggtggccacagttgagggagagagggtggggtcctggcccacgagccgcagcaatgagtggtgcctctcagtcagccaatcaacaaatcctcgtttggctcttccttaggccccatccagcagtgctcaagatacggggagtgcccttgccagagatagcccaggccaacaccacattcctctcttcttgcagactctgtgcacatcgaagatgccgaggctgtggagcagctgcgagaagctctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgccacagcctgctggcagggccagggcaatgccatcagcccctgggaacaggccccacgccctctcctccccctcctagggggtgtcagaagctgggaacgtgtgtccaggctctgggcacagtgctgccccttgcaagccataacgtgcccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtaggagagcactgcctctatgccctgcagagcaataacactatatttatttttgggtttggccagggaggcgcagggacatggggcaagccagggcccagagcccttgactgtacagagactctattttaatgtatatttgctgcaaagagaaaccgcttttggttttaaacctttaatgagaaaaaaatatataataccgagctc

(The sequence listing continues in the following parts.)

What is claimed is:

1. A method of determining gene expression levels in prostate tissue samples from subjects diagnosed as having prostate cancer, comprising the steps of:
   (a) assaying the relative content of malignant and non-malignant cells within each of two or more heterogeneous prostate tissue samples from subjects diagnosed as having prostate cancer, wherein at least two of the samples do not contain the same relative content of malignant and non-malignant cells, and wherein the assaying is done without physically separating the malignant from the non-malignant cells in the sample;
   (b) measuring the overall level of each of a plurality of different RNA expression analytes extracted from each prostate tissue sample without physically separating the malignant from the non-malignant cells in the sample, such that each measured level corresponds to the combined expression of an RNA expression analyte in malignant and nonmalignant cells;
   (c) determining a linear or non-linear regression relationship between the relative content of malignant and non-malignant cells in each sample and the measured overall levels of the plurality of different RNA analytes in each sample to provide a quantitative relationship therebetween;
   (d) using the regression relationship determined in step (c) to calculate the level of each of the plurality of different RNA expression analytes in the malignant cells and in the non-malignant cells separately, wherein the calculated levels of analytes correspond to the gene expression levels; and
   (e) outputting to a display information regarding the calculated levels of analytes.

2. The method of claim 1, further comprising a step of identifying genes differentially expressed in malignant cells relative to non-malignant cells, or in non-malignant cells relative to malignant cells.

3. The method of claim 1, wherein the step of determining the regression relationship further comprises determining the regression of overall levels of each RNA expression analyte on the proportion of malignant and non-malignant cells.

4. The method of claim 1, wherein step (c) comprises determining a linear regression relationship between the relative content of malignant and non-malignant cells in each sample and the measured overall levels of the plurality of different RNA analytes in each sample to provide a quantitative relationship therebetween, using Equation 1:

$$G_{jk} = \sum_j x_{ki} \beta_{ij} + \varepsilon_{jk}$$

assuming that the contribution to gene expression of any one cell type depends only on the proportion of that cell type and its corresponding characteristic cell-type expression level, $\beta_{ij}$, wherein $G_{jk}$ is the average expression level of gene j in a sample k, and is the average of $\beta_{ij}$ weighted by cell type fractions $x_{ki}$.

* * * * *